United States Patent 10,260,073 (ISOLATED POLYNUCLEOTIDES AND POLYPEPTIDES, AND METHODS OF USING SAME FOR INCREASING YIELD OF PLANTS) - sequence listing, part 2

SEQ ID NO: 2435 - DNA, 1199 bp, Helianthus annuus
ggatttggatggatataagagtcgaagatattagaaatctttggaagctctcttattggttcttcccatatttccaacttcagccatacacgtgtcacttctcacctcttctataaacttcccaatcatcaccaacagacaacaacacttgcatcttcctcttttcaagtttcaaccaccaaagaaatcctccatcaatggctgccgctgctagctccaccaccgtggtccaagccacacccttcttgggtcaaactagaccatctagcctcaaccccttaagagatatggtctctatgcctagtgccaaatacaccatgggaaatgacttgtggtatggacctgaccgtgtgaagtacttgggacccttctcggctcagaccccatcttacttgacgggtgaattcccgggtgactatggttgggacacagcaggtttgtcagctgatcccgaggcttttgccaagaatcgggctcttgaggtcatccatggacgatgggccatgcttggtgccctggggtgcatcacacccgaggtgcttgaaaagtgggtgaaagtggatttcaaggagccagtttggttcaaggccggcgcccagattttctctgaaggtggtctggactaccttgggaacccgaaccttgtccatgctcagagcatattggcagttctcgggttccaggtagtcctgatgggccttgttgaggggttccgtatcaacgggcttgagggggttggagatggtaacaatctgtatccaggtgggcaatattttgacccgttgggactagcggatgacccggtgacctttgcagagttgaaggtgaaagagatcaagaatggaagattggctatgttttccatgtttgggttctttgtgcaagcaatagtgacaggcaaaggcccattggagaaccttttggaccatttggacaaccctgtggctaacaatgcatgggtctacgccacaaagtttgtgcctggctcttagacttattagcctttgcattgttgttgtaacctcaagtttgtggtaaaaattgtgtagattattataagttagttatatatattatggtgtttatttggtcaatttcatgaattgaaataataaaaataaaaagcactggtgcgtggagcattcacatcctggaaatcaaaatctgtgtatgggttttttaaaatataaagagtataa

SEQ ID NO: 2436 - DNA, 930 bp, Helianthus annuus
cgggaatctctttcaagtttcaagctttaattaatggcatccatggctactagctcctccactgttgtcagagccacccctttcttgggtcaaactagagcctccaatgttaactcccttagagattctgtttccatggtcaatggcaagttcaccatgggaaatgagttgtggtatggaccggaccgagtgaagtacttgggacctttttcggcccaaacaccatcatacttgaccggtgaattcccgggtgactatggttgggacaccgccggtttatccgctgatcctgaggcttttgccaagaaccgggctcttgaggtgatccacgggagatgggcgatgctaggagcattcgggtgcatcacccccgaagtgctcgagaaatgggtgaaagtagatttcaaggagcccgtttggttcaaagccggagcccaaatcttctccgaaggcgggctagactatttgggcaacccaaacctagtccacgcccaaagcatattagcggtactcggtttccaagtggtcctaatgggcctagttgaagggttccgtattaacgggcttgagggtgttggagatggtaacaacctctacccgggtggtcaatactttgacccattgggccttgcggacgacccgattacttttgctgagttgaaggtgaaggaaatcaagaatggaagactagcaatgttttcaatgtttgggttctttgtgcaagcaattgtgacaggaaaaggaccattggagaaccttttggaccatttggataaccctgtggctaacaatgcttgggtctatgccaccaagtttgttcctggttcataaacattgtggctcgtgaattgttcttgtaaactatgacttggatgaaaaaaaaaattaattaactgtatgcagaaatatcaatgtggatgaacttttttt

SEQ ID NO: 2437 - DNA, 975 bp, Helianthus annuus
ttgaccatggaaacagaatctctttcaagtttcaagctttaattaatggcatccatggctactagctcctccactgttgtcagagccacccctttcttgggtcaaactagagcctccaatgttaactcccttagagattctgtttccatggtcaatggcaagttcaccatgggaaatgagttgtggtatggaccggaccgagtgaagtacttgggacctttttcggcccaaacaccatcatacttgaccggtgaattcccgggtgactatggttgggacaccgccggtttatccgctgatcccgaggcttttgccaagaaccgggctcttgaggtgatccacgggagatgggcaatgctaggagcattcgggtgcatcacccccgaagtgctcgagaaatgggtgaaagtagatttcaaggagcccgtttggttcaaagccggagcccaaatcttctccgaaggcgggctagactatttgggcaacccaaacctagtccacgcccaaagcatattagcggtactcggtttccaagtggtcctaatgggcctagttgaagggttccgtattaacgggcttgagggtgttggagatggtaacaacctctacccgggtggtcaatactttgacccgttgggccttgcggacgacccgattacttttgctgagttgaaggtgaaggaaatcaagaatggaagactagcaatgttttcaatgtttgggttctttgtgcaagcaattgtgacaggaaaaggaccattggagaaccttttggaccatttggataaccctgtggctaacaatgcttgggtctatgccaccaagtttgttcctggttcataaacattgtggcttgtgaattgttcttgtaaactatgacttggatgaaaaaaatttaattaactgtatgcagaaatatcaatgtggatgaactttttttaattatataaaatggtataaatttctattttaagc

SEQ ID NO: 2438 - DNA, 1040 bp, Tragopogon dubius
tcgaacatcacctatactttcctctcttgaatcatcagaaaccacctccatcaatggcggcagctgctagctccaccaccgtggtccgagccaccccattcttgggtcaaaccagaacctcgagtatcaatcctctaagagattttgtctccatgcccagtgccaaattcaccatgggaaatgacttgtggtatggacctgaccgtgtcaaatacttgggacccttttcagctcagaccccatcgtacttgaccggagaattccccggtgactacggttgggacaccgccggcttgtccgctgatcctgaagccttcgccaagaacagagctcttgaggttatccatggacgatgggccatgctcggtgcactcggttgcatcacgccggaggttcttgaaaagtgggtgaaagtggatttcaaggaaccagtttggttcaaggccggatcccagatcttctccgaaggtggtctggactacttagggaacccgaaccttgttcatgctcaaagcatactggcggtgctcggattccaggtgatcttgatgggtcttgtggaggggttccgcattaacggtcttgaaggggttggagacggtaacaacttgtaccccggcggccaatatttcgacccgttggggcttgcagatgacccggtgacatttgctgagttgaaggtgaaggagatcaagaatggaaggttggcaatgttttccatgtttgggttctttgtgcaagccatcgttacagggaaagggccattggagaacctgttggaccatttggacaaccctgtggctaacaatgcgtgggtgtatgccactaagtttgtgcctggttcatagactatgtaacttttctaattaatgtgcttgtaattgcgagtgtggggaagaacattgtagattattataatttaattatatacaatatggtgttaattatgaaggaaatcgcatctaaatatatacaaagttattctgtacaaacaaaaaacataaacaatttaagaaaacattaattatttctataaaaaa

SEQ ID NO: 2439 - DNA, 1081 bp, Gossypium hirsutum
tctgtcattttcctatccagctaaaatcaactgaatatatatatatttttaaaagggttgcccccttctaactctgaaaggcaatggcttcaatgcttagctcaggaaccgtccttaggccaaccccatttcttggccaaaacagaaatgctaaccctctcagagatgttgtctccgtgggcactgccaaatacacaatgggaaatgaactgtggtatggaccagacagagtgaagtacttgggacccttttcagctcagattccatcctacttgaacggcgagttccctggtgactacggatgggacactgccggtttgtcagctgaccctgaggcctttgctaggaacagggctcttgaggtaatccatggaagatgggcaatgctgggagcactaggctgcatcaccccagaagtccttgagaaatggcttagagttgacttcaaggaaccagtatggttcaaggcaggagctcaaattttctcagaaggtggcttggactacctaggcaaccccaaccttgttcatgctcaaagcattctcgctgtcctcgggttccaggttgtcctcatgggactagtcgaaggattccgcatcaatggtctccccggagtcggggaaggcaatgacctttaccctggtggccaatactttgaccctcttggtcttgctgatgaccctgtcacatttgctgaacttaaggttaaggaaatcaagaatggcaggctagccatgttctctatgtttggtttcttcgttcaagccattgtcacaggcaaaggtccactggaaaatctcttggaccaccttgacaaccctgttgccaacaatgcttgggtctatgctaccaagtttgtgcctggatcgtaaattaacagccccggatcgaacttgttccattatttgcttgtatctatcctctatgtacctgtagatttcgcatcactctgaaattttaaacctgtatcactaagaagtcaatgaaattcatgatcaagttcggtgtagggttccgtgatggctgggatttccattcatatgagaatgattaaccaaattttaattctgtcaaaaaagaa

SEQ ID NO: 2440 - DNA, 1211 bp, Lactuca sativa
tgcagatatacgaaatcttttgaagctttctcattggttcttcccaaatttcatgatcttaaccacacacctgtcacagttcactccctacagatacccccaccctcgcaaccttctccatcatctacaacaggcaacagcacctgtaccttcctctcttgaaccatcactcatcagaaaccacatccatcaatggctgcagctgctagctctaccaccgtggtccgagcgaccccattcttgggtcaaacaagaccatcgggtctcaactctctaagagatgttgtctccatgcccagtgccaaattcaccatgggaaacgacttgtggtacggacctgaccgagtcaagtatttgggacccttttccgctcagacaccatcgtacttgaccggcgaattccccggtgactacggttgggacaccgctggcctgtccgctgatcccgaggccttcgctaagaacagggctctagaggttatccatgggcgatgggccatgcttggtgcattcggatgtatcacgccggaggttctccaaaagtgggtgaaagttgatttcaaggagccagtctggttcaaggccggagcccagattttctccgaaggtggtctggactacttaggaaacccgaaccttgtccatgctcaaagcatactggcggtgctcggattccaggtggtgttgatgggtcttgttgaggggttccgcatcaacggtcttgaaggcgttggagacggtaacaacctttaccccggtggccaatattttgacccgttggggctcgcggatgacccggtgacatttgctgagttgaaggtgaaggagatcaagaatggaaggctcgcaatgttctccatgtttgggttttttgttcaagctattgttacagggaaggggccattggagaacctattggaccatttggacaatcctgtggctaacaatgcctgggtctatgccaccaagtttgcgccagggtcatagactatgtaacttttcccttgttcttgtaattgtaagtttggggagaaacatttgtagattataaaaatttaattatattccagatggtgtacatttatgaaagaaagagtatcttcatataaattaggaaaatcttcggtctttgtggttttcaaaaaaatcaattttgggttaacttttttgtaatttggtttgttaagtctaatcatgaaaataagccttca

SEQ ID NO: 2441 - DNA, 1160 bp, Papaver somniferum
taatccattcataaaaatctctttggtacaaattcctgagttctcaatcttaaattcctaattacaatcataatttacacaaattccccattcatttcattttaatcacagctttaaaacacaacttcaaaccaagtgctaagaactgccttagagttcagaaaaaaatacagtacttgaagaagaaaaatggcgtcaactttgatggcagctaactccactactgttcttagaacctccccatttttgggtcagaacagagtctctagtcctaattcccttagagatgtcgttgcgatgggtaatggaaaatacaccatggcaggaaatgatttgtggtacggaccagacagagttaagtacttgggtccattctctgctcaaactccatcatacctaaaaggagaatttcctggtgactatggatgggataccgctggattatctgctgatccagaggcctttgctaagaacagggctcttgaggtaattcacggaagatgggctatgttgggagcactgggatgcataaccccagaagtactagagaaatgggttaaggtcgattttaaggaacccgtatggttcaaagctggttcacaaatcttctcagaaggcggtcttgactacttgggaaacccaaaccttgtccatgcccagagtatcttggctgttctaggtttccaagtcctacttatgggtcttgttgaaggtttccgcattaacggattagacggagttggtgagggaaacaacttgtaccctggtggacctacttcgacccattgggacttgccgatgaccctgttacctttgctgaattgaaagtgaaggaaattaagaacggacgtcttgctatgttctctatgttcggcttctttgttcaagccattgttaccggaaaaggtcctcttgagaacctctttgatcaccttgacaaccccgttgctaacaatgcttgggtttacgcaaccaagtttgttcccggagcttagatagatgtcaaatttttcattattgctgtgctcccatttagctgtgattaaaatgaaatgaatggggaatttgtgtaaattatgattgtaattaggaatttaagattgagaactcaggaatttgtaccaaagagatttttatgaatggattacatttcttctcaa

SEQ ID NO: 2442 - DNA, 865 bp, Ambrosia trifida
aagcttcaattaatggcatccatggctactaactcctccactgttgtcagagccacccctttcttgggtcaaaccagagccaccaatgtcaactcccttagagattctgtttccatggtcaatggcaagttcaccatgggaaatgacttatggtatgggccagaccgagtgaagtacttgggacctttttcgtcccaaacaccatcatacttgaccggtgaattcccgggtgactatggctgggacaccgctgggttatctgctgatcccgaggcttttgccaagaaccgggctcttgaggtgatccatgggagatgggcaatgttaggagccttcgggtgcatcacccccgaagtcctcgaaaaatgggtaaaagtagatttcaaggagcctgtttggttcaaagccggagcccaaatcttttccgaaggcgggctagactatttaggcaacccaaacctagtccacgcccaaagcatattagcggtactcggtttccaagtagtcctaatgggcttggttgaagggttccgtattaacgggcttgagggtgtcggagatggtaacaacctctacccggggggggcaatactttgacccgttgggccttgcggacgacccgattacttttgctgagttgaaggtgaaggaatcaagaatggaagactagcaatgttttcaatgtttgggttttttgtacaagcaattgtgacagggaaaggcccattggagaaccttttggaccatttggacaaccctgtggctaacaatgcttgggtctatgccaccaagtttgtgcctggttcataaacattgtggcttttgaactgttcttgtaaacattggatgaaacaattaaataaaa

SEQ ID NO: 2443 - DNA, 960 bp, Ocimum basilicum
tcaatggctacattcgccagctcagcagccgccgtttaaggccaccccattcttaggccaaaccaagaatgccaaccctcttagagatgtagtctccatgggcaatgccaaatacaccatgggcaatgatttgtggtacggccccgaccgagttaagtatttgggacccttctcagctcagactccttcatacctcactggagaattccccggcgactacggctgggacaccgccggtctatctgccgacccagaggccttcgccaagaacagggctcttgaggtgattcacggaagatgggcgatgcttggagctctggggtgcatcacaccagaagtccttgaaaagtgggtgaacgtggacttcaaggagccggtgtggttcaaggccggtgcacagatcttcactgaaggtgggctcgactacttgggcaaccccaacttggtccacgctcagagcattcttgcggttcttgggttccaagttgtgctgatggggcttgttgaagggttcagaatcaacggccttgatggagtgggagagggcaacgacctctacccgggcggacagtactttgaccccctcggcttggctgatgacccggtcacctttgcggagttgaaggtgaaggagatcaagaatggaagattggcaatgttttcgatgtttggattctttgttcaagcgattgtgaccggaaaaggaccccttgagaacttgttggatcatcttgacaaccctgttgctaacaatgcttgggtttttgccaccaagttcaccctggatcgtaagatgggtggctacttgatttttagtggtgtgagagaatggatacgttgtgtacattaattatgttttgattgctaatattctcaactcatttagtgaaggaatccaccattactgagatgggtaaaaagagacttataggcctgcatttcgcccttgcttcattctat

SEQ ID NO: 2444 - DNA, 1219 bp, Primula obconica
gggattgtaacctctcttctttaagctttttttaaaacacaaggcaaaatcccaatggcatccatgagcacagtcctaagaccaaccccattcttgggccaagccaaaggaggcaatgccaacactctcagagatgttgttgccatgggtactagcaaattcaccatgagtaatgacttgtggtatggacccgatagagtgaagtacttgggaccgttttcggctcaaactccgtcatatttgactggagaattccccggtgattatggatgggacactgctggtttgtcccgctgatccagaggcttttgccaaaaacagggctcttgaggtcattcatggaagatgggcaatgcttggagccctaggatgcatcacccccgaagtcctcgaaaaatgggtgaaagtggacttcaaagagccagtttggttcaaagccggagcccaaatcttctcagaaggtgggctcgactacctaggcaaccccaacctcgtacacgcccagagcattttagcagttttgggcttccaagtgatcttaatgggcctcgtcgagggattccgcattaatgggctgccaggtgtcggcgatggaaacaacttatatccaggtggacaatacttcgacccgttgggcttggccgatgacccggttacgttttctgaactcaaggtgaaagagattaagaacgggaggctagctatgttctctatgtttgggttctttgtccaagctattgtgaccggaaaaggcccactcgagaacctattggatcacctagacagtccagtggctaacaatgcttgggtctacgccaccaagtttgtacccggatcgtaaattcatcagatgttatttttattttttgtgtggtgaaagaatgggtattaattgaatgtgtacattttaacggttttcgctgctttattttttgttacaattcaacagattgtgaaaccaacgtatggattgttgtggaaattgtcataataagtatgtatttgggagagaattgtctttgaattaaaagagttgggaatggatagtgatttggatgtgtagtgctaaatgactgggatggaaaatctgttgtgtgaaaaaacgcattcaatttagagattagttctcaaactcattgtactttggttggtgggtattcgaatccagaggtgcttaggttgaagttaatagaaaaaagggcaaattaaactgcgtgat

SEQ ID NO: 2445 - DNA, 1489 bp, Theobroma cacao
acgttctttagaattgttctcatgtgaaacactgcctgcggggatagctcagttgggagagcgtcagactgaagatctgaaggtcgcgtgttcgatccacgctcaccgcatttgtattgatttttattttttatttttaccaatattttgccaaaacgttttaccaatggttttttgcaactcatttattgcgtaagccacgtgtccagactctctctcccttgagataataaatgtggatagaaggatatgagttggagatgcttcaaatcctttgcagccctttgattggcttatttttgagcctccaaatccccaccacaagtccttgcctcttcctttcttaaccacccatcttttgattcttccatttctctttcttctcttctccacatatatagctttcacttccctttccatacatacatttcccagctgatttgaactgattaaactgcccctcttgactccaagacacaatggcttccatgcttagctctggaactgtccttaggccaaccccatttcttggccaaaacagaacctctaatgctaaccctctcagagatgttgtctctacaggcactggcaaatacacaatgggaaatgatctgtggtatggaccagacagagtgaagtacttgggacccttttcagctcagactccatcatacttgactggagagttccctggtgactatggatgggacacagctggtttatcagctgaccctgaggcctttgccaggaacagggctcttgaggtgatccatggaagatgggcaatgttgggagcactaggctgcatcaccccagaagtccttcagaaatggcttcgtgtgaacttcaaggaaccagtatggttcaaagctggagctcagattttctcagaaggtggcttggactacctaggcaaccccaacctggttcatgctcaaagcatcctcgccatcctcggcttccaagtcgtcctcatgggtctggttgaaggattccgcatcaacggtctccctggtgttggagaaggcaatgacctttaccctggtggccgatacttcgaccctcttggccttgctgatgaccctgtaacatttgctgaactcaaggtgaaagaaatcaagaacggcaggctagccatgttctccatgttcggtttcttcgtccaagccattgttaccggaaaaggtcccctggagaacctgtttgaccaccttgacaaccctgttgccaacaatgcttgggtctatgctaccaagtttgtgcctggatcgtaaatcaataatacccagatcaaacttgttctgtgtttgcttgtgtggattagaagggagatgtatctattgttcgacaatgtgaaacctctgtatcactgagattcaatgtaatttagggaaaaggcatatgaacatttctcatttcatctgtattcaaggaactacatagtttggaccttacatcactggaaacagaatatacacaaactaaaccg

SEQ ID NO: 2446 - DNA, 941 bp, Cicer arietinum
tttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaaccagtttggttcaaagcaggatcccagatattcacagaaggtggacttgactatctaggaaacccaaaccttgtacatgcacaaagcattttagcagtactaggtttccaagttgttctgatgggacttgtggaaggtttcagaatcaatggtctacctggtgttggtgaaggtaacaatctttaccctggtgggcaatactttgatccacttggtcttgctgatgatcctgtcacatttgctgaacttaaggttaaggaaattaagaatggaaggttggctatgttttctatgtttggtttctttgttcaagctattgttactgggaaaggtcctttggagaatcttttggatcatattgataatcctgttgctaataatgcttgggtttatgctaccaagtttgtgcctggttcttaaacattatcacattcatgtatctttatcattcaattttaatttctgtgaattatgtatgagacatggaaattattatgtgtagattatgaatatcttaataataatattgttgta

SEQ ID NO: 2447 - DNA, 907 bp, Ambrosia trifida
tacaccttttcttctacaattctcttttctaagttaatttttaagcttccatacatggcatccatggctgctaactcatccactgttgtcagagccacccctttcttgggtcaaacaagaacctcaaatgtcaactcccttagagattctgtttccatggtcaatggcaagttcaccatgggaaatgacttgtggtatggaccggaccgagtgaagtacttgggacctttttcggcccaaacaccatcatacctaactggtgaattcccgggtgactatggatgggacactgctggtttatctgctgatcccgaggcttttgccaagaaccgggctcttgaggtgatccatgggagatgggcaatgttaggagcattcgggtgcatcacacccgaagtcctcgaaaaatggctaaaagtggattttaaggagcccgtttggttcaaagccggagcccaaatcttctccgaaggcgggctagactatttaggcaacccaaacctagtccacgcccaaagcatattagcggtgctcggttttcaagtggtactaatgggcctggtcgaaggcttccgtattaatgggcttgagggtatcggagatggcaacaacctctacccaggaggccaatactttgacccgttgggccttgcggacgacccgattacttttgctgagttgaaggtgaaggaaatcaagaatggaagactagcaatgttttcaatgtttgggttttttgtacaagcaattgtgacaggaaaaggcccattggagaaccttttggaccatttggacaacccggtggctaacaatgcttgggtctatgccaccaagtttgtgcctggttcataaacattgtggctattgaactgttcttgtaaacattggatgaacaaattaaataaaa

SEQ ID NO: 2448 - DNA, 993 bp, Antirrhinum majus
  misc_feature (254)..(254): n is a, c, g, or t
  misc_feature (432)..(432): n is a, c, g, or t
attttagcagagtatagagagagagagagagaaagggatcaattttgaacaaatcttgaaagtagaaaatggcatcaatggctgctactgcaagctccacaactgttgtaagggcaacaccattcttgggccaaaccaagactgccaatccccttagagatgttgtctccatgggaaatggcaaatacaccatgggtaatgatttgtggtatggacccgaccgtgtcaaatacttgggtcctttctcagctcanactccatcatacttgactggagaattccccggcgattatggttgggacactgccggtctttcagctgatcccgaggcctttgctaagaacagggctcttgaggttattcacgggaggtgggcaatgcttggagcttttggatgcatcacccctgaagttcttcagaaatgggtgagcntccagttcaaggagccagtttggttcaaggctggagcccaaattttctcagagggcgggctcgactacttgggcaaccccaatcttgtgcatgctcaaagcattcttgcagttctcggattccaagtcgtgctcatgggacttgttgaaggatttagaattaatggccttgatggagttggtgagggcaacgacctctaccctggtggccaatactttgacccccttggcttagccgatgacccagtcacttttgccgagctcaaggtgaaggaaatcaagaacggaagattagccatgttctcaatgttcggtttctttgtacaggctattgtcacaggcaaaggccccctcgagaacttgttggaccaccttgacaaccctgtggctaacaatgcttgggtgtacgccaccaagtttgtccctggatcataagctcaatggcttagtccaagtgttgtgtgaatttgtgcagattattaatatatttacttgatgggaaactggtgtatcgattgcataacagttgataatatcctgaactcctgattttccagttgcg

SEQ ID NO: 2449 - DNA, 887 bp, Arnica chamissonis
atcaatggcatccatggctgctaactccaccaatgttgtcagagccacccctttcttgggtcagaccaaagcctccaatgtcaactcccttagagattctgtctccatggtcaacggcaagttcaccatgggaaacgacttgtggtatggaccggaccgagttaagtacttgggacccttttcggcccagacaccatcatatttaaccggtgaattccccggtgactatggctgggacactgctggtttatctgctgatcctgaggcttttgccaagaaccgggctcttgaggtaattcacgggagatgggcgatgctaggagcattcgggtgcatcaccccagaggtcttggagaaatgggtgaaagtggatttcaaggagcccatttggttcaaagccggatcccaaatcttctccgaaggcgggctagactatttgggcaacccaaacctagtccacgcccaaagcatattagcggtactcggttttcaagtggtcctcatgggcttggttgaagggttccgtattaatgggcttgagggcgtcggagatggtaacaacctctacccgggtggtcaatactttgacccgttggggcttgcggatgacccgactacttttgctgagttgaaggtgaaggaaatcaagaatgggagactagcaatgttttcaatgtttgggttttttgtgcaagcaattgtgacagggaaaggaccgttggagaatcttttggaccatttggacaaccctgtggctaacaatgcatgggtctatgccaccaaatttgtgcctggttcataaaatttatggctttgtaactgttgtaaattatggcttggatgagaaaattaattgaaatattattgttagattgatttagcaaatt

SEQ ID NO: 2450 - DNA, 1027 bp, Trifolium pratense
gagtaaactaaggtttcaactcaacaagaggaagcacttgaaagctttggaacaagtcatggcattgatggcagcaagctcagcaactgttgttaagcaaacccctttccttggtcaaaggaagggtgccaattctcttagagatgttgtcgccatgggaacttcaaaattcactatgggaaatgaattgtggtatggaccagacagagtgaaatatttgggaccgttttcagctcagactccttcatacttaaccggagaattccccggtgattatggatgggacactgctggattatctgctgacccagaagcatttgccaagaacagggctcttgaggtgattcatggaagatgggctatgctaggagcactaggatgcatcacaccagaagtacttgaaaaatgggtgagagttgacttcaaagaaccagtttggttcaaagcaggatcacaaatattctcagaaggtggacttgactacttaggaaacccaaaccttgttcatgcacaaagcatcttagcagtactaggtttccaagttgttctaatgggacttgtcgaaggattccgcatcaacggtcttcctggtgttggagatggcaacaatctttaccctggtggccaatactttgaccctcttggtcttgctgacgatcccgttactttcgccgaacttaaagtgaaggaaatcaagaatggaagattggctatgttttcaatgtttggtttctttgttcaagctattgttactggtaaaggacctttggagaatcttttggatcaccttgataaccctgttgctaacaatgcttgggtttatgctaccaagtttgtacctggtgcttaaacattaatgttatctatgattgcctttgtgtgaatgatgagacatggcatttatgtgtagattatgatcttaatgagtattggattagtgtacttgtttttggttcttaaggaccaaggttcattttaaacatgaaagatctcttgttaatatattttgtgcatgttattgatttga

SEQ ID NO: 2451 - DNA, 910 bp, Flaveria ramosissima
ggctgctaactccaccactgttgttagagccacccctttcttaggtcaaaccagaggctccaatgtcaacgcccttagagattctgtctccatggtcaatggcaaatacaccatgggaaatgacttgtggtatggaccggaccgagtgaagtacttgggacccttttcggcccagacaccatcgtacctgaccggtgaattccctggtgattatggttgggacaccgctggtttatctgctgatcccgaggcttttgccaagaaccgggctctcgaggtgatccacgggagatgggccatgttaggagcattcgggtgcatcactcccgaagtcctagaaaaatgggtgaaagtagatttcaaggagcccgtctggttcaaagccggagcccaaatcttctccgaaggcgggctagactatttgggcaacccgaacctggtccacgcccaaagcatactagcagtactcggtttccaagtggtcctaatgggcctcgtggaagggtttcgcattaacgggctcgagggtgtaggtgaaggtaacaacctatacccgggtggccagtactttgacccgttgggccttgcggatgacccggtcactttcgccgagctaaaagtgaaggaaatcaagaatgggagactagcaatgttttcaatgtttgggttctttgtgcaagcaattgtaacaggaaaaggaccattggagaaccttttggaccatttggataaccctgtggctaacaatgcatgggtctatgccactaagtttgttcctggttcataaactatgtggcttcttaattgttattgtaaattataagttggatgataaaattgaataaaattatcgttatatgattgtattgttatatgttggttgtatgttggtaaagaagatacaaatacg

SEQ ID NO: 2452 - DNA, 799 bp, Flaveria ramosissima
ggctgcagctgctagctccaccgtggtccaagccaccccgttcttgggtcaaaccagaccatctagcctcaaccccttaagagatatggtctctatgccaagtgcaaaatataccatgggaaatgacttgtggtacggacctgaccgtgttaagtacttgggacccttttcggctcagaccccatcgtacttgactggtgaattccccggtgactacggttgggacactgccggtttgtccgctgatcccgaggctttcgccaagaacagggctcttgaggttatccatggacggtgggccatgcttggagcactcgggtgcatcacacccgaggtccttgaaaagtgggtgaaagtggatttcaaggagcccgtctggttcaaggccggagcccaaatattctcagaaggtggtttggactacctagggaacccgaaccttgtccatgctcagagcatattggcagttctcgggttccaggtggtcctaatgggccttgttgaagggttccgtattaacgggcttgaaggggttggagatggtaacaatttgtatccgggcgggcaatactttgacccattgggccttgcggacgacccggtgaccttcgccgagttgaaggtgaaagagatcaagaatggtagattggctatgttttcgatgtttgggttcttcgtgcaagcaatagtgaccggcaaaggcccgttggagaacttgttggaccatttggacaaccctgtggctaacaatgcatgggtttatgccactaagtttgtgcctggctcttagaccttttag

SEQ ID NO: 2453 - DNA, 952 bp, Lactuca sativa
gcaacagcacctgtaccttcctctcttgaaccatcactcatcagaaaccacatccatcaatggctgcagctgctagctctaccaccgtggtccgagccaccccattcttgggtcaaaccagaccatcgcgtctcaactctctaagagatgttgtctccatgcccagtgccaaattcaccatgggaaacgacttgtggtacggacctgaccgagtcaagtacttgggacccttttccgctcagaccccatcgtacttgaccggcgaattccccggtgactacggttgggacaccgccggcttgtccgctgatcccgaggccttcgctaagaacagggctctagaggttatccatgggcgatgggccatgcttggtgcattcggatgtatcacgccggaggttctccaaaagtgggtgaaagttgatttcaaggagccagtctggttcaaggccggagcccagattttctccgaaggtggtctggactacttaggaaacccgaaccttgtccatgctcaaagcatactggcggtgctcggattccaggtggtgttgatgggtcttgttgaggggttccgcatcaacggtcttgaaggcgttggagacggtaacaacctttaccccggtggccaatattttgacccgttggggctcgcggatgacccggtgacatttgctgagttgaaggtgaaggagatcaagaacggaaggctcgcaatgttctccatgtttgggttttttgttcaagctattgttacagggaaggggccattggagaacctattggaccatttggacaatcctgtggctaacaatgcctgggtctatgccaccaagtttgcgccagggtcatagactatgtaacttttcccttgttcttgtaattgtaagtttggggagaaacatttgtagattataaaaatttaattatattccagatggtgtacatttat

SEQ ID NO: 2454 - DNA, 916 bp, Lactuca sativa
gccaaaacacctgtaccttcctctcttgaaccatcactcatcagaagccacctccacaatggctgcagctgctagctctaccaccgtggtccgagccaccccattcttgggtcaaaccagatcatctagtctaaaccctctaagagatgttgtttccatgccaagtgccaaattcaccatgggaaacgacttgtggtacggacctgaccgagtcaagtacttgggacccttttccgctcagaccccatcgtacttgaccggagaattccccggtgactacggttgggacaccgccggtttgtctgctgatcccgaggccttcgctaagaacagggctcttgaggttatccatgggcgatgggccatgcttggtgcattcggttgcatcacgccggaggttctccaaaagtgggtgaaagttgatttcaaggaggcagtctggttcaaggccggagcccagatcttctccgaaggtggtctggactacttagggaaccccaaccttgtccatgctcaaagcatactagcggtgctcggattccaggtggtgttgatgggtcttgttgaggggttccgcatcaacggtcttgaaggggttggagacggtaacaacctttacccgggtggccaatattttgacccgttggggcttgcagatgacccggtgacatttgcggagttgaaggtgaaggagatcaagaacggaaggctcgcaatgttctccatgtttgggttcttcgtgcaagccattgttacagggaagggaccattggagaacctgttggaccatttggacgatcctgtggctaacaatgcctgggtgtatgccaccaagtttgtgccagggtcatagactatgcaacttttcccttgttcttgtaattgtgagtttgaagagaaacatttgtagattata

SEQ ID NO: 2455 - DNA, 913 bp, Olea europaea
catcaatggctaccactgccagttccaccgctgttgttagggcaactccattcttgggccaaaccaagaatgccaagtcttttaaagatgttgtctctatgggaaatggcaaatacaccatgggtaatgacttatggtatggaccggaccgtgtcaagtacttggggccattctctgctcaaactccatcgtacttgaccggaaaattcccgggtgattatggttgggacactgctggtttatctgctgatcctgaggcctttgcaaaaaacagggctcttgaggttattcacgggcgatgggcaatgcttggagctctgggatgcatcaccccagaagttcttgagaaatgggttaaagtatactttaaagagccagtttggttcaaggctggagctcaaatcttctctgaaggtggactagattacctgggcaatcccaatcttgtacatgcacaaagcattttggcagttcttggattccaagtagttctcatgggacttgttgaaggatttagaattaacggcttagaaggcgttggagagggtaacaacctttaccctggtggccaatactttgatcctcttggccttgctgatgaccccgtcactttcgctgagctcaaagtgaaggaaataaagaacggaaggctagccatgttctccatgttcgggttctttgttcaggctattgtcactggaaaaggccctctggagaatctgttggaccaccttggtaaccctgttgctaacaatgcttgggtctatgctaccaagttcgcgccaggatcataaacctagtttcatttgttcgatcaagtgttaagagaatgcatgtgttgggttcgaaccctggaccttttggtcatattgcttccacagttcttttaaaggcaaaaacgtgttcaatgtag

SEQ ID NO: 2456 - DNA, 983 bp, Lippia dulcis
ctccaaactccaccaccaaaaccactcatcaaaggcatctccatcatcatcaatggctgcagctgccagctccaccgctgttcttggggcaagaccatttctgggcaaaaccaagaatgcgaatccgcttagagacgccgtcccgatgggaaatgcaaaattcgccatgagtaatgatttgtggtatggacctgaccgtgtgaagtacttgggacccttctcggctcagactccgtcgtacctgaccggagaattccccggcgactacggctgggacactgctggtttgtctgctgatcctgaggcctttgccagaaacagggctcttgaggtcatccacgggaggtgggccatgctcggagctctgggatgcataacccccgaagttctcgaaaaatggctgaaagttgacttcaaggagccagtctggttcaaggccggtgcccaaatcttctcagagggtggtctggactacttgggcaaccccaacctagtccacgctcaaagcattcttgcagttctcggattccaagttgtgctcatgggactcgttgaaggattcagaatcaacggtctggatggagttggagagggcaacgacctctacccaggtggccagtactttgacccccttggtttggctgatgaccccgtcacttttgctgagctcaaagtcaaggaaatcaagaatgggaggttagctatgttctccatgtttggattctttgttcaagctatagttactggaaaaggcccgttggagaatctcttggaccatcttgacaacccggttgctaacaatgcatgggtctatgccaccaagtttgtacctggatcataagatgttgtgtagatgatgtgtacatgcttggaactaatgtattaattcattgcaatggaagttgataatatgtatgaatatctttatgttctcacctgatttaaatcaaactacaaatacgacaaaaaagaattacgttact

SEQ ID NO: 2457 - DNA, 1073 bp, Populus trichocarpa
actcgttcttttgattctcatgctttccttcacatataagcttaacacttccctttcgacgcccttccagtgtacatttctctcctcttcaagagacatcaacaagttttaacctaagaaaacactgctgaacgtatttgcaagacaatggcatcgcttgctagctccagcaccattgttagaccaaccccgtttcttggcaaaaggggttcaaatgctaaccctcttagagatgttgtctccatgggaaatggcaaatacatcatgagcaatgagttgtggtatggacctgacagggtgaagtacttgggaccattttcagctcagactccttcatacctgactggagaattcccaggtgactatggatgggacactgctggtttatcagctgatcctgaggcctttgctaagaacagggctcttgaggtgatccatggcagatgggctatgcttggagcactaggctgcatcaccccagaggtccttgagaaatgggttaaagtagacttcaaggaaccagtgtggttcaaagctggagctcaaatcttctcagaaggtggcttggactacttgggcaaccccaaccttgtccatgcccaaagcatccttgctgtccttggattccaagttgtcctcatgggccttgttgagggattccgcatcaatggtctccccggagtaggagagggtaatgacctttaccctggtggccaatacttcgaccctctcggcctggccgatgatccagctacattcgccgagctcaaggtgaaggaaatcaagaatggacggctagccatgttctccatgtttggattctttgttcaggctattgttactggaaaaggtcccctggagaatctcttggaccacctggacaaccctgttgctaacaacgcttgggtctacgccaccaagtttgtgcctgggtcataaattaacatttaatttcttggattagaatggaaagaccttgcctgaattgtcatggttcctgtatttctagattaaagacttcgtatcgttgagatccaaagtaaattgtataacctgttttattgtgtgatcca

SEQ ID NO: 2458 - DNA, 1100 bp, Primula obconica
cggccgaaaatagattgcaaccttagagtattttattctctaagcttgtaacaaaacacaaaggcaaatttaggcaatggcatcaatgagcactgtcctgagacccaccccttttcttggtcaaaccaagggagcaaatgccaactctctcagggatgttgttgccatgggtactggcaaatacaccatgggaaatgacttgtggtatggaccggagagagtgaagtacttgggaccgttctcggcccagacgccttcctacctcaccggagagtttcctggtgattacggatgggacactgctggattatccgccgatcccgaggcttttgccaaaaatagggctcttgaggtgattcacggaagatgggccatgcttggagccctaggctgcatcacccccgaagtcctcgaaaaatgggtgaaagtggacttcaaagaacccgtttggttcaaagccggatcccaaatcttctccgaaggtgggctcgactacttaggtaacccaaacctagtccacgcccagagcattttagcagttttgggcttccaagtgattttaatgggcctcgtggagggctttcgcattaacgggctgccaggtgtcggcgacggaaacaacctctatccgggtggggaatattttgacccgttgggtttggccgatgacccggttacttttgctgagttaaaggtgaaggagattaaaaatgggagactagctatgttctcaatgtttggtttctttgttcaagctattgtcactggtaaaggccctcttgagaacctattggaccaccttgataatcctgtggctaacaatgcttgggtttatgctaccaagtttgttcctgggtcgtaattttatgtgattaattgattgttttgtgttggaatgatggataaaaagctgggggtgttttgtgtacatttttctttttcttcgattgtatagttttatcagatgttgatgttgggcttgagagagattgtgcaactccacacatttcaaaaccctgcgaaggctatcaggtttatttgaaaaatggtgtaacatccacaaacacaagaactgttaccagaaaggttgagattttacc

SEQ ID NO: 2459 - DNA, 1075 bp, Scabiosa columbaria
tgaccacatatcctttgcttctcagtgcctacacatacacttgacttcaccaagaaactttcaacttgcagtgtgttctcatacaatttttaaagagaaaatttaaggagataacaagaaaaaatgtcaatggctgcaagttctagcactgttgttagagcaactccatttttggggggaactagatcttatgttaacccacttagagatgttgtggctatggggacttccagattgaccatggggaatgatttatggtatggaccggaccgtgttaagtacttgggaccattttcagctcagactccatcctacttgaccggagaattccctggtgactatggttgggacaccgctggcttgtctgctgaccccgaggcctttgccaagaacagagctcttgaggttatccatgggagatgggcgatgcttggagcactaggatgcatcttcccggaagtcctcgagaaatgggtcaaagttgacttcaaagaacccgtctggttcaaagccggagctcaaattttcagcgaaggtggactcgactatttaggaaaccctaatctcgtccacgcccaaagcattttagccgttcttggattccaagttgttctaatgggactagttgaaggtttccgtatcaatggtcttgatggagttggtgaaggcaacaatctctaccctggtgggacctactttgacccactcggcttggctgatgatcctgtcacctttgctgagctcaaagtgaaagaaatcaagaacggaagattggctatgttctcaatgttcggtttctttattcaagccattgttactggcaaaggaccacttgagaacctattggaccaccttgataaccccgttgccaataacgcttgggtatatgccaccaagtttgtgccaggggcgtaattggtactatgtgttaaagctcattttcgctcatttatgtttgttttagttgtggaactccatgtacattgacactcgtgtttaaaagtatccaatgctgttatcaatcaaactaaaactatgtcatttggttattgactacgttagaacattgtcctgc

SEQ ID NO: 2460 - DNA, 983 bp, Scabiosa columbaria
ttgtcttccccaagaaactttcaacttgcagtgtgctttcatagattctatctacttttcaaatagaaaatttatacacccttcttcaagaagataacaagaaacaatgtcaatggctgcaagttctagcactgttcttagagccaccccttttttgggccaaaccagagcaaatgctaaccctcttagagattttgtccctatgggcccttcaaagttgaccatggggaatgatttatggtatggaccagaccgtgttaagtacttgggaccgttttcagctcagactccatcgtacttgaacggagaattcccaggtgactacggttgggacaccgccggcttatctgctgatcccgaggcttttgccaagaacagagctcttgaggttatccatggaagatgggcgatgcttggagcactaggatgcatcttccctgaagtcctcgaaaaatgggtcaaagttgacttcaaagaacctgtctggttcaaagctggagctcaaatcttcagcgaaggtggactcgactatttaggaaaccctaatctcgtccacgcccaaagcattcttgcagttcttggattccaagttgttctaatgggactagtcgaaggttttcgcatcaatggtcttgacggagttggtgagggcaacaatctttacccgggtgggacctacttcgatccacttggcctagccgatgatcctgtgacatttgccgagctaaaagtgaaggaaatcaagaatggaagattggctatgttctctatgtttggtttctttatccaagctatcgttactggcaaaggaccgcttgagaaccttttggatcaccttgataaccctgttgccaataacgcttgggtatatgctactaagtttgtgccaggggcgtaaatcgtgttgtgattaaggctcatttgctcacttttatgtttgttttagttgatgtgagaatgtacattaacaatcatcatgttag

SEQ ID NO: 2461 - DNA, 1166 bp, Elaeis guineensis
cttccctacataccccccgttccctccttccactccacgctccctctccaccccagagagaactacaaacacaccacgatcaactcctaaatcaaccaagaggacacccgtatatgcagatggcggcgacactaacagcagcctccgctcgcaccaccaccatcgtcggcccgacgcctttcctcggccagacccgggcctcaacttccaaccctctgagagatgtcgtctccatgggcaatggaaagttcaccatggggaacgagctttggtacgggccagaccgcgtcaagtacttgggacccttctcggctcaaaccccctcctacctcaccggggaattccccggcgactacggatgggacaccgctggcctgtctgcggaccctgaagccttcgcaaggaaccgagccctcgaggtgatccacgggcggtgggcgatgctgggtgcgctcggttgcatcacccccgaagtcctggagaaatgggtgagggtggatttcaaggagcctgtctggttcaaagctggagctcagatcttcaccgaaggcgggctcgactacctcggcaatcccaacttggtccacgcacagagcatactggcagtcctggggttccaagtagtcctcatgggcctcgtcgaagggtaccgcatcaatggcctgcccggagtcggggaaggcaacgacctctaccctggcggcacctacttcgaccccctcggcctcgccgacgaccccaccacattcgccgagctgaaggtgaaggagatcaagaacgggaggctggcgatgttctccatgttcggattctttgttcaggcgattgtcactgggaagggcccgctcgagaacctcttggaccatctcgacaaccctgtcgccaacaatgcctgggtctacgccaccaagtttgtgccgggctcttaagtctcgcatttcggaagaatctgggaagctgttgtagattacttttaagtaggatgttgagactgcatcaatctgagtcaaccagttggatggcaatgtatgattcataagatttgggatgatttctctttaatttctaatgtttgttgatcgaccaaaaaaaaaaaaacaaaaaactagaagacgtcgaccgaaggaccacgaacggaagggggtaagtagggcgacccccccccc

SEQ ID NO: 2462 - DNA, 1149 bp, Lactuca sativa
tatatttccaagtgttctgattggtgcaaatgaaattgcttatttgtcaaaaaaccacaatgcaatattagccacaagtctctaattcccgatgcctacacatacctcctctttctacaccttcttcctcagtcgatctcattgaagctcccatcaatggcatccatggctgcaactgcttctagctcctcaactgtggtccgagccacccctttcttgggtcaaaccaaaggatccaatgccaacacccttagagattctgtctccatggtcaatggcaaattcaccatgggaaatgacttgtggtatggaccagaccgtgtgaagtacttgggcccattttcggctcaaacaccatcctacctgaccggtgaattcccaggcgactatggttgggatacagctggtttgtctgctgatcccgaggcattcgctaaaaaccgggctcttgaggtgatccacgggcgatgggcaatgctcggagcactgggctccatcacgcccgaagtccttgcaaaatgggtcaaagtggatttcaaggagcccgtttggttcaaagccggatcccaaatcttctcagaaggtgggctagactacttgggcaaccctaacctggtccacgcacaaagcatactagcagtactcggttttcaagtggtcctaatgggcctagtcgaagggttccgtatcaacgggctcgatggtgttggagatggtaacaacttgtacccgggtggtcagtattttgacccgttgggacttgctgacgacccggttacctttgccgagttgaaagtgaaggaaatcaagaatggaagactagcaatgttttcaatgtttgggttttttgttcaagcaattgtaacagggaaaggaccattggagaaccttttggaccatttggatgaccctgtggctaacaatgcatgggtctatgccaccaagttcgcccctggttcataagtttttgtggctccttgagttttcttgtaaacttatcagtttgatgaagaaaatatgtatattatcgttgtttatgttgagatttgttgacacacatgaaatgagtgttttgtcacaaaacatgattgttctatactaattaaatgcgttataaaattgtttattgagataaaaaaaatattagag

SEQ ID NO: 2463 - DNA, 1131 bp, Aquilegia formosa
aaaatatagtctttactttatattgcaccttccttccaccacatttgacatctccaaacaatactaactgaatattcaaagttcaaacactcagcagagatggttgcaacactgatggcagcatcacccacttccagcactgttcttaaagcatctccctttttaggccaaacccgaagctccaatgccaactcattgcgcaatgttgtcgcaatggggactgcaaaaatctctatgagtaatgatttatggtatggaccagacagggttaaatatttgggaccattttctgcccagaccccttcataccttactggtgaattccccggtgattatggatgggacactgctggattatctgctgacccagaggcattcgccaagaatcgggctcttgaggtgattcacgggcggtgggcaatgcttggtgctttcggctgcatcaccccagaagtgcttgaaaagtgggttaaagtagacttcaaagaaccagtttggttcaaagctggagctcagatcttctctgaaggaggactagactacttaggcaaccccaaccttgtccatgcccagagtattttagcagtactaggcttccaagtcctactaatgggcgctgttgaaggatttcgtatcaacggtcttgatggagtaggagagggtaacgacctctaccctggtggcacctactttgaccctctaggtcttgccgatgaccccgtcacatttgctgagctcaaggtgaaagagatcaagaatggtcgcctcgctatgttctccatgtttggattctttgtacaagctattgttactggcaaggggccacttgaaaacctcttggatcatctcgacaaccctgtcgctaacaatgcctgggtctatgccactaaatttgtgcctgggtcgtaaatgcagcaaattatctcattccactttttgtgagaatgccccaaaactcagcaagttggaagaatgtgcagattgtaatagttactaccatttgaaaagtggagattgattgtttcagaatgattgaatgtatagtaagatagtgttaactgctccataaaaagattttaacgtacagccaccattaaggaagaaggttgatcatacctaattcaaatcttt

SEQ ID NO: 2464 - DNA, 1069 bp, Vigna unguiculata
  misc_feature (227)..(227): n is a, c, g, or t
tgaagaaaaaagtactcggaagccatggcagcaacattaatggcagcctcagcaagcaccggcactgtccttaaaccaacacctttccttggccaaagtagagcaaccaatgccaaccctcttagagattttgtctccatgggacatgggaaatacaccatgggaaatgaactgtggtatggaccagacagagtgaaatacttgggacccttttcagctcagactcnttcatatttgacaggagaattcccaggggactatggatgggacactgctggattgtctgctgatcctgaagcatttgccaagaacagggctcttgaggtgatccatgggcgttgggccatgcttggagcactaggatgcatcactccagaagtgcttgagaagtgggtgagagtggatttcaaggagccagtttggttcaaagcaggagcacaaatattctcagaaggaggcctagactatctggggaaccctaaccttgtgcatgcacagagcattttggcagtgctagggttccaagttgtgctgatgggtcttgttgaagggtttcgcatcaatgggcttcctggtgtgggagagggcaatgatctgtaccctggtggccaatactttgaccctcttggacttgctgatgatcctgtggcttttgctgagcttaaggttaaggagataaagaatggaaggttggccatgttctccatgtttgggttctttgtgcaagccattgtcactgggaaaggacctcttgagaaccttttggatcaccttgacaaccctgtggctaacaatgcttgggtctatgccaccaagtttgtgcctggctcttagattgctttttcctttgtttggttttatatgaatgacatgatgtggaagtttccttgtagattagtacactttttatggttcattttttaacccttttgttcattcatttgaataaatgaatgagatgacacatcgatcttaaatcaacatagaaagtgattttttataatctgtaacaaacttggaattggaaaaaagaatgccaaagtgcatctgcatcagctagttttgaaca

SEQ ID NO: 2465 - DNA, 1100 bp, Platanus occidentalis
accggaaaggcaatagatatggtggccacgctaatggcagcatccgccaactccagcactgtccttagacaaacagagacaactgatcactcaaactcaccggtttctcgccagcaactcggccgaccggaaaggcaatagatatggtggccacgctaatggcagcatccgccaactccagcactgtccttagaccaaccccatttttgggccaaaaccgggtgtccagcactaacccacttaggaatgtggtttctatgggcactgggaaattcactatggggaatgatttatggtatgggccagaccgtgtgaagtacctgggccccttctctgctcagaccccttcataccttactggagaatttcccggtgactatggatgggacactgccgggttatcggctgacccagaggcctttgccaagaacagagctcttgaggtgatccacggccgatgggcaatgctcggggcactcggttgcatcaccccagaagtacttgagaaatgggttaatgtggacttcaaggaaccagtgtggttcaaagctggagctcagatcttctctgaaggcgggctcgactacttgggcaaccccaaccttgtccacgcccagagcatcctggcagtgctaggcttccaggttgtactcatgggacttgtcgaaggcttccgcatcaatggccttccaggtgttggtgagggtaacaacctctatcccggtggaacctactttgatcccctgggacttgctgatgatcctgtcacctttgccgaactcaaggtgaaggagatcaagaatggccggctcgccatgttctccatgttcggattctttgtacaggccattgtcactggcaagggtcctcttgaaaacctcttggatcaccttgacaaccctgttgctaacaatgcatgggtctatgccaccaagttcgtgccagggtcgtaaatttcagttcctttgctcccattttttttgagaaaatgaattaagatgacactagattgaatgtatcttgtaacattgcatatgctgatgataatcacattttgtacttatcagatggttatctgttattctaaaattaagattgtt

SEQ ID NO: 2466 - DNA, 941 bp, Taraxacum officinale
caccaccgcttaccttcctctcttcctctcttgaaccattagaagccacatccatcatggccgcagctgctagctccaccaccgtggtccgagccaccccattcttgggtcaaaccagaacatcgagcctaaaccctctaagagatgttgtctccatgcccagtgcaaaatacaccatgggaaatgacttgtggtacggacctgaccgtgtcaagtacttgggaccattttcggctcagaccccatcatacttgaccggcgaattcccgggtgactacggttgggacacagccggattgtctgctgatcccgaggccttcgccaagaacagggctcttgaggttatccatggtcgatgggccatgcttggagcatttggatgcatcacacctgaggtactcgaaaagtgggtgaaagtagatttcaaggagccagtctggttcaaggccggatcccagatcttctccgaaggtggtctggactacttaggaaacccgaacctagtccatgctcaaagcatactagcggttcttggattccaagtggtgttgatgggtcttgttgaggggttccgtatcaacggtcttgaaggggttggagaaggtaacaacttgtacccgggtgggcagtattttgacccgttgggtcttgcagatgacccggtgacatttgctgagttgaaggtgaaggaaatcaagaattgaaggttagcgatgttctccatgtttggattctttgtgcaagctattgttaccgggaagggacctctggagaaccttttggaccatttggataatcctgtggctaacaatgcgtgggtctatgccaccaagtttgtgcctgggtcatagagactatgtaacaatttcatcgtttttgtaattgtgaatgtgaagagaaacgcttgtatattatcataattgaattataatattatatat

SEQ ID NO: 2467 - DNA, 2266 bp, Brassica rapa
caatatcccatatctgattctcccgtgtcttctcatccacaaaacactcactttaaaactcaaactcccttagatcaattctccaccaaacagcaaagaagaagaacaacaccacagagagaaaacaaacgttcaaaatcctagagagactcaatggcttcaacattcatgagctcaagcagtgttttgaccccaacaccatttcttggacagactaaaggctccaccttcaaccctcttcgtgatgctgtctctctcggatctcccaagtacactatgggaaatgatctttggtacggaccagacagagttaagtacctaggaccgttttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttaggcaacccaaaccttgtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgacccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttaatttttttaagtcttaaaatgtaatcctttgaaatgatatgaacataacctttcttgttcctctgcaaattacaacactctatttgctatgcacataaaaaaaaagagttccaaaacaaatacatgtatctcagctgaatctacaatgatctggtgattgtgttttactaatacaacaaacaaaccctaagcgagtggtggaaaaccccttagcctcttttgccccaccatttccgatgacgacctttatcactatggagtcttgctttagtctctcttaatctagctttgtaatctttcttccatgtctcaaatcttagcttcaatctcttgaactcatcttctggatgttgctgcccgtttggagttgcctgcggtccacctttcacctccacaatagctctagcatcttcgtcgaaattgagtctcctttgatcaaactctcttgctagatgattaaccgcgttcaaacttccgttgagttccctgattctgagttctggagtgttcccgttgctgaacttagttgtgggagttctcactccgggagttccagtagacattgtgtcctccgagtcatagccgaaaggtgacatcgatgcgtcttgtcttcctcctgcttgacctgtattgttttctgtagctagactctttcgagcagcagcaagactcatctgagagaaaaaggaaacatttcttaatctttattttatgtttgtgtcttgaatcagtcaaggatgaggaactaacctgcaacgatgacatttgtttttgccaagtgtcctccatcgacttcatctttatttcatactctgaccatctctcctcaaattgtctcaactgatctctcaatgctgtgttttcttcttccttctgcactaaagcttcttcagatttcaaaacccgcttctggagatcagacatagctgattgttgaacttggaaccgctctaccggcaaatcctacatcacaaacgagagagtgttatagtgtttgattcagaagtgtacaatttttcttttgatagtaagtaccttgtcttctgaaaccctcctgcctcctttcctctttgatttagtcgtcacatcgacaagttctttctgtctttgcatactgttgaatcttttccgagacaaccatccacggaccgctgcaagagagataaaagaatgatgagcattaagatccatatattccacattggataacctaaatttttagttcagcaaataagataccagattgcaagtttatgactgcagtcaactctcctgcactagcttcagaaacagacaccgcatggatctttgcttta

SEQ ID NO: 2468 - DNA, 978 bp, Musa acuminata
attcctttccatccatctctcggctcttgagctctaccagcagcagacatggcgtcctccactgttgttactccgacccggttcctcggccaaacccggacttcaacaagcgccaaccctctcagggatgtcgtcgccatgggaagaggaaggatcaccatggggaatgaactgtggtacggaccagaccgcgtcaagtacttgggacccttctcagctcagacgccgtcctacctcaggggcgagttccccggcgactacggttgggacaccgccgggctctccgccgaccccgaagcctttgcgaggaacagagctctggaggtgatccatggcaggtgggcgatgctgggggcgctgggctgcatcaccccggaggtcctggagaagtggctgaaggtggacttcaaggagcccgtgtggttcaaagcaggggcgcagatcttctcggaaggcgggctcgactacctcggcaaccccaacctcgttcacgcccagagcatactggcagtgctggggttccaggtcgtgctcatgggcttggtggagggtttccgcatcaacggactcgccggagtcggggagggcaacgacctgtaccccggcggcacctacttcgaccccctcggcctcgccgacgaccccgtcaccttcgccgagctcaaggtgaaggagatcaagaacgggaggctggcgatgttctccatgtttgggttcttcgtgcaggcgatcgtgacggggaaggggccgctggagaacctcttggatcacctcgacaaccctgtcacaaacaatgcctgggtttatgccaccaagttcgtgccaggctcctaaatctccctcgccatcgtttgcaagaacaagagaaatgtgcatgctgcatgcttgctgtatgtaggagaagctattgattgctgtgtattgctgctacatttaggatgttctctaatcatacctctcaattctctcgttctctgc

SEQ ID NO: 2469 - DNA, 960 bp, Antirrhinum majus
  misc_feature (46)..(46): n is a, c, g, or t
  misc_feature (52)..(52): n is a, c, g, or t
  misc_feature (62)..(62): n is a, c, g, or t
  misc_feature (120)..(120): n is a, c, g, or t
  misc_feature (752)..(752): n is a, c, g, or t
  misc_feature (782)..(782): n is a, c, g, or t
cggcacgagaaactttttgaaataactctcaatagcaaatttgaanagaggnaattaattanatggcatcaatggctgcaactgccagctccaccacagttgttaaggccaccccattcntgggccaaaccaaaaatgccaaccctcttagagatgttgtctccatgggaaatggcaaatacgccatgagcaatgacttgtggtatggccctgaccgtgtaaagtacttgggacccttctcagctcagactccatcatacttgaccggagaattccccggtgattacggttgggacaccgctggcctttctgctgatcctgaggcctttgccaagaacagagctcttgaggttatccacggacgatgggccatgcttggagctttcggatgcatcaccccagaagttctcgagaaatgggtgagcgtcgacttcaaagagccagtgtggttcaaggccggcgcccaaatcttctccgaaggtggattggactacttaggcaaccccaatcttgtgcatgctcaaagcatccttgcggttcttggcttccaagttttgctcatgggacttgtcgaaggattcagaatcaacggtttggatggagttggcgagggcaacgatctttacccgggtggccaatacttcgacccccttggactagccgatgaccccgtgactttcgccgagctcaaggtgaaggagataaagaatggaaggttggctatgttttctatgttcggattctttgttcangctattgtgacaggaaaaggtccccttganaacttgttggaccaccttgacaaccctgttgcaaataatgcctgggtctatgccactaagtttgtccctggatcataagcacaaagtgtacatgattcaagtgttgtatgatttgaagtgcataattttgtgtaaatttgtcatattttcttgctttagaactgatgtatctttgttc

SEQ ID NO: 2470 - DNA, 982 bp, Brassica juncea
gaacaagaaaggttatgttcatatcatttcaaaggattacattttaagacttaaaaaaatcaagcaccaggtacaaacagcaaagaagaagaacaacaccacagagagaaaacaaacgttcaaaatcctagagagactcaatggcttcaacattcatgagctcaagcagtgttttgaccccaacaccatttcttggacagactaaaggctccaccttcaaccctcttcgtgatgctgtctctctcggatctcccaagtacactatgggaaatgatctttggtacggaccagacagagttaagtacctaggaccgttttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttgggcaacccaaacctagtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgacccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttgatttttttaagtcttaaaatgtaatcctttgaaatgatatgaaca

SEQ ID NO: 2471 - DNA, 910 bp, Brassica juncea
gaaaacagcaaagaagaagaacaacaccacagagagaaaacaaacgttcaaaatcctagagagactcaatggcttcaacattcatgagctcaagcagtgttttgaccccaacaccatttcttggacagactaaaggctccaccttcaaccctcttcgtgatgctgtctctctcggatctcccaagtacactatgggaaatgatctttggtacggaccagacagagttaagtacctaggaccgttttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttgggcaacccaaacctagtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgacccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttgatttttttaagtcttaaaatgtaatcctttgaaatgatatgaaca

SEQ ID NO: 2472 - DNA, 905 bp, Brassica oleracea
gaccaaaccagcaaagaagaagaacgacaccacagagagaaaacaaacgctcaaaatcctagagagactcaatggcttcaacattcatgagctcaagcagtgttctgaccccaacaccatttcttggacagactaaaggctccaccttcaaccctcttcgtgatgctgtctctctcggatctcccaagtatactatggggaatgatctttggtacggaccagacagagttaagtacttaggaccgttttccgtccaaaccccgtcttacctcaccggagagtttcccggagactatggttgggacaccgctggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttaggcaacccaaacctagtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgatccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttgatttttttaagtcttaaaatgtaatcctttgaaatga

SEQ ID NO: 2473 - DNA, 965 bp, Brassica rapa
cacaaaacactcactttaaaactcaaactcccttagatcaattctccaccaaacagcaaagaagaagaacaacaccacagagagaaaacaaacgttcaaaatcctagagagactcaatggcttcaacattcatgagctcaagcagtgttttgaccccaacaccatttcttggacagactaaaggctccaccttcaaccctcttcgtgatgctgtctctctcggatctcccaagtacactatgggaaatgatctttggtacggaccagacagagttaagtacctaggaccgttttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttaggcaacccaaaccttgtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgacccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttaatttttttaagtcttaaaatgtaatcctttgaaatgatatgaacataacctt

SEQ ID NO: 2474 - DNA, 865 bp, Brassica napus
aaaatcctagagagactcaatggcttcaacattcatgagctcaagcagtgttttgaccccaacaccatttcttggacagactaaaggctccaccttcaaccctcttcgtgatgctgtctctctcggatctcccaagtacactatgggaaatgatctttggtacggaccagacagagttaagtacctaggaccgttttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttgggcaacccaaacctagtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgacccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttgatttcttttaagtcttaatgtaatgctttgaaatgatatgaacataacc

SEQ ID NO: 2475 - DNA, 1060 bp, Brassica napus
taggcaactgcttgtttctgtagttgttactggtttaacatctctctagtaacttattttgtttcttgaagaagaagaacaacaccacagagagaaaacaaacgttcaaaatcctagagagactcaatggcttcaacattcatgagctcaagcagtgttttgaccccaacaccatttcttggacagactaaaggctccaccttcaaccctcttcgtgatgctgtctctctcggatctcccaagtacactatgggaaatgatctttggtacggaccagacagagttaagtacctaggaccgttttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttaggcaatccaaacctagtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgatccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttaatttttttaagtcttaaaatgtaatcctttgaaatgatatgaacataacctttcttgttcctcttgacaaaaaaaaaaaaactgagactagcctaaggacactaccaaggggtagttaagggtatagatcacgaaat

SEQ ID NO: 2476 - DNA, 1021 bp, Chelidonium majus
gaaaaccagtgggaagagtaaaacatggtggcaactctaatggcagcatcagctagctccagcactgttctaagaccatcccaattcttgggccaaaacagggcctctagctctaactctcttagagatgttgttgctatgggaactggaaagtacaccatgagtaatgatctgtggtatggtcccgaccgagttaagtacttgggcccattctctgctcaaactccctcgtaccttactggagaatttcccggtgactacggatgggacaccgccggattatctgctgatccagaggcttttgctaggaacagggctcttgaggtgatccacggaagatgggctatgttaggggcacttggatgcataaccccagaagtcctacaaaaatgggttaaggtagacttcaaggaagcagtatggttcaaagctggatcacagatcttctctgaaggaggtcttgattacttgggcaacccaaacttggtccatgcacagagcatcttggctgttttaggtttccaagtcttactaatgggtctcgttgagggcttccgtatcaacggattagacggagtcggtgacggtaacaacttgtaccctggtggcacttacttcgacccactaggccttgccgatgacccagttacctttgctgagttgaaggtgaaagagatcaagaacggtcgtcttgctatgttttcaatgttcgggttcttcgttcaggccattgttactggaaagggtcccctcgagaacctgtttgatcaccttgacgaccctgttgctaacaacgcctgggtctatgccaccaagtttgttccaggatcttaagttcatgatctaatttcattattggttcccttcattgtaactttgtttcttatgattcatgaaaagcaaagcaaaatatgggaaattgagtttgtaaattatgtttgtcaaagagttaaagattgagaattcgagactcatgatctgtacctaaaagaattttattgaacattaatttttcttcttc

SEQ ID NO: 2477 - DNA, 986 bp, Cicer arietinum
gattagcgtggtcgcggccgaggtgagtaaactaagttttcaactcaacaagaacaaatcatggcattgatggcagcaacagcaagctcagcaactgttgttaaacaatctcctttccttggacaaaggaaaggtgccagtgccaatcctcttagagatgttgtctccatgggaacttctaaattcaccatgggaaatgaattgtggtatggaccagacagagtgaaatatttaggacccttttcagctcagacaccttcatacttaactggagaattcccaggagattatggatgggacactgctggtttatctgctgatcctgaagcatttgccaagaacagggctcttgaggtgatccatggaagatgggcaatgctaggagcactaggttgcataacaccagaagtgttagaaaaatgggtgagagttgacttcaaagaaccagtttggttcaaagcaggatcccagatattcacagaaggtggacttgactatttaggaaacccaaaccttgtacatgcacaaagcattttagcagtactaggtttccaagttgttctgatgggacttgtggaaggtttcagaatcaatggtctacctggtgttggtgaaggtaacaatctttaccctggtgggcaatactttgatccacttggtcttgctgatgatcctgtcacatttgctgaacttaaggttaaggaaattaagaatggaaggttggctatgttttctatgtttggtttctttgttcaagctattgttactgggaaaggtcctttggagaatcttttggatcatattgataatcctgttgctaataatgcttgggtttatgctaccaagtttgtgcctggttcttaaacattatcacattcatgtatctttatcattcaattttaatttctgtgaattatgtatgagacatggaaattattatgtgtagattatgaatatcttaataataatattgttgtattagttca

SEQ ID NO: 2478 - DNA, 1098 bp, Solanum melongena
ctattcaacaaaacacaaaatatctcgaaccacaatttccatatgtgcaatattagccatccacctaagattctcactttctctatacaaataagaaccaactccctcttgatttgccaagcacaaaatataacaaaaatcaacttaaagaattttgaagaaaatggcatcaatggcagcaacagccagctcctccacagttgttagagcaactccatttttgggccaaaccaggagcgtgaaccctcttagagatcttcctgtgggcaatggcagatatgccatgagtaatgatttgtggtatggacccgatcgtgtcaagtacttgggacccttttctgctcaaactccttcatacttgaccggagaattccctggtgattacggatgggacactgctggtttatctgctgatcctgaagcctttgccaagaacagagctcttgaggttatccatgggaggtgggcaatgcttggtgcactaggatgcattttcccagaagttcttgaaaaatgggtgaaagtggacttcaaagaaccagtatggttcaaagcaggagcacaaatcttcagtgacggcggacttgactacttgggcaaccctaaccttgtccatgctcagagtattctagctgtgctaggtttccaagttgtgcttatgggacttgttgaaggttttagaatcaatggacttcctggagtaggagaaggcaacgatttataccctggtggtcaatattttgacccactcggtctagctgatgaccctgccacatttgctgagcttaaggtgaaggagatcaagaatggaagactcgcaatgttctccatgtttggattcttcgttcaagctattgttaccgggaaaggtcctcttgagaacctgttagatcaccttgataaccctgttgctaacaatgcttgggtttatgccactaagtttgttcctggatcttaagataacttatgttccaattcttcaacaagtactttgtgtaactgaacccttcagaaatgcaaatatgttgtagatgaaatcattgtgttttagttattctttggtcacagtactttatttttagacaatcaacttgttta

SEQ ID NO: 2479 - DNA, 947 bp, Flaveria ramosissima
tgtcaacaattgcatcttccacttaaatcttaatttacaaccatcacaacaaaccaccatcaatggctgcagctgctagctccaccgtggtccacgccacaccattcttgggtcaaaccagaccatctagccttaaccccttaagagatatggtctctatgcccagtgcaaaatacaccatgggaaatgacttgtggtatggacctgaccgtgttaagtacttgggacccttttcggctcagaccccatcatacttgaccggtgaattccctggtgactacggttgggatactgcgggtttgtctgctgatcccgaggccttcgccaagaacagggctcttgaggttatccatggccgatgggccatgcttggagccctcgggtgcatcacacccgaggtccttgaaaagtgggtgaaagtggatttcaaggagccagtctggttcaaggctggagcccagattttctcagaaggcggtttggactacctcgggaacccgaaccttgtccatgctcagagcatattggcagttctcgggttccaggtggtcctaatgggcctcgttgaggggttccgtattaacgggcttgaaggggttggagatggtaacaatttgtatccgggcgggcaatacttcgacccgttggggcttgcggatgacccagtgaccttcgccgagttgaaggtgaaagagatcaagaacggtagattggctatgttttcgatgttcggcttctttgtgcaagcaatagttacaggcaaaggcccgttggagaacctgttggaccatttagacaaccctgtggctaacaatgcatgggtttatgccactaagtttgtgcctggctcttagagtttttagcctttctactgtacttgtaaccgcaagtttgggaagaaaaatgtgtagattatcataattagttctatataatatggtgtttat

SEQ ID NO: 2480 - DNA, 929 bp, Flaveria ramosissima
aatatggggatcactaacaacaattgcatcttccacttgatttacaatcaccacaacaaaccaccgtcaatggctgcagctgctagctccaccgtggtccaagccacaccattcttgggtcaaaccagaccatctagccttaaccccttaagagatatggtctctatgcccagtgcaaaatacaccatgggaaatgacttgtggtatggacctgaccgtgttaagtacttgggacccttttcggctcagaccccatcttacttgaccggtgaattccctggtgactacggttgggacactgcgggtttgtccgctgatcccgaggccttcgccaagaatagggctcttgaggttatccatggccgatgggccatgcttggagcactcgggtgcatcacacccgaggtccttgaaaagtgggtgaaagtggatttcaaggagccggtttggttcaaggccggagcccaaatattctcagaaggcggtttggactacctcgggaacccgaaccttgtccatgctcagagcatattggcagttctcgggttccaggtggtcctaatgggtctcgttgaggggttccgtattaacgggcttgaaggggttggagatggtaacaatttgtatccgggcgggcaatactttgacccgttgggccttgcggatgacccggtgacctttgccgagttgaaggtgaaagagatcaagaacggtagattggctatgttttcgatgttcgggttctttgtgcaagcgatagtgaccggcaaaggcccgttggagaacctgttggaccatttggacaaccctgtggctaacaatgcatgggtctatgccaccaagtttgtgcctggctcttagactttttagcctcttgtaaccgcaagtttggggagaaaaatgtgtagattattataattagttctata

SEQ ID NO: 2481 - DNA, 981 bp, Flaveria ramosissima
atcttccactttacaaccaccacaacaaacaaccatcaatggctgcagctgctagctccaccgtggtccaagccacaccgttcttgggtcaaaccagaccatctagccttaaccccttaagagatatggtctctatgcccagtgcaaaatacaccatgggaaatgacttgtggtatggacctgaccgtgttaagtacttgggacccttttcggctcagaccccatcatacttgactggtgaattccccggtgactacggttgggacactgccggtttgtccgctgatcccgaggctttcgccaagaacagggctcttgaggttattcatggccgatgggccatgcttggagcactcgggtgcatcacacccgaggtccttgaaaagtgggtgaaagtggatttcaaggagccagtctggttcaaggccggggcccaaattttctcagaaggcggtttggactacctcgggaacccgaaccttgtccatgctcagagcatattggcagttctcgggttccaggtggtcctaatgggccttgttgaggggttccgtattaacgggcttgaaggggttggtgatggtaacaatttgtatcctggtgggcaatactttgacccgttgggccttgcggacgacccggtgaccttcgccgagttgaaggtgaaagagatcaagaacggtagattggctatgttttcgatgtttgggttctttgtgcaagcaatagttacaggcaaaggcccgttggagaacctgttggaccatttggacaaccctgtggctaacaatgcatgggtttatgccactaagtttgtgcctggctcttagactttttagcctttccattgttcttgtaaccgcaagtttggggagaaaaatgtgtagattattataattagttctatataatatggtgtttatatgatggtcttgtttatatgttgaactcatgtgaaaagaaaaacattaatagctaaaa

SEQ ID NO: 2482 - DNA, 926 bp, Flaveria ramosissima
tcactaacaacaattgcatctttcacttaatttacaaccacaataacaaaacaccatctatggctgcagctgctagctccaccgtggtccaagccacccccttcttgggtcaaaccagaccatctagccttaaccccttaagagatatggtctctatgcccagtgcaaaatacaccatgggaaatgacttgtggtatggacctgaccgtgttaagtacttgggacccttttcggctcaaaccccatcatacttgactggtgaattccctggtgactatggttgggacactgctggtttgtccgctgatcccgaggctttcgccaagaacagggctcttgaggtgatccatggccgatgggccatgctaggagcactcgggtgcatcacacccgaggtccttgaaaagtgggtgaaagtggacttcaaggagcctgtttggttcaaggccggagcccagatattctcagaaggtggtttggactaccttgggaacccgaaccttgtccatgctcagagcatattggcagttctcggattccaggtggtcctaatgggccttgttgaggggttccgtattaacgggcttgaaggggttggagatggtaacaatttgtatccgggcgggcaatacttcgacccattgggccttgcggatgacccggtgacctttgccgagttgaaggtgaaagagatcaagaacggtagattagctatgttttcgatgttcgggttctttgtgcaagcaatcgtgaccggcaaaggcccgttggagaacctgttggaccatttggacaaccctgtggctaacaatgcttgggtctatgccaccaagtttgtgcctggctcctagactttttaccctcttgtaaccgcaagtttgggaagaaaaatgtgtagattattataattagttctatataatatg

SEQ ID NO: 2483 - DNA, 1112 bp, Flaveria ramosissima
tcaccaacaacaattgcatctttcacttaatttacaaccaccacaacaaacaaccatctatggctgcagctgctagctccaccgtggtccaagccacccctttcttgggtcaaaccagaccatctagccttaaccccttaagagatatggtctctatgcccagtgcaaaatacaccatgggaaatgacttgtggtacggacctgaccgtgttaagtacttgggacccttttcggctcagaccccatcatacttgactggtgaattccctggtgactacggttgggacactgctggtttgtccgctgatcccgaggctttcgccaagaatagggctcttgaggtgatccatggccgatgggccatgctaggagcactcgggtgtatcacacccgaggtccttgaaaagtgggtgaaagtggatttcaaggagcccgtttggttcaaggccggagcccagatattctcagaaggcggtttggactatcttgggaacccaaaccttgtccatgctcaaagcatattggcagttctcgggttccaggtggtcctaatgggcctcgttgaggggttccgtattaacgggcttgaaggggttggagatggtaacaatttgtatccgggcgggcaatacttcgacccattgggccttgcggatgaccctgtgacctttgccgagttgaaggtgaaagagatcaagaacggtagattagctatgttttcgatgttcgggttctttgtgcaagcaatcgtgaccggcaaaggcccgttggagaacctgttggaccatttggacaaccctgtggctaacaatgcttgggtctatgccaccaagtttgtgcctggctcctagactttttaccctcttgtaaccgcaagtttgggaagaaaaatgtggtgtttattagatggtcttgtttatatgttgaactcacgtgaaagaaaaatattaatagttagaattatgatttagaaaaacgttcaactagatttaaactcaaaaaagagcatttgcttaaactatggatatttatgatctgagcttgagcccacgtcaggacggtttgagcttgaaaataccagagcaatcccggctcaatatactctacttagc

SEQ ID NO: 2484 - DNA, 975 bp, Flaveria ramosissima
catctttcacttaatttacaaccaccacaacaaaccaccatctatggctgcagctgctagctccaccgtggtccaagccacccctttcttgggtcaaaccagaccatctagccttaaccccttaagagatatggtctctatgcccagtgcaaaatacaccatgggaaatgacttgtggtatggacctgaccgtgttaagtacttgggacccttttcggctcaaaccccatcatacttgactggtgaatttcctggtgactacggttgggacactgctggtttgtccgctgatcccgaggctttcgccaagaacagggctcttgaggtgatccatggccgatgggccatgctaggagcactcgggtgcatcacacccgaggtccttgaaaagtgggtgaaagtggatttcaaggagcccgtttggttcaaagccggagcccagatattctcagaaggcggtttggactatcttgggaacccgaaccttgtccatgctcaaagcatattggcggttctcgggttccaggtggtcctaatgggcctcgttgaggggttccgtattaacgggcttgaaggggttggagatgggaacaatttgtatccgggcgggcaatacttcgacccattgggccttgcggatgacccggtgacctttgccgagttgaaggtgaaagagatcaagaacggtagattagctatgttttcgatgttcgggttctttgtgcaagcaatcgtgaccggcaaaggcccgttggagaacctgttggaccatttggacaaccctgtggctaacaatgcttgggtctatgccaccaagtttgtgcctggctcttagactttttaccatcttgtaaccgcaagtttgggaagaaaaatgtgtagattattataattagttctatataatatggtgtttattagataggtcttgtttatatgttgaactcacgtgaaagaaaaatattagtagttaag

SEQ ID NO: 2485 - DNA, 1041 bp, Pisum sativum
tcaactcaacaacaagaagaaaatcatggcattgatggcagctacagcaagctcagcaactgttgttaagcaaactcctttccttggtcaaaggaagagtgccaatcctcttagagatgttgttgccatgggaacttccaaattcaccatgggaaatgatttgtggtatggaccagacagagtgaaatatttaggaccattttcagctcagactccttcatacttgactggagaattccctggtgattatggatgggacactgctggtttatctgctgatccagaagcatttgccaagaaccgggctcttgaggtgatccatggaagatgggctatgctaggagcactaggatgcataacaccagaagtacttcaaaaatgggttagagttgacttcaaagaaccagtttggttcaaagcaggatcacagattttctcagaaggtggactagactatttaggaaaccctaaccttgttcatgcacaaagtatcttagcagtactaggtttccaaattgttctaatgggactcgtcgaaggttttcgcatcaacggacttcccgatgtcggagaaggcaatgatctttaccctggtgggcaatactttgatcctcttggtcttgccgacgatccggttactttcgccgagcttaaagtgaaggagatcaagaatgggagattggctatgttctctatgtttggtttctttgttcaagctattgtgactggtaaaggacctttggagaatctgttggatcaccttgataaccctgttgctaacaatgcttgggtttatgctacaaagtttgtgcctggtgcttaaacatttgatgttatctatgattgcatttgtgtgaaggatgagacttggcattattgtataaattatgatgttgatggttgttggattagtgcacttgtttgtttcttggttcttaaggactaaggttcattttaaagatgggagatcttttgttaatatgttttgttcaaaccaaccaatgagaaaagttatgtcaacatgatttgcttaaaccaaat

SEQ ID NO: 2486 - DNA, 1049 bp, Capsicum annuum
taaaaattaagtgtaagaaaatggcatcaatggcagcaacagctagctccaccacagttgttagagcaactccattcttgggtcaaaccaagaatactaaccctcttagagatgttgttcccatgggctctggcaaatttaccatgagtaatgatttgtggtatggaccagaccgtgtcaagtacttgggacccttttctgctcaaactccttcatacttgaccggagaattccctggtgattacggatgggacactgctggtttatctgctgatcccgaggcctttgccaagaacagagctcttgaggttatccatgggagatgggcaatgcttggtgctctaggttgcattaccccagaagttcttgaaaaatgggtgaaggtggacttcaaagaaccagtatggttcaaagcaggatcacaaatcttcagtgacggtggacttgactacttgggcaaccccaaccttgtccatgctcagagtatcctagctgtgctaggtttccaagtggtgcttatgggacttgttgaaggtttcagaattaatggacttcccggagttggagaaggcaacgatttataccctggcggccaatactttgacccactcggcttagctgatgaccctacaacatttgcagaactcaaggtgaaggagatcaagaacggaagattggcgatgttctccatgttcggattcttcgttcaagctattgtcaccggcaaaggccctcttgagaacctattggaccaccttgacaaccctgttgctaataatgcttgggtttatgccactaaatttgttcctggatcttaagatttatgtttcaattcttctaaagtacttttgtgtaactgaaccattgagaaatgcaaatatgctgtagatgaaataattttgagttgagtcgtattctttgagagtaacattttacactgtcaacttgtttaaatggtcttctagattctcaattactctttttaatgggaatgaaaaaatagtgtcatgtatcaaattgatatgaataaatgaatgcactctaactag

SEQ ID NO: 2487 - DNA, 937 bp, Capsicum annuum
gcacgaggccagcacagaatattaaaaattaagtgtaagaaaatggcatcaatggcagcaacagctagctccaccacagttgttagagcaactccattcttgggtcaaaccaagaatactaaccctcttagagatgttgttcccatgggctctggcaaatttaccatgagtaatgatttgtggtatggaccagaccgtgtcaagtacttgggacccttttctgctcaaactccttcatacttgaccggagaattccctggtgattacggatgggacactgctggtttatctgctgatcccgaggcctttgccaagaacagagctcttgaggttatccatgggagatgggcaatgcttggtgctctaggttgcattaccccagaagttcttgaaaaatgggtgaaggtggacttcaaagaaccagtatggttcaaagcaggatcacaaatcttcagtgacggtggacttgactacttgggcaaccccaaccttgtccatgctcagagtatcctagctgtgctaggtttccaagtggtgcttatgggacttgttgaaggtttcagaattaatggacttcccggagttggagaaggcaacgatttataccctggcggccaatactttgacccactcggcttagctgatgaccctacaacatttgcagaactcaaggtgaaggagatcaagaacggaagattggcgatgttctccatgttcggattcttcgttcaagctattgtcaccggcaaaggccctcttgagaacctattggaccaccttgacaaccctgttgctaataatgcttgggtttatgccactaaatttgttcctggatcttaagatttatgtttcaattcttctaaagtacttttgtgtaactgaaccattgagaaatgcaaatatgctgtagatgaaataattttgagttgagtcgtat

SEQ ID NO: 2488 - DNA, 914 bp, Solanum tuberosum
caaaatatatttactttgagaggttgaagaaaatggcatcaatggcagcaacagcaagctccaccacagttgttagagcaacaccatttttgggccaaaccaagaatgctaatcctcttagagatgttgttgccatgggctctgccagattcaccatgagtaatgatttgtggtacggacctgaccgtgtcaagtacttgggacccttttctgctcaaactccttcatacttgaacggagaattccctggtgactacggatgggacactgctggtttatctgctgatcccgaggcctttgccaagaacagagctcttgaggttatccatggaagatgggcaatgcttggtgcactaggttgcattttcccagaagttcttgaaaaatgggtgaaagtagacttcaaagaaccagtatggttcaaagcaggagcacaaatcttcagtgacggtggacttgactacttgggaaacccaaaccttgtccatgctcagagtattctagctgtgctaggtttccaagtggttcttatgggacttgttgaaggtttcagaatcaatggacttccaggagttggagaaggcaacgacttataccccggtggccaatattttgacccactcggccttgctgatgaccctaccacatttgctgagctcaaggtaaaggaaatcaaaaatggaagactagctatgttctccatgtttggattcttcgttcaagctattgttaccggtaaaggccctcttgaaaacctgttagatcaccttgacaaccctgttgctaacaatgcttgggtttacgccactaagtttgttcctggagcttagatttatgtttcaattcattgaaagtactactttttgtgtaactgaaatcttcagaaatgcaaatatcttgtagatgaaaaaaaa

SEQ ID NO: 2489 - DNA, 958 bp, Scabiosa columbaria
aactttcaacttagagtgtgcattcatagattctatcaagttttcaaatagaaaatttatagacccttctgcaagaaaataacaagaaacaatgtcaatggctgcaagttctagcactgttcttagagccaccccttttttgggccaaaccagagcaaatgctcttagagattttgtccctataggcccttcaaagttgaccatgggaaatgatttatggtatggaccagaccgtgttaagtacttgggaccgttttcagctcagactccatcgtacttgaacggagaattcccaggtgactacggttgggacaccgccggcttatctgctgatcccgaggcttttgccaagaacagagctcttgaggttatccatggaagatgggcgatgcttggagcactaggatgcatcttccctgaagtcctcgaaaaatgggtcaaagttgacttcaaagaacctgtctggttcaaagccggagctcaaatcttcagcgaaggtggactcgactatttaggaaaccctaatctcgtccatgcccaaagcattctcgcagttcttggattccaagttgttctaatgggactagtcgaaggttttcgcatcaatggtcttgacggagttggtgagggcaacaatctttaccctggtgggacctacttcgatccacttggcctagccgatgatcctgtgacatttgccgagctaaaagtgaaagaaatcaagaatggaagattggctatgttctccatgtttggtttctttatccaagctattgttactggcaaaggacctcttgagaaccttttggatcaccttgataaccctgtcgccaataatgcttgggtatatgctactaagtttgtcccaggggcgtaaatcgtgttgtgattaaggctcatttgctcacttttatgtttgttttagttgatgtgagaatgtacattaacaatcattatg

SEQ ID NO: 2490 - DNA, 923 bp, Solanum phureja
gccaagcacaaatatattttaaaaaacaactttgagaggttgaagaaaatggcatcaatggcagcaacagcaagctccaccacagttgttagagcaacaccatttttgggccaaaccaagaatgctaatcctcttagagatgttgttgccatgggctctgccagattcaccatgagtaatgatttgtggtacggacctgaccgtgtcaagtacttgggacccttttctgctcaaactccttcatacttgaacggagaattccctggtgattacggatgggacactgctggtttatctgctgatcccgaggcctttgccaagaacagagctcttgaggttatccatgggagatgggcaatgcttggtgcactaggttgcattttcccagaagttcttgaaaaatgggtgaaagtagacttcaaagaaccagtatggttcaaagcaggagcacaaatcttcagtgacggtggacttgactacttgggaaacccaaaccttgtccatgctcagagtattctagctgtgctaggtttccaagtggtgcttatgggacttgttgaaggtttcagaatcaatggacttccaggagttggagaaggcaacgacttataccccggtggccaatattttgacccactcggtcttgctgatgaccctaccacatttgctgagctcaaggtaaaggaaatcaaaaacggaagactagctatgttctccatgtttggattcttcgttcaagctattgttaccggcaaaggccctcttgaaaacctgctagatcaccttgacaaccctgtcgctaacaatgcttgggtttacgccactaagtttgttcctggagcttagatttatgtttcaattcattgaaagtactactttttgtgcaactgaaatcttcagaaatgcaaatatcttgtagatga

SEQ ID NO: 2491 - DNA, 1038 bp, Tabernaemontana elegans
tcctgactgtagttgtcacaaagcttgcagaccaacgctacagaaagtaaattaatcgactgtaagctcaagaggaaaaagaatggcatcaatggcagctacagccagctccgccactgttgttagagcaaccccattcttgggccaaaccaaaagtgttaaccctcttaaagatgttgtctccatgggaaatggcaagtacaccatgggaaatgaactatggtatggacccgaccgtctgaaatacttaggacccttttcagctcaaactccatcatacttaactggggagtttcctggtgactatggatgggatactgctggtttatctgctgatcctgaggcctttgccaggaacagggctcttgaggttattcacggacgatgggctatgcttggagcactgggatgcatcaccccagaagttcttgagaagtgggtcaaggtggacttcaaggaaccagtctggttcaaagctggagcacagatcttctctgaaggaggtcttgactacttgggtaacccaaacctcgtccacgcacagagcattttggcggtccttggtttccaggttgttctgatgggacttgttgaaggatacaggatcaatggtcttcctggagtcggagagggcaatgacctctaccctggtggtcaatactttgatcctcttggcttagctgatgacccagttacctttgctgaacttaaggttaaggaaatcaagaatggaaggctagccatgttctctatgtttggtttctttgtccaagctattgtcactggcaaaggtcctcttgagaatctcctggaccatcttgacaacccagtggctaacaatgcctgggtttatgccaccaagtttgtccccgggtcataaatttcagcttacttgatgaaaagtcgtgtgaatggaaaactgtgaatgagagccttaagtagaatatatttattttgccccctttttgagtctctaaagctttagagctcatgtatcattgttgtgccaaggctacttaatgatctaatgctcatttt

SEQ ID NO: 2492 - DNA, 910 bp, Vinca minor
aaaattaatcatccaatggcatcaatggcagccacagccagctccaccactgtcatcagagctactccgttcttgggcctaactaaaagtgctaaccctcttagagatgttctctccatgggaaatggcaagttcaccatgggaaatgagctatggtatggtccagacagagtgaaatacttgggacccttttcagcacaaactccatcttacttgactggtgaatttcctggtgattatggttgggatactgctggcttgtctgccgatcctgaggcctttgccaagaacagggctcttgaggtaatccacgggagatgggctatgcttggagcactaggatgcataaccccagaagttcttgagaagtgggttaatatagacttcaaagaaccagtttggttcaaagctggagcccagatattctcagaaggaggtcttgactatttaggaaacccaaatcttgttcatgcacaaagcatattagcagtcctaggtttccaggttgtcctaatgggacttgttgaaggattcagaatcaatggtctacctggagttggagaaggcaacgatctatacccaggtggacaatactttgatccacttggattggccgatgatccggtaacttttgatgaacttaaggttaaggaaatcaagaatggaagattagccatgttttccatgtttggattctttgttcaagctattgttactggcaaaggtccacttgagaatctccttgatcatcttgataaccctgttgctaacaatgcctgggtttatgctactaagtttgttcctggatcttaaatttctggttactcaatcaatttgttgtttgtgtgaatggagaattgtgaatgaaaaatcttgagaattttagttaatcctgttatcctacattaat

SEQ ID NO: 2493 - DNA, 869 bp, Ambrosia trifida
aagcttcaattaatggcatccatggctactaactcctccactgttgtcagagccacccctttcttgggtcaaaccagagcctccaatgtcaactcccttagagattctgtctccatggtcaatggcaagttcaccatgggaaatgagttgtggtatgggccagaccgagtgaagtacttgggacctttttcggcccaaacaccatcatacttgaccggtgaattcccgggtgactatggctgggacaccgctgggttatctgctgatcccgaggcttttgccaagaaccgggctcttgaggtgatccatgggagatgggcaatgttaggagcattcgggtgcattacccccgaagtcctcgaaaaatgggtaaaagtagatttcaaggagcccgtttggttcaaagccggagcccaaatcttctccgaaggcgggctagactatttaggcaacccaaacctagtccacgcccagagcatattagcagtactcggtttccaagtggtcctaatgggcttggttgaaggattccgtattaacgggcttgagggtgtcggagatggtaacgacctctacccgggaggccaatactttgacccgttgggccttgcggacgacccgattacttttgctgagttgaaggtgaaggaaatcaagaatggaagactagcaatgttttcaatgtttgggttttttgtacaagcaattgtgacagggaaaggcccattggagaaaccttttggaccatttggacaaccctgtggctaactatgcttgggtctatgccaccaagtttgtgcctggttcataaactattgtggtcttttgaactgttcttgtaaacgttggatgaaactaattaaataaaa

SEQ ID NO: 2494 - DNA, 1046 bp, Amorphophallus konjac
acagcgccccggcacagagggaaagcggtgagcatactgcagcgatggcggcgacactgacagtagcctccgccagctcgaccgtccggccgacccccttcctcggccagaccaggggctcgcccgccaacccgctgatcagggatgccgtccccatgggcaacggcaagtacaccatgggcaacgagttgtggtacggccccgacagagtgaagtacttgggtcccttctcggcccagacgccatcctacctcaccggagaattccccggcgactacgggtgggacaccgccgggctgtcggccgaccccgaggccttcgcccgcaacagggcccttgaggtcatccacggccggtgggcgatgctcggggcgctcggctgcatcaccccagaggtgctggagaagtgggtgcgtgtcgacttcaaggagccggtgtggttcaaggccggggcgcagatcttctccgccggcggcctcgactacctgggcaaccccaacctggtgcacgcccagagcatcctggcggtgcttggcttccaggtcgtactcatgggcctcgtcgagggctaccgcatcaacggcctccccggcgtcggcgagggcaacgacctctaccccggcggccagtacttcgaccccctcggcctcgccgacgaccccgccaccttcgccgagctgaaggtgaaggagatcaagaacggccggctggccatgttctccatgttcgggttcttcgtgcaggccatcgtcaccggcaagggcccgctgggagaacctgctcgaccacctcgacaaccccgtcgccaacaacgcctgggtctacgccacccaagttcgccccgggatcttaattaaacctagtcgtcgccccttcaccaaatctatccccagccagctatcaatttgttgtgaattgaagaacatgagaggcttgttctttgtagattaccccgtttaactgctagttccgggagagcatggattgatatatatatatgtcccaagtccagatcaggtagacttcataatatatgttgtaaactt

SEQ ID NO: 2495 - DNA, 992 bp, Flaveria ramosissima
cacttaaataaatcttaatttacaaccaccacaacaaaccaccatcaatggctgcagctgctagctccaccgtggtccacgccacaccattcttgggtcaaagcagaccatctagccttaaccccttaagagatatggtctctatgcccagtgcaaaatacaccatgggaaatgacttgtggtatggacctgaccgtgttaagtacttgggacccttttcggctcagaccccatcgtacttgaccggtgaattccctggtgactacggttgggatactgcgggtttgtccgctgatcccgaggccttcgccaagaatagggctcttgaggttatccatggccgatgggccatgcttggagccctcgggtgcatcacacccgaggtccttgaaaagtgggtgaaagtggatttcaaggagccagtctggttcaaggctggagcccagattttctcagaaggcggtttggactacctcgggaacccgaaccttgtccatgcgcagagcatattggcagttctcgggttccaggtggtcctaatgggcctcgttgaggggttccgaattaacgggcttgaaggggttggagatggtaacaatttgtatccgggagggcaatacttcgacccgttggggcttgcggatgacccggtgaccttcgccgagttgaaggtgaaagagatcaagaacggtagattggctatgttttcgatgttcgggttctttgtgcaagcaatagttaccggcaaaggcccgttggagaacctgttggaccatttagacaccctgtggctaacaatgcatgggtttatgccactaagtttgtgcctggctcttagagtttttagcctttctactgtacttgtaaccgcaagtttgggaagaaaaatgtgtagattattataattagttctatataatatggtgtttattagatggtcttgtttatatcttgaactcatgtgaaaagaaaatattaatagcgagaattat

SEQ ID NO: 2496 - DNA, 938 bp, Flaveria ramosissima
cgtaatgggaacgacgtttgaacgttgtaagacttcgtatcaataggtcatcataccatggctgctaactccaccactgttgtcagagccacccctttttaggtcagaccagaggctccaatgtcaattcccttagagattctctctccatggtcaatggcaaatacactatgggaaatgacttgtggtatggaccggaccgagtgaagtacttgggacccttttcggcccagacaccatcatacttgaccggtgaattccctggtgattatggttgggacactgctggtttatctgctgatcccgaggcttttgccaagaaccgggctcttgaggtgatccatgggagatgggcaatgctaggagcattcgggtgcatcacccccgaagtcctagaaaaatgggtgaaagtagacttcaaggagcccgtctggttcaaagccggagcccaaatcttctccgaaggcgggctagactatttgggcaacccaaacctagtccacgcccaaagcatactcgcagtactcggctttcaagtggtcctaatgggcctcgtcgaagggttccgcattaacgggctcgagggtgtaggagaaggcaacaacctctacccgggtggccagtattttgacccattgggccttgcagatgacccgattactttcgccgagctaaaggtgaaggaaatcaagaatgggagactagcaatgttttcaatgtttgggttctttgtgcaagccattgtgacaggaaaaggaccattggagaaccttttggaccatttggataaccctgtggctaacaatgcatgggtctatgccaccaagtttgtccctggttcataaattatgtggctttttataagttcttgtaaattatgagttggatgataaaatgaataaatattgttattatataaaaaaaaaaaaaaaaaaaaa

SEQ ID NO: 2497 - DNA, 1041 bp, Populus trichocarpa
gctttccttcacatataagcttagcacttcctttctacacgcttccagactacaattttctgctcttcgagagagatcactaagttctaacccagggaaaaacagtaaggattgtctggaagacaatggcatctcttgctagctcaagcaccattgcaagaccaccgcatttcttggcaaaaagggttcaaatgctaaccctcttagagatgttgtctccatgggaaatggcaaatacatcatgggtaatgagttgtggtatggacctgacagagtgaagtacttgggacctttttcagctcagactccttcatacctgactggagaattcccaggtgactatggatgggacactgctggtttatcagctgatcctgaggcctttgctaagaacagagctcttgaggtcatccatggcagatgggctatgctaggagcactaggttgcatcaccccagaagtccttgagaaatgggttaaggtagacttcaaggaaccagtttggttcaaagctggagctcaaatcttctcagaaggtggcttggactacttgggcaaccccaaccttgtccatgcccaaagcatccttgctgtccttggattccaagttgtcctcatgggccttgttgagggattccgcatcaatggtctccctggagtaggagagggtaatgacctttaccctggtggccaatacttcgaccctcttggcctggccgatgatccaactacatttgccgagctcaaggtgaaggaaatcaagaatggccggctagctatgttctccatgtttggattctttgttcaggctattgttactggaaaaggtcccctggagaacctcttggaccaccttgacaacccagttgccaacaacgcctgggtctacgccaccaagtttgtgcctgggtcataaattgacatttactttctcggattccaatggaaagatcttgccaggattgtcgtggttactgtatttctagatttgaagattttgtcgttgggatccagagtaaattgtacaatctgtttcgttgt

SEQ ID NO: 2498 - DNA, 935 bp, Eschscholzia californica
attactttcaacaagttagagaagtaccttgaaacttaagcagtgagtataaaaaatggtgtcaactctaatggcagcctcagctaattccagtacagttcttagaccatctcaatttttgggacaaaatagagtctctaactctcttagagatgttgttgctatgggaactagtaaatacactatgagtaatgatttgtggtacggtcctgaccgtgtcaaatacttaggcccattctctgctcagactccatcttacttaaccggtgaattccccggtgattacggatgggatactgctggattatcagcagatcctgaagccttcgctaagaacagagctcttgaggtcattcacggtcggtgggctatgttaggggcgtttgggtgcatcaccccagaagtgctagagaaatgggtcaaggtagacttcaaggaacccgtttggttcaaagctggatcacagatcttttccgaaggtggtcttgactacttgggaaaccctaaccttgttcatgcacaaagcatcttggctgtgttagggttccaagttattctaatgggcctcgtcgagggtttccgtatcaatggattacccggagtcggtgaaggtaacaacttataccctggtggtacatactttgacccactaggccttgctgatgatccaactaccttcgccgaattgaaagtgaaggagatcaagaatggacgacttgccatgttttctatgttcgggttctttgttcaagccattgttactggaaaaggccctcttgaaaacctactagatcacctcgacaaccctgtcgctaacaatgcttgggtttacgccaccaaatttgtcccaggatcttaaatttatctcggttttattataacgtgtaatcacgagtgtaaattattatgattttaatagaaggccttgaagattt

SEQ ID NO: 2499 - DNA, 923 bp, Nicotiana benthamiana
cacgaggaaattattaagaaagaaagagagaatggcatcaatggcagcaaccggcagctccgccactgttgttagagcaactccattcttgggccagaccaaatatgccaaccctcttagagatgtagttcccatgggctctgccaaattcaccatgagtaatgatttgtggtatggacctgaccgtgtcaagtacttgggacccttttctgctcaaactccttcctacttgactggagaattccctggtgattacggatgggacacagccggtttatctgctgatcctgaggcctttgccaagaacagagctcttgaggtcatccatgggagatgggccatgcttggggcactgggttgcattactccagaagttctcgagaaatgggtgaaagtggacttcaaggaaccagtatggttcaaagctggagcccaaatcttcagtgaaggaggactcgactatttgggcaacccaaaccttgtccatgctcagagcattctagcagtgttgggcttccaagtagttctaatgggccttgtagaaggttttagaattaatgggcttcctggagttggtgatggcaacaatctctacccaggtggtcagtactttgacccacttggcctagctgatgacccaactacttttgccgagctcaaggttaaggagatcaagaatggaagattggctatgttctccatgtttggattctttgttcaagctattgtcactggcaaaggtcctcttgagaaccttttggatcaccttgacaaccctgttgctaacaatgcatgggtttatgcaactaagtttgttcctggatcttaaattttacattttgacttcctccacaagaggcttgtaccactgagtcattcagaatgcaaatatttggcagatgaaaactattttgccatgtgat

SEQ ID NO: 2500 - DNA, 917 bp, Solanum tuberosum
gattaagagagaaattaagaaagagaagaaatggcagcaacaggcagctcagccacagttgttagagcaactccatttttgggccagaccaaatatgctaacccccttagggatatagttcctatgggctctgccagattcaccatgagtaatgatttgtggtatggacctgaccgtgtcaagtacttgggaccattttctgctcaaactccttcatacttgactggagaattccctggtgattacggatgggatactgctggtttatctgctgatcccgaggcctttgccaagaaccgagctcttgaggttatccatgggagatgggccatgcttggggcttttggttgcattacaccagaagttcttgaaaaatgggtaaaagtggacttcaaagaaccagtatggttcaaagctggagcccaaatcttcagtgaaggtgggctggactatttgggcaacccaaaccttgtccatgctcagagcattctagcagtattgggcttccaagtagtactaatgggccttgtagaaggtttcagaattaatgggcttcctggagttggtgaaggcaacaatctatacccaggtggtcagtactttgacccattgggcctagcagatgacccaacaactttcgccgagctcaaggttaaggagatcaagaacggaagattagctatgttctccatgtttggattcttcgttcaagctattgttaccggcaaaggcccacttgagaacctattggatcaccttgacaaccctgttgctaacaatgcatgggtttatgcaactaagtttgttcctggttcttaaattttttacattttgacttcctccataagaggctttgtagtttgtaccactcaatcattcataatgcaaatatttggcaaaggaaaattattttacat

SEQ ID NO: 2501 - DNA, 1051 bp, Solanum phureja
tttcaaaactatttcacaccacaattttctaaaacacaagaaccagaattgttggatggaccactccagatatttttccaacagttattctttatatataaattgtgcaagaaacttagtgaaaattgtgaggtccaattaattaagagagaaattaagaaagagaagaaatggcagcaacaggcagctcagccacagttgttagagcaactccatttttgggccagaccaaatatgctaacccccttagggatatagttcctatgggctctgccagattcaccatgagtaatgatttgtggtatggacctgaccgtgtcaagtacttgggaccattttctgctcaaactccttcatacttgactggagaattccctggtgattacggatgggatactgctggtttatctgctgatcccgaggcctttgccaagaaccgagctcttgaggttatccatgggagatgggccatgcttggggcttttggttgcattacaccagaagttcttgaaaaatgggtaaaagtggacttcaaagaaccagtatggttcaaagctggagcccaaatcttcagtgaaggtgggctggactatttgggcaacccaaaccttgtccatgctcagagcattctagcagtattgggcttccaagtagtgttaatgggccttgtagaaggtttcagaattaatgggcttcctggagttggtgaaggcaacaatctatacccaggtggtcagtactttgacccattgggcctagcagatgacccaacaactttcgccgagctcaaggttaaggagatcaagaacggaagattagctatgttctccatgtttggattcttcgttcaagctattgtcaccggcaaaggcccacttgagaacctattggatcaccttgacaaccctgttgcaaacaatgcatgggtttatgcaactaagtttgttcctggatcttaaattttttacattttgacctttgtagtttgtaccactcaatcattcataatgcaaatatttgtcaaaggaaaattattttacatacacttgaa

SEQ ID NO: 2502 - DNA, 934 bp, Nicotiana tabacum
ggccattacggccgggggtgaagtccaagagagaaattaagaaagaaagagagaatggcagcaaccggcagctccgccactgttgttagagcaactccattcttgggccagatcaaatatgccaaccctcttagagatgtagttccaatgggctctgccaaattcaccatgagtaatgatttgtggtatggacctgaccgtgtcaagtacttgggacccttttctgctcaaactccttcctacttgactggagaattccctggtgattacggatgggacacagccggtttatctgctgatcctgaggcctttgccaagaacagagctcttgaggtcatccatgggcgatgggccatgcttggggcactgggttgcatcaccccagaagttcttgagaaatgggtcaaagtggactttaaggaaccagtatggttcaaagctggagcccaaatcttcagtgaaggaggactggactatttgggcaacccaaaccttgtccatgctcagagcattctagcagtgttgggcttccaagtagttctaatgggccttgtagaaggtttcagaattaatgggcttcctggagttggtgatggcaacaatctctacccaggtggccagtactttgacccacttggtctagcagatgacccaactacttttgccgaactcaaggtaaaggagatcaagaatggaagattggccatgttctctatgtttggattcttcgttcaagctattgtcactggcaaaggtcctcttgagaaccttttggatcaccttgacaaccctgttgctaacaatgcatgggtttatgcaactaagtttgttcctggatcttaaattttacattttgacttcctccacaagaggcttgtaccactgattcattcagaatgcaaatatttggcactattttgcagcggccgcatga

SEQ ID NO: 2503 - DNA, 1056 bp, Solanum lycopersicum
tttcaaaactatttcacaccacaattttataaaacacaagaaccagaattgttaaatggggcccctccagatatttttccaacagttattctttatatataagtatataaattgtgcaagaaaattgtgaggtccaattaattaaaagagaaattaagcaatagagaaaatggcagcaacaggcagctcagccacagttgttagagcaactccatttttgggccagaccaaatatgctaaccccctaagggatatagttcctatgggctctgccagattcaccatgagtaatgatttgtggtatggacctgaccgtgtcaagtacttgggaccattttctgctcaaactccttcatacttgactggagaattccctggtgattacggatgggatactgctggtttatctgctgatcccgaggcctttgctaagaacagagctcttgaggttatccatgggagatgggccatgcttggagcttttggttgcattacaccagaagttcttgaaaaatgggtaaaagtggacttcaaagaaccagtatggttcaaagctggagcccagatcttcagtgaaggtgggctggactatttgggcaacccaaaccttgtccatgctcagagcattctagcagtattgggcttccaagttgtactaatgggccttgtagaaggtttcagaattaatgggcttcctggagttggtgaaggcaacaatctctacccaggtggacagtactttgacccattgggcctagcagatgacccaacaactttcgcggaactcaaggtcaaggaaatcaagaacggaagattagctatgttctccatgtttggattcttcgttcaagctattgtcaccggcaaaggcccacttgaaaatctattggatcaccttgacaaccctgttgctaacaatgcatgggtttacgcaactaagtttgttcctggatcttaaattttttcacatattgactttgtagctttgtaccactcaatcattcattcataatgcaaatatttggcaaatgaaaaattattttacatacacttgaa

SEQ ID NO: 2504 - DNA, 799 bp, Brassica juncea
aatggcttcaacattcacaagctcaagcagtgttctgacccaaacaccatttcttggacagactaaaggctccaccttcaaccctcttcgtgatgttgtctctctcggaactcccaaatgcactatggggaacgatctttggtacggaccagacagagtaaagtacttaggaccattttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttaggcaacccaaaccttgtccacgcccaaagcattttagccgtccttggcttccaagttatcctaatgggattagttgaaggtttccgcatcaacggtcttgatggtgttggcgaaggcaatgacttgtacccgggcgggcaatactttgacccactgggtcttgcagatgacccggttacttttgctgagctcaaggtgaaagagatcaagaatggaaggttggctatgttctcaatgtttggcttctttgttcaagccattgtaaccggaaaaggtcctttggagaatctccttgaccatcttgataaccctgttgctaacaatgcatgggctttcgcaacaaagtttgtacctggagcttga

SEQ ID NO: 2505 - DNA, 1004 bp, Brassica juncea
tggaggagattcttgattcttgttggtttcagcgagcggccgaggcggcgattcagagttcggaacggtgacttcgtggtggtcgggttgagttttgagaggtgtttcaagattcgattgttgagactccattttcgaaagagagataagagtgagagacaaatggcttcaacattcacaagctcaagcagtgttctaagcccaacaccatttcttggccagaccaaaggctccaccttcaaccctcttcgtgatgttgtctctctcggaactcccaaatacactatggggaatgatctttggtacggaccagacagagttaagtacttaggaccattttctgtccaaaccccttcttacctcaccggagagtttcctggcgactatggttgggacaccgccggtttatccgcagaccctgaagcctttgccaagaacagagctcttgaggtgatccatgggagatgggcaatgttgggagcattaggttgcataacacctgaagttcttcagaaatgggtccgtgtggacttcaaagagccggtctggttcaaagccggttcacaaatcttctctgaaggaggtttggactacttaggcaacccaaacctagtccacgcccaaagcattttagccgtccttggcttccaagttatcctaatgggattggttgaaggtttccgcatcaacggtcttgatggtgttggtgaaggcaatgacttgtacccgggagggcaatactttgacccactgggtctcgcggatgatccggttacctttgctgagcttaaggtgaaggagatcaagaatggaaggttggctatgttctcaatgtttggcttctttgttcaagccattgttactggaaaaggtcccttggagaatctccttgaccatcttgataaccctgttgctaacaatgcttgggcttttgctacaaagtttgtacctggagcttgattttttttaagtcttgatgtaatccctttgaaatgatatgaaca

SEQ ID NO: 2506 - DNA, 919 bp, Triticum aestivum
accaaacagcaagaagaagaacgacaccagagagagaaacaaacgctcaaaatcctagagagactcaatggcttcaacattcatgagctcaagcagtgttctgaccccaacaccatttcttggacagactaaaggctccaccttcaaccctcttcgtgatgctgtctctctcggatctcccaagtacactatggggaatgatctttggtacggaccagacagagttaagtacttaggaccgttttccgtccaaaccccgtcttacctcaccggagagtttcccggagactatggttgggacatcgctggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttaggcaacccaaacctagtccacgctcagagcattttagccgtccttggcttccaagttatcctaatgggattagttgaaggtttccgcatcaacggtcttgatggtgttggtgaaggcaatgacttgtacccgggtgggcaatactttgacccgctgggtcttgcggatgatcccgttacttttgctgagcttaaggtgaaggaaatcaagaatggaaggttggctatgttctcaatgtttggcttctttgttcaggctattgttaccgggaagggtcctttggagaatctccttgaccatcttgataatcctgttgctaacaatgcttgggcttttgcaacaaagtttgtacctggagcttgatttgatgtgatcctttgaaatgatataaacataatcttttcttgtgtactactt

SEQ ID NO: 2507 - DNA, 1133 bp, Arabidopsis lyrata
atatcccatctctgattctccaacctctcttctcatccacaaaatactaacataaaactcaaagtccctgagaccaatactttcaccaaacagcaaaagaagaagaacaacaacactaagcaaaaaaaaaaatctcaagccgagagagacaatggcatcaacattcacgagctcaagcagtgttctgtctccaacaacattccttggccagactaaagcctcaagctttaaccctcttcgtgatgttgtctctctcggatctcccaaatacactatgggaaatgatctttggtatggaccagatagagtgaagtacttaggacccttttccgtccaaactccgtcttacctcaccggagaattccccggcgattatggttgggacaccgccggtttatctgcagaccctgaagcctttgctaaaaacagagctcttgaggtgatccatgggagatgggcaatgttgggagcttttggttgcataacccctgaagttcttcaaaagtgggtccgtgtggacttcaaagaaccagtctggttcaaagccggttcacaaatcttctccgaaggcggtttggactacttaggcaacccaaacctagtccatgctcagagcattttagccgtccttggcttccaagtcatcctcatgggattggttgaaggtttccgcatcaacggtcttgacggtgttggcgaaggaaacgacttgtaccccggtggacaatactttgacccgttgggtctcgctgatgatccagttacttttgctgagctcaaggtgaaagagatcaagaatggaagattggctatgttctcaatgtttggcttctttgttcaagccatcgttactggaaaaggtcctttggagaatctccttgaccatctcgacaaccccgttgctaacaatgcgtgggctttcgcaactaagtttgcacctggagcttaaatttttaggtcttgatgtgattcttgtaatgatatgaacataacctttcttgttcctctcaaattacaaatctctattcgctatgcacagaagaagtctcaaaaatacatgtctctcacagctaaatctacaatgctctcaatctaacattttgggatcgggatactaatacaaagctaagtgg

SEQ ID NO: 2508 - DNA, 1036 bp, Arabidopsis thaliana
atatcccatctctgattctcccacctctcttctcatccacaaaatactaacataaaagtcaaagtccctgagaccaatactttcaccaaacagcaaaacaagaagaacaacaacactaagcaaaaaagaaaagctcaagccgagagagacaatggcatcaacattcacgagctcaagcagtgttcttaccccaacaacattccttggccagactaaagcctcaagctttaacccccttcgtgatgttgtctctctcggatctcccaagtacactatgggaaatgatctttggtatggacctgacagagtgaagtacttaggacccttttccgttcaaactccgtcttacctcaccggagaattccctggcgattatggttgggacaccgccggtttatccgcagaccctgaagcctttgccaaaaacagagctcttgaggtgatccatgggagatgggcaatgttgggagcttttggttgcataacccctgaagttcttcaaaagtgggtccgtgtggacttcaaagaaccagtctggttcaaagccggttcacaaatcttctccgaaggcggtttggactacttaggcaacccaaacctagtccatgctcagagcattttagccgtccttggcttccaagtcatcctcatgggtttggttgaaggtttccgcatcaacggtcttgatggtgttggcgaaggcaacgacttgtaccccggtgggcaatactttgacccgttgggtctcgctgatgatccagttacttttgctgagcttaaggtgaaagagatcaagaacggaagattggctatgttctctatgtttggcttctttgttcaagccattgttactggaaaaggtcctttggagaatctccttgaccatcttgacaaccctgttgctaacaatgcgtgggctttcgcaactaagtttgcacctggagcttaaattttcaagtcttgatgtgattcttgtaatgatatgaacataacctttcttgttcctctcaaattacaaatcttctatttgctatgc

SEQ ID NO: 2509 - DNA, 863 bp, Arnica chamissonis
atccatggctgctaactccaccactgttgtcagagccacccctttcttgggtcagaccaaagcctccaatgtcaactcccttagagattctgtctccatggtcaacggcaagttcaccatgggaaacgacttgtggtatggaccggaccgagttaagtacttgggacccttttcggcccagacgccatcatacttgaccggtgaattccctggtgactatggctgggacactgctggtttatctgccgatcctgaggcttttgccaagaaccgggctcttgaggtaatccacggaagatgggcgatgctaggagcattcgggtgcatcaccccggaagtcctagaaaaatgggtgaaagtggatttcaaggagcccgtttggttcaaagccggatcccaaatcttctccgaaggcgggctagactatttgggcaacccaaacctagtccacgcccaaagcatattagcggtactcggttttcaagtggtcctcatgggcttggttgaagggttccgtattaatgggcttgagggcgtgggagatggtaacaacctctacccgggtggtcaatactttgacccattggggcttgcggatgacccaactacttttgcggagttgaaggtgaaggaaatcaagaatgggagactagcaatgttttcaatgtttgggttttttgtgcaagcaattgtgacagggaaaggaccgttggagaaccttttagaccatttagacaaccctgtggctaacaatgcatgggtctatgccaccaagtttgtgcctggttcgtaaattttgtggctttgtaactggtcttgtaaattatgggctggatgagaacatctaatgaaatattattttt

SEQ ID NO: 2510 - DNA, 1126 bp, Artemisia annua
acgagtgcgtaagagtggtatcaacgcagtactccgacggggactctttgaatccaactatcataacattaatagtatcaatggcttcaactgctgctgctagctcaaccacagttgttagagccactcctttcttgggtcaaaccaaagggtccaatgttaactcccttagagattctgtctctatggtcaatggcaagtacaccatgggaaatgacttgtggtatggaccagaccgagtgaagtacttgggacccttttcggcccagacaccttcatacttgactggtgaattccctggtgactatggctgggacactgctggtttgtctgctgatcctgaggctttcgctaagaaccgggccctcgaggtcatccacgggcgatgggcaatgcttggagccttcggttgcatcacccctgaagtccttgaaaaatgggtcaaagtggatttcaaggagcctgtttggttcaaagctggagctcaaatcttctctgaaggtgggctagactacttaggcaaccctaacctagttcatgcccaaagcatattagccgtactcggtttccaagtagtcctaatgggacttgttgaaggattccgtattaacgggcttgatggtgttggagatggtaacaacctctaccccggaggccaatactttgacccattgggccttgcagatgacccggcaacctttgctgagttgaaggtcaagaacggaagactagcaatgttttcgatgtttgggttctttgtgcaagcaattgtgacaggaaaaggaccattggaaaaccttttggaccatttggataaccctgtggctaacaatgcatgggtctatgccaccaagtttgttcctggttcatagattttgtggcttgtttaattgtttctgtaaactatgagttggatgagaaaactgtgtagattattattgtactaatatatattggtttggttgttgttgtcctttatttaagctcaaattatttacatagattgaagcattcgaagaaaaatgattaaagatgctcaaggagagaccgatatgtagaatactggatcggagtcaggtttgtcggttcattgtcggacttaagtatgtttcggtttacaaggatt

SEQ ID NO: 2511 - DNA, 886 bp, Brassica napus
cacagaagagaaaacaaacgctcaaaatcctagagagactcaatggcttcaacattcatgagctcaagcagtgttctgaccccaacaccatttcttggacagactaaaggctccaccttcaaccctcttcgtgatgctgtctctctcggatctcccaagtatactatggggaatgatctttggtacggaccagacagagttaagtacttaggaccgttttccgtccaaaccccgtcttacctcaccggagagtttcccggagactatggttgggacaccgctggtttatccgcagaccctgaagcctttgccaagaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactatttaggcaacccaaacctagtccacgcccaaagcattttagccgtccttggcttccaagttatcctaatgggattagttgaaggtttccgcatcaacggtcttgatggtgttggtgaaggcaatgacttgtacccgggcgggcaatactttgacccgctgggtctcgcggatgatccggttactttggccgagcttaaggtgaaggaaatcaagaatggaaggttggctatgttctcaatgtttggcttctttgttcaagccatcgttacaggaaagggtcctttagagaatctccttgaccatcttgataaccctgttgctaacaatgcttgggcttttgcaacaaagtttgtacctggtgcttgatttttttaagtcttaaaatgtaatccttttgaaatgatatgaacat

SEQ ID NO: 2512 - DNA, 1121 bp, Euphorbia peplus
gttagtatttgtaaagttaagtaactttattattgtatatctaatttacttgtctgagtttacttagtattctaatagataatattaattactatgttcacaataaaaaaaaaaaaaactaaaaagtaaacaaggcaatggcatcaactcttatggcagcaactgctagctcaagctcagtgctaaggcctactcccttttttggtcaaagaggttcaacttctaattctcttagagatgttgtctccttgggaaactccaaatacattatggggaatgagttgtggtacggaccggacagagtaaaatacttaggacccttttcagcacagactccatcataccttagtggagaatttccaggtgattatggttgggatactgctggtttgtctgctgatcctgaagcctttgccaagaacagggctcttgaggtaatccatggaagatgggcaatgctaggagcattagggtgcattatcccagaagtacttgaaaaatgggtaaaagtggacttcaaagagccagtatggttcaaagcaggagctcaaatattctcagaaggtggactagactatctaggcaaccctaatctagtgcatgcacaaagcattctagctgtgcttggtttccaagtggtcctgatgggccttgttgaaggcttcagaatcaatggccttgatggagtaggagagggcaatgacctttacccgggtggtcaatactttgacccacttggcctagctgatgatcctgtcacttttgctgagctcaaggttaaggagatcaagaatggaaggctagccatgttctctatgtttggtttctttgttcaagctattgtcactggcaaaggtcctcttgagaatcttttggatcatcttgatgaccctgttgctaataatgcttgggtttatgccactaagtttgtccctggttcataaaccattttatcttttggttccacatttgttttgttgagatcctatgtaaatttccatcttaatgacaaatgcctgccttaatatattcacgttgtgtttctctttagcttgaatttcaaggaaggtgctgaaaatgataatacttgttacttaagtgacaatctctcccaccaaaat

SEQ ID NO: 2513 - DNA, 909 bp, Flaveria ramosissima
ctaactccaccactgttgttagagccactcctttcttaggtcaaaccagaggctccaatgtcaatgcccttagagattctgtctccatggtcaatggcaaatacaccatgggaaatgacttgtggtatggaccggaccgagtgaagtacttgggacctttttcggcccagaccccatcatacttgactggtgaattccctggtgattatggttgggataccgctggtttatctgctgatcccgaggcttttgccaagaaccgggctctcgaggtgatccacgggagatgggccatgttaggagccttcgggtgcatcactcccgaagtcctagaaaaatgggtgaaagtagatttcaaggagccagtctggttcaaagccggagcccaaatcttctccgaaggcgggctagactatttgggcaacccgaacctagtccacgcccaaagcatactagcagtactcggtttccaagtggtcctaatgggccttgtcgaagggttccgcattaacgggctcgagggtgtaggagaaggtaacaacctctacccgggtggccagtactttgacccgttgggccttgcggatgacccggtcactttcgccgagctaaaggtgaaggaaatcaagaatgggagactagcaatgttttcaatgtttgggttctttgtgcaagcaattgtaacaggaaaaggaccattggagaaccttttggaccatttggacaaccctgtggctaacaatgcatgggtctatgccaccaagtttgtccctggttcataaattatgtaactttttaattgttactgtaaattataagttggatgataaaattaaataaacattattgttatatggattgatttaatgatttgtatatgttggttatttagtttgttgaagacaactt

SEQ ID NO: 2514 - DNA, 894 bp, Panax ginseng
atctcaaagagagaaatactagctaaaacttctaaaaacatgtcaatggcggcaactgcaagctccagcactgttgttagagcaaccccatttttgggtcaaaccaagggcccaaatgctaactctcttagagatgttgtctcaatgggcacgggcaaattcaccatggggaatgatttgtggtacggaccagaccgtgtcaagtacttgggaccattttcagctcagactccatcatacttaaatggggaatttcctggtgattatggttgggatacagctggtttatctgctgatcctgaagcctttgctaagaacagagctcttgaggtgatccacgggcggtgggcaatgcttggagcactgggatgcatcaccccagaaatcctccagaaatgggtcaaggtagacttcaaggagccagtttggttcaaagccggatctcagatcttcaccgaaggtggcctagactacttgggcaacccaaaccttgtccatgctcagagcattttggccgtactcggattccaagtcgttctaatgggcctggttgaagggttccgcatcaacggccttgccggagtcggagagggcaacgatctctaccctggaggccaatattttgacccactgggccttgctgatgatccagttacatttgcagagcttaaggtgaaagagatcaaaaacggaaggctggccatgttttctatgtttggcttcttcatccaagcaattgtcactggaaaaggacctcttgagaacctcttggaccaccttgacaaccctgttgccaacaatgcatgggtctatgccaccaagtttgttcccggatcataacttatgtgggtgtgtgtgtaaatcgtcaatttttaattaaatgttcgattgaca

SEQ ID NO: 2515 - DNA, 939 bp, Gossypium hirsutum
ctctggaattgttcttaggccaaccccatttcttggccaaccaaaaatgctaaccctcttagagatgttgtctctttgggcactcccaaatatgcaatgggaaatgaactatggtatggaccagacagagtgaagtacttgggaccattttcagctcagactccatcttacttgactggagaattccctggtgactatggttgggacactgctggtttgtcagccgaccctgaggcctttgccaggaatagggctcttgaggtcatccatggaagatgggcaatgttgggagcactaggctgtatcacaccagaagtacttgagaaatggcttagggttgatttcaaggaaccggtatggttcaaggcaggagctcaaattttctcagaaggtggcttggattacttaggcaaccctaacctagtccatgctcaaagcatccttgccgttctcggattccaagtcgtcctaatgggactcgtcgaaggattccgcatcaatggcttccctggtgttggtgaaggcaatgatctttaccctggtggacaatactttgaccctcttggtcttgctgatgaccctgttacatttgctgaacttaaggttaaagaaatcaagaatggtaggctagccatgttttcaatgtttggtttctttgttcaagccattgttactggtaaaggtcccttggagaacctattggaccaccttgataaccctgttgcaaacaatgcttgggtctatgctactaagtttgtgcctgggtcttgaatgaaaatagccaaaaggtcaaaacttgtataatttgctttatgtggattagaaattgagatatgtgtatttatgtgattgtagattttgaacaactttgacaaatcaaattatgtatcattaagaattgaatttaactcattgataaataagtattggtgttagaca

SEQ ID NO: 2516 - DNA, 1032 bp, Papaver somniferum
aatcttaaattcctaattacaatcataatttacacacattccccattcatttcattttaatcacagctaaaatggaaaatttgacatgtatctaagctccgggaacaaacttggttgcgtaaacccaagcattgttagcaacagggttgtcaaggtgatcaaagaggttctcaagaggaccttttccggtaacaatggcttgaacaaagaaaccgaacatagaaaacatagcaagacgtccgttcttaatttccttcaccttcaattcagcaaaggtaacagggtcatcggcaagtcccaatgggtcgaagtaggttccaccagggtacaaattgtttccctcaccaactccgtctaacccgttaatacggaaaccttcgacaagacccataagtaggacttggaaacctaaaacagctaagatactctgggcatggacaaggtttgggttccccaagtagtcaagaccgccttctgagaagatttgtgaaccagctttgaaccatacgggttccttaaagtcgaccttaacccatttctctagtacttctgggtttatgcatcccagtgctcccaacatagcccatcttccatgaattacctcaagagccctgttcttagcaaaggcctctggatcagcagataatccagcggtatcccatccataatcaccaggaaattctccttttaggtatgatggagtttgagcagagaatggacccaagtacttaactctgtctggtccgtaccacaaatcatttcctgccatggtgtattttccattacccatcgcaacgacatctctaagggaattaggactagagactctgttctgacccaaaaatggggaggttctaagaacagtagtggagttagctgccatcaaagttgacaccatttttcttcttcaagtactgtatttttttctgaactctaaggcagttcttagcacttggtttgaagttgtgttttaaagctgtgatggatgataagttgatgtgccagagagaactatatatacatgtatttgtg

SEQ ID NO: 2517 - DNA, 884 bp, Cynara scolymus
  misc_feature (138)..(138): n is a, c, g, or t
  misc_feature (141)..(142): n is a, c, g, or t
  misc_feature (730)..(730): n is a, c, g, or t
  misc_feature (820)..(820): n is a, c, g, or t
  misc_feature (850)..(850): n is a, c, g, or t
  misc_feature (876)..(876): n is a, c, g, or t
gcgggggagctttcctttcctcatcaatggcatccatggctgcgacaactgctgctagctccaccactgttgtcagagccaccccattcttgggtcaaaccagaccctccatgtcaactctcttagagactctgtctncanngtcaatggcaaattcaccatgggaaatgacttgtggtacggaccggaccgtgtgaagtacttgggacccttttcggctcagacaccatcgtacttgagcggcgaattcccgggtgactacggctgggacaccgctggcttatcagccgatcccgaggcttttgctaagaaccgagctcttgaggtgatccacggccgatgggcaatgctcggagcattgggatgcatcaccccagaagtcctcgaaaaatggttgaaagtcgatttcaaggagcccgtttggttcaaagccggagcccaaatcttctccgaaggcggtctagactacttaggcaaccctaacctcgtccacgcccaaagcatattagccgtcctcggttttcaagtcatcttaatgggccttgttgaagggttccgtatcaacgggctcgacggtgtcggagacgggaacaacctctacccgggaggtcagtatttcgaccctttgggccttgcggatgacccgttaacatttgccgaattaaaggtgaaggaaataaagaacgggaggctagcaatgttctcaatgttcggattcttcgttcaagcnatagtgaccggaaagggaccattggagaaccttttggaccatttggataaccctgtggctaacaatgcgtgggtctatgccaccaagttngtgcctggtcaaagtttatggtgtaaatgntatgaatttatgaaccaaacgggttntttccaaa

SEQ ID NO: 2518 - DNA, 905 bp, Flaveria ramosissima
taggggaagtacatacttgaacttcgtaagactttcgatacaatggcgtgctaactaccaccactcgttgttagagccacccctttcttaggtcaaaccagaggctccaatgtcaacgcccttagagattctgtctccatggtcaatggcaaatacaccatgggaaatgacttgtggtatggaccggaccgagtgaagtacttgggacccttttcggcccaaacgccatcatacttgacgggtgaattccccggtgattatggttgggataccgctggtttatctgctgatcccgaggcttttgctaagaaccgggctctcgaggtgatccacgggagatgggccatgttaggagcattcgggtgcatcactcccgaagtcctagaaaaatgggtgaaagtagatttcaaggagcccgtctggttcaaagccggagcccaaatcttctccgaaggcgggctagactatttgggcaacccgaacctagtccacgcccaaagcatactagcagtactcggtttccaagtggtcctaatgggcctcgtcgaagggttccgcattaacgggctcgagggtgtaggtgaaggtaacaacctctacccgggtggccagtactttgacccgttgggccttgcggatgacccggtcactttcgccgagctaaaagttaaggaaatcaagaatgggagactagcaatgttttcaatgtttgggttctttgtgcaagcaattgtaacaggaaaaggaccattggagaaccttttggaccatttggataaccctgtggctaacaatgcatgggtctatgccactaagtttgtccctggttcataaattatgtaactttttaattgttattgtaaattataagttggatgataaaattgaataaaaatattgttata

SEQ ID NO: 2519 - DNA, 986 bp, Flaveria ramosissima
gcatctttcacttaatttacaaccaccataacaaaccaccatctatggctgcagctgctagctccaccgtcggtccaagccacccccttccttgggtcaaaccagaccatctagccttaaccccttaagagatatggtctctatgcccagtgcaaaatacaccatgggaaatgacttgtggtatggacctgaccgtgttaagtacttgggacccttttcggctcaaaccccatcatacttgactggtgaatttcctggtgactacggttgggacactgctggtttgtccgctgatcccgaggctttcgccaagaacagggctcttgaggtgatccatggccgatgggccatgctaggagcactcgggtgcatcacacccgaggtccttgaaaagtgggtgaaagtggatttcaaggagcctgtttggttcaaagccggagcccagatattctcagaaggcggtttggactatcttgggaacccgaaccttgtccatgctcaaagcatattggcggttctcgggttccaggtggtcctaatgggcctcgttgaggggttccgtattaacgggcttgaaggggttggagatgggaacaatttgtatccgggcgggcaatacttcgacccattgggccttgcggatgacccggtgacctttgccgagttgaaggtgaaagagatcaagaacggtagattggctatgttttcgatgtttgggttctttgtgcaggcaatagtgaccggcaaaggcccgttggagaacctgctggaccatttggacaaccctgtggctaacaatgcttgggtctatgccaccaagtttgtgcctggctcttagacttttaccatcttgtaaccgcaagtttgggaagaaaatgtgtagattattataattagttctatataatatggtgtttattagatggtcttgtttatatgttgaactcacgtgaaagaaaaataattaatagttagaattatgatgt

SEQ ID NO: 2520 - DNA, 1182 bp, Sarracenia psittacina
tttctcactctctgcgaaagagaaaaccagtggtttttagggagctcggattccaattttgaagctttgaagaaacaacaatggcttcaatgttgatggcggcaacaaccggaaccggcactgtcgtcagaccaaccccatttctagggcaaatcaggggatcaactgccaatcctttcagagacgttgtttctatgggcactgccaaattcactatggggaacgaattatggtacggaccggacagagtgaagtacttgggacccttttcagctcaaactccgtcgtacctgaccggagaatttcctggcgattatggatgggacactgctggtttatctgccgatccagaggcttttgccaagaacagggctcttgaggtcatccacgggcggtgggcgatgcttggagccctaggttgcatcacccctgaagtccttcagaaatgggttaaagtagccttcaaagaaccagtttggtttaaagctggagctcaaatcttctcggaaggcggccttgactacttgggcaaccctaacctcgtccacgcccaaagcatcttggcggtgctcggcttccaggtcgttctgatgggccttgttgaggggttccgcatcaacggccttcctggagttggagaggggaacaacctctaccccggcggccaatacttcgaccctctcggcctcgccgatgacccggtcacctttgccgaactcaaggtgaaggagatcaagaatgggagactagccatgttctcaatgttcggcttctttgtccaagccattgtcaccggaaaaggccctctcgagaacctcttagaccaccttgacaaccctgtggctaacaatgcatgggtctatgccaccaagtttgtgcctggatcatgaactttcccaattaccaatttctttaatcttgtattggacaattggattgtgagaattgggaagattgtgtaaattgtcatagttccactttgctggatctgaaaagtttaggaaaggttgtgttgagcaattatgtactatggatttggtggaagttgctcattttgatggtgagaaactgttaaatatgcatatattcaacacaaatgttgctggaaagtctataagttgctaaatgtatacaaagttataaaaatcactataatcagataatatgagacatttagaaact

SEQ ID NO: 2521 - DNA, 5039 bp, Brassica rapa
gatttatttcattgctctttccaatagaaaaagcagcaaaagttgcagagaaaaaaatcatcattttctcacaagaaagaagaagaagaagagaatattagggtttacctcaggaaacgattcgtgtgctccgcttttcaaatcattttctcttcatccttcgtgcaagggaccagcaggctgtgtttgtttccccaaacgacgttcctcgttcactgcacctgtttgtgaaatttagggtttatgaagcgtggaaggctgcttgtccgttaaaagactccaaatgatgttatctgcgtcgctagcgaaaagctcgctagaggagatgctcgagtctctccggcagaaagatgagtgccaccagcagcctcgagatatccctccggcgcttccttctcgccctacctccagggctcgtcttccctccgctcgccgctcgcttccggccaactttagtgtttctagtgtcattgaagatcagaatcagagcgggagtgttgcttcttctaggcagcctgaagcggaagggaagaggaggaaagagaaggatttaagagttaagaggaagagtttcggaagcaagaagatgaggaggactggttatgtatcagagtctccttacgctgcagagaaggaggaagaggaagttgtgaaggtaactgctgctgctaaggttagtccggtggaggagcagaaacctgagtggaacgataatgttgactatttcattaaaaagaaacttcgagtttggtgccgggttgcaaatgggcagtggcagctggggaagatacagtctactgctgctgatacgtctcttgttatgttgtccactgcaaatgttgtggaagtgtctactgaagatctctttcctgcaaacccagatattctggaaggtgttgaaaaccttatacagcttagctatttaaatgaaccctctgttctttttaaccttcgtgtcagatactcgcaagacgttatttatagcaaagcaggaccggtgttgattgcggtcaatccgttcaagaacgttgacatatacggagatgatttcatttcagcttatcagaagaaggatgtggatgctcctcatgtatatgctgtggcaggtgcagcttatgatgagatgatgagagaagagaagaaccagtctataattataagtggagaaagtggtgctgggaaaactgagactgcgaaatttgcaatgcagtatttggcagctcttggtggaggcagctgtggagtagagtatgaaatcctcaagacaacttgcattctcgaagcctttggaaatgctaagacatcaagaaatgctaactctagcagatttggtaaactcatagaaattcattttagtgcaatgggaaagatatgtggagccaaacttgaaactttatcctttgaccagtcaagagtggttcagctgtgcaatggcgaaagatcctaccacatattttatgagttctgtgcaggtgcttcacctgttctcaaagagaggttgaagcttaaaacagcaagtgagtatacctacctaaaccagagtgattgcttgaccatcgaccgtgttgatgatgctcagaaatttcgcaagctacttgaagcttttgacattgttcaaatccctaaagaacatcaggagcgtgtgtttgcattgcttgcggcggtgttgtggctagggaatgtatctttccgagttactgacaacgaaaatcatgtggaggtggtcgcagatgaagctgtcaccaatgccgctatgttaatggggtgcaactcagaagagcttatggtggttttgtctacccgtaaacttcaagctggtacagattgtatttcaaaaaaactgacgttgcggcaggcaaccaacatgagggatggaatagcaaaatttatttatgcaagccttttcgactggcttgttgagcaaataaacattgcattagaagtcggtaaatcactcacagggagatctataagcatccttgatatatatgggtttgaatcatttaagaataatagctttgaacaattctgtataaactatgcaaatgaaaggttgcagcaacacttcaaccggcatttatttaaacttgaacaagaggaatatgaagaggatggaattgattggaccaaggtcgaatttgtagacaatcaagagtgcttagatctaattgaaaagaaacccattggtttattgaccctactagacgaggaatcaaattttccgaaagcaactgatttgacctttgcaaacaagctcaagcaacatttgaagaccaactcttgcttcaaaggagagagaggtcgagccttcagagttaatcattatgctggagaggttctctacgatacaaatgggtttttggaaaagaacagggatccgttgcctgctgatcttatcaatcttttatcatcatgcgactgccagttgctgaaattgttttctactaaaatgcgtggcaaatatcagaagccgcttatgttatcagactccacaaatcaaactgttgggactaagttcaagggtcaacttttcaagttgatgaacaagttggaaaacacaacccctcacttcattagatgcataaagccaaattcgaagcagcttcccagagtttatgaagaggatcttgtcctacaacagcttagatgttgtggcgtgttggaggttgttagaatatcaagatctggatatcctacacgtttgacacatcaagagtttgcaggaagatatggtttcctattgtcagacaaaaaggtctctcaggatcctttgagcgtatcaatcgctgttctgaaacagtatgatgttcatcctgaaatgtatcaagttgggtacacaaaactgtacctacgaactgggcaaattggtgtctttgaagataggagaaagaaagttcttcaaggcatagtgggattacaaaagcatctccgtggtcgcctgtctcgtgaatacttccaaaatatgagaaacggagcattggtacttcagtcatatgtacgaggtgaaaatggtagaagaatgtttgatactaaagcaaagatccatgcggtgtctgtttctgaagctagtgcaggagagttgactgcagtcataaacttgcaatctgcggtccgtggatggttgtctcggaaaagattcaacagtatgcaaagacagaaagaacttgtcgatgtgacgactaaatcaaagaggaaaggaggcaggagggtttcagaagacaaggatttgccggtagagcggttccaagttcaacaatcagctatgtctgatctccagaagcgggttttgaaatctgaagaagctttagtgcagaaggaagaagaaaacacagcattgagagatcagttgagacaatttgaggagagatggtcagagtatgaaataaagatgaagtcgatggaggacacttggcaaaaacaaatgtcatcgttgcagatgagtcttgctgctgctcgaaagagtctagctacagaaaacaatacaggtcaagcaggaggaagacaagacgcatcgatgtcacctttcggctatgactcggaggacacaatgtctactggaactcccggagtgagaactcccacaactaagttcagcaacgggaacactccagaactcagaatcagggaactcaacggaagtttgaacgcggttaatcatctagcaagagagtttgatcaaaggagactcaatttcgacgaagatgctagagctattgtggaggtgaaaggtggaccgcaggcaactccaaacgggcagcaacatccagaagatgagttcaagagattgaagctaagatttgagacatggaagaaagattacaaagctagattaagagagactaaagcaagactccatagtgataaaggtcgtcatcggaaatggtggggcaaaagaggctaaggggttttccaccactcgcttagggtttgtttgttgtattagtaaaacacaatcaccagatcattgtagattcagctgagatacatgtatttgttttggaactctttttttttatgtgcatagcaaatagagtgttgtaatttgcagaggaacaagaaaggttatgttcatatcatttcaaaggattacattttaagacttaaaaaaattaagcaccaggtacaaactttgttgcaaaagcccaagcattgttagcaacagggttatcaagatggtcaaggagattctctaaaggaccctttcctgtaacaatggcttgaacaaagaagccaaacattgagaacatagccaaccttccattcttgatttccttcaccttaagctcggcgaaagtaaccgggtcatccgcgagacccagcgggtcaaagtattgcccgcccgggtacaagtcattgccttcaccaacaccatcaagaccgttgatgcggaaaccttcaactaatcccattaggataacttggaagccaaggacggctaaaatgctttgggcgtggacaaggtttgggttgcctaagtagtccaaaccgccttcagagaagatttgtgaaccggctttgaaccagaccggctcttttaagtccacacggacccatttctgaagaacttcaggggttatgcaacctaatgctcccaacattgcccatctcccatggatcacctcaagagctctgttcttggcaaaggcttcagggtctgcggataaaccggcggtgtcccaaccatagtcgccgggaaactctccggtgaggtaagacggggtttggacggaaaacggtcctaggtacttaactctgtctggtccgtaccaaagatcatttcccttagtgtacttgggagatccgagagagacagcatcacgaagagggttgaaggtggagcctttagtctgtccaagaaatggtgttggggtcaaaacactgcttgagctcatgaatgttgaagccattgagtctctctaggattttgaacgtttgttttctctctgtggtgttgttcttcttctttgctgtttggtggagaattgatctaagggagtttgagttttaaagtgagtgttttgtggatgagaagacacggg

SEQ ID NO: 2522 - DNA, 882 bp, Elaeis guineensis
caacactaagcaaaaaagaaaagctcaagccgagagagacaatggcatcaacattcacgagctcaagcagtgttcttaccccaacaacattccttggccagactaaagcctcaagctttaacccccttcgtgatgttgtctctctcggatctcccaagtacactatgggaaatgatctttggtatggacctgacagagtgaagtacttaggacccttttccgttcaaactccgtcttacctcaccggagaattccctggcgattatggttgggacaccgccggtttatccgcagaccctgaagcctttgccaaaaacagagctcttgaggtgatccatgggagatgggcaatgttgggagcttttggttgcataacccctgaagttcttcaaaagtgggtccgtgtggacttcaaagaccagtctggttcaaagccggttcacaaatcttctccgaaggcggtttggactacttaggcaacccaaacctagtccatgctcagagcattttagccgtccttggcttccaagtcatcctcatgggtttggttgaaggtttccgcatcaacggtcttgatggtgttggcgaaggcaacgacttgtaccccggtgggcaatactttgacccgttgggtctcgctgatgatccagttacttttgctgagcttaaggtgaaagagatcaagaacggaagattggctatgttctctatgtttggcttctttgttcaagccattgttactggaaaaggtcctttggagaatctccttgaccatcttgacaaccctgttgctaacaatgcgtgggctttcgcaactaagtttgcacctggagcttaaatttcaagtcttgatgtgattcttgtaatgatatgaacataacc

SEQ ID NO: 2523 - DNA, 985 bp, Gossypium hirsutum
ctatccagctaaaatcaactgaatattttaaaaaaagaagagggttgcccccttctaactctgaaaggcaatggcttcaatgcttagctcaggaaccgtccttaggccaaccccatttcttggccaaaacagaaatgctaaccctctcagagatgttgtctccgtgggcactgccaaatacacaatgggaaatgaactgtggtatggaccagacagagtgaagtacttgggacccttttcagctcagattccatcctacttgaacggcgagttccctggtgactacggatgggacactgccggtttgtcagctgaccctgaggcctttgctaggaacagggctcttgaggtaatccatggaagatgggcaatgctgggagcactaggctgcatcaccccagaagtccttgagaaatggcttagagttgacttcaaggaaccagtatggttcaaggcaggagctcaaattttctcagaaggtggcttggactacctaggcaaccccaaccttgttcatgctcaaagcattctcgctgtcctcgggttccaggttgtcctcatgggactagtcgaaggattccgcatcaatggtctccctgaagtcggggaaggcaatgacctttaccctggtggccaatactttgaccctcttggtcttgctgataaaccctgtcacatttgctgaacttaaggttaaggaaatcaagaatggcaggctagccatgttctctatgtttggtttcttcgttcaagccattgtcattagcaaaggtccactggaaaatcttttggaccaccttgacaaccctgttgccaacaatgcttgggtctatgctaccaagtttgtgcctggatcgtaaattaacagccccggatcgaacttgttccattatttgcttgtatctatcctctatgtacctgtagatttcgcatcactctgaaattttaaacctgtatcactaagaagtcaatgaaattcatgatc

SEQ ID NO: 2524 - DNA, 853 bp, Flaveria ramosissima
gctaactccaccactgttgttagagccacccctttcttaggtcaaaccagaggctccaatgtcaatgcccttagagattctgtctccatggtcaatggcaaatacaccatgggaaatgacttgtggtatggaccggaccgagtgaagtacttgggacccttttcggcccaaacgccatcatacttgacgggtgaattccccggtgattatggttgggataccgctggtttatctgctgatcccgaggcttttgccaagaaccgggctctcgaggtgatccacgggagatgggccatgttaggagcattcgggtgcatcactcccgaagtcctagaaaaatgggtgaaagtagatttcaaggagcccgtctggttcaaagccggagcccaaatcttctccgaaggcgggctagactatttgggcaacccaaacctagtccacgcccaaagcatactagcagtactcggtttccaagtggtcctaatgggcctcgtcgaagggttccgcattaacgggctcgagggtgtaggagaaggtaacaacctctacccgggtggccagtactttgacccgttgggccttgcggatgacccggtcactttcgccgaactaaagtgaaggaaatcaagaatgggagactagcaatgttttcaatgtttgggttctttgtgcaagcaattgtaacaggaaaaggaccattggagaaccttttggaccatttagataaccctgtggctaacaatgcatgggtctatgccactaagtttgtccctggttcataaattatgtaactttttaattgttattgtaaattataagttggatgataaaattgaataaaaatattgttata

SEQ ID NO: 2525 - DNA, 815 bp, Flaveria ramosissima
actgttgttagagccacccctttcttaggtcaaaccagaggctccaatgtcaatgcccttagagattctgtctccatggtcaatggcaaatacaccatgggaaatgacttgtggtatggaccggaccgagtgaagtacttgggacccttttcggcccaaacgccatcatacttgacgggtgaattccccggtgattatggttgggataccgctggtttatctgctgatcccgaggcttttgccaagaaccgggctctcgaggtgatccacgggagatgggccatgttaggagcattcgggtgcatcactcccgaagtcctagaaaaatgggtgaaagtagatttcaaggagcccgtctggttcaaagccggagcccaaatcttctccgaaggcgggctagactatttgggcaacccgaacttagtccacgcccaaagcatactagcagtactcggtttccaagtggtcctaatgggcctcgtggaagggttcgcattaacgggctcgagggtgtaggtgaaggtaacaacctctacccgggtggccagtactttgacccgttgggccttgcggatgacccggtcactttcgccgagctaaaagtgaaggaaatcaagaatgggagactagcaatgttttcaatgtttgggttctttgtgcaagcaattgtaacaggaaaaggaccattggagaaccttttggaccatttggataaccctgtggctaacaatgcatgggtctatgccactaagtttgttcctggttcataaattatgtaactttttaattgttattgtaaattataagttggatga

SEQ ID NO: 2526 - DNA, 822 bp, Heritiera littoralis
gagacagcccttcgactctgagagacaatggcttcgatgcttagccctggaactgtccttaggcccaaccccatttcttggccagaacagaacctcaaatgctaacgccctcaaagatgttgtctctatgggcaatggcaaatacacaatgggaaatgaattgtggtatggaccggacagagtgaagtacttgggacccttttcagctcagactccatcatacttgactggtgagttccctggtgactatggttgggacactgctggtttgtcagctgatcctgaggcctttgccaggaacagggctcttgaggtgatccatggaagatgggcaatgttgggggcactaggctgcatcaccccagaagtccttgagaaatgggttagagtgaacttcaaggaaccagtgtggttcagggctggagctcaaattttctccgaaggtggcttggactacctaggcaaccccaaccttgttcatgctcaaagcattctggctgtccttggattccaggtcgtcctcatggggctggttgaaggattccgcatcaacggtctccccggggtcggggtaggcaaggcctttaccctggtggccgatactttgaccctcttggccttgccgatgaccctgtcacatttgctgaactcaaggtgaaagaaatcaagaatggcaggctagccatgttttccatgtttggtttctttgtccaagccattgtcaccggaaaaggtcccctgagaacctcttggaccaccttgacaaccctgttgccaacaatgcttgggtctatgctactaagtttgtgcctggatcgtaag

SEQ ID NO: 2527 - DNA, 882 bp, Brassica juncea
cccttagatctaacacttcaccaaacagtaaagaataataacaaaaccacatagaaacaaaccgctcaatccaagagagaagaatgacttcaacattgacgacctcaagcagtgttctgtgcccaacaacattccttggccagactagaagctccagctttaaccctcttcgtgatgttgtctctctcggctctcccaaatacactatgggaaatgatctttggtatggaccagacagagtgaagtacttaggacccttttccgtccaaactccatcttacctcacaggagagtttcccggagactacggttgggatacggccggtttatctgcagaccctgaagcctttgccaaaaacagagctcttgaggtgatccatgggagatgggcaatgttgggagcatttggttgcataacccctgaagttcttcagaaatgggtccgtgtggacttcaaagagccggtctggttcaaagccggttcacaaatcttctccgaaggcggtttggactacttaggcaacccaaacctagtccacgctcagagcattttagccgtacttggcttccaagttatcctaatgggattagttgaaggtttccgcatcaacggtcttgatggtgttggtgaaggcaatgacttgtacccgggcgggcaatactttgacccgctgggtctcgcggatgacccggttactttcgccgagcttaaggtgaaggaaatcaagaatggaaggttggctatgttctcaatgtttggcttctttgttcaagccattgtaactggaaagggtcctttagagaatctccttgaccatcttgataaccctgttgctaacaatgcttgggcttttgcaacaaagtttgtacctggtgcttgat

SEQ ID NO: 2528 - DNA, 918 bp, Brassica juncea
accaaatagcaacgaataataacaagaccacagagaaaacaaacgctcaatacaagagagaacaatggcgtcaacattcacgagctcaagtagtgtgttgtgcccaacaacattccttggccagactaaaagctccagctttaaccctcttcgtgatgttgtctctctcggatctcccaaatacactatggggaatgatctttggtatggaccagacagagtgaagtacttaggtcccttttctatccaaactccgtcttacctcaccggagagtttcccggagactatggttgggacactgccggtttatccgcagaccctgaagcctttgccaaaaacagagctcttgaggtgatccatgggagatgggcaatgttgggagcattaggttgcataacccctgaagttcttcagaaatgggtccgtgtggacttcaaagagccggtctggttcaaagccggttcacaaatcttctctgaaggcggtttggactacttaggcaacccaaacctagtccacgctcagagcattttggccgtccttggcttccaagttatcctaatgggattagttgaaggtttccgcatcaacggtcttgacggtgttggtgaaggcaatgacttgtacccgggcgggcaatactttgacccgctgggtctcgcggatgatccggttactttcgccgagcttaaggtgaaggaaatcaagaatggaaggttggctatgttctcaatgtttggcttctttgttcaagccattgttacaggaaagggtcctttagagaatctccttgaccatcttgataaccctgttgctaacaatgcttgggcttttgcaacaaagtttgtacctggtgcttgattttttttaagtcttaaaatgtaatccttttgaaatgatatgaacaaaacctttct

SEQ ID NO: 2529 - DNA, 1984 bp, Amborella trichopoda
ctttttttcctttttttttaattttttatattttgtgaggcctgcgtaactcaaccaagtcagctccccccaaagtttgagtacttttcggcattggccaaggcgagctttaaaacattgcatattattaatcattttgaactcaagaggacccgcattattgactttttaaatctaattttataaattattatttacaataaaaaataacaaataaagattaaacaataatcatatatggcccagtaaacgttctataattctcatcagttcttacttccaatggttgataacaattatggtatccttataccaaaacaaataatcttgttatatatatttccataaaaatattaatgatgatcactaagattttaatagcaatggaaaactatggaaaacattgcaaaatagtagcattattgagcaggccaaatagattgcacataagctttgcaagggaaaatgagaaaaaaggatagagcatatgcggataaaaggatatgggaaaagatgctcaatatcctttaaagccttcccattggttctcatcctcacgacccatcttaaccacacgttgcgcaaaatcttctccaccgctccttcctctacaaacaaacctctctattcgtcgagcacaaccccaattcctaggtagagagagagagagagagatggctgctacagtgggcaccagcagtgtggtaagaccatcaacctttctccttggacaggggaagacactcagtcctctcagggacaacatctcttttggcaatggaaggtttaccatgggaaatgatctatggtatggaccagaccgtgtcaagtacttgggacccttttcggcacaaaccccttcgtatctcaccggagaatttcccggtgactacggatgggacactgccggcctgtctgcggatcctgaagcctttgcaagaaacagagctcttgaggtgattcacgggagatgggcaatgctcggtgcccttgggtgtataacacccgaggtgctccaaaagtgggtcaaggttcagcttaaggagccagtgtggttcaaggcaggagcccaaatcttcagtgaaggcggtctcgactacttgggcaaccccaacttggtccatgcacaaagcatcttagcggtcctagggttccaagtcgtgctcatgggcttggtcgagggctatcgcatcaatggcctcccaggtgttggtgaaggcaacaacctttaccctggaggaacctacttcgacccacttggccttgctgatgatcctatcacttttgctgagctcaaggttaaggagatcaagaatgggaggcttgctatgttctcaatgttcggtttctttgttcaagccatagtgactggaaagggtccattggagaacctcttggatcaccttgagaaccctgtggctaacaatgcttgggtttatgccaccaagtttgtgccaggttcttagattgctagtgcagcagcatccacaagtgtcattgtgaagtgtccatttgattccccctaatttgtgtgtgtgtgggtgtgtgtcggtgtattggttttgtaactatgatggtatctcacatataatcatgtagtaatgtgaatgtagtatttagattttgattttgaggggaaagtatgagcatccaatacatttgacaaatttggttaatttttttttaaaaaagagaggtggcatcttcctgtattagcaaccattgcatttgtttcaacggagaagcggggatctaccttcttaatagttaaggaacacacagtaatgcaaatgatatatcagttaaaaaaagaaaagctaattatatttgttcgggcattttggacaaactttcaagggtttgaacctttacccaaattgatgtgtctaccaatatgctgaagcccaagggacagagagagagagagaagatcagtagcatgcacctacaggttgagccatatattgggaaatcctgagaaacc

SEQ ID NO: 2530 - DNA, 1017 bp, Amborella trichopoda
gtctggagagatggctgctacagtgggcaccagcagtgtggtaagaccatcaacctttctccttggacaggggaagacactcagtcctctcagggacaacatctcttttggcaatggaaggtttaccatgggaaatgatctatggtatggaccagaccgtgtcaagtacttgggacccttttcggcacaaaccccttcgtatctcaccggagaatttcccggtgactacggatgggacactgccggcctgtctgcggatcctgaagcctttgcaagaaacagagctcttgaggtgattcacgggagatgggcaatgctcggtgcccttgggtgtataacacccgaggtgctccaaaagtgggtcaaggttcagcttaaggagccagtgtggttcaaggcaggagcccaaatcttcagtgaaggcggtctcgactacttgggcaaccccaacttggtccatgcacaaagcatcttagcggtcctagggttccaagtcgtgctcatgggcttggtcgagggctatcgcatcaatggcctcccaggtgttggtgaaggcaacaacctttaccctggaggaacctacttcgacccacttggccttgctgatgatcctatcacttttgctgagctcaaggttaaggagatcaagaatgggaggcttgctatgttctcaatgttcggtttctttgttcaagccatagtgactggaaagggtccattggagaacctcttggatcaccttgagaaccctgtggctaacaatgcttgggtttatgccaccaagtttgtgccaggttcttagattgctagtgcagcagcatccacaagtgtcattgtgaagtgtccatttgattccccctaatttgtgtgtgtgtgggtgtgtgtcagtgtattggttttgtaactatgatggtatctcacatataatcatgtagtaatgtgaatgtagtatttagattttgattttgaggggaaagtatgagcatccaatacatttgacaaatttggttaattttt

SEQ ID NO: 2531 - DNA, 944 bp, Brassica juncea
gatccacaaaacactcactttaaaaagcaaagctccctgatatcaattctccaccaaacagcaaagaagaagaactacaccacagagaaaacaaaacgctccgtccgagagagagagagagcaatggcttcaacattcacaagctcaagcagtgttctgacccaaacaccatttcttggacagactaaaggctccaccttcaaccctcttcgtgatgttgtctctctcggaactcccaaatgcactatggggaacgatctttggtacggaccagacagagtaaagtacttaggaccattttccgtccaaaccccgtcttacctcaccggagagtttcccggcgactatggttgggacaccgctggtttatcagcagatcctgaagcctttgccaagaatagagctcttgaggtgatccatggcagatgggcaatgttgggagcattcggttgcataacccctgaagttcttcagaaatgggtccgtgtggacttcaaggagccggtctggttcaaagccggttcacaaatcttctccgaaggaggtttggactacttaggcaacccaaacctagtccacgcccaaagcattttagccgtccttggcttccaagttatcctaatgggattagttgaaggtttccgcatcaacggtcttgatggtgttggtgaaggcaatgatttgtacccgggcgggcaatactttgacccactgggtcttgcggatgatccagttaccttcgctgagctcaaggtgaaggagatcaagaatggaaggttggctatgttctcaatgtttggcttctttgttcaagccattgttacaggaaaaggtcccttggagaatctccttgaccatcttgataaccctgttgctaacaatgcttgggcttttgctacaaagtttgtacctggagcttgaatttttttaaagtctcgatgtaa

SEQ ID NO: 2532 - DNA, 1197 bp, Brassica juncea
caatatcccatatctgattctcccgtgtcttctcatccacaaaacactcactttaaaactcaaactcccttagatcaattctccaccaaacagcaaagaagaagaactacaccacagagaaaacaaaacgctccgtccgagagagagagagagcaatggcttcaacattcacaagctcaagcagtgttctgacccaaacaccatttcttggacagactaaaggctccaccttcaaccctcttcgtgatgttgtctctctcggaactcccaaatgcactatggggaacgatctttggtacggaccagacagagtaaagtacttaggaccattttccgtccaaaccccgtcttacctcaccggagagtttcccggcgactatggttgggacaccgctggtttatcagcagatcctgaagcctttgccaagaatagagctcttgaggtgatccatggcagatgggcaatgttgggagcattcggttgcataacccctgaagttcttcagaaatgggtccgtgtggacttcaaggagccggtctggttcaaagccggttcacaaatcttctccgaaggaggtttggactacttaggcaacccaaacctagtccacgcccaaagcattttagccgtccttggcttccaagttatcctaatgggattagttgaaggtttccgcatcaacggtcttgatggtgttggtgaaggcaatgatttgtacccgggcgggcaatactttgacccactgggtcttgcggatgatccagttaccttcgctgagctcaaggtgaaggagatcaagaatggaaggttggctatgttctcaatgtttggcttctttgttcaagccattgttacaggaaaaggtcccttggagaatctccttgaccatcttgataaccctgttgctaacaatgcttgggcttttgctacaaagtttgtacctggagcttgaatttttttaaagtctcgatgtaatcctttgaaatgatatgaacataaaccttttcttgttcctctgcaaattacaacactctaattgatatgcacatataaagtccaaaacaaatacatatctctcagctgaatctacaatgatcttactctaacgttttgtgattgtgttactaatacaacaaacaaacctaagagagtggtggaaaccccttagcctcttttgccccaccatttccggtgac

SEQ ID NO: 2533 - DNA, 990 bp, Coffea canephora
ttcacaagattttcttccgagacagctacataaaacagggaaccacccagcctaaggtttaggggaaaattagcatcaacatccatggcggctgccgccggctccagcaccgttgtggttagagcaaccccattcttggggcaacccaaaaatgccaacccacttcgagaagttgtctccatgggcaacggcaaatacaccatgggtaatgaactttggtacggaccggaccggttgaagtatttaggacccttttcagctcagaccccttcctacttgactggtgaatttccaggtgactacggatgggatactgctggtttatctgctgatcctgaggcttttgccaggaaccgagctctcgaggttattcacggtaggtgggctatgctcggagcactgggatgcatcaccccagaagtccttgagaaatatcttaaagtggactttaaggagccagtgtggttcaaagccggagcacaaatcttctcagaaggtgggcttgactacctgggaaaccctaaccttgtccatgctcagagcattctggcagtgctcggcttccaagttgtcctcatgggtcttgttgaggggtatagaatcaatggtcttgaaggcgtcggagagggcaatgatctctaccccggtggccagtactttgatcctcttggcctagccgatgaccctgctacatttgctgagcttaaggtgaaggaaatcaagaatggaaggcttgcaatgttctccatgttcggcttctttgtccaagctattgtcactggcaaaggccctcttgaaaatctcttggaccatcttgacaacccagttgctaacaatgcctgggtctatgccaccaagtttgtccccggatcgtaaatttttcttactttgtctcgactaaaatttgtgaatggaaacttgtttattaatttatatttattttgcccgaccgtatgtaaagtaaagcgattgagctcatgtaccgtcacg

SEQ ID NO: 2534 - DNA, 764 bp, Flaveria ramosissima
aatattgttagagccacccctttcttaggtcaaaccagaggctccaatgtcaatgcccttagagattctgtctccatggtcaatggcaagttcaccatgggaaatgacttgtggtatggaccggaccgagtgaagtacttgggacccttttcggcccagacaccatcatacttgactggtgaattccctggtgattatggttgggacaccgctggtttatctgctgatcccgaggcttttgccaagaaccgggctctcgaggtgatccacgggagatgggccatgttaggagcattcgggtgtatcacccccgaagtcctagaaaaatgggtgaaagtagatttcaaggagcccgtctggttcaaagccggagcccaaatcttctccgaaggcgggctagactatttgggcaacccgaacctagtccacgcccaaagcatactagcagtactcggtttccaagtggtcctaatgggcctcgtcgaagggttccgcattaacggcctcgagggtgtaggagaaggtaacaacctctacccgggtggccagtactttgacccgttgggccttgcggatgacccggtcactttcgccgagctaaaagtgaaggaaatcaagaatgggagactagcaatgttttcaatgtttgggttctttgtgcaagcaattgtaacaggaaaaggaccactggagaaccttttggaccatttggacaaccctgtggctaacaatgcatgggtctatgccaccaagtttgtccctgg

SEQ ID NO: 2535 - DNA, 820 bp, Flaveria ramosissima
ctgttgttagagccacccctttcttaggtcaaaccagaggctccaatgtcaacgcccttagagattctgtctccatggtcaatggcaaatacaccatgggaaatgacttgtggtatggaccggaccgagtgaagtacttgggacccttttcggcccagacaccatcgtacctgaccggtgaattccctggtgattatggttgggacaccgctggtttatctgctgatcccgaggcttttgccaagaaccgggctctcgaggtgatccacgggagatgggccatgttaggagcattcgggtgcatcactcccgaagtcctagaaaaatgggtgaaagtagatttcaaggagcccgtctggttcaaagccggagcccaaatcttctccgaaggcgggctagactatttgggcaacccgaacctggtccacgcccaaagcatactagcagtactcggtttccaagtggtcctaatgggcctcgtcgaagggttccgcattaacgggctcgagggtgtaggtgaaggtaacaacctctacccgggtggccagtactttgacccgttgggccttgcggatgacccggtcactttcgccgaactaaaagtgaaggaaatcaagaatgggagactagcaatgttttcaatgtttgggttctttgtgcaagcaattgtaacaggaaaaggaccattggagaaccttttggaccatttggataaccctgtggctaacaatgcatgggtctatgccactaagtttgtccctggttcataagttatgtaactttttaattgttattgtaaattataagttggatgataaaa

SEQ ID NO: 2536 - DNA, 830 bp, Flaveria ramosissima
tgttgttagagccacccctttcttaggtcaaaccagaggctccaatgtcaacgcccttagagattctgtctccatggtcaatggcaaatacaccatgggaaatgacttgtggtatggaccggaccgagtgaagtacttgggacccttttcggcccaaacgccatcatacttgacgggtgaattccccggtgattatggttgggataccgctggtttatctgctgatcccgaggcttttgctaagaaccgggctctcgaggtgatccacgggagatgggccatgttaggagcattcgggtgcatcactcccgaagtcctagaaaaatgggtgaaagtagatttcaaggagcccgtctggttcaaagccggagcccaaatcttctccgaaggcgggctagactatttgggcaacccgaacctagtccacgcccaaagcatactagcagtactcggtttccaagtggtcctaatgggcctcgtcgaagggttccgcattaacgggctcgagggtgtaggtgaaggtaacaacctctacccgggtggccagtactttgacccgttgggccttgcggatgacccggtcactttcgccgagctaaaagtgaaggaaatcaagaatgggagactagcaatgttttcaatgtttgggttctttgtgcaagcaattgtaacaggaaaaggaccattggagaaccttttggaccatttggataaccctgtggctaacaatgcatgggtctatgccactaagtttgttcctggttcataaactatgtggcttcttaattgttattgtaaattataagttggatgataaaattgaataaaaa

SEQ ID NO: 2537 - DNA, 984 bp, Nuphar advena
  misc_feature (157)..(157): n is a, c, g, or t
  misc_feature (187)..(187): n is a, c, g, or t
  misc_feature (511)..(511): n is a, c, g, or t
  misc_feature (671)..(671): n is a, c, g, or t
  misc_feature (680)..(680): n is a, c, g, or t
  misc_feature (693)..(693): n is a, c, g, or t
gctttttatttgcttcaacttgtgaactccataccaccaccagagtctgcaggaagagtggagaagcaaagacagagagaaagggaacaacaaaaatggcctccactttagcctctgccaggtctgggaccattgtgaagaccccatttctaggccnagcaagaagctccaatgccaaatctctcanagaccttgtttcctttggaaatggaaaattcacaatgggaaatgagctgtggtatggtccagacagagtgaagtacctgggtcccttctcagcacagaccccatcttacttgactggagagttccctggggactacggatgggacacagccggattatctgcagacccagaagcctttgctaagaacagagctctggaggtgatccatggtaggtgggcaatgctcggcgcattgggctgcatcacacctgaggtcctgcagaagtgggtgaaggtgcagttcaaagagccagtgtggttcaaagcaggagctcagatcttctntgaaggtggccttgactacttgggcaacccaaaccttgttcatgctcagagcattctagcagtgcttggcttccaagtcatcctcatgggccttgtcgagggattccgcatcaatggtctccctggtgtaggagaaggcaacaatctgtaccctggtggncaatacttngaccctcttggtnttgctgatgaccctgtcaccttttttgagcttaaagtgaaagaaatcaagaatggccgattagccatgttttccatgtttggcttctttgttcaggccattgttaccggaaaaggtccgcttgaaaacctcctggaccaccttgacaacccagttgctaacaatgcttgggtttatgctaccaaatttgttcctggcttttaaacttgataaaaccttgcatctttaagaatgtgaatttgttgatatgtatgggcatcaaattatttgagactgtaataatcagatagct

SEQ ID NO: 2538 - DNA, 929 bp, Raphanus sativus
  misc_feature (18)..(18): n is a, c, g, or t
ggacccaaacagcacagnacagaacaagaaaaacaccacagagaaaatcaacgctcaaaatctcagagagagcaatggcatcaacattcacaagctcaagcagtattctgagcccaacaccatttcttggccagaccaaaggctccacgttcaaccctcttcgtgatgttgtctctctcggaactcccaaatacactatgggcaatgatctttggtacggaccagacagagtgaagtacttgggaccattttccgtccaaaccccgtcttacctcaccggagagtttcccggcgactatggttgggacaccgccggtttatccgcagaccctgaagcctttgccaagaacagagctcttgaggtgatccatgggagatgggcaatgttgggagcactaggttgcataacccctgaagttcttcagaaatgggtccgtgtggacttcaaggagccggtctggttcaaagccggttcacaaatcttctctgaaggaggtttggactacttaggcaacccaaacctagtccatgcccaaagcattttagccgttcttggcttccaagttatcctaatgggattagttgaaggtttccgcatcaacggtcttgatggtgttggtgaaggcaatgacttgtacccaggcgggcaatactttgacccactgggtctcgcagatgatccagttaccttcgctgagctcaaggtgaaggagatcaagaatggaaggttggctatgttctcaatgtttggcttctttgttcaagccattgttactggaaagggtcccttggagaatctccttgaccatcttgataaccctgttgctaacaatgcttgggctttcgcaacaaagtttgtacctggagcttgatttgatgtaatcctttgaaatgatatgaacataaaccttctcttgttcctctgcgga

SEQ ID NO: 2539 - DNA, 902 bp, Raphanus sativus
acagaacaagaaaaacaccacagagaaaatcaacgctcaaaatctcagagagagcaaatggcatcaacattcacaagctcaagcagtattctgagcccaacaccatttcttggccagaccaaaggctccacgttcaaccctcttcgtgatgttgtctctctcggaactcccaaatacactatgggcaatgatctttggtacggaccagacagagtgaagtacttgggaccattttccgtccaaaccccgtcttacctcaccggagagtttcccggtgactatggttgggacaccgccggtttatccgcagaccctgaagcctttgccaagaacagagctcttgaggtgatccatgggagatgggcaatgttgggagcattaggttgcataacacctgaagttcttcagaaatgggttcgtgtggacttcaaggagccggtctggttcaaagccggttcacaaatcttctcagaaggcggtttggactacttaggcaacccaaacctagtccatgcccaaagcattttagccgttcttggcttccaagttatcctcatgggattagttgaaggtttccgcatcaacggtctagatggtgttggtgaaggcaatgacttgtacccgggcggacaatactttgacccgctgggtctcgcggatgatccagttaccttcgctgagctcaaggtgaaggagatcaagaatggaaggttggctatgttctcaatgtttggcttctttgttcaagccattgttactggaaagggtcccttggagaatctccttgaccatcttgataaccctgttgctaacaatgcttgggctttcgcaacaaagtttgtacctggagcttgatttgatgtaatcctttgaaatgatatgaacataaaccttctcttgtt

SEQ ID NO: 2540 - DNA, 1084 bp, Triphysaria pusilla
acacaattccctttcctcttgcgcataaaaacttgcctcatcaccaccactaatttcagtcactccaaactccacacacatccatattacacagaagaaccataatcaatggctgcaactgctagctcaacctctcttgttattagggcaaccccattcttgggcaacaccaagaatgccattaatcctcttagagatgttgtctccatgggaaatgctaaatacaccatgagtaatgatttgtggtacgggccagaccgggtcaagtttttgggcccattttctgctcagactccgtcttacctgaacggagagttccccggcgactacggttgggacactgctggtttgtctgctgatcctgaggcttttgccaaaaacagggctcttgaggtaattcacgggagatgggccatgctaggagcgctcgggtgcataaccccagaggttcttgagaaatgggtgagtgttgatttcaaggagccagtttggttcaaggccggagcccaaatattctcagaaggtgggctcgactacttgggcaacccaaatctcgtccacgctcagagcatcctggccgtactcgggttccaagttgtgctgatgggacttgtcgaaggtttcagaatcaatggtctggatggagtcggagatggcaacgatctttacccaggcggacagtatttcgacccactcggcctggctgatgacccagtcacttttgccgagcttaaggtgaaggaaattaagaatggaaggctagctatgttttccatgttcggtttcttccttcaggctatcgtaaccggaaaagggcctttggaaaatttgttggaccaccttgataaccctgttgcaaataatgcatgggtatatgccaccaagtttgtccctggatcctaagtattttttttcatgctttgtatcattgttgatattattgtaacctgaattattcaatccaatcagaagattttcttgtatcattgttgaaattattgtaacctgaattattcaatccaatcagaagattttcttgttcttgcaatgaaacttcatgtaatataatatgggtagtttacag

SEQ ID NO: 2541 - DNA, 865 bp, Brassica juncea
gccaccaaacagcaaagaagaagaactacaccacagagaaaacaaaaacgctccgtccgagagagagagagcaatggcttcaacattcacaagctcaagcagtgttctgacccaaacaccatttcttggacagactaaaggctccaccttcaaccctcttcgtgatgttgtctctctcggctctcccaaatacactatgggaaatgatctttggtatggaccagacagagtgaagtacttaggacccttttccgtccaaactccatcttacctcaccggagagtttcccggagactatggttgggacacggccggtttatctgcggaccctgaagcctttgccaaaaacagagctcttgaggtgatccatgggagatgggcaatgttgggagcatttggttgcataacccctgaagttcttcagaaatgggtccgtgtggacttcaaagagccggtctggttcaaagccggttcacaaatcttctccgaaggcggtttggactacttaggcaacccaaacctagtccacgctcagagcattttagccgtacttggcttccaagttatcctaatgggattagttgaaggtttccgcatcaacggtcttgatggtgttggtgaaggcaatgacttgtacccgggcgggcaatactttgacccgctgggtcttgcagatgacccagttacttttgctgagctcaaggtgaaagaaatcaagaatggaaggttggctatgttctcaatgtttggcttttttgttcaggctattgttaccgggaaaggtcctttggagaatctccttgaccatcttgataaccctgttgctaacaatgcatgggcttttgcaacaaagtttgtacctgga

SEQ ID NO: 2542 - DNA, 807 bp, Capsicum annuum
agggagaaattaagaaagagaggaaatggcagcaacaagcagttcagccagtgttgttagagcaactccattcttgggccagaccaaatatgctaaccctcttagagatgttgtttccatgggctcaggcaaattcactatgagcaatgatttgtggtatggacctgaccgtgtcaagtacttgggaccattttctgctcaaactccttcatacttaaccggagaattccccggtgattacggatgggacactgctggtttatctgctgatcctgaggcctttgccaagaacagagctcttgaggtcatccatgggagatgggccatgctaggggcatttggttgtattacaccagaagttcttgagaaatgggtgaaagtggacttcaaggagccagtatggttcaaagcaggagcccaaatcttcagtgaaggtggactggactatttgggcaacccaaaccttgtccatgctcaaagcattctagcagtattgggcttccaagtagtgctaatgggtcttgtagaaggtttcagaattaatgggcttcctggagttggcgaaggcaatgatctctacccaggtggccagtactttgacccactgggcctagcagatgacccaacaactttcgcggagctcaaagttaaggagatcaagaatggaagattggctatgttctccatgtttggattctttgttcaagctattgtcactggcaaaggcccacttgagaacctcttggatcaccttgacaaccctgttgctaacaatgcatgggtttatgcaactaagtttgttcctgg

SEQ ID NO: 2543 - DNA, 979 bp, Nicotiana benthamiana
  misc_feature (12)..(12): n is a, c, g, or t
ttacggccgggnaaatgtgaagtccaagagaaattattaagaaagaaagagagaatggcatcaatggcagcaaccggcagctccgccactgttgttagagcaactccattcttgggccagaccaaatatgccaatcctcttagatatgtagttccaatgggctctgccaaattcaccatgagtaatgaattgtggtatggacctgaccgtgtcaagtacttgggacccttttctgctcaaactccttcctacttgactggagaattccctggtgattacggatgggacacagccggtttatcagctgatcctgaggcctttgccaagaacagagctcttgaggtcatccatgggcgatgggccatgcttggggcactaggttgcatcaccccagaagtccttgagaaatgggtgaaagtggactttaaagaaccagtatggttcaaagctggagcccaaatctttagtgaaggaggactggactatttgggcaacccaaaccttgtccatgctcagagcattctagcagtgttgggcttccaagtagtgctaatgggccttgtagaaggtttcagaattaatgggcttcctggagttggtgatggcaacaatctctacccaggtggccagtactttgacccacttggtctagctgatgatccaactacttttgccgagctcaaggttaaggagatcaagaatggaagattggctatgttctccatgttcggattcttcgttcaagctattgtcactggcaaaggccctcttgagaaccttttggatcaccttgacaaccctgttgctaacaatgcatgggtttatgcaacaaagtttgttcctggatcttaaattttacattgtgacttcctccacaagaggcttgtaccattgattcattcagaatgcaaatatttggcagatgaaaactattttaccatgtgataaaatactctttaagcccccagcatttcattta

SEQ ID NO: 2544 - DNA, 1006 bp, Euphorbia esula
  misc_feature (226)..(226): n is a, c, g, or t
caacacaaataactcaagtaaacaaggcaataatggcatcaactctaatggcagcaactgctatctcaagctcagtactaaggcctactcctttttttggccaaagaggctcaacttctaaccctcttagagatgttgtctccttgggaaattccaaatacattatggggaatgagttgtggtatggaccagacagagtaaaatacttaggacccttttcagcacngactccttcatatcttagtggagaatttccaggtgattatggttgggataccgctggtttgtctgctgatcctgaagcctttgccaagaacagggctcttgaggtaatccatggaagatgggcaatgctaggagcattagggtgcataaccccagaagtactagaaaaatgggtaaaagtggacttcaaagagccagtgtggttcaaagcaggagctcaaatattctcagaaggtggattggactatctaggaaaccctaatctagtccatgcccaaagcattctagcagtgcttggtttccaagtgatcctaatgggccttgttgaaggcttcagaatcaatgggcttgaaggagtaggagagggcaatgacctttacccaggtggtcaatactttgacccacttggacttgctgatgatcctgtcacttttgctgagctcaaggttaaggagatcaagaatggaaggctagccatgttttctatgtttggtttctttgttcaagctattgtcactggaaaaggtcctcttgagaatcttttggaccatcttgatgaccctgttgctaataatgcttgggtttatgctactaagtttgtccctggttcataattaaaccaatttatgttatggttctacatttgttttgttgagatcctacttgtaaatttccatctaatgacaaatgcatgccttaatatatttgatgttgtgtttctcttttagcttgaaatccaaggaaagtggttgaaatgataataatacttgctacttaagtg

SEQ ID NO: 2545 - DNA, 932 bp, Allium cepa
  misc_feature (49)..(49): n is a, c, g, or t
  misc_feature (116)..(116): n is a, c, g, or t
  misc_feature (149)..(149): n is a, c, g, or t
  misc_feature (242)..(242): n is a, c, g, or t
  misc_feature (245)..(245): n is a, c, g, or t
  misc_feature (507)..(507): n is a, c, g, or t
  misc_feature (668)..(668): n is a, c, g, or t
taactgtattaacttattcatagaagaagagatctaagtacatagtgcngatggctgcggcggcttcaacaattgtctcacccttccttgttggccaatctcgtgtctccgccgcntcccagcttcgcaatgttgcctccatgggcaanggaaagttcaccatgggaaacgagctatggtacggcccagacagagtgaagtacctgggcccattctcagcccaaacaccatcctacctaacnggngaattcccaggagactacggatgggacacagcagggctatcagcagacccagaagccttcgccagaaaccgagccctggaagtgatccacgggaggtgggccatgctaggagccctaggatgcatcaccccagaagttcttcagaaatgggtcaacatcaacttcaaagagcccgtctggttcaaggccggggcccaaatcttttcccaaggcgggctggactacctgggcaacccaaacctggtgcacgcccagagcatcntagcggttttagggttccaggttctgctcatgggagcggttgagggcttccgcattaatgggcttgaaggggtcggaaatggaaatgatctgtacccaggcgggcagtatttcgacccgttgggcctagctgatgacccggtaacgtttgctgagttgaangtgaaggagattaagacggcaggctggctatgttctccatgttcgggttctttgtgcaggccattgtaactgggaaggggcctttggagaactggctagaccaccttgataaccctgttgctaataacgcctgggtttatgctaccaagtttgttcctgggtcttaaatctaatgaatgccactgtacttgtatattatatgtatcttgttttggtgaaacttgaattggtaacgtttatctgaattgttgaatttaaaaaaaa

SEQ ID NO: 2546 - DNA, 867 bp, Allium cepa
taagtacatagcgcagatggctgcggcggcttcaacgattgcctcacccttccttgttggccaatctcgtgtctccgccgcctcccagcttcgcaatgttgcctccgtgggcaatggaaagttcaccatgggaaacgagctatggtacggaccagaccgagtgaagtatttgggcccattctcggcccaaaccccatcctatctaactggggaattcccaggagactacggatgggacacagcagggctatcagcagacccagaggcctttgccagaaaccgagccttggaagtgatccacggaaggtgggccatgctgggggccctaggatgcatcaccccagaagtcctacaaaaatgggtcaacgtcaacttcaaagagcccgtttggttcaaggccggggcccagatcttctcccaaggcgggctggactacctgggcaacccgaacctggtgcacgcgcagagcatcctagcggttttagggttccaggtgctgctcatgggggcggtcgagggcttccgcattaacgggcttgatggggttggaaatggcaacgacctgtacccaggcgggcagtactttgatccgttgggcttagctgatgatccggtaacgtttgctgagttgaaggtgaaggagatcaagaatggcaggctggcgatgttctctatgtttgggttctttgtgcaggccattgtaactgggaaggggcctttggaaaactggctagaccatcttgataatcctgttgctaacaatgcctgggtttatgctaccaagtttgttcctgggtcttaattttaagggatgccactgtacttgtatattatatgtattttgttttggtgaaacttgaagtggta

SEQ ID NO: 2547 - DNA, 2908 bp, Eutrema halophilum
aacatctcactctgtatctatatcccctctctgattcttcctcctctcttctcatccacaaaacactaacataaaagtcaaactccctcacatcaatccttcaccaagtagcaaaagaagaacaagaacacagaaaaaaaacgctcaatccgagagagagcaatggcttcaacattcacgagctcaagcagtgttctgaccccaacaccatttcttggccagactaaaggctcaagctttaaccctcttcgtgatgttgtctctctcggatctcccaaatacactatgggaaatgatctttggtacggaccagacagagtgaagtacttaggacccttctccgtccaaactccgtcttacctcaccggagagtttcccggcgactatggttgggacaccgccggtttatccgcagaccctgaagcctttgccaaaaacagggctcttgaggtgatccatgggagatgggcaatgttgggagcttttggttgcataacccctgaagttcttcagaaatgggtccgtgtggagttcaaagaaccggtctggttcaaagccggttcacaaatcttctccgaaggcggcttggactacttaggcaacccaaacctagtccacgcccaaagcattttggccgtccttggcttccaggtcatccttatgggattagttgaaggtttccgcatcaacggtcttgatggtgttggcgaaggcaatgacttgtacccgggaggtcaatattttgacccgctcggtctagcggatgatccggttacttttgctgagctcaaggtgaaagagatcaagaatggaaggttggctatgttctcaatgtttggcttctttgttcaagccattgttaccggaaaaggtcctttggagaacctccttgaccatatcgatgaccctgttgctaacaatgcttgggcttttgcaacaaagtttgtacctggagcttgatttttatgtcttgaagtgatccctttttaatgatatgaacataatcttttcttgttctttctcaagttacaaaactctatttgctatgcacaacaaaagttccaaaaaatacatgtatttcagctgaatctacaatgctctcaatctaacatttgggattgtcatactaatacaaacctaagtggagcaatcgaaatccctagcctcttttgccccaccatttccggtgacgacttttatcaccatctactctatggagtcttgctttagtctctcttaatctagctttgtaatctttcttccaagtctcaaaccttagcttcagtctcctgaattcatcctctggatgttgctgttgctgcccatttggagttgcctgcggtcccagcttcacctctacaatagctcttgcatcttcgtcgaaattgagtctcctttgatcaaactctcttgcgagatgattaaccgcattcaaacttccattgagctctctgactctgagctctggagtgtttccgttagtgaatttagttgtgggagttcttacaccgggtgttccagtagacgttgtgtcctctgagtcataaccgaaaggggatatcgatgtgtcttgtcttcctcctgcttgacccgtcatgttctctgcagctaaactcttccgagcagccgcaagactcatctgcaaaaatacgaatacaaaattgtaacttttaagaaaattttggtgtgatgcagtgagtgagaaggacattgatgatcagtgaaacacgcaacctgcaacgacgacatttgcttttgccatgtttcctccattgacttcatcttcatttcatactccgaccatctctcctcaaactgcctcaactgctctctcaatgctgtgttttcctcttccttctgcgctaaagctgcttcggatttcaaaacccgcttctggagatcagacatagctgatggttgaacttggaactgctccaacggaagatcctacatcgcaaacgagagaaagttatagcgtaaattgtgtaataacgtttgattcagaagaggacaatcttccttttagtagtaagtaccttgtcttctgaaatcctcctgcccgctttcctttttgattttgtcgtcacattgagtaattctttctgtctttgcatactcttgagtcgttttcgagccaaccatcctcgaaccgctgcaaaagaatgatgagccttaaaatccatatccatgtttgagaaccaaaatctctagtttaccaaataatatagtgtggtctaccagattgcaagtgtgtgactgcagtcaactctcctgtgcttgcttgagaaacagaatccacatggatctttgtttcataaattcttcgagcattttcacctcgtacatatgactgaagtacaaatgctgcgtttctcatattttggaagtattcacgagacaagtaaccgcggagatgcttttgtaagcccactatgcctttaagaactttttttctcctatcttcaaagataccaatctataaaaaaattcgaagatgtgagcataagaaatgtatcgataagatcaggaaacagcctctatatatctgtgcgtaaggaattacttacttgtccagttcggaggtacagttttgtatagccaacttggtacatttcaggatgaacatcgtattgtttcaaaacagcaattgatacgctcagaggatcctgacagacattcttgcctgacaaaaggaacccgtatcttcctgcaaactcttgatgtgtcaaacgagtaggatatccagatcttgatattctaactacctccaacacgccacaacatctaagctgttgtaggacaagatcctcttcataaactctgggaagctgcttcgaattcggctttatgcatctaatgaagtggggacttgtgttttctaacttgttcatcaacttgaaaagttgac

SEQ ID NO: 2548 - DNA, 2919 bp, Eutrema parvulum
aacatctcactctctatctgtatcccttctctgattctccttgctctatcctcatccacaaaacacttactttaaaagtcaaactccctgagatcaattcttcaccaaatagcaaagaaaaagaacaagaacacagagaaaaaaaaacgctcaatccgagagagagcaatggcttcaacattcacgagctcaagcagtgttctgagcccaacaacatttcttggccagactaaaggctccacctttaaccctcttcgtgatgttgtctctctcggatctcccaaatacactatggggaatgatctttggtacggaccagacagagtgaagtacttaggacccttttccgtccaaactccgtcttacctcaccggagagtttcccggcgactatggttgggacaccgccggtttatcggcagaccctgaagcctttgccaaaaacagagctcttgaggtgatccatggaagatgggccatgttgggagcattaggatgcataacccctgaagttcttcagaaatgggtacgtgtggacttcaaagagccagtctggtttaaagccggttcacaaatcttctccgaaggcggtttggactacttaggcaacccaaacctagtccacgcccaaagcattttagccgtacttggcttccaagttatcctaatgggattagttgaaggtttccgcatcaacggtcttgatggtgttggcgaaggcaatgacttgtacccaggtgggcaatattttgatccgctgggtctcgcggatgatccagttacttttgcagagctcaaggtgaaagagatcaagaatggaaggttggctatgttctcaatgtttggcttctttgttcaagccattgttaccggaaaaggtcctttggagaacctccttgaccatattgatagcccggttgctaacaatgcttgggctttcgcaacaaagtttgtacctggagcttgatttttaagtcttgatgtgatcctttgaaatgatatgaacataatatttcttgttcctctcacattacaaaactctattttctatgcacagaagttccaaaaaaattacatgtctctcagctgaatctacaatgctctcaatctaacattttgggattgtgatactaatacaacaaacctaagagaatgctggaaatccctagcctcttttgccccaccatttccggtgacgacttttatcaccatctactctatggagtcttgctttagtctctcttaatctagctttgtaatctttcttccacgtctcaaatcttagcttcagtctcttaaattcatcttctggatgttgctgttgctgcccgtttggagttgcctgcggatcaactttcacttccacaatagctctagcatcttcatcaaaattgagtctcctttgatcaaactctcttgcgagatgattgactgcgttcaaacttccattgagctctctgattctgagttctggagtgtttccattggtgaacttagttgtgggagttcttactccgggagttccagtagtagacattgtgtcctccgagtcataaccgaaaggtgatatcgatgtgtcttgtcttcctcctgcttgacctgtaatgttctctgcagctagactcttccgagcagccgcgagactcatctgagaaaaaaggcaaaatacgaagttggaacatttcataatcttatattttcggtttatgtcaagaatcagtcaagtatgaggaactaacctgcaacgatgacatttgtttttgccaagtttcctccattgacttcatctttatttcatactctgaccatctctcctcaaattgtctcagctgctctctcaatgccatattttcttcttccttctgcactaaagctgcttcagatttcaaaacccgcttctggagatcagacatagctggtggttgaacttggaactgctccagcggcatatcctatacatcacaaacaagagagagttatagtgtaataatgtttgattcagaagtggacaatctttcttttaatagtaactaccttgtcttcagaaatcctcctgcccgctttcctctttgactttgtcgttacaatgagtaattctttctgtctttgcatactgttgaatcgttttcgagccaaccatcctcgaaccgctgcaaaagagaaaagtgaatgatgagcctgaaaatccctatccaaatttgaggaccaatatctttactttagcaaaaagataaagagtggttttaccagattgcaagtgtatgactgcagtcaactctcctgtgcttgcttcagaaacagaacccgtatggatctttgcttcagtgtcaaacattcttcgggcaatttcacctcttacatatgactgaagtaccaatgctccgtttctcatattttggacgtattcacgagacaagcgaccacggaaatgcttttgtaagcccacaatgccttgaagaactttttttctcctatcttcaaagataccaacctatagaaatttaaaaatgaggcgcataagaattgtatcgataagatcaagaaacagcctctacatctctacgtaaagaattacttacttgcccagttcgtaggtacaattttgtatagccaacttgatacatttcaggatgaacatcatactgtttcagaacagcgattgatacgctcagaggatcctgagagacctttttgtctgctaataggaacccatatctccctgcaaactcttgatgtgtcaaacgagtaggatatccagatcttgatattctaacaacctccaacacgccacaacatctaagctgttgtaggatgaggtcctcttcataaactctgggaagctgcttcgtattcggctttatgcatctaatgaagtgaggacttgtgttctctaacgtgttcatcaacttgaaaagttgac

SEQ ID NO: 2549 - DNA, 915 bp, Fagopyrum esculentum
caaaacacttcaattttcaatcaccacaaaacacaaaaaatcaatggcatccatgtttagctctggcactcttcttagaccaactccatttctcagtggtcaaactagaggaggccaagctaatgctcttagagatgttgtttccatgggcactcccaaattcaccatgtctaatgatctgtggtatggacctgatagagtgaagtacttaggaccattctctgctcaaactccttcataccttactggtgagttccctggtgattatggttgggacactgctggactttccgctgatcccgaggctttctctaagaaccgggcccttgaggttatccatggacggtgggccatgctaggagccttgggatgcataacaccagaagtactacaaaaatgggtgaaagtaaacttcaaggagccaatctggttcaaagctggagcacaaattttctccgagggtggtctcgactacttaggaaacccgaacctggttcatgctcaaagcattttagcagtcttagggttccaagtagtactaatgggactcgttgaaggattcagaatcaacggattggatggtgttggtgagggcaacaacttgtatccaggtggtcagtactttgacccacttgggctcgcggatgacccgtccacctttgccgagctcaaggttaaggagatcaagaatggaaggctagctatgttctctatgtttggtttctttgttcaagccattgttactggcaaaggtcccttggagaacttgttggaccacttggataaccctgtggctaacaatgcttgggtttatgctactaagtttgttcctggatcataaacaaatctttatttgaacattttgggatgttgtgaatacaattttatgtaaactttaatgaatgatcattgctt

SEQ ID NO: 2550 - DNA, 906 bp, Fagopyrum esculentum
aaacacttccattttcaatcaccaaaaaacacaaaattcaatggcatccatgtttagctcaggaactcttcttagaccaactccatttctcagtggtcaaactagaggaggccaagctaatgctcttagagatgttgtttccatgggcactcccaagttcaccatgtcaaatgatttgtggtatggacctgatagagtgaagtacttaggaccattctctgctcaaactccttcataccttactggtgagttccctggtgattatggttgggacactgctggactttccgctgatcctgaggctttctctaagaaccgagcccttgaggttatccatggaaggtgggccatgctaggagcattgggatgcataacaccagaagtactacaaaaatgggtgaaagtaaacttcaaggagccaatctggttcaaagctggagcacaaattttctcggagggcggtctcgactacttaggaaacccgaacttggttcatgcccaaagcattttagccgtcttaggtttccaagtagtactcatgggactcgtcgaaggattcagaatcaacggcttggatggtgttggtgagggtaacaacttgtacccaggtggtcagtactttgacccacttgggctcgcggacgacccgtcaacctttgccgagctcaaggtaaaggagatcaagaatggaagactagctatgttctctatgtttgggttctttgttcaagccattgttactggcaaaggtcctttggagaatttgttagaccacttggataaccctgttgctaacaatgcttgggtttatgctaccaagtttgttcctggatcataaataaatctattatgtgaacattttgggatgtgtgaatataattttatgtggactttaatgaatgatca

SEQ ID NO: 2551 - DNA, 858 bp, Flaveria ramosissima
actgttgtcagagccaccccttttttaggtcagaccagaggctccaatgtcaattcccttagagattctctctccatggtcaatggcaaatacaccatgggaaatgacttgtggtatggaccggaccgagtgaagtacttgggacccttttcggcccagacaccatcatacttgaccggtgaattccctggtgattatggttgggacactgctggtttatctgctgatcctgaggcttttgccaagaaccgggctcttgaggtgatccacgggagatgggcaatgctaggagcattcgggtgcatcacccccgaagtcctagaaaaatgggtgaaagtagacttcaaggagcccgtctggttcaaagccggagcccaaatcttctccgaaggcgggctagactatttgggcaacccaaacctcgtccacgcccaaagcatattagcagttctcggctttcaagtggtcctaatgggcctcgtcgaagggttccgcattaacgggctcgagggtgtaggagaaggcaacaacctctacccgggtggccagtattttgacccgttgggccttgcagatgacccgattactttcgccgagctaaaggtgaaggaaatcaagaatgggagactagcaatgttttcaatgtttggattctttgtgcaagccattgtgacaggaaaaggaccattggagaaccttttggaccatttggacaatcctgtggctaacaatgcatgggtctatgccaccaagtttgtccctggttcataaattatgtggctttttataagttcttgtaaattatgagttggatgataaaaatgaataaatattgttataacaaaaaaaaaaaaaaaa

SEQ ID NO: 2552 - DNA, 958 bp, Flaveria ramosissima
ccaccgtggtccaagccaccccgttcttgggtcaaaccagaccatctagcctcaaccccttaagagatatggtctctatgccaagtgcaaaatacaccatgggaaatgacttgtggtatggacctgaccgtgttaagtacttgggacccttttcggctcagaccccatcgtacttgactggtgaattccccggtgactacggttgggacaccgccggtttgtccgctgatcccgaggctttcgccaaaaacagggctcttgaggttatccatggacggtgggccatgcttggagcactcgggtgcatcacacccgaggtccttgaaaagtgggtgaaagtggatttcaaggagcccgtctggttcaaggccggagcccaaatattctcagaaggtggtttggactatctcgggaacccgaaccttgtgcatgctcagagcatattggcagttctcgggttccaggtggtcctaatgggccttgttgaggggttccgtattaacgggcttgaaggggttggagatggtaacaatttgtatccgggcgggcaatactttgacccattgggccttgcggacgaccccgtgaccttcgccgagttgaaggttaaagagatcaagaacggtagattggctatgttttcgatgtttgggttcttcgtgcaagcaatagtgaccggaaaaggcccgttggagaacttgttggaccatttggacaaccctgtggctaacaatgcatgggtttatgccactaagtttgtgcctggctcttagaccttttagcctttccattgtacttgtaaccgcaagtttggggagaaaaaatgtgtagattattatgattagttctctataatatggtgtttattagatggtcttgtttatatgttgaactcatgtgaaaagaaaacattaatggctagaattatgaattttaagaaaaaaaaaaaaaaaaaaaa

SEQ ID NO: 2553 - DNA, 957 bp, Flaveria ramosissima
cgtggtccaagccacccctttcttgggtcaaaccagaccatctagccttaaccccttaagagatatggtctctatgcccagtgcaaaatacaccatgggaaatgacttgtggtatggacctgaccgtgttaagtacttgggacccttttcggctcaaaccccatcatacttgactggtgaatttcctggtgactacggttgggacactgctggtttgtccgctgatcccgaggctttcgccaagaacagggctcttgaggtgatccatggccgatgggccatgctaggagcactcgggtgcatcacacccgaggtccttgaaaagtgggtgaaagtggatttcaaggagcccgtttggttcaaagccggagcccagatattctcagaaggcggtttggactatcttgggaacccgaaccttgtccatgctcaaagcatattggcggttctcgggttccaggtggtcctaatgggcctcgttgaggggttccgtattaacgggcttgaaggggttggagatggtaacaatttgtatccgggcgggcaatacttcgacccattgggccttgcggatgacccggtgacctttgccgagttgaaggtgaaagagatcaagaacggtagattagctatgttttcgatgttcgggttctttgtgcaagcaatcgtgaccggcaaaggcccgttggagaacctgttggaccatttggacaaccctgtggccaacaatgcttgggtctatgccaccaagtttgtgcctggctcctagactttttaccctcttgtaaccgcaagtttgggaagaaaaatgtggtgtttattagatggtcttgtttatatgttgaactcacgtgaaagaaaaatattaatagttagaattatgatttagaaaaacgttcaactagatttaaactacaaaaaagagcatttgcttaaactatggatatttatgatctg

SEQ ID NO: 2554 - DNA, 1267 bp, Vitis vinifera
ataaatgtggatagaaagctctgacctggagatacttcaatcctttaaagccagctcattggctggatagaactccggagtcccaccaccaccgctccgcttccaacctcacatttctaaccactcgttctgattcttccttcactccttttaaactgcaattctcacccgagttcttgcaattgaactaactgaaaccaagctcagagctgatacagaggagtcagaaatggtagccactgtaatggcagcaactgccagctccagcactggtcttagaccaactcaattcttaggccaaacccggggatccaatgctaaccagcttagagaagttgttcctatgggaactggaaaattcactatggggaacgaattatggtatggaccggaccgggtgaagtacttgggacccttctccgctcagacaccttcatacctcaccggagagttccccggtgactatggatgggacactgcaggattatcagctgacccagaagcctttgccaggaacagggcccttgaggtaatccacgggcggtgggctatgctgggagcctttggctgcatcaccccagaagttcttgagaagtgggtgaaggtggacttcaaggaaccagtttggttcaaagccggagctcaaatcttctcggaaggcggcctggactacttgggaaatcccaaccttgtccatgcccagagcatcttggctgtgctgggcttccaagtcgtactgatgggccttgtggagggctaccgcatcaatggccttccgggagtaggcgaaggcaacgacctctacccgggtggaccttacttcgaccctctaggacttgctgatgaccctgtcacctttgctgagctgaaggtgaaagagatcaagaacgggaggctagccatgttctccatgtttggattctttgtccaagccatcgttaccggcaaggggccgctcgagaacctcttggatcaccttgataaccctgtggccaacaacgcttgggcttacgcaactaagtttgtgcctggatcataagctgttacatttccccttcattcccattgttggcagaatcaattgaatgggaagttgtgtagattattataatggatgaatcaagtttgaagctaaaatgtacggataaaaaatcttcaccgtttgatggactgggcttgactggttaggatttaccttcaactcactccaagtaaagttggcaccctggggttccaaataagattgatttagtctatttatggaaaa

SEQ ID NO: 2555 - DNA, 1063 bp, Mimulus guttatus
agtcttcactgattttcaaaacccacagcccaaagagcaattactgcaggagataaaaaaaaaaaactcacctgcaaatctctccgagcaaaagagtaaccggaatcaatggccgccgccgccgcgagctcctccgccgtcgtcagggcgacgccgttcctggggcaaaccaagaccgccaatcctctcagagatgttgtctccatgggaaatggaaaatacaccatgggtaatgatttgtggtacggacctgaccgggtcaagtacttggggccgttttcagctcagactccgtcgtacctgaccggagaattccccggcgactacggctgggacaccgccggtttgtcggctgatcccgaggcctttgctaagaacagggctcttgaggtcatccacgggaggtgggctatgctaggagcattcggttgcatcacacccgaaatcctccaaaaatgggtgggcgtcactttgaaggagcccgtttggttcaaagccgggtcacaaatcttttctgagggcggtttggactatttaggaaaccccaacctcgtccacgcgcagagcatcctagccgttcttggattccaagtcttgctaatgggagccgttgaagggttcagaatcaacggtctagatggagtcggagatggcaatgacctctacccagggggtcagtattttgaccccctcggtttggctgatgaccccgtcacttttgcggagctcaaagtgaaggagatcaagaacgggagattggctatgttctccatgtttggattctttgtgcaggcgattgtgacaggaaaggggccgttggagaatttgttggaccaccttgataaccccgttgcgaataatgcgtgggttttcgcgaccaagttcgcgcctggatcgtagattttgatgaaagagatcgaacctcgatcttgaatgttttgattgaatgcaagacgtgtaatttttattgcatcatttgttcatattatcatccatcacctgatttattcaattttcaatgacgaagttgttcattatgtctaattaatcattgctaaatcat

SEQ ID NO: 2556 - DNA, 920 bp, Raphanus sativus
atagcaactaataataacaagaccacagagaaacaaacactcaatacaagagagaacaatggcttcaacattcacgagctcaagcagtgtgttgtgcccaacaacattccttggtcagactaaaagctccagctttaaccctcttcgtgatgttgtctctctcggatctcccaaatacactatggggaatgatctttggtatggaccagacagagtgaagtacttaggacccttttctgtccaaactccgtcttacctcaccggagagtttcccggagactatggttgggatactgccggtttatccgcagaccctgaagcctttgccaaaaatagagctcttgaggtgatccatgggagatgggcaatgttgggagcatttggttgcataacccctgaagttcttcagaaatgggtccgtgtggacttcaaagaaccggtctggttcaaagccggttcacaaatcttctccgaaggtggtttggactacttaggcaacccaaacctagtccacgctcagagcattttagccgtccttggcttccaagttatcctaatgggactagttgaaggtttccgcatcaacggtcttgatggtgttggtgaaggcaatgacttgtacccgggcggtcaatactttgacccgctgggtcttgcagatgatccagttacttttgctgagctcaaggtgaaagaaatcaagaatggaaggttggctatgttctcaatgtttggcttctttgttcaagccattgttaccggaaagggtcctttggagaatctccttgaccatcttgataaccctgttgctaacaatgcatgggctttcgcaacaaagtttgtacccggagcttgatgaaatgatatgaaacataatctttcttgttgctctcaaaatacaaaaactctatttgatgcca

SEQ ID NO: 2557 - DNA, 984 bp, Thellungiella halophila
accaagtagcaaaagaagaacaagaacacagaaaaaaaacgctcaatccgagagagagcaatggcttcaacattcacgagctcaagcagtgttctgaccccaacaccatttcttggccagactaaaggctcaagctttaaccctcttcgtgatgttgtctctctcggatctcccaaatacactatgggaaatgatctttggtacggaccagacagagtgaagtacttaggacccttctccgtccaaactccgtcttacctcaccggagagtttcccggcgactatggttgggacaccgccggtttatccgcagaccctgaagcctttgccaaaaacagggctcttgaggtgatccatgggagatgggcaatgttgggagcttttggttgcataacccctgaagttcttcagaaatgggtccgtgtggagttcaaagaaccggtctggttcaaagccggttcacaaatcttctccgaaggcggcttggactacttaggcaacccaaacctagtccacgcccaaagcattttggccgtccttggcttccaggtcatccttatgggattagttgaaggtttccgcatcaacggtcttgatggtgttggcgaaggcaatgacttgtacccgggaggtcaatattttgacccgctcggtctagcggatgatccggttacttttgctgagctcaaggtgaaagagatcaagaatggaaggttggctatgttctcaatgtttggcttctttgttcaagccattgttaccggaaaaggtcctttggagaacctccttgaccatatcgatgaccctgttgctaacaatgcttgggcttttgcaacaaagtttgtacctggagcttgatttttatgtcttgaagtgatccctttttaatgatatgaacataatcttttcttgttctttctcaagttacaaaactctatttgctatgcacaacaaaagttccaaaaaatacatgtatttcagctg

SEQ ID NO: 2558 - DNA, 1117 bp, Zamia vazquezii
attgagctttgagttttcagtgtaaaatatcctcatactcgactctgtgtgtattggttatcaaggatggctgctacaataacaacagctgcttcaactagtagtatttccaaatcttcatttctaggttcatccagagtctccaggagcttcaccaatgctctcagaaacaatgtttcccttgccaatgctcggccaagaatcatcatgggaaatgaattgtggtatggacctgatcgcgtgaagtacctgggaccgttctctgcacagactcctccttatctgactggtgaattccctggagactatggttgggatactgctggtctgtctgctgatccagaggcctttgctcgtaatagggctcttgaggttatccatgggagatgggcaatgctaggagccttaggatgcatcacacctgaggttttggagaaatggttgagggtggatttcaaggagccggtatggttcaaggcaggtgcacaaattttctccgagggtggtctggactacctaggaaaccccaatctgattcatgctcagagtattcttgcagtactgggttttcaggtgattctaatgggtcttgtcgagggtttccggatcaatggcctgcctggagttggggagggtggcgatttataccctggaggtacatacttcgatccattgggcctggccgatgatccagatacatttgcagagctgaaagtaaaggaactcaagaatggaagactggctatgttttctatgtttggatttttcgtacaggccatagtcactggaaaagggccactggagaatttactggatcatcttgataatcccgttgccaacaatgcctggaactatgccaccaaatttgtgccagggtcttaaacaaataatactgccagaatcaatcgattgtctgtgatcttgatgcatcctggaatctgcattaatttgtttagggcatggcgaattcatctgttcttttaaacttgcacaatgggtttcatgacttactctatctggatgtgcatactcatctcaatatctactcggatttccaagaaatccaaatgtcttgaaaatgtattttcattgaggtctttgaatcttatccggtagc

SEQ ID NO: 2559 - DNA, 845 bp, Ambrosia trifida
ctccatcaatggctgccactgctagctccaccactgtggtccaagccacccccttcttgggtcaaactagaccatctagcctcaatcccttgagagatatggtctctatgtccagtgccaaatacaccatgggaaatgatttgtggtatggaccagaccgtgttaagtacttgggacccttttcggctcagactccatcgtacttgactggtgaattccctggtgactacggttgggacaccgccggtttgtcagcggatcccgaggcttttgccaagaaccgggctcttgaggttatccatgggcgatgggccatgcttggtgccctcgggtgcatcacacccgaggtgcttgaaaagtgggtgaaagtggatttcaaggaaccagtttggttcaaggctggggcccagattttctctgaaggcggcctggactaccttgggaacccgaaccttgtccatgctcagagcatattggcagttctcgggttccaggtagtcctatgggcctgttgagggttccgtatcaatgggcttgaaggggttggagatggtaacaatttgtacccgggtgggcaatactttgacccgttgggccttgcggatgatccggtaacttttgctgagttgaaggtgaaagagatcaagaacgggagactggctatgttttctatgtttgggttctttgtacaagcaatagtgacaggcaaaggcccattagagaaccttttggatcatttggacaaccctgtggctaacaatgcatgggtctacgccaccaagtttgtccctggctcttagacttttaagcctttgtgttgttattgtaacctcaagtttgtggtg

SEQ ID NO: 2560 - DNA, 977 bp, Flaveria ramosissima
gcacgctgctagctccaccgtggccaagccacccgttctggtcaaaccagaccatctagcctcaaccccttaagagatatggtctctatgccaagtgcaaaatacaccatgggaaatgacttgtggtatggacctgaccgtgttaagtacttgggacccttttcggctcagaccccatcgtacttgactggtgaattccccggtgactacggttgggacaccgccggtttgtccgctgatcccgaggctttcgccaaaaacagggctcttgaggttatccatggacggtgggccatgcttggagcactcgggtgcatcacacccgaggtccttgaaaagtgggtgaaagtggatttcaaggagcccgtctggttcaaggccggagcccaaatattctcagaaggtggtttggactatctcgggaacccgaaccttgtccatgctcagagcatattggcagttctcgggttccaggtggtcctaatgggccttgttgaagggttccgtattaacgggcttgaaggggttggagatggtaacaatttgtatccgggcgggcaatactttgacccattgggccttgcggacgacccggtgaccttcgccgagttgaaggtgaaagagatcaagaatggtagattggctatgttttcgatgtttgggttcttcgtgcaagcaatagtgaccggcaaaggcccgttggagaacttgttggaccatttggacaaccctgtggctaacaatgcatgggtttatgccactaagtttgtgcctggctcttagaccttttagcctttccattgtacttgtaaccacaagtttggggagaaaaaatgtgtagattattatgattagttctatataatatggtgtttattagaaaaaaaaaaaaaaaaaaataaaagtactagcgtgtatacactagacgtactatagactacgtcaacgacgacacaggaggagtagggggggggggg

SEQ ID NO: 2561 - DNA, 873 bp, Flaveria ramosissima
atcaccaaaaacaattgcatcttccacttaatttacaaaccaccatcaatggctgcagctgctagctccaccgtggtccaagccaccccgttcttgggtcaaaccagaccatctagcctcaaccccttaagagatatggtctctatgccaagtgcaaaatacaccatgggaaatgacttgtggtatggacctgaccgtgttaagtacttgggacccttttcggctcagaccccatcgtacttgactggtgaattccccggtgactacggttgggacaccgccggtttgtccgctgatcccgaggctttcgccaaaaacagggctcttgaggttatccatggacggtgggccatgcttggagcactcgggtgcatcacacccgaggtccttgaaagtgggtgaaagtggatttcaaggagcccgtctgggttcaaggccggagccccaaatattctcagaaggttggtttgactatctacgggaacccgaaccttgtccatgctcagagcatattggcagttctcgggttccaggtggtcctaatgggccttgttgaagggttccgtattaacgggcttgaaggggttggagatggtaacaatttgtatccgggcgggcaatactttgacccattgggccttgcggacgacccggtgaccttcgccgagttgaaggtgaaagagatcaagaatggtagattggctatgttttcgatgtttgggttcttcgtgcaagcaatagtgaccggcaaaggcccgttggagaacttgttggaccatttggacaaccctgtggctaacaatgcatgggtttatgccactaagtttgtgcctggctcttagaccttttagcctttccattgtacttgtaacc

SEQ ID NO: 2562 - DNA, 966 bp, Eschscholzia californica
attactttcaacaagttagagaagtaccttgaaacttaagcagtgagtataaaaaatggtgtcaactctaatggcagcctcagctaattccagtacagttcttagaccatctcaatttttgggacaaaatagagtctctaactctcttagagatgttgttgctatgggaactagtaaatacactatgagtaatgatttgtggtacggtcctgaccgtgtcaaatacttaggcccattctctgctcagactccatcttacttaaccggtgaattccccggtgattacggatgggatactgctggattatcagcagatcctgaagccttcgctaagaacagagctcttgaggtcattcacggtcggtgggctatgttaggggcgtttgggtgcatcaccccagaagtgctagagaaatgggtcaaggtagacttcaaggaacccgtttggttcaaagctggatcacagatcttctccgaaggtggtcttgactacttgggaaaccctaaccttgttcatgcacaaagcatcttggctgtgttagggttccaagttattctaatgggcctcgtcgagggtttccgtatcaatggattacccggagtcggtgaaggtaacaacttataccctggtggtacatactttgacccactaggccttgctgatgatccaactaccttcgccgaattgaaagtgaaggagatcaagaatggacgacttgccatgttttctatgtttggattctttgttcaagccattgttactggaaaaggccctcttgaaaacctactagatcacctcgacaaccctgtcgctaacaatgcttgggtttacgccaccaaatttgtcccaggatcttaaatttatctcggttttattataacgtgtaatcacgagtgtaaattattatgattttaataagaaggaccttgaagattctttagtttacaagacaaaaaaaaaaaaaa

SEQ ID NO: 2563 - DNA, 875 bp, Brassica napus
gaaacaaaccgctcaatccaagagagaataatggcttcaacattcacgagctcgagcagtgttctgtgcccaacaacattccttggccagactagaagctccagctttaaccctcttcgtgatgttgtctctctcggctctcccaaatacactatgggaaatgatctttggtatggaccagacagagtaaagtacttaggacccttttcagtccaaactccgtcttacctcaccggagagtttcccggagaatatggttgggacactgccggtttatccgcagaccctgaagcctttgccaaaaacagagctcttgaggtgatccatgggagatgggcgatgttgggagcatttggttgcataacccctgaagttcttcagaaatgggtccgtgtggacttcaaagagccggtctggttcaaagccggttcacaaatcttctcggaaggcggtttggactacttaggaaacccaaacctagtacacgctcagagcattttagcggtacttggcttccaagttatcctaatgggattagttgaaggcctccgcatcaacggtcttgatggtgttggcgaaggcaatgacttgtacccgggtgggcaatactttgacccgctgggacttgcagatgatcccgttacttttgctgagctcaaggtgaaagaaatcaagaatggaaggttggctatgttctcaatgttcggcttctttgttcaggctattgtaaccgggaaaggtcctttggagaatcttcttgaccatcttgataatcctgttgctaacaacgcatgggcttttgcaacaaagtttgtacctggagcttgatttgatgtgatcctttgaaatgatataaacataatctttcttgtgtc

SEQ ID NO: 2564 - DNA, 811 bp, Flaveria ramosissima
gccaccccttttttaggtcagaccagaggctccaatgtcaattcccttagagattctctctccatggtcaatggcaaatacaccatgggaaatgacttgtggtatggaccggaccgagtgaagtacttgggacccttttcggcccagacaccatcatacttgaccggtgaattccctggtgattatggttgggacactgctggtttatctgctgatcctgaggcttttgccaagaaccgggctcttgaggtgatccacgggagatgggcaatgctaggagcattcgggtgcatcacccccgaagtcctagaaaaatgggtgaaagtagacttcaaggagcccgtctggttcaaagccggagcccaaatcttctccgaaggcgggctagactatttgggcaacccaaacctagtccacgcccaaagcatactcgcagtactcggctttcaagtggtcctaatgggcctcgtcgaagggttccgcattaacgggctcgagggtgtaggagaaggcaacaacctctacccgggtggccagtattttgacccattgggccttgcagatgacccgattactttcgccgagctaaaggtgaaggaaatcaagaatgggagactagcaatgttttcaatgtttgggttctttgtgcaagccattgtgacaggaaaaggaccattggagaaccttttggaccatttggataaccctgtggctaacaatgcatgggtctatgccaccaagtttgtccctggttcataaattatgtggctttttataagttcttgtaaattatgagttggatgataaaaat

SEQ ID NO: 2565 - DNA, 1284 bp, Vitis vinifera
ataaatgtggatagaaagctctgacctggagatacttcaatcctttaaagccagctcattggctggatagaactccggagtcccaccaccagcgctccgcttccaacctcacatttctaaccactcgttttgattcttccttcattccttttaaactgcaattctcacccgagttcttgcaattgaactaactgaaaccaagctcagagctgatacagaggagtcagaaatggtagccactgtaatggcagcaactgccagctccagcactggtcttagaccaactcaattcgtaggccaaacccggggatccaatgctaaccagcttagagaagttgttcctatgggaactggaaaattcactatggggaacgaattatggtatggaccggaccgggtgaagtacttgggacccttctccgctcagacaccttcatacctcaccggagagttccccggtgactatggatgggacactgcaggattatcagctgacccagaagcctttgccaggaacagggcccttgaggtaatccacgggcggtgggctatgctgggagcctttggctgcatcaccccagaagttcttgagaagtgggtgaaggtggacttcaaggaaccagtttggttcaaagctggagctcaaatcttctcggaaggcggcctggactacttgggaaatcccaaccttgtccatgcccagagcatcttggctgtgctgggcttccaagtcgtactgatgggccttgtggagggctaccgcatcaatggccttccgggagtaggcgaaggcaacgacctctacccgggtggaccttacttcgaccctctaggacttgctgatgaccctgttacctttgctgagctgaaggtgaaagagatcaagaacgggaggctagccatgttctccatgtttggattctttgtccaagccatcgttaccggcaaggggccgctcgagaacctcttggatcaccttgataaccctgtggccaacaacgcttgggcttacgcaactaagtttgtgcctggatcataagctgttacatttccccttcattcccattgttggcagaatcaattgaatgggaagttgtgtagattattataatggatgaatcaagtttgaagctaaaatgtacggataaaaaatcttcaccgtttgatggactgggcttgactggttaggatttaccttcaactcactccaagtaaagttggcaccctggggttccaaataagattgatttagtctatttatggaaaaatttgatagattggaaa

SEQ ID NO: 2566 - DNA, 1070 bp, Tripterygium wilfordii
cttaatattggaattattacccctatgcagcacaggttgtcttgctgaagacgctaaaaggcaaggaagctaagctaaaggatatggagatttcaacagttgatggtttccaaggtcgggagaaaaaagcttggttgagtgggaatgacatcaatgctaagttccagcaccgtcctcaggacaaccccatttcttggacagggcaggacctcatttgccaaccctcttggtgatgttgtctccatgggcactccaaaatacataatgggcaatgacttgtggtatggaccagacagagtgaagtacttgggacctttctcagctcaaactccttcatacctgactggagagttccctggagactatggatgggatactgctggtttatctgctgacccagaggcttttgccaagaacagagcccttgaggtgatccatgggagatgggcgatgcttggagcactaggctgcattaccccagaagtacttgaaaaatgggttaaagtggacttcaaagagccagtgtggttcaaagctggagctcaaatcttctctgaaggtggcctggactacttaggcaatcccaaccttgttcatgctcaaagcatcttggcagttctcggattccaagttgttctcatgggacttgttgagggattccgcatcaacggcctcccaggcgtcggagagggtaacgatctctaccccggcggccagtacttcgaccctctcggcctagccaatgatcctgtttcaatctctgagctcaaggtgaaggaaatcaagaatggcaggctagctatgttctccatgtttggtttctttgtccaagctattgtcactggaaagggtcccctggagaatctcttggatcatcttgacaatcctgttgctaacaatgcttgggtctatgccaccaagtttgtacctggatcataagactacttctctggggtatttatttggatttctgtgaatgtactgtacctgtataactctctatcatttagaactaatgtaaatcttgattccatttcagccttcgataatttaaaaaaacagaattgaat

SEQ ID NO: 2567 - DNA, 813 bp, Vinca minor
acagctagctccactactgtaatcagagccacccctttcttgggccaaaccaaaagttctaaccctcttagagatgttgtttccatgggaaatgccaagtacaccatgggaaatgaactatggtatggaccagaccgtgtgaaatacttgggacccttttcagcacaaactccatcttacttgaatggtgaatttcctggtgattatggttgggatactgctggtttgtctgctgatcctgaggcctttgccaagaacagggctcttgaggttatccatggaagatgggcaatgcttggagcacttggatgcataaccccagaagttcttgagaagtgggttaatgtggacttcaaggaaccagtttggttcaaagcaggagcccagatattctcagaaggaggtcttgactatttagggaacccaaaccttgtacatgcacaaagcatattagcagtactaggtttccaggttgtcctaatgggacttgttgaaggattcagaatcaatggtctagctggagttggagaaggggacaatctatacccaggtggtcaatactttgatccacttggattggctgatgacccagtaacttttgatgaacttaaggttaaggaaataaagaatggaagattagcaatgttttcaatgtttggattctttgttcaggctattgttactggtaaaggtccacttgagaatctacttgatcatcttgataaccctgttgctaataatgcctgggtttatgctactaagtttgttcctggatcatgaatcattcaattgtttgtttgaatggagaattgt

SEQ ID NO: 2568 - DNA, 937 bp, Gossypium hirsutum
caactcaaaatcaatccccattgacaaacaatggcttccatgcttagctctggaactgttcttaggccaaccccattcttggccaaccaaaaatgctaaccctcttagagatgttgtctctttgggcactcccaaatatgcaatgggaaatgaactatggtatgggccagacagagtgaagtacttgggaccattttcagctcagactccatcttacttgactggagaattccctggagactatggttgggacactgctggtttgtcagccgaccctgaggcctttgccaggaatagggctcttgaggtcatccatggaagatgggcaatgttgggagcactaggctgcatcacaccagaagtacttgagaaatggcttagggttgatttcaaggaaccagtatggttcaaggcaggagctcaaattttctcagaaggtggcttggattacttaggcaaccctaacctagtccatgctcaaagcatcctcgccgttctcggattccaagtcgtcctaatgggactcgtcgaaggattccgcatcaatggcctccctggtgttggtgaaggcaatgatctttaccctggtggccagtactttgaccctcttggccttgctgaagaccccgttacatttgctgaacttaaggttaaagaaatcaagaatggtaggctagccatgttttcaatgtttggtttctttgttcaagccattgttacaggtaaaggtcccttggagaacctattggaccaccttgataaccctgttgcaaacaatgcttgggtctatgctactaagtttgtgcctgggtcttaaatgaaaatagccaaaaggtcaaaacttgtataatttgctttgtgtggattagaaattgagatatgtgtatttatgtgattgtaggttttgaacaactttgacaaatcaaattatgtgcca

SEQ ID NO: 2569 - DNA, 1060 bp, Zingiber officinale
  misc_feature (984)..(984): n is a, c, g, or t
gcacccgttccgccacaactgcaaccgcagcacatccgcagatggcagcagcaactctcacagcagccaccgtcgtcggcaccttcctcggccaagcccggccatcaaatggccacaaccccctcagggattttgtccccatgggaaaaggaaagttcaccatggggaacgatctgtggtacggcccggaccgtgtcaagtacctgggacccttctcagctcagacaccttcctacctcaccggagagttccccggcgactacgggtgggacacggcggggctctccgccgacccggaagccttcgccaagaaccgcgctctggaggtgatccacgggaggtgggcgatgctgggggcgctggggtgcatcacgccggaggtgctgcagaagtggctgcgggtggagttcaaggagccggtgtggttcaaggccgggtctcagatcttctcggagggcggcctcgactacctgggcaaccccaacctggtgcacgcgcagagcatccttgccgtgctgggtttccaggtcatcctcatggggctggtggagggctaccgcatcaacggcatccccggcgtcggcgagggcaatgacctctaccccggcggcacctacttcgacccgctgggcctcgcagacgaccccgtcgccttcgcggagctgaaggtgaaggagattaagaacgggcggctggccatgttctccatgttcggattcttcgtgcaggccatcgtgaccggaaaggggccgctggagaacctgttggatcatctggacaatccggtggccaacaatgcctgggtttacgccaccaagttcgcgccgggctcttaatttctacgcatgccttgtactttaattcaactgccccgcaatctgtcacttgtaagaaacagaggatctagttgcaattgttgtagaacaatgttcattgtatttatcttcttcttctctcgatcatgcacggatgctacttcgtcgnatgctttaactcaaataaaaaatctgtttatagaagcttactttcaaagctctaaaccaaaaaaaccccccccccc

SEQ ID NO: 2570 - DNA, 918 bp, Capsicum annuum
gttaattcctcaatatatatattgtgcaacaaacttagtaaaaatgtgaggtccaattaagggagaaattaagaaagagaggaaatggcagcaacaagcagttcagccagtgttgttagagcaactccattcttgggccagaccaaatatgctaaccctcttagagatgttgtttccatgggctcaggcaaattcactatgagcaatgatttgtggtatggacctgaccgtgtcaagtacttgggaccattttctgctcaaactccttcatacttaaccggagaattccccggtgattacggatgggacactgctggtttatctgctgatcctgaggcctttgccaagaacagagctcttgaggtcatccatgggagatgggccatgctaggggcatttggttgtattacaccagaagttcttgagaaatgggtgaaagtggacttcaaggagccagtatggttcaaagcaggagcccaaatcttcagtgaaggtggactggactatttgggcaacccaaaccttgtccatgctcaaagcattctagcagtattgggcttccaagtagtgctaatgggtcttgtagaaggtttcagaattaatgggcttcctggagttggcgaaggcaatgatctctacccaggtggccagtactttgacccactgggcctagcagatgacccaacaactttcgcggagctcaaagttaaggagatcaagaatggaagattggctatgttctccatgtttggattctttgttcaagctattgtcactggcaaaggcccacttgagaacctcttggatcaccttgacaaccctgttgctaacaatgcatgggtttatgcaactaagtttgttcctggatcttatatttttacattttgacttcctcatatagaggctttgcataattgt

SEQ ID NO: 2571 - DNA, 1164 bp, Podocarpus macrophillus
agagaggtgtaagcaatcagtattagtcccacaggaaagggaatatggcttcaacaatcacagctgcctcaactgcagccataaccaaatcttcattcctagcacctgcgaagagcttcaccaatgcaatcagagaagaagtttctttcgtcaattcaaggcccaaatatacaatgtcttcaaataatctgtggtatggaccagaccgtgtaaagtacttgggacctttctctgcacagaccccttcataccttactggtgaatttcctggggactatggttgggatacagcaggactttctgctgatccagaggcctttgctcgtaacagagctcttgaggtaattcatgggagatgggctatgcttggagcccttggatgtatcacccctgaggtattggagaaatgggtgagagtggacttcaaggagcctgtgtggttcaaggctggagctcaaatcttttcagagggtggtctggactacttagggaaccccaacctggtccatgcacagagcattcttgcagttttgggatttcaagtggtcttgatgggattggttgagggataccgcatcaatggcctggctggtgtgggtgaaggaggagatctataccctggtggccagtattttgatccattgggtttggctgatgaccccgagacatttgcagagctcaaggtgaaggaaataaaaaatggaaggcttgccatgttttccatgtttggattttttgtacaggctattgtcactggcaagggacccttggagaacttgttggatcaccttgacaaccctgttgccaacaatgcatggaattatgccacaaagtttgcaccaggatcttaaacagtcctgatattcgtccatcttggacattcttaccatgatcgcattcatcttggaagctgcgctatttcagagctgttgtagtttatccaatggagttcatttgcatgtacactatgcccatagtacaatctttattattctgtactaattaggttctagattggtgaagcatttatttattattgtgattataatagtattttgatgctcatgttggcactttgcaacagggaacattttactttatggggatctcttttcctcctttcaagataatgttttattaaacctaaatgaaagtgaatgccgt

SEQ ID NO: 2572 - DNA, 1232 bp, Cleome spinosa
aaagaagaaaagaaaaaaaaagacagagcaaaaggaaaagaaaaaaaataggcatcaacatttgcaagcacgagcagtgtgttgaggccgacgccgtttcttggtcagaccaaagtctccagttccaatcctctgagagacgctgtctctcttggatctcccagatacattatgagcaatgatttgtggtacggaccggacagagtgaagtacttgggaccgttttccgtacagacgccgtcgtacctcaccggagagtttcccggcgattacggttgggacaccgccggtctgtcggccgaccccgaggccttcgccaagaaccgagctcttgaggtgatccacgggaggtgggcaatgctgggagcgctgggatgcataacaccagaagtgctggagaaatgggtcagagtggatttcaaagagccggtctggttcaaggccggagctcagatcttctctgaaggtggactcgactacttgggaaaccctaacctcgtccacgctcagagcatcttagccgtccttgccttccaagtcgtactgatgggtctcgtcgaaggtttccgcatcaacggtctcgaaggcatcggtgaaggcaacgacctttacccgggcggtcagtacttcgaccccttgggtctggccgaggacccagtcacgtttgccgagctcaaggttaaggagatcaagaacgggaggctggctatgttctccatgtttggattctttgttcaggccattgttacagggaaaggacctttggagaatctccttgaccatcttgacaacccggttgccaacaatgcctgggcttatgccactaagtttgtgcctggagcttgatcttgtttctgtaaaacaatggattcctggaatggaaaagaaaaaaccctaatttgatattttatgcacatggctgaatctagggggctgctcggctaagttttaaagtgttttctggggctgaatccctaagatctgatctttccccaccatttccggtggtggcccttttgtccttctagtctatggagtcttgccctcgtctctcgtaatctggctttgtaatctttcttccatgtcttgaatctttgcttcagtttcttgagttcttcttccgggtggtgttgcccctcggatgaagttgatgtcggtccaggtttctcctcagcaagaaatctcacgtcttcgtcgaaattgaatttccgctgttcgaattcaaaaaaaaa

SEQ ID NO: 2573 - DNA, 768 bp, Cynara scolymus
ctccccccgtggttcgagccaccccattcttgggtcaaaccagatcaactctgatcaaccccctaagagatgctgtctccatcccaaatgccaagttcaccatgggaaatgatttgtggtatggacctgatcgcgttaagtatttgggaccgttttcagctcagaccccgtcttacttgaccggcgagttccccggtgactacggttgggacactgctggcttgtcggctgatccagaggctttcgccaagaacagggctcttgaggtcatccatggacgatgggccatgcttggtgcactcgggtgcatcacccccgaggtcctcgaaaagtggctcaaagtggatttcaaggagcccgtttggttcaaagccggagcccagatcttctcggaaggtggtctggactacctagggaacccgaacctagtccatgctcaaagcattctagccgtgctcggattccaggtgatcttgatgggtctcgttgaagggttccgaatcaacggtctagacggggttggagacggaaacaacctgtatccaggcgggcaatacttcgacccgttggggctagccgatgacccagtgacatttgctgagttgaaggtgaaagagataaagaatggaagacttgcaatgttctcaatgtttgggttctttgtgcaggccatagttacagggaaaggtccattggagaacttgttggaccatttggacaaccctgtggctaaacatgcatgggtctatgccactaaagttgtgcctg

SEQ ID NO: 2574 - DNA, 960 bp, Actinidia deliciosa
caattctcacaagtcttcaaaagtgaacaggttttaacagaaactctcaattccaatatctgaaacaggcatggcatcaacattgcttctgggtctaaccaggggagtctctgccaaccctcttagaaatgttgctgccatgagcacttccagatacaccatgagcaatgagttgtggtacggaccggaccgagtgaagtacttgggacccttttcggctcaaactccgtcgtacttgactggagaatttcctggtgactatggatgggacactgccggtttatctgctgatcccgaggcttttgctaggaatagggcccttgaggtcatccacgggcgatgggccatgcttggagcactgggatgcatcacccctgaagtcctcgagaaatgggtcaaagtggacttcaaggagccagtttggttcaaggccggagcccaaatcttctccgagggtgggctagactacttgggcaaccccaatttggtccatgcccagagtattctagccgtgctaggcttccaagtcgtcttaatgggcctcgtcgagggttaccgcatcaacggcattcctggggtaggagagggtaacgacctctaccccggtggacaatactttgacccactaggccttgccgatgacccggttacctttgctgagctcaaggtgaaggagatcaagaatggtaggctagccatgttctccatgttcgggttttttgtccaagccatcgtcactggcaagggcccacttgagaacctcttggaccaccttgacaaccctgtagctaacaatgcttgggtctatgccaccaagtttgtgcctggatcgtaaactctcaattatcttgttattgtgttgtcattcaagatgagattctgtatattattataatttccactttgttggatctgaaaactttggacaaggttcaattattttcctacaaaaaaaaaaaa

SEQ ID NO: 2575 - DNA, 903 bp, Flaveria ramosissima
gttcttgggtcaaaccagaccatctagcctcaaccccttaagagatatggtctctatgccaagtgcaaaatataccatgggaaatgacttgtggtacggacctgaccgtgttaagtacttgggacccttttcggctcagaccccatcgtacttgactggtgaattccccggtgactacggttgggacactgccggtttgtccgctgatcccgaggctttcgccaagaacagggctcttgaggttatccatggacggtgggccatgcttggagcactcgggtgcatcacacccgaggtccttgaaaagtgggtgaaagtggatttcaaggagcccgtctggttcaaggccggagcccaaatattctcagaaggtggtttggactacctagggaacccgaaccttgtccatgctcagagcatattggcagttctcgggttccaggtggtcctaatgggccttgttgaagggttccgtattaacgggcttgaaggggttggagatggtaacaatttgtatccgggcgggcaatactttgacccattgggccttgcggacgacccggtgaccttcgccgagttgaaggtgaaagagatcaagaatggtagattggctatgttttcgatgtttgggttcttcgtgcaagcaatagtgaccggcaaaggcccgttggagaacttgttggaccatttggacaaccctgtggctaacaatgcatgggtttatgccactaagtttgtgcctggctcttagaccttttagcctttccattgtacttgtaaccacaagtttgggagaaaaatgtgtagattattatgattagttctatataatatggtgtttattagatggtcttgtttatattttgattcatgtgaaaataaaacattaatggctagaattat

SEQ ID NO: 2576 - DNA, 1025 bp, Linum usitatissimum
ccacgcgtccgcccatctctctttcccagcccagcttcacttggtggcaattatcaacccatatttagagcaaagagagatctttaatggctgcttcaacagttatggcagcagcagcatctggtacctccagactcaaccttggacagacaggtcctgtttcaaaccgtcttcgaaatgtaaagaccatggccacttccaggttcaacatgggaagcaatttgtggtatggaccggacagagtgaagtacttgggacccttctcagctcagacaccttcctatctaactggtgaattcccaggtgactatggttgggacactgctggtctctctgccgatcccgaggccttcgccaaaaacagagctcttgaggttatccatggaaggtgggcaatgttgggagccttgggatgcataacccctgaggttttgcagaaatgggtgaaagttgacttcaaggagccagtatggttcaaagctggagctcaaatcttctcagaaggagggttggactatctggggaacccaaacctagtacatgctcagagtatccttgcagtgctaggattccaggtggttctgatgggtctagttgaaggtttccgcatcaatggactccctggagttggagaagggaatgatctttacccaggaggacagtactttgacccacttggacttgcagaagacccagtcactttcgctgagctcaaggtcaaagagatcaagaatggaaggcttgctatgttctctatgtttggtttcttcgttcaggctattgtcacagggaaaggtcccttggagaatctcttggaccatcttgataaccctgttgctaacaatgcttgggtctatgccaccaaatttgtgcctggatcctagactagtttgtgtcttgtcttgtctttcccatttcggacaacttcttctatgtaaaaacaaaagctaccccaacttgtttgcttatggttatttttctgtctactaacttattaattcattcctgctgagtatacttgctac

SEQ ID NO: 2577 - DNA, 921 bp, Silene vulgaris
aagccatggcaacaatgttaagctctggtaatgtccttagtccaactccatttctaggccaaggaaagggttccgaccgtaacgccctcaaagatgttgttcccatgggttctgccaaattcaccatggggaatgatttatggtatggcccagatagggtgaagtacttgggcccattctcagcacagacaccctcatacttaacaggagaatttcctggtgactatggctgggacactgctggactttcggctgaccccgaggcgttcgccaggaacagggctcttgaggtcattcacgggcgttgggccatgcttggagcactaggctgcatcaccccggaagtacttcaaaaatggattggagtccaattcaaagaaccggtttggttcaaggcgggcgcccaaattttctccgagggtggcctcgactatttgggaaaccctaatttggtccatgcccaaagcatcttggccgttctcggcttccaagttatattaatgggcctcgttgagagcttccgcataaatgggatcgaaggagtcggagagggtgaaaacctctaccctggaggccaatactttgacccattgggcttggccgatggcccggtcacattctcggaactcaaggttaaggagatcaagaatgggaggctagccatgttttccatgttcgggttctttgttcaagccatagtgaccggcaagggtcccttggaaaatctattggaccacctcgacaacccggtggctaataatgcttggatatttgctaccaagtttgtgcctggctcttaatttaatttgtaaattaacttttgttaatctgtagtgaatcacaggaatgtcattatcagtattgtacaaactatgaacctccctctttatcaggttacattaattcgaactcgactcgtgc

SEQ ID NO: 2578 - DNA, 1210 bp, Cycas rumphii
  misc_feature (543)..(543): n is a, c, g, or t
  misc_feature (620)..(620): n is a, c, g, or t
  misc_feature (654)..(654): n is a, c, g, or t
  misc_feature (656)..(656): n is a, c, g, or t
  misc_feature (678)..(678): n is a, c, g, or t
  misc_feature (717)..(717): n is a, c, g, or t
  misc_feature (719)..(719): n is a, c, g, or t
  misc_feature (737)..(737): n is a, c, g, or t
  misc_feature (743)..(743): n is a, c, g, or t
  misc_feature (761)..(761): n is a, c, g, or t
  misc_feature (808)..(808): n is a, c, g, or t
  misc_feature (815)..(815): n is a, c, g, or t
gcttcttcgttggatgaaaattgcaagggaagccacagaaagctttgagttttaagtaaaatccttctattcaactctctgtatttatatcattagagatggctgctacgataaccacagctgcatcaaccagcagcatttccaaatcttcatttctgcgatcatcttcagtgtctaagaatgctctcagaaacaatgtttcccttgccaacactcggtcaagaatcaccatgggaagagatttgtggtatggaccggaccgggtaaagtacttgggacctttctctgcacagactccttcctatctgactggtgaattccctggagactatggttgggatactgctggtctgtctgctgatccagaggcctttgctcgcaatcgggcccttgaggttatccatgggagatgggcaatgctaggagcactagggtgcatcacacctgaggttttggagaaatgggtgagggtggatttcaaggagcccgtatggttcaaggcgggtgctcaaattttctctgagggtggtctggactacttangaaaccccaatctgattcatgctcagagtattcttgcagtcctgggtttccaggtggttctaatgggactggttganggtttccgcatcaatggcctgcctggagttggananggtggagatttgtatcctggangtaaatactttgatccgttgggtctggctgatgatccananacatttgcagagctgaangtgaangaagtcaagaatggaagnctggccatgttttctatgtttggatttttcgtgcaagccatagtcantgggaangggccattggaaaatttgctggatcatcttgacaatcccgttgccaacaatgcttgggaatatgcaaccaaatttgtgccaggatcttaaacaaatagcatttcatgaatcgattacatctctgtgatcttgattcaccttggaaatacatttagtgcaatatgaattcatctgttctgttaacctgcacataggaaatctgcatctgcacattcatctcattgtctacttggatttctgaggtggtcaaatgtacgatacaaattttcattgaagcggttgaattttacttctctgttacatttgcctcttactacaagtgggatttgggtttaataactttaaattatgtattgcgaattcatcataaatgggtgttgaatgttgaagcctgc

SEQ ID NO: 2579 - DNA, 929 bp, Nicotiana tabacum
ggccattacggccgggggaggtccaagagagagaaatcaagaaagggagagaaagagaatggcatcaatggcatcaatggcagcaaccggtagctcagccactgttgttagagcaactccattcttgggccagaccaaatatgccaaccctcttagagatgtagttcccatgggctctgccaaattcaccatgagtaatgaattgtggtatggacctgattgtgtcaagtacttgggacccttttctgctcaaactccttcctacttgactggagaattccccggtgattacggatgggacacagctagtttattagctgatcctgaagcctttgcaaagaatagagctcttgaggtcatccatgggcgatgggccatgcttggggcactgggttgcattactccagaagttcttgagaaatgggtgaaagtggatttcaaagaaccagtatggttcaaagctggagcccaaatcttcagtgaaggaggactggactatttgggcaacccaaaccttgtccatgctcagagcattctagcagttttgggcttccaagtagtgctaatgggccttgtagaaggtttcagaattaatgggcttcctggagttggtgatggcaacaatctttacccaggtggccagtactttgacccacttgatctagcagatgacccaactacttttgccgagctcaaggttaaggagatcaagaatggaagattggctatgttttccatgttcggattcttcgttcaagctattgtcactggcaaaggccctcttgagaaccttttggatcaccttgacaaccctgttgctaacaatgcatggctttatgcaactaagtttgttcctggctcttaaattttacattttgacttcctccacaagaggcttgtaccactgattcattcagaatgcaaatatt

SEQ ID NO: 2580 - DNA, 988 bp, Linum usitatissimum
cagcttcacttggtggcaatcatcaacccatttatttagagcaaacagagatctttgatggctgcttcaacagttatggcagcagtagcagcatctggtacctccagactcaaccttggacagacaggtcctgtttcaaaccgtcttcgaaatgtaaaggccctggccacttccaggttcaacatgggaagcaatttgtggtatggaccggacagagtgaagtacttgggacccttctcagcccagacaccttcctatctaactggtgaattcccaggtgactatggttgggacactgctggtctctctgccgacccagaagccttcgccaaaaacagagctcttgaggtcatccatggaaggtgggcaatgttgggagccttgggatgcataacccctgaggttttgcagaaatgggtgaaagttgacttcaaggagccagtttggttcaaagctggagctcaaatcttctcagaaggagggttggactatctggggaacccaaacctagtacatgctcagagtatccttgcagtgcttggattccaggtggttctgatgggtctagtcgaaggtttccgcatcaatggactccctggagttggagaagggaatgacctttacccaggaggacaatactttgacccacttggacttgcagaagacccagtcactttcgctgagctcaaggtcaaagagatcaagaatggaaggcttgctatgttctccatgtttggtttcttcgttcaggctattgtcactgggaaaggtcctttggagaatctcttggaccatcttgataaccctgttgctaacaatgcttgggtctacgccaccaaatttgtgcctggatcctagactagattttgtgtcctgtcttgtctttcccatttcggacaacttatgtaaaaacaaaagctattacaacttgtctggttaaggtttttgcctgtcgttaacttattaattcattcctactaagttccta

SEQ ID NO: 2581 - DNA, 918 bp, Utricularia gibba
cggggatcccacgcagaccggaaagaagtgcttgaagatggcatcaatggttgctgccgccagctccacgaccgccgtgaagccttctcccttcttgggccagaccaagaactccaaccccctcagattcattgtccccatgggaagcgccaagtacaccatgggtaatgatctgtggtacggccccgaccgcgtcaagttcctgggaccattctccgctcaaactccatcgtatctcaatggagaattccccggcgactacggatgggataccgccggactctctgcggatccagaggccttcgctaaaaacagagcacttgaggtcattcacgggagatgggcaatgctgggagctctaggctccataacccctgaagttcttcagaaatggctcaatgttgatttcaaggaaccagtctggttcaaggctggagcccagatcttctccgaaggaggacttgactatttggggaaccccaaccttgtccatgctcagagcattcttgcagttcttggggtccaagttgtgctcatggggcttgtggaaggatacagaatcaatgggcttgagggtgttggagagggcaatgatctttatcccggaggccagtattttgatcctcttggattggccgatgaccctgtgactctcgcagagctcaaggtgaaggagatcaagaatgggagattggccatgttctcaatgtttggattcttcgttcaagccattgttaccggtaaagggcctctggagaatctgttggatcatcttgataaccctgttgccaacaatgcttgggtctatgccaccaagtttgcccctggatcataagctctctttgtattagatcccaaatctgatagaccatgttgattctggatgttgataaatgttatttccctcatttgattaag

SEQ ID NO: 2582 - DNA, 1483 bp, Zingiber officinale
aggtgtcaaagggtatcataatacacaattcacaagctagccccaacctcttattttaaaaaccaaaattacaactttttcccaaaattaaaaaaaaaaaaatccaagcttttgttttcttcttgatgaaccaggaacagcgcactatcaagggcaaaggaaataagcaacacgagagtgatcggagcacggttttagtggcgtcattagaaatcgaatcccccggcgtcgtcaaagccggcgtcgtatcccgcgtcgtactctgatgcatccgacaccatttcccctaaaaggaggccgccgatggcgccgcctagaagacctgcacctagcccagccccgaacttgttcttctttggcggcgcggcggccgcgtacccatactgaggcgccggtggcggagggtacccgtaccctgccggaggaggtgcatatccgtactgggtcggaggtgggtacccgcagaagctcagccacacctgcaaccacaacagacatccacagatggcggtagcaactctcacggcagcttcttctcgtgctgccaccgtcgtcagcaccttcctcggccaaacccggccatcaaacggccactccctcagagattttgttcccgtgggaaaaggaaagttcaccatggggaacgagctgtggtacggcccggaccgtgttaagtacctgggacctttctcggctcagacaccgtcgtacctcaccggcgagttccccggcgactacgggtgggacaccgcggggctgtctgctgacccggaagccttcgccaagaaccgtgctctggaagtgatccacgggaggtgggcgatgttgggggcgtttgggtgcatcacgccggaggtgctgcagaagtggctgcgggtgcagttaaaggagccagtgtggttcaaggccgggtcgcagatcttctccgagggcggcctcgactacctgggcaaccccaacctggtgcacgcgcagagcatcctcgccgtgctggggtgtcaggtcatcctcatggggctggtcgaggggtaccgcatcaacggtctccccggagtgggcgagggcgacgatctgtaccccggaggcacctacttcgacccgctgggcctcgccgacgaccctgtcgccttcgcggagctgaaggtgaaggagatcaagaacggtcggctggcgatgttttccatgttcggcttcttcgtgcaggcgatcgtgacagggaaggggccgctggagaacctgttggatcatctggacaatccggtggccaacaatgcgtgggtttacgccaccaagtttgcgccgggctcttaattcctatgctgtaatttggcatttgtaagaaacagagttggaattgatgtgttgtatgtacgttgttctatcatcgtgcattgatgttatttcattttatgcttccattcggattgacggggtgctgggacgaatgtattcgtcttttgcctataattttatgcttccattc

SEQ ID NO: 2583 - DNA, 881 bp, Utricularia gibba
gctgccgccagctccacgaccgccgtgaagccttctcccttcttgggccagaccaagaactccaaccccctcagattcattgtccccatgggaagcgccaagtataccatgggtaatgatctgtggtacggccccgaccgcgtcaagttcctgggaccattctccgctcaaactccatcgtatctcactggagaattccccggcgactacggatgggataccgccggactctctgcggatccagaggccttcgctaaaaacagagcccttgaggtcattcacgggagatgggcaatgctgggagctctaggctccataacccctgaagttcttcagaaatggctcaatgttgatttcaaggaaccagtctggttcaaggctggagcccagatcttctccgaaggaggacttgactatctagggaaccccaaccttgtccatgctcagagcattcttgcagttcttggggtccaagttgtgctcatggggcttgtggaaggatacagaatcaatgggcttgaaggtgttggagagggcaatgatctttatcccggaggccagtattttgatcctcttggattggccgatgaccctgtgactctcgcagagctcaaggtgaaggagattaagaatgggaggttggccatgttctcaatgtttggattcttcgttcaagccattgtcaccggtaaagggcctcttgagaatctgttggatcatcttgataaccctgttgccaacaatgcttgggtctatgccaccaagtttgcccctggatcataagctctctttgtattagatcccaaatctgatagaccatgttgattctggatgttgataaatgttatctccctcatttgattaaaaaaaaaaaaaaaaaa

SEQ ID NO: 2584 - DNA, 790 bp, Flaveria ramosissima
ctgcagctgctagctccaccgtggtccaagccaccccgttcttgggtcaaaccagaccatctagcctcaaccccttaagagatatggtctctatgccaagtgcaaaatacaccatgggaaatgacttgtggtatggacctgaccgtgttaagtacttgggacccttttcggctcagaccccatcgtacttgactggtgaattccccggtgactacggttgggacaccgccggtttgtccgctgatcccgaggctttcgccaaaaacagggctcttgaggttatccatggacggtgggccatgcttggagcactcgggtgcatcacacccgaggtccttgaaaagtgggtgaaagtggatttcaaggagcccgtctggttcaaggccggagcccaaatattctcagaaggtggtttggactatctcgggaacccgaaccttgtgcatgctcagagcatattgcagtctcggtccagtccgtctatggccttgttgaggggttccgtattaacgggcttgaaggggttggagatggtaacaatttgtatccgggcgggcaatactttgacccattgggccttgcggacgaccccgtgaccttcgccgagttgaaggttaaagagatcaagaacggtagattggctatgttttcgatgtttgggttcttcgtgcaagcaatagtgaccggaaaagggcccgttggagaacttgttggaccatttggacaaccctgtggctaacaatgcatgggtttatgccactaagtttgtgcctggctcttagtacctttt

SEQ ID NO: 2585 - DNA, 755 bp, Picea glauca
agcaaatgccaactcccttagagatgttgtgcccatgggtggtggcaaattcaccatgttgaatgaactgtggtacggaccagaccgggtcaagtacttgggacccttttcagctcagactccgtcgtacctcaccggcgaatttcccggtgactacggatgggacactgccggtttatctgccgatcctgaggcttttgccaagaacagggctcttgaggtaatccatggccgatgggcaatgctgggggcactcggatgcatcaccccggaagtcctcgaaaaatgggtcaaagtggacttcaaggagccagtttggttcaaagcaggtgcccaaattttcacagaaggtggtctagactacttgggcaaccccaatcttgttcatgcacaaagcattcttgcagtactgggattccaagtggtcctaatgggcctcgttgagggttacagaatcaacggccttgatggagtcggagagggcaacgatctctaccccggtggcacatattttgacccacttggcctagctgatgacccggtcacctttgctgagcttaaggtgaaggagatcaagaatggtagactagctatgttctcgatgtttggattctttgttcaagctattgtcaccggcaaaggtccacttgagaatctcttggaccaccttgacaaccctgtggctaacaatgcatgggtctatgccaccaagtttgcgcctggctcgtaaatttcatgaataacttcattaatct

SEQ ID NO: 2586 - DNA, 1053 bp, Cleome gynandra
ttatttatgtcaatattacattacacacagaaattataaaatatcaaagaaaaaaaaagaaaaatggcatcaacatttggaagctcaagcagtgtgttaaggccaactccttttgttagccaaagcaaagtctcaaactttaatcctctaagagatgttgtctctcttggatctcccaaatacattatgagcaatgatctgtggtacggacccaacagagtgaaatacttaggacccttttccgtacagacgccgtcatacctcaccggagaatttcccggtgactacggttgggataccgccggtttatctgccgaccccgaggccttcgccaagaaccgagctcttgaggtgatccatgggaggtgggcaatgttaggagcattgggatgtctaacaccagaagtacttgaaaaatgggttcgtgtggatttcaaagagccaatctggttcaaggccggtgctcagatattctcagaaggtggtttagattacttaggaaaccctaatcttgttcatgctcaaagtatattagccgtcttggccgttcaagtcgttcttatgggtttagttgaaggtttccgtatcaatggccttgaaggtgtaggagaaggcaatgaactttaccctggtggtcaatattttgacccattaggtttggcagatgatcctgttacatttgctgaattgaaggttaaagagattaaaaatggcagattggcaatgttttccatgtttggattctttgttcaagccattgttactggtaaaggaccattggagaatcttcttgatcatcttgataaccctgttgctaataatgcttgggcttttgccactaagtttgtacccggagcttgatgtatcaatctgaaactatttatgatcaatccaaacaaaaatgcatccttatcaatggatctaattagatctgtccatttcggttcagatataatggatacggattattcggattcaaatataatgtatcaatctgaaactacgtatgtacctggagcttgatgtatcaatttgaaactatttatgatcaat

SEQ ID NO: 2587 - DNA, 915 bp, Malus domestica
ttgttgttgttattcgagcgatggtctacactaaattagtctaaactacagaatgcatgtctaatattcggggtttgtgacatgaataggggaatgatttgtggtatggaccagacagagtgaagtatttgggacccttttctgctcagactccttcgtacctgaacggagaatttcctggtgattacggatgggatactgcagggttgtcagctgacccagaggcctttgctaagaaccgggctcttgaggtaatccatagccggtggggctatgcttggagcactaggctgcatcaccccagaagttctcgagaaatgggtgagagtggacttcaaagagccagtgtggttcaaagccggagctcaaatcttctcagaaggaggcctcgactatttgggcaaccccaacctagtccacgctcagagcatcctagcagtgcttgggttccaagtcatcctcatgggtctcgttgaaggattccgtatcaacggtcttgatggcgtaggagagggcaacaacctctaccccggagggcaatacttcgaccccctcggccttgccgatgaccctgtcacctttgccgagctcaaggtgaaggaaatcaagaatgggaggctagccatgttctccatgtttgggttctttgtccaagccattgtgactgggaagggtcccctagagaacctcttggaccaccttgacaaccctgtagctaacaatgcatgggtctatgccaccaagtttgtgcccggatcataaattaatcttcagttcctctaattagtaattattaatcttgtttgggagaatgtaattgaacagaaaattttatggagatgttaatacttgccgttttaattgatcagatttctcaaatgtcactatgagtatcaactctataactgtgatcca

SEQ ID NO: 2588 - DNA, 1077 bp, Distylium racemosum
agggagggctcaaagcaactagtgaaatccttctactcaatctcacagtaaaaatggctgcaacaatcacagcagcagctgcctcaacaacgcccataaccaaatcttcgttcctagcatcttccaagagctttagtaatgctatcagagacaatgttttctttgtcaattcaagacccagatatacaatgagttcaaataatctgtggtatggaccagaccgtgtgaagtacttgggacctttctctgcacagaccccttcatatctgactggtgaattccctggagactatggttgggatacagcagggctctctgctgatccagaggcttttgctcgcaacagagctcttgaggtaattcatgggagatgggcaatgctaggagctctgggatgcatcacccctgaggttctggagaagtgggtgagggtggatttcaaggagcctgtgtggttcaaggctggtgcacagatctttttcagagggtggtttggactatctgggaaaccccaatctggtccatgctcagagcattcttgcagtgttggcattccaggtggttctgatgggacttgttgagggattccgcattaatggtctgcctggtgtgggtgagggaggagacttatatcctgggggcaaatacttcgatccactgggtttggctgatgacccagagacatttgctgaacttaaggtgaaggaactgaagaatggaaggctggccatgttttccatgtttggattctttgtgcaggccatagttactgggaaggggcccttggagaatttgttggatcaccttgacaaccctgttgccaacaatgcatggaattatgcaaccaaatttgtgccaggggcttaaacagtttttggtcgtctgttccagcatttcatttatcttggaagcagcactaattcattgaaagccgctgttgaatttatgtccattgagtccacttgcatgtatactatgtcaaatgtataaatgtcttccctgtaacattcaggatctagattatgtgggcatttgtttactgttgtaattataagactatttaggtgctcttcttgt

SEQ ID NO: 2589 - DNA, 1177 bp, Sciadopitys verticillata
agattgaaagggaatcccacagcaaatagtaaaatccttctgcttctttccatataagaagcatggctgcaacaatcacagcaagagctgtctctactaccaccataactaaatcttcattccttgctccttccaaaggcatcaacagttctttcagagataaagtttcctttgccttttctgcacccagatatttaatgtcattagatctgtggtatggaccagacagagtgaagtacctgggacctttctctgcacagactccatcatatttgaatggtgaattcccaggagactatggttgggatacagcagggctctctgctgatccagaggcctttgctcgcaacagggctcttgaggtaattcatggaagatgggcaatgttaggagccctgggatgcatcactcctgaggttttagagaagtgggtaagggtggatttcaaggagccagtgtggttcaaggctggtgctcagatctttacggagggtggcctagactacttgggaaaccccaacttggtccatgctcagagcattctcgcagtgctgggatgtcaggtggttcttatgggtttagttgagggattcagaattaatggcttgcctggtgtaggtgaaggtggggatctgtaccctgggggtaagtactttgatccattgggtcttgctgatgacccagaggcatttgctgagctcaaggtgaaggaagtcaagaatggaaggctggctatgttttccatgtttgggttctttgtgcaagccatagttactgggaagggacccttggagaatttgttggatcacctagacaaccctgttgccaacaatgcatgggaatatgcaaccaagtttgtgccaggggcttaaacagatgtctgtctaaggccaactaaacaataatttcattcatcttggaaacagaactagttcattcaaagtggttgatgagtaaatttcacttgcatgtatactttgtacatgtcccttcattgcttgtttaatatctgtagtataaaaaaggtgaggggattcaggaaattctgattgcccacccaaatgtataattttcttctctgcgacatttagattttagattatttggggtattcgtttaaatgattctattctactattgtaattatatcagtgtttggatgttcaaattggcattt

SEQ ID NO: 2590 - DNA, 949 bp, Gerbera hybrid cultivar
accagaccatccaaccaaaactcccttagaaacgtcgtcgtatccgtctccaacgccaagttcaccatgggaaatgacttgtggtatggacctgaccgtgttaagtacttgggacccttttcagctcagaccccatcttacctgaccggagaattccccggcgactatggctgggacaccgccggtttatctgctgacccggaagcgttcgccaagaaccgagctcttgaggttatccatgggcgatgggccatgcttggtgcccttgggtgcatcacaccagaggttctcgagaagtgggtcaaggtggacttcaaggaaccggtttggttcaaagccggagcccagatattctcggaaggcggtctggactatctgggcaacccgaacctggttcatgcacaaagcatactagcggttcttgggttccaagtggttctaatgggtctggttgaagggttccgtatcaatggtcttgatggggttggtgatggtaataatttgtacccgggtgggcaatactttgacccgttggggctggcggatgacccggttacatttgcagagttgaaggtgaaggagatcaagaacggaagactggcgatgttttcgatgttcgggttcttcgtgcaggcgatcgtgacggggaaagggccattggagaacttgttggaccatttggataaccctgtggctaataatgcgtgggtctatgccaccaagtttgtgcctggttcatagagtctttttaagtttttgattgtgatggtaattgtgaatgtggaggggaaaatgtgtagattattataatttaatttctatatgatatctaaaatgtgattttgcgatgatatgatggtcttgttttgtttgatcatgttcatgattatactgcaaagattaaagtttaatttcaagaataatcttgattcaaaaaaaaaaaaaaaaa

SEQ ID NO: 2591 - DNA, 915 bp, Pteridium aquilinum
tgcttagctctggaactgtccttaggccaacccattcttggccaaaacagaacctctaatgctaaccctctcagagatgttgtctctacaggcactggcaaatacacaatgggaaatgatctgtggtatggaccagacagagtgaagtacttgggacccttttcagctcagactccgtcatacttgactggagagttccctggtgactatggacgggacacagctggtttatcagctgaccctgaggcctttgccaggaacagggctcttgaggtgacccatggaagatgggcaatgttgggagcactaggctgcatcaccccagaagtccttcagaaatggcttcgtgtgaacttcatggaaccagtatggttcaaagctggagctcagattttctcagaaggtggcttggactacctaggcaaccccagcctggttcatgctcaaagcatcctcgccgtcctcggcttccaagttgtcctcatgggtctggttgaaggattccgcatcaacggtctccctggtgttggagaaggcaatgacctttaccctggtggccgatacttcgaccctcttggccttgctgatgaccctgcaacatttgctgaactcaaggtgaaagaaatcaagaacggcaggctagccatgttctccatgttcggtttcttcgtccaagccattgttaccggaaaaggtcccctggagaacctgtttgaccaccttgacaaccctgttgccaacaatgcttgggtctatgctaccaagtttgtgcctggatcgtaaatcaataatacccagatcaaacttgttctgtgtttgcttgtgtggattagaagggagatgtatctattgttcgacaatgtgaaacctctgtatcactgagattcaatgtaatttagggaaaaggcatatgaa

SEQ ID NO: 2592 - DNA, 1252 bp, Cephalotaxus harringtonia
aaggaaagcccacaagcaattaattatatcctttgtgctcccttccataagaaaaatggctgcaacaattacagctgcatccactgccaccataaccaaatcttcatttcttggatcttccaagggcatcaacaatgctttcaaaaacagggtattctttcccactgctaaaaccattaccactgctaaacgcatatatgcaatgtcaaatgatttgtggtatggaccagaccgtgtaaagtacttggggcctttctcttcacagactccttcatatctgactggtgaattccctggagactatggttgggatacagcagggctctccgctgatccagaggcctttgctcgcaacagggctcttgaggtaattcatgggagatgggcaatgttaggagcactgggatgcataactcctgaggttttggagaaatgggtgaaggtggatttcaaggagcctgtgtggttcaaggccggtgctcagatcttttcagaaggtggcctggattacttgggaaaccccaacttggtccatgctcagagcattcttgcagtgttgggatttcaggtggtattgatgggtttggttgagggattcagaattaatggcttgcctgatgtaggagagggtggggatttgtaccctggaggaaagtactttgatccattgggtctggctgatgacccagagacatttgctgagctcaaggtgaaggaagtcaagaatggaaggttggccatgttttccatgtttgggttctttgtgcaggctatagttactgggaagggaccattggagaatctgttggatcaccttgacaaccctgttgccaacaatgcatgggaatatgcaaccaagtttgttccagggtcttaaacagatgtttatcatcttgttaggccaaaccaacaatgatttcattcgtctcaaggaaacaacattaattcattccaagtggttgatgagttagtttattgagttcacttgcatgtatactgtgtacatgttttccagttgcttgtttgatctcagtagcaatagggtgagggaattgagagaatgcccatgctttagtccagtcaaatgtatcatttttaccttgtggtatttaggatttacttcatgtggggtagtgatttaatatattatattcaactattgtaattacatcactattgggattctcagatttgcattttatgttaagaatagctgtttatggtgattgttttatggtttataaaatttcac

SEQ ID NO: 2593 - DNA, 1026 bp, Fragaria vesca
actcatttccaagcttcattcaattcccaacacctcagagctagaacaagttggtcaatttatcagctaaagcttgacagtcatgtcctccatgcttatggcagccgctgctagctccagcactcttcttagaccaaacaccaactctcttagggatgttgttcctatgggacctgggaaatacaccatggggaatgaattgtggtatggaccagacagagtgaagtacttgggacccttttctgctcagactccttcatacctgaccggagaattccccggcgactacggatgggacactgcagggttgtcagctgacccagaagcctttgctaagaacagggctcttgaggttatccacgggcgatgggcaatgcttggagcattcgggtgcatcaccccagaagtacttgagaaatgggtgagagtggacttcaaagaaccagtctggttcaaagccggagctcaaatcttttcagagggtggtcttgactatttgggcaaccccaaccttgttcatgctcagagcatcctagcagttcttggctcccaagtccttctcatgggacttgttgagggattcagaatcaacggcctcgacggagtaggggagggcaatgatctgtaccccggcggccagtactttgacccacttggccttgctgatgaccctgtcacatttgctgagctcaaggtgaaggagatcaagaatggaagactagccatgttctccatgtttggtttctttgtccaagccattgtcactggcaaaggtcccctagagaacctcttggaccatcttgacaaccctgtagccaacaacgcttgggtctacgccaccaagtttgtgcctggatcgtaaatagagcttgagggtggtgtctagtcttgtgcctgtgaatgtaatcgaatgaagtgctctatgtgaatgtacttattaacaagttgccttaacggattttttttccaccctacatcaatacattccgatcaacataatggtcaagaacctgcatggaaattttc

SEQ ID NO: 2594 - DNA, 1121 bp, Sequoia sempervirens
atagtcaattaatcaaatctttctgctttctgtaagaaaaatggctgcagcaattacagctggctcaactgctaccattaccaaatcttcattccttgcttcttccaagagcttcaacaatgcttccagaagcagggcatcctttaccattgctaagcccatatatgcaatgtcacttgatctgtggtatggaccagaccgtgtaaagtacttgggacctttctctgcacagactccttcatatctgaatggtgaattccctggagactatggttgggatactgcagggctttctgctgatcccgaggcctttgctcgaaacagggctcttgaggtaattcatgggagatgggctatgttaggagccctgggatgcatcactcctgaggttttagagaagtggttgagggtggatttcaaggagcctgtgtggttcaaggctggtgctcaaatcttttcagatggtggcctggactacttgggaaaccccaacttggtccatgctcagagcattcttgcagtgctgggatttcaggtgattttgatgggtttggttgagggattcagaattaatggcttgcctgatgtgggtgagggtggggatttgtaccctgggggacagtactttgatcccttaggtctggctgatgatccagacacatttgctgagctcaaggtgaaggaaataaagaatggaaggctggctatgttttccatgtttgggttctttgtgcaggccatagttactgggaagggacccttggagaatttgttggatcaccttgataaccctgttgctaacaatgcttgggaatatgcaaccaagtttgtgccaggggcttgaacaaacagtgttttcattcatcttggaaacaagatttattcattacaagtggttgatgaatcaattctttgagtttcacttgcatgtatagtgtgtagatgtcttcttagatctcaatagctctaggttgaggggtttgacagaatgccaatgctccagtccagtcagatgtatctttgttttctttctaatatttaaacttaagtttgtatgggtttgatgtatagattttattttaccattgtaattatattactactgcgatactcaaatttgc

SEQ ID NO: 2595 - DNA, 858 bp, Gossypium hirsutum
tccagctaaaatcaactgaaatactttaaaaaaaagaagagggttgcccccttctaactctgaaagacaatggcttcaatgcttagctcaggaaccgtccttaggccaaccccatttcttggccaaaacagaaatgctaaccctctcagagatgttgtctccgtgggcactaccaaatacacaataggaaatgaactgtggtatggaccagacagagtgaagtacttgggacccttttcagctcagattccatcctacttcaacagcgagttccctggtgactacggatgggaactgctggtttgtcaggtgaccctgaggcctttgctaggaacagggctcttgaggtaatccatagaagatgggcaatgttgggagcactaggctgcatcaccccagaagtccttgagaaatggcttagagttgacttcaaggaaccagtatggttcaaggcaggagctgaaattttttcagaaggtggcttggactacctgggcaaccccaaccttgttcatgctcaaagcattctcgctatccctgggttccaggttgtcctcatgggactagtcgaaggattccgcatcaatggtctccctgaagtcggggaaggcaatgacctttaccctggtggccaatagtttgaccctcttggtcttgctgataaaccctgtcacatttgctgaacttaaggttaaggaaatcaagaatggcaggctagccatgttctctatgtttggtttcttcgttcaagccattgtcattagcaaaggtccactggaaaatcttttggaccaccttgacaaccctgttgccaacaatgcttgggtctatgctaactaagtttgtgcctggatcgta

SEQ ID NO: 2596 - DNA, 1133 bp, Cryptomeria japonica
tcaggtggggatttgaaaagaagcccaaagtaaattaatcaaatctctctcctttctgtaagaaaaatggctgcaacaattacagctggttcaactgcaaccattaccaaatcttcattccttgctccttccaagaccttcaacaatgctcccagaaacagagtatcctttaccaccattgctaagcccatatatgcaacttcaaatgatctgtggtatggaccagaccgtgttaagtacttgggccccttctcttcacagactccttcatatctgaatggggaattccctggagactatggttgggatactgcagggctctctgctgatcctgaggcctttgctagaaacagggctcttgaggtaattcatgggagatgggcaatgcttggagccttgggatgcatcactcctgaggttttagagaagtggttgagggtggatttcaaggagcctgtgtggttcaaggctggtgctcaaatctttacagaaggtggcctggactacttgggaaaccctaatttggtccatgctcagagcattcttgcagtgttgggatttcaggtgattttgatgggtttggttgagggattcagaatcaatggtttgcctgatgtgggtgagggtggggatttgtaccctgggggaaagtactttgatccattaggtctggctgatgatccagagacatttgctgagctcaaggtgaaggaaattaagaatggaagactggccatgttttccatgtttggcttctttgtgcaggccatagttactgggaagggacccttggagaatttgttggatcaccttgataaccctgttgctaacaatgcatgggaatatgcaaccaagtttgtgccaggggcttgaacaaacagtgtattacaattcattctatcttggaaacaagatttgttcattacaagtggttgatgagtcaattctttgagtttcacttgcatgtatagtgtgtatgatctcagtagctctaggttgaggggattgacagaatgccaatgctccagtccagtcagatttatctttgttttctttctgatattaaacttgagtttgtatggggtttgatgtaatatattttattttaccatgtcattatattgctattggat

SEQ ID NO: 2597 - DNA, 982 bp, Liriodendron tulipifera
  misc_feature (296)..(296): n is a, c, g, or t
  misc_feature (311)..(311): n is a, c, g, or t
  misc_feature (860)..(860): n is a, c, g, or t
agaccgtccaatctctatcagacagtttttatcggacacccaaatcgacggtagagatggcagcgatgctaacggcagcatcagccagctcgggcacccttcgcaaatcgttcttgggccagaacaagggagccagtgcaaatcccctcagagatgttgtttctatggggaatgggaaattcaccatggggaatgaactgtggtatggtccggaccgggtgaagtacttgggacccttctctgctcagaccccatcatatctcaccggtgaattccccggcgactacggatggganaccgccggattatcngccgaccccgaagcattcgccaggaacagggctcttgaggtgatccacggccgatgggccatgctcggtgcactgggctgcatcacccctgaagtccttgagaaatgggtgaaggtggacttcaaggagcctgtctggttcaaagccggggcccagatcttcacagaaggcgggctggactacctgggcaaccccaacctggtccatgcccagagcatcttggcagtactgggcttccaagttgtcctcatgggcctcgtcgagggctaccgcatcaacggtcttccaggcgtcggagacggtaatgacctctaccctggtgggacctacttcgatccactcggccttgccgatgaccccgttaccttcgccgagctcaaagtgaaggagatcaagaatggccggctcgccatgttctccatgttcggattcttcgtccaggccatcgtcactggcaagggcccgcttgagaacctcttggaccaccttgccaatcctgtggctaacaatgcatgggtctatgccaccaagttcgtgccaggctcttanatgtctcttggttcttcactcccttgtttttgagagcccaagaaaatgggaagtgtgtgtagattatcagtgtactattactggttttaaatgctagattcagcagtatattcatccatttt

SEQ ID NO: 2598 - DNA, 985 bp, Eragrostis curvula
  misc_feature (936)..(936): n is a, c, g, or t
cgcggggcggcgcgggggaactagcagaagtatctagcagcccagacacattcaagagccgcagatggcatcgacgatcatggccgcctccaccccccgcgttcgccgccaagacgcctgttcctgggccagagccgccccgccggcaatgccgccccgctccgcgacgtcgccgccgccgctggtggccggatcaccatgagcaacgacctgtggtacggccctgaccgcgtcaagtacctgggccccttctcagctcagacgccgtcgtacctccgtggcgagttccccggcgactacgggtgggacaccgccggcctctccgccgacccggaggccttcgcccggaacagggccctggaggtgatccacgggcggtgggccatgctgggcgcgctgggctgcatcaccccggaggtgctggagaagtgggtgcgcgtggacttcaaggagcccgtgtggttcaaggcgggggcccagatcttctcggagggcggcctcgactacctgggcaaccccaacctggtgcacgcgcagagcatcctcgccgtgctgggcttccaggtcgtcctcatgggcctcgtcgagggcttccgcatcaacggcctcgacggcgtcggcgagggcaacaacctctacccggggggacagtacttcgacccgctgggactcgccgacgaccccgtcaccttcgccgaactcaaggtcaaggagatcaagaacggacgcctcgccatgttctccttgttcgggttcttcgtccaggccatcgtcaccggaaaggggccactcgagaacctgctcgaccacctcgacgaccccgtcgccaacaacgcgtgggtctacgccaccaagttcgcgccggggtcgtaagcgacccagccggccgatgtgtagtgccaccactgtagactactcgctttgtgacatttgaanccatgatgaacgattgcaaatattgtgatatcaggattcaggaatctta

SEQ ID NO: 2599 - DNA, 956 bp, Cucurbita pepo
tcgtcgccatgggaactcccaaatacaccatgggtaatgatctgtggtatggaccagacagagtcaagtacttgggaccctttcagctcagactccctcctacttgaacggtgagttccccggcgattatggatgggacactgccggcttgtccgccgatcccgaggccttcgccaagaacagagctctcgaggtgatccacgggaggtgggctatgctgggagccttcggttgcataacaccggaagtcctagaaaaatggctgaaagtggacttcaaggagccggtatggttcaaggccggcgcccaaatcttctcagaaggcgggctggattacttggggaacccaaatctggtccacgcgcagagcatcctggccgtgttgggcttccaagtggtcctaatgggactggttgaagggttccgcatcaatggcctggacggcgtgggtgagggcaacgatctctacccagggggtcagtacttcgacccgctcggactggccgacgaccccgtcactttcgcggagctgaaggtgaaggagatcaagaatggccgcctcgccatgttctccatgttcgggttcttcgttcaggccatcgtcaccggaaagggccccctcgagaacctgctggaccatctggataaccctgtggccaacaatgcttgggtttatgccaccaagtttgcccctggctcgtaagtatcaggaagatgggcgctgggaggttttggtccatggaaattgaaggagtttgtggtgtaaattgtttgtatgtgagtggatgtgattaatcgaaggcagagagcattaaggtggatcaattggacattaattcccacttgatcgaaatggatgttcttaatcttaattaaattgccattaattaatgaaaaaaaagaaaaagaaaaactactgtgtgtgtacacgcgtctgtagagacgcgacgacgaca

SEQ ID NO: 2600 - DNA, 910 bp, Flaveria ramosissima
gatgggcttttgattccaaatcgtacggcgactctatacgaagtcggcgtcgtctaacctcctaccacgtgttgttagacgccacccctttcttaggtcaaaccagaggctccaatgtcaatgctcttagagattctgtctccatggtcaatggcaaatacaccatgggaaatgacttgtggtatggaccggaccgagtgaagtacttgggacccttttcggcccaaacaccatcatacttgactggtgaattccccggtgactatggttgggatactgctggtttatctgctgatcccgaggcttttgccaagaaccgggctctcgaggtgatccacgggagatgggccatgttaggagcattcgggtgcatcactcccgaagtcctagaaaaatgggtgaaagtagatttcaaggagccagtctggttcaaagccggagcccaaatcttctccgaaggcgggctagactatttgggcaacccaaacttagtccacgcccaaagcatactagcagtactcggtttccaagtggtcctaatgggcctcgtggaagggtttcgcattaacgggctcgagggtgtaggtgaaggtaacaacctctacccgggtggccagtactttgacccgttgggccttgcggatgacccggtcactttcgccgagctaaaagtgaaggaaatcaagaatgggagactagcaatgttttcaatgtttgggttctttgtgcaagcaattgtaacaggaaaaggaccattggagaaccttttggaccatttggataaccctgtggctaacaatgcatgggtctatgccactaagtttgttcctggttcattaattatgtaactttttaattgttattgtaaattataagttggatgataaaattgaataaaaatattgttata

SEQ ID NO: 2601 - DNA, 1004 bp, Rosa hybrid cultivar
actcacatccaagcttcactgaattcccaactcctcagagctagaacaagttgatcaaatcatcagttaaagcttgacagtcatggcctccatgcttatggcagcaactgctagcaccagcactcttcttagaccaaactccaactctcttagggatgttgtccccatgggacctgggaaatacaccatggggaatgagttgtggtatggaccagacagagtgaagtacttgggacccttttctgctcagactccttcatacctcaccggagaattccccggtgactacggatgggacaccgcagggttgtcagctgacccagaggcctttgctaagaacagggctcttgaggttatccacggacggtgggcaatgctcggcgcatttggctgcatcaccccagaagttcttgagaaatgggtgagagtggacttcaaagaaccagtctggttcaaagccggggctcagattttctcagaaggtggtcttgactatttaggcaaccccaaccttgtccacgctcagagcatcctagcagttcttggctcccaggtcgttctcatggggcttgttgagggattccgaatcaacggcctagatggagttggagagggcaatgatctgtaccccggcggccaatactttgacccactgggccttgctgatgaccctgtcacatttgctgagctcaaggtgaaggagatcaagaatgggagactagccatgttcgccatgtttggtttctttgtccaagccattgtcactggcaaaggtcccctagagaacgtcttggaccatcttgacaaccctgtagccaacaatgcttgggtctacgccaccaagtttgtgcctggatcgtaaatcgagcttgaggccgacatcaaatcttgcctgtgaatctaattgaattgaaagctttatgtgaatgtacttgtaaacaagttgccatcggattttttaaaacttcattgtatgcatcagtactttcaggaaaaaaaaaaaa

SEQ ID NO: 2602 - DNA, 1037 bp, Rosa hybrid cultivar
gacatccaagcttcactgaattcccaactcctcagagctagaacaagttgatcaaatcatcagttaaagcttgacagtcatggcctccatgcttatggcagcaactgctagcaccagcactcttcttagaccaaactccaactctcttagggatgttgtccccatgggacctgggaaatacaccatggggaatgagttgtggtatggaccagacagagtgaagtacttgggacccttttctgctcagactccttcatacctcaccggagaattccccggtgactacggatgggacaccgcagggttgtcagctgacccagaggcctttgctaagaacagggctcttgaggttatccacggacggtgggcaatgctcggcgcatttggctgcatcaccccagaagttcttgagaaatgggtgagagtggacttcaaagaaccagtctggttcaaagccggggctcagattttctcagaaggtggtcttgactatttaggcaaccccaaccttgtccacgctcagagcatcctagcagttcttggctcccaggtcgttctcatggggcttgttgagggattccgaatcaacggcctagatggagttggagagggcaatgatctgtaccccggcggccaatactttgacccactgggccttgctgatgaccctgtcacatttgctgagctcaaggtgaaggagatcaagaatgggagactagccatgttcgccatgtttggtttctttgtccaagccattgtcactggcaaaggtcccctagagaacgtcttggaccatcttgacaaccctgtagccaacaatgcttgggtctacgccaccaagtttgtgcctggatcgtaaatcgagcttgaggccgacatctaatcttgcctgtgaatctaattgaatcgaaagctttatgtgaatgtacttgtaaacaagttgccatcggattttttaaaacttcattgtatgcatcagtactttcagatcaaataataattaggtacaaagaacttgcattaggaaaaaaaaaaaa

SEQ ID NO: 2603 - DNA, 748 bp, Brassica juncea
aaccctcttcgtgatgttgtctctctcggctctcccaaatacactatgggaaatgatctttggtatggaccagacagagtgaagtacttaggacccttttccgtccaaactccatcttacctcacaggagagtttcccggagactacggttgggatacggccggtttatctgcagaccctgaagcctttgccaaaaacagagctcttgaggtgatccatgggagatgggcaatgttgggagcatttggttgcataacccctgaagttcttcagaaatgggtccgtgtggacttcaaagagccggtctggttcaaagccggttcacaaatcttctccgaaggcggtttggactacttaggcaacccaaacctagtccacgctcagagcattttagccgtccttggcttccaagttatcctaatgggattagttgaaggtttccgcatcaacggtcttgatggtgttggtgaaggcaatgacttgtacccgggcgggcaatactttgacccgctgggtcttgcagatgatccagttacttttgctgagctcaaggtgaaagaaatcaagaatggaaggttggctatgttctcaatgtttggcttttttgttcaggctattgttaccgggaaaggtcctttggagaatctccttgaccatcttgataaccctgttgctaacaatgcatgggcttttgcaacaaagtttgtacctggagcttgatctgatcctttgaaatgatatatgaaca

SEQ ID NO: 2604 - DNA, 2888 bp, Setaria italica
tttatatgagcgtggcttggaccaaaaggacatggctggtgcattatagcaagcactagtatatattgctgtttctgtaccctcccttccctcctctctctctctcccctctacccccttttcctctaacctttagctttcctccctccttccctctcctctcccctctcctcttcccttcctctaacaagaactagcctagccattcagatcctaagttgctgaccttgctgcttctcgctggagatagatttgttggttctaagttggaagtatcatgagtccaccgagtgtgatggggcagtttggagacacaacctacaccaaggttttcgttggtggactcgcatgggaaacccagaaggagaccatgaggaagtacttcgagcagtttggggagatcctggaggccgttgtcatcacagacaagaatactggcagatccaaaggctacggatttgttaccttccgggacccggatgcggcgatgagagcttgtgttgatcccgcgccagtgattgacgggaggagggctaactgtaatctggcttcccttggggttcaaagatctaggcctccaacgcctcagcatggagggactaggagctttagggtgatgaaatccttcagccagcaggcagggatccaaggtggactgggagcagcttttccttctcatgccaccttccctcattatgccatcccacaaggcctcccctaccatgtctatgggtactctccctatactccagattacagttatccaacaaacttctacaatatctatggaggagcccagtacccattttatggaggagcagcagctggcatggtgactggaacaagtcccttttatccatatttccagtttgggcagtcaggaaacactacaaccaactatacatctggacaaggctacaacttgcaatacccacagatgttccacttctctactgtatcctctacagctgcagctgtaacaggctttgctcagcagtttggaggaccattgtcactagcagcgagccctcaagcccaagcaggcatgactatggcactcacagctccaacactgccaactccaactcaggctgctcatccttaccggctgattccctcacactttgcggtgtccgctgctccagagcaacccttggcctaaccatggtctcccttcccactgttgctgtcttgttctcgtttccaacatgttgagtccatgtgtccatctctaacaccaaaaggcactattgtagatcctgttcatcagtcaaagtgctcacctccgtatcccacatagttatgtggtgattggaaattagctttagccccaggatgggctcaaagcttcatgccccaaggatggggtgtactaacagacaagcataaaccccaaccattttaacaacagtccaaggaaggacttcatccgggaaaagttagtttcagccctagcaagacaaggctgtagctaaagaaactctaacagtcaagcatgacccagggagggttaattcatgatgatgctagtcaaattggacaacaatgacagctaaacaactgattgaactagcatgccactcccacgtataatcagtagaatcccaaccgtatctagcttaggcatggtgcttctgggtgaagcatgaaccatttagtgtctctaatctttagtcttggtgttacctagagcaaatgaatttgacatatgaccagctactacttcttgtgtaaccaaccgtccacttttctatgcaaatgattagatgcaccaactaacatttcatatgatctttcagttgatagcttgcatctaggtggtcaaggctctaaggagagcctgtgcccctaatcagagacaggttcagagtagtgctaatgtttgtttttagcacttggcactacctcccgtcattccaaacacagtattgggtactccaaagaaggctttggagtagtcaagcactgctgtgtgactcattaacacaatggcccatagataaatttttattgtcttgggtcacccactcatgtagatgtcacttcttggtgttactaccatggttaggtccaggtctcctcctgccccccccccccccccccgcctcccctcccttccccttctctctgtctcttcgcagtgcagagaccttgctgttaatctactattctcaagcatggtggttgtaataataaagtagcactatgctacttgtaggacatgaagaactatttgttatttcacccttcatatgtacttaatatcttgtccatttcaattcagtagttggtacaattatttccaaccattgcagtaccatataatgttgtgtaaaataccactatggtgcacatttcttagtcaccagtctttcaattgcatgtgttccggttgaatgtaaaattacatctgtgaaagtatgcctttagaagcattaactttgtataataggtatgaacactaggaaggctaagaaccttgagttgaccaccccacggccccacccagtagtgtgctactgtgttagtatgctatccatcgatgtctcagtgagacatgggacccttcacttgttggacatcctaatactgaaatatggcatcatcagtgtggtactatgaaaaaattgtgccctcgtttctttttggaagggatagtgatcaacagcttcaatacaagattaagcaaaaatcataagcagtacagcatctgacctaataatcatgtgaaggaattggtaagttagcataagtggaaagaattacctagtaatcttgaagttgaaaacacgttagtattggatggagcaatgactaacatgcaaaacatttcatccaaggtgctacctacttgcactgatgcatatggaatatccaattaagaatat

SEQ ID NO: 2605 - DNA, 1136 bp, Panicum virgatum
ctctcctctcctctcctcttccattcctctaactagtcctagccattcagatcctaagttgctggccttgctgcttcttgttggagaaagatttgttggttccaagttggaagtatcatgagtccaccgagtgtgatggggcaatttggagacacaacctataccaaggttttcgttgggggactcgcatgggaaacccagaaggagaccatgaggaagtacttcgagcagtttggggagatcctggaggccgttgtcatcacagacaagaataccggcagatccaagggctacggatttgttaccttccgggacccggatgcggcgatgagagcttgtgttgatcctgcgccggtgatagacgggaggagggctaactgtaatctggcttcacttggggttcaaagatctaggcctccaacaccccagcatggaggagctaggagcttcagggtgatgaaatccttcagccagcaggcagggatccaaggtggactgggcgcagcttttccttcccatgccaccttccctcattataccatcccacaaggcctcccctaccatgtctatgggtactctccctatactccagactatggctatccaacaaacttctacaatatctatggaggagcccagtacccattttatggaggagcagcagctggcatggtgactggaacaagtcccttttatccatatttccagtttgggcagtcaggaaacactacaaccaactatacatctggacaaggctacaacttgcaatacccacagatgttccacttctctactgtatcatcaacagctgcagctgtgacgggctttgctccgcagtttggaggaccattgtcactagcagtgagcccacaagcccaagcaggcatgactatggcactcacagctccaacactgccaactccaactcaggctgctcatccttaccggctgattccctcacactttgcggtgtccgctgctccagagcaacccttggcctaaccatggtctcccttccaactgttgctgtcttgttctcgtttccaacgtgttgagtccatgcatccatctctaacacaaaaggcactattgtggatcctgttcatcagtcaagtgctcacctccatatcccacat

SEQ ID NO: 2606 - DNA, 2002 bp, Pennisetum glaucum
ccctctccctctctctcctctctactccttttctctaacctttagctttcctccctcgttctcccctctcctcccctcccctctcctctcctctttccttcctttaacaagaactagtcctagccattcagatcctaagttgctgaccttgctgcttgtcgctggagataagatttgttggttctaagttggaagaatcatgagcccaccgagtgtgatggggcagtttggagacacaacctacaccaaggttttcgttggtggactcgcatgggaaacccagaaggagaccatgaggaagtacttcgagcagtttggggagatcctggaggccgttgtcatcacagacaagaataccggcagatccaaaggctacggatttgttaccttccgggacccggatgcggcgatgagagcttgtgttgatcccgcgccagtgattgacgggaggagggctaactgtaatctggcttcccttggggttcaaagatctaggcctccaacgccccagcatggagggactaggacctttagagtgatgaaatccttcagccagcagggagggatccaaggtggactgggagcaacttttccatcgcatgccaccttccctcattatgccatcccgcaaggccttccctaccatgtctatgggtactctccttatactccagattacggttatccaacaaacttctacaatatatatggagcccagtacccattttatggaggagcagcagctggcatggtgactggaacaagtcccttttatccatatttccagtttgggcagtcaggaaacgcgacaaccaactacacatctggacaaggctacaacttgcaatacccacagatgttccagttctctactgtatcctctacagctgcagctgtaacgggctttgcacagcagtttggaggaccattgtcactagcagcgagccctcaagcccaagcaggcatgacaatggcactcacagctccaacactaccaactccaactcaggctgctcatccttaccggctgattccctcacactttgcggtgtccgctgctccagagcaacccttggcctaaccatggtctcccttcccactgttgctgtcttgttctcgtttccaacatgttgagtccatgcattcatctctaacaccaaaaggcactatcgtaaatcctgttcatcagtcgaagtgctcacctccatatcccacatagttatgtggtgattggaaattagctttagccccaggatgggctcaaagcttcatgccccaaggatggggtgtactaacagaaaagcataaaccccaaccattttaacaacagtccaaggaaggacttcatccggggggaaatagtttcaggctttcagccctagcaggacaaggctatagctagagaaactctaacagtcaagcatgacccagggaaggttaattcatgatgatactagtcaaaatggacaacaatgacagctaaacaactgattgaactagcacgccactcccggtataatcagtagaatccaaactgtatctagcttaggcatggtgcttctgggtgaagcatgaaccatttagtgtctctaatcttagtcctggtgtcacctagagcaaatgaatttgacatgtgaccagctactacttcttgtgtaaccaaccgcccaccttttccatgcaaatgattatatgcgccaactaacattatgatctttcagttgatagcttgcatctaggtggtcaaggctctaaggagagcctgtgcccctaatcagagacaggttcagagtagtgctaatgtttgtttttagcacttggcactacctcccgtcattgcaaacacagtattgggtattccaaagaaggctttggagtagtcaagcactgctgtgtgactcattaacacaatggcccatagataaatttttattgtcttgggtcacccactcatgtagatgtcacttcttggtgttactaccatggttaggtccacatctcc

SEQ ID NO: 2607 - DNA, 2360 bp, Zea mays
ttaatatgagcgtgctttggaccaaaaggacctcgctggtgcattatagcaaacactagtatatattgatgtttctgtacctcgccctctctctcctctaccccttttcctctaacctttagctttcctccctccctcctctctttctctcctctaacaagaacttagtcccggcagttcagatcctaagttgctgaccttgctgctgattgttggagatagatttgctgcttctaagttggaaataccatgagtccaccgagtgtgatggggcagtttggggacacgacctacaccaaggtttttgttgggggactcgcgtgggaaacccagaaggagactatgaggaagtatttcgagcagtttggagagatcctggaggctgttgtcatcactgacaagaacactggcagatccaagggctacggatttgttaccttccgggactcggatgcggcaatgagagcttgcgttgatcctgcaccggtgattgatgggaggagggctaactgtaatcttgcttcccttggggttcaaagatctaggcctcctactccccagcatggaggggctaggaactttaaagtgatgaaatctttcagccagcaggcaggaatccaaggtggactgggcgcagcttttccttctcatgccaccttccctcattatgccatcccacaaggcctcccctaccatatctatgggtactctccatataccctagactacggttatccaacaaacttttataatatatatggaggacctcagtacacattttatggaggaggagctggcatggtgacaggaacaagtcccttttatccatatttccagtttgggcaatcaggaaacactactaccaactatacaagtggacaaggctacaacttgcaatacccacaaatgttccacttctcaactgtatcatctacagctgcagctgtgaacggctttgctcagcagtatggaggaccattgtcactagcagcaagtcctcaagcccaagcaggcatgactatggcactcgcagctccaaccatgccaactccaacacaggctgctcatccttaccggttgattccctcagtgtccactgctccagagcaacccttggcctaaccatggtctcccttctcgtcattgctgtactgtctcgtttccaacttgtcgagtccatgcatccatctctaacaccaaaaggcactattgtagatcatgtttatcagccaaagtgctcacatccatatcccacatggtcatgtggtaactggatattagctttagccccaggatgggcacaaagcttcatgccccgaggatggggcgttctaacagacaagtacaaaccctaaccattctaaatatagtccaaggaaggactttatctgggagagttaatttcagctgtagcgagacaaggctgtaactaaaagatactaacagtcaagcatgacccaaggagggttcatgctgatactagtcaaattggactacaatgacagctaaataactgaactagcatgccactcccacatttcatcggtagaatcccaactgtacctagcttaggcctgacatttcttgttgaagcataaaccatttaggcaaacctacccttctatagtcctgctgttacggtgttacctagaccaaatgcatatgatatatgaccagcgactagtgtaaccaactcatcttttctttgcaaaagattagatgcaccaactaacaatttatttgatctttcagttgatagcttgcatctaggtggtcaaggctctaaggagagcctgtgcccctaatcagaaacaggttcagagtagtgccaatgtttgtttttagcacttggcactaccccctgtccctcgaaacacagcattggggactccaaagaaggctttggagtaaccaagcactgctgtgtaactcattaacacaatggacccatagatgaatttttgttgtcttgggtcaccccactcatgtagatgtcattacttctcagtgtcactaccatggttaggtccaggccccccttcactccctccctctctctctgcacagggcagagaccttagcactctttaatctactattaccaggcatggtggttgtaataataaattagcgctatgctacttgtaggacacgaagaactctgttattccacccttcatatgtacttaatatcctgtccatttcagttcagtagttggtacttatttccaaattccaaccattgtagtgcaccatataatgttgtgtaatatatgtccactgtgctgcacatttcttaatcatctgtcgttcagttgcatatattccaggtgaatgtactattagtctattacatctgt

SEQ ID NO: 2608 - DNA, 2704 bp, Oryza sativa
atcgggatacgctcacaaggcctgcatcttacgaaattctgttaagttccctaattcccgacggaatccctccctaactccgttccgtttttgccactatccagacaaggacagctcaacgccaccctgtaactactgttcatccaataaggacagttgagtcattctactgatgctttggccggggtgggtgtgtctcccggtgtgtagtattattatacgagcatggtttggaccaaaaggacaagagtggtgcattatagcagacacttgtatatattgcccttctgtactctcccttcccctctctcctacccccttttccttctaacctttagcttttcctgcctccctccttctttccctcctctcttctcttctcttctcttccatctcctaatcttcccctaacaagtcctagctaaattcagatccttagttgctggtttttcttgttccttttctgagctagatttcttgctgctgagttgaagttagtatcatgagtccaccgagtgtgatagggcaatttggggacacaacctacaccaaggtgtttgtaggagggctggcatgggagacccagaaggagaccatgaggaagtactttgagcagtttggggagatcctggaggcagttgttatcactgacaagaacactggcagatccaagggctatggatttgttaccttccgggacccggatgcggcgatgagggcttgcgttgatcccgcgccggtgatcgacgggagaagggctaactgtaatctggcttcccttggggttcagagatctaggcctccaaccccacagcatggaggggctaggagctttagggtgatgaagtcctttagccagcaggcagggatccaaggtggtctgggcgcagcttttccttctcacgccaccttcccccattatgctatcccacaaggtctcccttaccatgtctatgggtactctccctattctccagactacagttatcccacaaactactacaacatctacggaggagctcaatacccattttatggagcggcggcggcggcggcagcagcagcagctggcatggtgactggaagcagccccttttatccatatttccagtttgggcaatcaggaagcactacaaccaactatgcaagtggacaaggctacaacttgcaatacccacagatgtttcacttctcaactgtggcttctacagctgctgctgtaacaggttttgcacagcaatatggagggccattgtctcttgcagcgagtcctcaagcccaagcaggcatgactatggctctcacagctcctactttgccgactccaactcaggctgctcatccttaccggctcattccctcgcattttgctgtgtctgctgctccagagcaacccttggcctaaccatggtctcctttctcatcgtcactctcatttttatttcccacatgttgagtccatgcatccatctctaacaccagaaggcactattgttgacctcatgctcatcagctaaaagtgcacactccatatcccacatggtcatgtggtgattggagataagcttcagccccaggatgggctcaaagcttaatgcccccatggatggggctgtactaacagagaagcacaaaccaaccaatttaacaacagtccaaggaaggacttcatggattaatttcaaccctagcagagaaggctatgggcaaaagtaaccctaacaatcaagcattaacccagggagggttcatgctgatacaggccaattggacaaaagtgacatctaaacaactgatcgagcaagaatgccacttcaaaatttcgtcagtggaatctatattgtatttagcataggccatgtgcttctggatgaagcacaaaccatttagcagaccctaatcttctagtcttgctgttacctagaggaaatcaatttgacatgtaaccagtctttaacctcttcccatgcaaattagcccccagcaacttatctaacaccacgtgttaacttgtgtaaccaacttttaacctttagtaagcaactattaggtgctccaactaacattccttttttatcttccagtttatagcttgcatctaggtggttaaggctctaaggagagcctgtgccccttgtcagagacaggttcagaggagtgctaatgtttgtttttggcacttagtgctacctcctgtcatttctaacatagtgatggtaccccaaagaaggctttggaaatgccagacactgcctatgtatttcattcattaaccccaatggacccatagatatattttattgtcttgggtcggccactcatctagatgtccattgcttccccaatgtcactaccatggttaggtccaggatcactcctttctgctcccttccctccttccccacctctcttccctctctctgtgtgtacagagagaagccttaatgctttttaatgtactattatcggacatggtgattgtaataataaagtagtactgtgacacttttaggacaagcagtcaagcagaactgtttactattcaatcctgcatttctgccacatccattcctgatgttgtagtttattgtataatgttatgtaaaatctacctaccgtgatgcaaatttcttgctcgtttatcttttacctagtttcatctcagaaatcagaatttaaataaacaggaattactgatgtgaaa

SEQ ID NO: 2609 - DNA, 2214 bp, Oryza sativa
tctctcctacccccttttccttctaacctttagcttttcctgcctccctccttctttccctcctctcttctcttctcttctcttccatctcctaatcttcccctaacaagtcctagctaaattcagatccttagttgctggtttttcttgttccttttctgagctagatttcttgctgctgagttgaagttagtatcatgagtccaccgagtgtgatagggcaatttggggacacaacctacaccaaggtgtttgtaggagggctggcatgggagacccagaaggagaccatgaggaagtactttgagcagtttggggagatcctggaggcagttgttatcactgacaagaacactggcagatccaagggctatggatttgttaccttccgggacccggatgcggcgatgagggcttgcgttgatcccgcgccggtgatcgacgggagaagggctaactgtaatctggcttcccttggggttcagagatctaggcctccaaccccacagcatggaggggctaggagctttagggtgatgaagtcctttagccagcaggcagggatccaaggtggtctgggcgcagcttttccttctcacgccaccttcccccattatgctatcccacaaggtctcccttaccatgtctatgggtactctccctattctccagactacagttatcccacaaactactacaacatctacggaggagctcaatacccattttatggagcggcggcggcggcggcagcagcagcagctggcatggtgactggaagcagccccttttatccatatttccagtttgggcaatcaggaagcactacaaccaactatgcaagtggacaaggctacaacttgcaatacccacagatgtttcacttctcaactgtggcttctacagctgctgctgtaacaggttttgcacagcaatatggagggccattgtctcttgcagcgagtcctcaagcccaagcaggcatgactatggctctcacagctcctactttgccgactccaactcaggctgctcatccttaccggctcattccctcgcactttgctgtgtctgctgctccagagcaacccttggcctaaccatggtctcctttctcatcgtcactctcatttttatttcccacatgttgagtccatgcatccatctctaacaccagaaggcactattgttgacctcatgctcatcagctaaaagtgcacactccatatcccacatggtcatgtggtgattggagataagcttcagccccaggatgggctcaaagcttaatgcccccatggatggggctgtactaacagagaagcacaaaccaaccaatttaacaacagtccaaggaaggacttcatggattaatttcaaccctagcagagaaggctatgggcaaaagtaaccctaacaatcaagcattaacccagggagggttcatgctgatacaggccaattggacaaaagtgacatctaaacaactgatcgagcaagaatgccacttcaaaatttcgtcagtggaatctatattgtatttagcataggccatgtgcttctggatgaagcacaaaccatttagcagaccctaatcttctagtcttgctgttacctagaggaaatcaatttgacatgtaaccagtctttaacctcttcccatgcaaattagcccccagcaacttatctaacaccacgtgttaacttgtgtaaccaacttttaacctttagtaagcaactattaggtgctccaactaacattccttttttatcttccagtttatagcttgcatctaggtggttaaggctctaaggagagcctgtgccccttgtcagagacaggttcagaggagtgctaatgtttgtttttggcacttagtgctacctcctgtcatttctaacatagtgatggtaccccaaagaaggctttggaaatgccagacactgcctatgtatttcattcattaaccccaatggacccatagatatattttattgtcttgggtcggccactcatctagatgtccattgcttccccaatgtcactaccatggttaggtccaggatcactcctttctgctcccttccctccttccccacctctcttccctctctctgtgtgtacagagagaagccttaatgctttttaatgtactattatcggacatggtgattgtaataataaagtagtactgtgacacttttaggacaagc

SEQ ID NO: 2610 - DNA, 2378 bp, Brachypodium distachyon
cccttccttcccctctctccgactctctctccctttcctctaacctttagcttttccaccttctctccctcctctacccttactctaacaagagctagtgctagcaaaattcagatccttagttgctggtttcgttgtttctctttggagtttgggtttgtagttgcttgaggtgaagaagtttgcaccatgagtccaccgagtgtgatggggcagtttggagacacaacctacaccaaggtgttcgtaggcgggctggcgtgggagacccagaaggagaccatgaggaagtatttcgagcagttcggggagatcctggaagccgtcgtcatcactgacaagaacaccgggagatccaagggctacggatttgttaccttccgggacccggatgcggcgatgaggtcttgcgttgatcccgcgccggtgatcgacgggaggagggctaactgtaacctggcttcccttggtgttcagagatctaggcctccaaccccacagcacggaggcgcaaggagctttagggtgaagtcttttagccagcaggcagggatccaaggtgggctgggtgcagcttttccttctcaggccaccttccctcattatgccatcccacagggcctcccttaccatgtctatgggtactctccatattctccagactacggttatcccacaaactactataacatctatggaggaacccagtacccattttatggaggagcgggagctggcatggtgactggaaccagtcccttttatccatatttccagtttgggcagtcaggaagcactacgaccaactatggaaatggacagggctacaacatgcaatacccacagatgttccaattctccactgtagcttctacacctgctgctgtaacaggctttgcaccgcaatatggaggaccattgtcacttgcagcgagtcctcaagcccaagcaggcatgactatggctctcacggctccaaccttaccaagtccaactccggctgctcatccttaccggctcatcacctcgcactttgctgtgtctgctgctccagagcaatccttggcctaaccatggtctcctttctcatcgtcatcgtctcacttttattttctacgtgttgagtccatgcatccatctctaacaccaaagggcactattgttgattccacgttcatcggtcaaagtgcctccctctccatatcccacatggttatgtggcgaatggagatcagcttaagccccaggatgggctcaaagcttgatgccccaaggatggggttgtactaacaatcgagcacaaaccagacactttacccacagtcccaaggacttcatccaagagagttaatttcagccatacaagagaaaggatgtgggcaaacgaaaccctaacaatcaagcatgaccccaaggagggttcatgttgatacaagccaaattggacaaaactgacatctaggtaactaattgagctagagcatgccactctgaaatttcaacagtggaatttatactgtatttagcttaggaaaagtgcttctggatgaagcagggaccatttagcagatcctaatattctattcacgggtgttatctagagcaaataaaatttgacatctgaccagtctataacttcatttccacgcatactcacaccccccctcccatcaccaccagcaacttcacaacaacatcctgtgataacatcctgtgtaaccaaccactcacctttcctatgcactgagtagatgcaccaactaacagttctttttatccttcagttggtagcttgcatctaggtggttaaggctctaaggagagcctgtgcccctcatcagagacaggttcaggagtgctaatgtttgtttttggcacttagcactaccttctgtcatttttaacacagtgatgggactccaaagaaggctttggatacaccaagcactgagtgcaactcagtaaccccaatggacccacagatatatttttattgtcttgggtcacccactcatctagttcatcttctccagtgtcactaccatggttaggtccaagactccctccctcgcaccccgcccccctccctcccctccagcaccactactttctgcctttctctgtggacagagacgggccttaatgctttttaatgtactattatcaaacatggcagttgtaataataaagtggcactatgctacttgtaggacaaaaactgtactattttatcatgcggatgtagccaagtattctgtcaatttatagccagtactttctatatcgatattgtaggtcaccctataatgtaatgtaaaatcgccagctgtgttgcacatttcttattcattatctttaactatttcgtcttggcactt

SEQ ID NO: 2611 - DNA, 2251 bp, Secale cereale
ctagtgtcctagcccaattcagatcctttagttgcagctggttttgttgcttcccctctggtgctgaggtagaagaagaagaagaataaggtagccatgagtccgccgagtgtgatgggacagttcggggacacgacctacaccaaggtgttcgtcggggggctggcgtgggagacgcagaaggagaccatgaggaagtacttcgagcagttcggggagatcctcgaggccgtcgtcatcaccgacaagaacaccggcagatccaagggctacggatttgttaccttccgggacccggatgcagcgatgaggtcttgcgtcgaccccgcgccggtgatcgacgggaggagggccaactgcaacctggcttcccttggggtgcagagatccaggcctccaaccccgcagcacggaggcgctaggagctttcgggtgatgaagtcctttgggcagcagcaggctgcggggatccaaggtgcgctgggcgcagcttttccctcgcaggccaccttccctcattatgccatcccacaaggcctcccttaccatgtctatgggtactctccttattctccagactacggttatcccgcaaactactacaacatctatggaggaaaccagtacccgttttacggaggagcaggaactggcatggtgactggaaccaatcccttctatccatacttccagttcgggcagtccggaagcactacgcccaactatgcaagtggacagggctacaacatgcaattcccacagatgttccccttctcaactgtggcttctacagctgctgctgtaactggctttgcacagcaatatggagggccattgtcacttgcagcaagtcctcaagcccaagcaggcatgactatggctctcacagcaccaaccttgccaagtccaactcaggctgctcatccttaccggctcgtcccctcgcactttgctgtgtctgctgctccagagcaatccttggcctaaccatggtctccatcctcatcgtcaccgtctcttttttatttcctatgtgttagtccatgcatccatctctaacaccaaagggtgtcaccaatgttgatcccatgtggatcacgtaagtgcccctctctccatatcccacatggttatgtgatgattggagaccagcttgagccccaggatgggctcaaagcttgatgccccaaggaggggatgtactaacagttgggcgcaaaccagccgtttaaccagtccaaggaaggacttcatccaagagagttaatttgagccttagcaagagatggctacgggaaaaggcgaccctaacaatcaagcatgaccctagggagggttcatgctgatacaatccaaattggacaaaactgacatgtagacaaccaattgagctagcatgccactcctaaacttcatcagtggaattcatactgtatttagcttaggccaagtgcttctggctgaagcatgaggcatttagcagatcctaatattctattcatgggtgttatctagagcaaataaaacttgacatctgaccagtctataacttcatttccacgcatagtcacacacacacccctccccaccaccaccagcaacttcgcaacaacatcctgtgataacttcttgtgtaaccaaccactctaacttttctatgcactgagtagatgcaccaactaacagttctttatccttcagtttatagcttgcatctaggtggctcaggctctaaggagagcctgtgcccctcatcagagacaggttcaggagtgctaatgttagtttttggcacttggcactacctcctgccatttgtaacacagtgatgggactccaaagaaggctttggagataccaaaacactgctgtgcaactcaataaccccaatggacccaggcatattttattgtcttgggtcacccactcatctagatgttcatcttcccaatgtcattaccatggttaggtccaggacccactctctttctctctctgtgcagagaggctttgatgcttttaatgtaatattatcggtcacggtgattgtaataataaagtagtactatgccacttctagggcaggaactctttactgttttatcagtcggatcaagctaaatattctgtcaatctataatcagtaccttctctgtcgacatggtagctcgccatatagtgcaatgtaaatctacctgttatgttgcacatttctcattcaatgatcttttataactaaaaactaaaagaa

SEQ ID NO: 2612 - DNA, 2251 bp, Secale cereale
cgggcgtccccccccccaccccttttcttcctctaacctttacgcttttccttcactccctccctccgttcctctaacaagaactgcagcccgctagtgtcctagcccaacttcagatcctttagtttgcagctggttttagtttgtctcccctttcggtgctgaggtagaagaaggagaagaagaagaagaaggtagccatgagtccgccgagtgtgatgggacagttcggggacgacgacctacaccaaggtgttcgtgggcgggctggcgtgggagacccagaaggagaccatgaggaagtacttcgagcagttcggggagatcctcgaggccgtcgtcatcaccgacaagaacaccggcagatccaagggctacggatttgtaccttcggacccggatgcggcgatgaggtcatgcgtcgaccccgcgccggtgatcgacgggaggagggccaactgcaaccttgcttcccttggggttcagagatccaggcctccaaccccgcagcacggaggcgctaggagctttcgggtgatgaagtcctttgggcagcagcaggctgcggggatccaaggtgcgctgggcgcagcttttccctcgcaggccaccttccctcattatgccatcccacagggcctcccttaccatgtctatgggtactctccttattctccagactacggctatcccgcaaactactacaacatctatggaggaaaccagtacccgttttacggaggagcaggaactggcatggtgactggaaccaatcccttctatccatacttccagttcgggcagtccggaagcactacgcccaactatgcaagtggacagggctacaacatgcaattcccacagatgttccccttctcaactgtggcttctacagctgctgctgtaactggctttgcacagcaatatggagggccattgtcacttgcagcaagtcctcaagcccaagcaggcatgactatggctctcacagcaccaaccttgccaagtccaactcaggctgctcatccttaccggctcgtcccctcgcactttgctgtgtctgctgctccagagcaatccttggcctaaccatggtctccatcctcatcgtcaccctctctattttatttcctatgtgttagtccatgcatccatctctaacaccaaagggcactaatgttgatcccatgtggatcgcgtaagtgcccctctctccatatcccacatggttatgtgatgattggagatcagcttgagccccaggatgggctcaaagcttgatgccccaaggaaggggatgtactaacagtcgggcgcaaaccagccgtttaaccagtccaaggaaggacttcatccaagagagttaatttgagccctagcaagagatggctacgggaaaagacgaccctaacaatcaagcatggccctagggagggttcatgctgatacaatccaaattggacaaaactgacatgtagacaaccaattgagctagcatgccactcctaaacttcatcagtggaattcatactgtatttagcttaggccaagtgcttctggctgaagcatgaggcatttagcagatcctaatattctattcatgggtgttatctagagcaaataaaacttgacatctgaccagtctataacttcatttccacgcatagtcacacacacccctccccaccaccaccagcaacttcacaacaacatcctgtgataacttcttgtgtaaccaaccactctaacttttctatgcactgagtagatgcaccaactaacagttctttatccttcagtttatagcttgcatctaggtggctcaggctctaaggagagcctgtgcccctcatcagagacaggttcaggagtgctaatgttagtttttggcacttggcactacctcctgccatttgtaacacagtgatgggactccaaagaaggctttggagataccaaaacactgctgtgcaactcaataaccccaatggacccaggcatatttttattgtcttgggtcacccactcatctagatgttcatcttccccaatgtcattaccatggttaggtccaggacccactctctttctctctctgtgcagagaggctttgatgctttttaatgtaatattatcggtcacggtgattgtaataataaagtagtactatgccacttctagggcaggaactctttactgttttatcagtcggatcaagctaaatattctgtcaatctataatcagtacctt

SEQ ID NO: 2613 - DNA, 1281 bp, Secale cereale
tcccctccgttcatctaacaagagccgccgctagtgtcctagcccaattcagatcctttagttgcagctggttttagttgcttcccctctggtgctgaggtagaagaagaagaaggtagcagcgtcgccatgagcccgccgagtgtgatggggcagttcggggacacgacctacaccaaggtgttcgtgggcgggctggcgtgggagacccagaaggagaccatgaggaagtacttcgagcagttcggggagatcctcgaggccgtcgtcatcaccgacaagaacaccggcagatccaagggctacggatttgttaccttccgggacccggatgcggcgatgaggtcatgcatcgaccccgcgccggtgatcgacgggaggagggccaactgcaaccttgcttcccttggggttcagagatccaggcctccaaccccgcagcacggaggagctaggagctttcgggtgatgaagtcctttgggcagcagcaggctgcggggatccaaggtgcgctgggcgcagcttttccctcgcaggccaccttccctcattatgccatcccacagggcctcccttaccatgtctatgggtactctccttattctccagactacggctatcccgcaaactactacaacatctatggaggaaaccagtacccgttttacggaggagcaggaactggcatggtgactggaaccaatcccttctatccatacttccagttcgggcagtccggaagcactacgcccaactatgcaagtggacagggctacaacatgcaattcccacagatgttccccttctcaactgtggcttctacagctgctgctgtaactggctttgcacagcaatatggagggccattgtcacttgcagcaagtcctcaagcccaagcagtgtgtatcccattaaacaggcatgactatggctctcacagcaccaaccttgccaagtccaactcaggctgctcatccttaccggctcgtcccctcgcactttgctgtgtctgctgctccagagcaatccttggcctaaccatggtctccatcctcatcgtcaccgtctctttttattcctatgtgttagtccatgcatccatctctaacaccaaagggtgccaccaatgttgatcccatgtggatcacgtaagtgcccctctctccatatcccacatggttatgtgatgattggagaccagcttgagccccaggatgggctcaagcttgatgccccaggagggatgtactaacagtcgggcgcaaccgcgttaaccagtc

SEQ ID NO: 2614 - DNA, 2479 bp, Hordeum vulgare
tcccctccccctctctctctccccacccctttctcctctaacctttagcttttcctcactcactccctctctctcccaccgttcctctaacaaggcccgccgctcgtagcgtcctagcccaattcagatccttagctgcagctgctttcagtcgtttcctcttcctcgaggcgacgaagaaggaggcggcggcgtcgccatgagcccgccgagcgtgatggggcagttcggggacacgacctacaccaaggtgttcgtgggggggctggcgtgggagacgcagaaggagaccatgaggaagtacttcgagcagtttggggagatcctcgaggccgtcgtcatcaccgacaagaacaccggcagatccaagggctacggatttgttaccttccgggacccggatgcggcgatgaggtcttgcgtcgatcccgcgccggtcatcgacgggaggagagccaactgcaacctggcttcccttggtgttcagagatccaggcctccaaccccacagcacgggggtgctaggagctttcgagtgatgaagtcctttgggcagcagcaggctgcggggatccaaggtgcgctgggcgcagcttttccttcgcaggccaccttccctcattatgccatcccacagggcctcccttaccacgtctatgggtactctccttattctccagactacggttttcccgcaaactactacaacatctatggaggaaaccagtacccattttacggaggagcaggaactggcatggtgactggaaccagtcccttctatccatatttccagtttgggcaatccggaagcactacgcccaactatgcaactggacaggggtacaacatgcaatacccacagatgtttcccttctcaactgtggcttctacagccgctgctgtaacaggctttgcacagcaatatggagggccattgtcacttgcagcgagtcctcaagcccaagcagtgtgtatccccattaaacaggcatgactatggctctcacagcaccaaccttgccaagtccaactcaggctgctcatccttaccggctcgtcccctctcactttgctgtgtctgctgctccagagcaatccttggcctaaccatggtctccattctcatcatcgccgtctctttttatttcctatgtgttgagtccatgcatccatctctaacaccaaagggtgtcaccaatgttgatcccatgtggatcacttaagtgcctctctctccatatcccacatggttatgtgacgattggagattagcttgagccccaggatgggctcaaagctttgatgccccaaggaaggggatgtactaacagtcaagcgcaaaccagccatttaaccagtccaaggaaggactacatccaagagagttaatttgaaccctagcaagagatggctacggggaaaagcgaccctaacaatcaagcatggccccagggaggggtcatgctgatacaagccaaattggacaaaactgacatgtagacaaccaattgagctagcatgccactccaaaatttcatcagtggaattcatactgtatttagcttaggccaagtgcttctggctgaagcatgaggcatttagcagatgctaatattctattcatgggtgttatctagagcaaataaaatttgacagctgaccagtctataacttcatttccacgcatactcacacacacgcctccccaccaccaccagcaacttcacaacaacatcctgtgataacttcttgtgtaaccaaccactctaactttttctatgcactgagtagatgcaccaactaacagttctttatccttcagtttatagcttgcatctaggtggctcaggctctaaggagagcctgtgcccctcatcagagacaggttcaggagtgctaatgttagtttttggcacttggcactacctcctgccatttgtaacacggtgatgggactccaaagaaggctttggagataccaaaacactgctgtgcaactcaataaccccaatggacccaggcatatttttattgtcttgggtcacccactcatctagatgttcatcttccccaatgtcattaccatggttaggtccaggacccactgtctctctctctctctctctgtgcagagaggctttgatgctttttaatgtaatattatcggtcacagtgattgtaataataaagtagtactacgccatttctagggcaggaactctttactgttttatcagtcggatctagctaaatattctgtcaatctataatcagtaccttctctatcgacatggtagctcgccatataatgcaatgtaaaatctacctgttctgttgcacatttcttattcaattatcttttatccaatttcgtttcagtacttagtaagcaaaaataagtaatctgaaatatgtgttaacagcatactcccttcacttcacacatatgatgcggatgcagactggtcagtttgag

SEQ ID NO: 2615 - DNA, 2383 bp, Secale cereale
ctttctcctctaaacctttagcttttcctcactccctccctccgttcctctaacaagaactgcagccccctagtgtcctagcccaattcagatcctttagttgcagctggttttagttgcttcccctctggtgctgaggtagaagaagaagaagaagaaggtagccatgagcccgccgagtgtgatggggcagttcggggacacgacctacaccaaggtgttcgtgggcgggctggcgtgggagacccagaaggagaccatgaggaagtacttcgagcagttcggggagatcctcgaggccgtcgtcatcaccgacaagaacaccggcagatccaagggctacggatttgttaccttccgggacccggatgcggcgatgaggtcctgcgtcgaccccgcgccggtgatcgacgggagaagggccaactgcaacctggcttcccttggggtgcagagatccaggcctccaaccccgcagcacggaggcgctaggagctttcgggtgatgaagtcctttgggcagcagcaggctgcggggatccaaggtgcgctgggcgcagcttttccctcgcaggccaccttccctcattatgccatcccacaaggcctcccttaccatgtctatgggtactctccttattctccagactacggctatcctgcaaactactacaacatctatggaggaaaccagtacccgttttacggaggagcaggaactggcatggtgactggaaccaatcccttctatccatacttccagttcgggcagtccggaagcactacgcccaactatgcaagtggacagggctacaacatgcaattcccacagatgttccccttctcaactgtggcttctacagctgctgctgtaactggctttgcacagcaatatggagggccattgtcacttgcagcaagtcctcaagcccaagcagtgtgtatccccattaaacaggcatgactatggctctcacagcaccaaccttgccaagtccaactcaggctgctcatccttaccggctcgtcccctcgcactttgctgtgtctgctgctccagagcaatccttggcctaaccatggtctccatcctcatcgtcaccgtctcttttttatttcctatgtgttagtccatgcatccatctctaacaccaaagggtgccaccaatgttgatcccatgtggatcacgtaagtgcccctctctccatatcccacatggttatgtgatgattggagaccagcttgagccccaggatgggctcaaagcttgatgccccaaggaaggggatgtactaacagtcgggcgcaaacccgccgtttaaccagtccaaggaaggacttcatccaagaagagttaatttgagccctagcaagagatggctacgggaaaaagcgaccctaacaatcaagcatggccctagggagggttcatgctgatacaatccaaattggacaaaactgacatgtagacaaccaattgagctagcatgccactcctaaacttcatcagtggaattcatactgtatttagcttaggccaagtgcttctggctgaagcatgaggcatttagcagatcctaatattctattcatgggtgttatctagagcaaataaaacttgacatctgaccagtctataacttcatttccacgcatagtcacacacacccctccccaccaccaccagcaacttcacaacaacatcctgtgataacttcttgtgtaaccaaccactctaacttttctatgcactgagtagatgcaccaactaacagttctttatccttcagtttatagcttgcatctaggtggctcaggctctaaggagagcctgtgcccctcatcagagacaggttcaggagtgctaatgttagtttttggcacttggcactacctcctgccatttgtaacacagtgatgggactccaaagaaggctttggagataccaaaacactgatgtgcaactcaataaccccaatggacccaggcatatttttattgtcttgggtcacccactcatctagatgttcatcttccccaatgtcattaccatggttaggtccaggacccactctctttctctctctgtgcagagaggctttgatgctttttaatgtaatattatcggtcacggtgattgtaataataaagtagtactatgccacttctagggcaggaactctttactgttttatcagtcggatcaagctaaatattctgtcaatctataatcagtaccttctctgtcgacatggtagctcgccatatagtgcaatgtaaaatctacctgttatgttgcacatttcttattcaatgatcttttatctaattttgtctcggtacttagtaaatgaaaaaagtaatgtgaaatatgttaacaa

SEQ ID NO: 2616 - DNA, 2226 bp, Triticum aestivum
ctccgttcctctaacaagagccgctagtgtcctagcccaattcagatccttagctgcagctggtttagttgcctcccctctggtgctgaggtagaagaagaagaaggaggtagcagcatcgccatgagcccgccgagtgtgatggggcagttcggggacacgacctacaccaaggtgttcgtgggcgggctggcgtgggagacccagaaggagaccatgaggaagtacttcgagcagttcggggagatcctcgaggccgtcgtcatcaccgacaagaacacgggcagatccaagggctatggatttgttaccttccgggacccggatgcggcgatgaggtcctgcgtcgaccccgcgccggtgatcgacgggaggagggccaactgcaacctggcttcccttggggtgcagagatccaggcctccaaccccacagcacgggggcgctaggagctttcgagtgatgaagtcctttgggcagcagcaggctgcggggatccaaggtgcgctgggcgcagcttttccttcgcaggccaccttccctcattatgccatcccacaaggcctcccttaccatgtctatgggtactctccttattcaccagactacggttatcccgcaaactactacaacatctatggaggaaaccagtacccgttttacggaggagcaggaactggcatggtgactggaaccagtcccttctatccatatttccagtttggccagtccggaagcactacacccaactatgcaactggacagggctacaacatgcaattcccacagatgttccccttctcaactgtggcttctacagctgctgctgtaactggctttgcacagcaatacggagggccattgtcacttgcagcgagtcctcaagcccaagcagtgtgtatccccattaaacaggcatgactatggctctcacagcaccaaccttgccaagtccaactcaggctgctcatccttaccggctcgtcccctcgcactttgctgtgtctgctgctccagagcaatccttggcctaaccatggtctccatcctcatcgtcaccgtctcttttttatttcctatgtgttagtccatgcatccatctctaacaccaaagggtgtcaccaatgtcgatcccatgtggatcacgtaagtgcccctctctccatatcccacatggttatgtgatgaatggagaccagcttgagccccaggatgggctcaaagcttgatgccccaaggaaggggatgtactaacagtcgggcgcaaaccagccgtttaaccagtccaaggaaggacttcatccaagagagttaatttgagccctagcaagagatggctacgggaaaaagcgaccctaacaatcaagcatgaccctagggagggttcgtgctgatacaatccaaattggacaaaactgacatgtagacaaccaattgagctagcatgccactccaaaacttcatcagtggaattcatactgtatttagcttaggccaagtgcttctggatgaagcatgaggcatttagcagatcctaatattctattcacgggtgttatctagagcaaataaaatttgacatctgaccagtctataacttcatttccacgcatactcacacccccctcccatcaccaccagcaacttcacaacaacatcctgtgataacttcttgtgtaaccaaccactctaacttttctatgcactgagtagatgcaccaactaacagttctttatccttcagtttatagctttgcatctaggtggctcaggctctaaggagagcctgtgcccctcatcagagacaggttcaggagtgctaatgttagtttttggcacttggcactacctcctgccatttgtaacacagtgatgggactccaaagaaggctttggagataccaaagcactgctgtgcaactcaataaccccaatggacccaggcatatttttattgtcttgggtcacccactcatctagatgttcatcttccccaatgtcattaccatggttaggtccaggacccactctctttctctctctgggcagagaggctttgatgctttttaatgtaatattatcggtcacgatggttgtaataataaagtagtactatgccacttctagggcaggaactctttactgttttatcagtcggatctagctaaatattctgtcaacctataatcagtaccttctctatcgacatggtagctcgccatataa

SEQ ID NO: 2617 - DNA, 2326 bp, Secale cereale
acaagaactagcagcccgcctagtgtcctagcccaacttcagatcctttagttgtcagctggtttagttgcttccctttcggtgctgaggtagaagaaggagaagaagaagaagaaggtagccatgagtccgccgagtgtgatgggacagttcggggacacgacctacaccaaggtgttcgtgggcgggctggcgtgggagacccagaaggagaccatgaggaagtacttcgagcagttcggggagatcctcgaggccgtcgtcatcaccgacaagaacaccggcagatccaagggctacggattgtaccttccgggacccggatgcggccatgaggtcttgcgtcgaccccgcgccggtgatcgacgggaggagggccaactgcaacctggcatcccttggggtgcagagatccaggcctccaaccccgcagcacggaggagctaggagctttcgggtgatgaagtcctttgggcagcagcaggctgcggggatccaaggtgcgctgggcgcagcttttccctcgcaggccaccttccctcattatgccatcccacagggcctcccttaccatgtctatgggtactctccttattctccagactacggttatcctgcaaactactacaacatctatggaggaaaccagtacccgttttacggaggagcaggaactggcatggtgactggaaccaatcccttctatccatacttccagttcgggcagtccggaagcactacgcccaactatgcaagtggacagggctacaacatgcaattcccacagatgttccccttctcaactgtggcttctacagctgctgctgtaactggctttgcacagcaatatggagggccattgtcacttgcagcaagtcctcaagcccaagcagtgtgtatccccattaaacaggcatgactatggctctcacagcaccaaccttgccaagtccaactcaggctgctcatccttaccggctcgtcccctcgcactttgctgtgtctgctgctccagagcaatccttggcctaaccatggtctccatcctcatcgtcaccgtctcttttttattcctatgtgttagtccatgcatccatctctaacaccaaagggtgccaccaatgttgatcccatgtggatcacgtaagtgcccctctctccatatcccacatggttatgtgatgattggagaccagcttgagccccaggatgggctcaaagcttgatgccccaaggaaggggatgtactaacagtcgggcgcaaaccagccgtttaaccagtccaaggaaggacttcatccaagagagttaatttgagccctagcaagagatggctacgggaaaaggcgaccctaacaatcaagcatggccctagggagggttcatgctgatacaatccaaattggacaaaactgacatgtagacaaccaattgagctagcatgccactcctaaacttcatcagtggaattcatactgtatttagcttaggccaagtgcttctggctgaagcatgaggcatttagcagatcctaatattctattcatgggtgttatctagagcaaataaaacttgacatctgaccagtctataacttcatttccacgcatagtcacacacacccctccccaccaccaccagcaacttcacaacaacatcctgtgataacttcttgtgtaaccaaccactctaacttttctatgcactgagtagatgcaccaactaacagttctttatccttcagtttatatcttgcatccaggtggctcaggctctaaggagagcttgtgcccctcatcagagacaggttcaggagtgctaatgttagtttttggcacttggcactacctcctgccatttgtaacacagtgatgggactccaaagaaggctttggagataccaaaacactgctgtgcaactcaataaccccaatggacccaggcatatttttattgtcttgggtcacccactcatctagatgttcatcttccccaatgtcattaccatggttaggtccaggacccactctctttctctctctgtgcagagaggctttgatgctttttaatgtaatattatcggtcacggtgattgtaataataaagtagtactatgccacttctagggcaggaactctttactgttttatcagtcggatctagctaaatattatgtcaatctataatcagtaccttctctatcgacatggtagctcgccatataatgcaatgtaaaatctacctgttatgttgcacatttcttattcaatgatcttttatcaaattttgcctcggtgcttagtaaatgaaagaagtaatgtgaaat

SEQ ID NO: 2618 - DNA, 2424 bp, Triticum aestivum
tctcctctaacctttagcttttcctcactccctccctccgttcctctaacaagagccgctagtgtcctagcccaattcagatccttagctgcagctggtttagttgcctcccctctggtgctgaggtagaagaaggagaaggtagcagcatcgccatgagtccgccgagtgtgatggggcagttcggggacacgacctacaccaaggtgttcgtgggggggctggcgtgggagacgcagaaggagaccatgaggaagtacttcgagcagttcggggagatcctcgaggccgtcgtcatcaccgacaagaacaccggcagatccaagggctacggatttgttaccttccgggacccggaatcggcgatgaggtcttgcgtcgaccccgcgccggtgatcgacgggaggagggcgaactgcaatctggcttcccttggggtgcagagatccaggcctccaaccccacagcacggaggcgctaggagctttcgagtgatgaagtcctttgggcagcagcaggctgcggggatccaaggtgcgctgggcgcagcttttccttcgcaggccaccttccctcattatgccatcccacaaggcctcccttaccatgtctatgggtactctccttattctccagactacggttatcctgcaaactactacaacatctatggaggaaaccagtacccgttttacggaggagcaggaactggcatggtgactggaaccagtcccttctatccatacttccagtttgggcagtccggaagcactacgcccaactatgcaactggacagggctacaacatgcaattcccacagatgttccccttctcaactgtggcttctacagctgctgctgtaactggctttgcacagcaatatggagggccattgtcacttgcagcgagtcctcaagcccaagcagtgtgtatccccattaaacaggcatgactatggctctcacagcaccaaccttgccaagtccaactcaggctgctcatccttaccggctcgtcccctcgcactttgctgtgtctgctgctccagagcaatccttggcctaaccatggtctccatcctcatcgtcaccgtctcttttttatttcctatgtgttagtccatgcatccatctctaacaccaaagggtgtcaccaatgtcgatcccatgtggatcacgtaagtgcccctctctccatatcccacatggttatgtgatgattggagaccagcttgagccccaggatgggctcaaagcttgatgccccaaggaaggggatgtactaacagtcgggcgcaaaacagccgtttaaccagtccaaggaaggacttcatccaagagagttaatttgagccctagcaagagatggctacgggaaaaagcgaccctaacaatcaagcatgaccctagggagggttcgtgctgatacaatccaaattggacaaaactgacatgtagacaaccaattgagctagcatgccactccaaaacttcatcagtggaattcatactgtatttagcttaggccaagtgcttctggctgaagcatgaggcatttagcagatcctaatattctattcatgggtgttatctagagcaaataaaatttgacatctgaccagtctataacttcatttccacgcatactcacacccccctcccatcaccaccagcaacttcacaacaacatcctgtgataacttcttgtgtaaccaaccactctaacttttctatgcactgagtagatgcaccaactaacagttctttatccttcagtttatagctttgcatctaggtggctcaggctctaaggagagcctgtgcccctcatcagagacaggttcaggagtgctaatgttagtttttggcacttggcactacctcctgccatttgtaacacagtgatgggactccaaagaaggctttggagataccaaagcactgctgtgcaactcaataaccccaatggacccaggcatatttttattgtcttgggtcacccactcatctagatgttcatcttccccaatgtcattaccatggttaggtccaggacccactctctttctctctctgggcagagaggctttgatgctttttaatgtaatattatcggtcacggtgattgtaataataaagtagtactacgccacttctagggcaggaacactttactgttttatcagtcggatctagctaaatattctgtcaacctataatcagtaccttctctatcgacatggtagctcgccatataatgcaatgtaaaatctacctgttctgttgcacatttcttattcaatgatcttttatctaattttgtcacagtatacttagtaaatgaaagaagtaatgtgaaatgtgtgttaacaacattctcccttcactttatatgatgcatcagatgcagacttgacggttgag

SEQ ID NO: 2619 - DNA, 2358 bp, Sorghum bicolor
ctggtgcattatagcaaacactagtatatattgctgtttctgtaccctacccgctctctctctctctcctctaccccttttcctctaacctttagctttccttccttcctccctctcctctcctctcctcttcccctcctctaacaagaactagttccagccattcagatcctaagttgctgaccttgctgctgcttgttggaggtagatttgttggatctaagttgaaagtaccatgagtccaccgagtgtgatggggcagtttggggacacaacctacaccaaggtttttgttggtggactcgcgtgggaaacccagaaggagaccatgaggaagtacttcgagcagtttggggagatcctggaggctgttgtcatcactgacaagaacactggcagatccaagggctacggatttgttaccttccgggacccggatgcggcgatgagagcttgcgttgatcccgcaccggtgattgacgggaggagggctaactgtaatcttgcttcccttggggttcaaagatctaggcctcctactccccagcatggaggggctaggaactttagagtgatgaaatctttcagccagcaggcaggaatccaaggtggactgggcgcagcttttccttctcatgccaccttccctcattatgccatcccacaaggcctcccctaccatgtctatgggtactctccatataccccagacggttatccaacaaacttctacagtatatatggaggagctcagtacccattttatggaggagcagcagctggcatggtgacaggaacaagtcccttttatccatatttccagtttgggcaatcaggaaacactactaccaactatacaagtggacaaggctacaacttgcaatatccacaaatgttccagttctcgactgtatcttctacagctgcagctgtcaccggctttgctcagcagtatggaggaccattgtcactagcagcaagccctcaagcccaagcagtctgtatccccattaaacaggcatgactatggcactcgcagctccaaccctgccaactccaacacaggctgctcatccttaccggttgattccctcgcacttcgcagtgtccgctgctccagagcaacccttggcctaaccatggtctaaaactgtctcgtttccaatgcgtcgagtccatgcatccatctctaacaccaaaaggcactattgtagatcatgtttatcagccaaagtgctcacctccatatcccacatggtcatgtggtgactggatattagctttagccccaggatgggcacaaagcttcatgccccaaggatggggtgttctaacagacaagtacaaaccccaaccattctaacaatagtccaaggaaggacttttatcagggagagttaatttcagacgtaccaagacaaggctgtagctaaaagaaactaacagtcaagcatgacccagggagggttcatgctgatacttgtcaaattggacaacaatgacagctaaataactgatttaactagcatgccactcccacatttcatcagtagaatctcaactgtacctagcttaggcatggcatttcttgttgaagcatgaaccatttagcaaaacctacccttctatagtcctgctgttacctagaccaaatgcatttgatatatgaccagcgactacttgtgtaacaaactcatcttttctttgcaaatgattagatgcaccaactaacattttatttgatctttcagttgatagcttgcatctaggtggtcaaggctctaaggagagcctgtgcccctaatcagacacaggttcagagtagtgctaatgtttgtttttagcacttggcactacctcctgtcactccaaacacagtattggggactccaaagaaggctttggagtaaccaagcaatgctgtgtaactcattaacacaatggacccatagataaatttttattgtcttgggtcaccccactcatgtagatgtcattacttctcagtgtcactaccatggttaggtccaggccccacctccccaaccccttttcctccccctcccccttctctctctctctctctctctctctctctctctctgcacagccagagaccttagttctctttaatctaccaggcatggtggttgtaataatgaagtagcactatgctactcgtaggacatgaagaactatttgttattccacccttcatatgtacttaatatcctgtccatttcagttcagtagttggtacttatttccaaccattgttgtgcaccatataatgttgtgtaatatatgtcctctgtgctgcacatttcttagtcatatggccttgttccagttgaatgt

SEQ ID NO: 2620 - DNA, 2536 bp, Sorghum bicolor
tttatatgagcgtgctttggaccaaaaggacctggctggtgcattatagcaaacactagtatatattgctgtttctgtaccctacccgctctctctctctctcctctaccccttttcctctaacctttagctttccttccttcctccctctcctctcctctcctcttcccctcctctaacaagaactagttccagccattcagatcctaagttgctgaccttgctgctgcttgttggaggtagatttgttggatctaagttgaaagtaccatgagtccaccgagtgtgatggggcagtttggggacacaacctacaccaaggtttttgttggtggactcgcgtgggaaacccagaaggagaccatgaggaagtacttcgagcagtttggggagatcctggaggctgttgtcatcactgacaagaacactggcagatccaagggctacggatttgttaccttccgggacccggatgcggcgatgagagcttgcgttgatcccgcaccggtgattgacgggaggagggctaactgtaatcttgcttcccttggggttcaaagatctaggcctcctactccccagcatggaggggctaggaactttagagtgatgaaatctttcagccagcaggcaggaatccaaggtggactgggcgcagcttttccttctcatgccaccttccctcattatgccatcccacaaggcctcccctaccatgtctatgggtactctccatataccccagacggttatccaacaaacttctacagtatatatggaggagctcagtacccattttatggaggagcagcagctggcatggtgacaggaacaagtcccttttatccatatttccagtttgggcaatcaggaaacactactaccaactatacaagtggacaaggctacaacttgcaatatccacaaatgttccagttctcgactgtatcttctacagctgcagctgtcaccggctttgctcagcagtatggaggaccattgtcactagcagcaagccctcaagcccaagcagtctgtatccccattaaacaggcatgactatggcactcgcagctccaaccctgccaactccaacacaggctgctcatccttaccggttgattccctcgcacttcgcagtgtccgctgctccagagcaacccttggcctaaccatggtctaaaactgtctcgtttccaatgcgtcgagtccatgcatccatctctaacaccaaaaggcactattgtagatcatgtttatcagccaaagtgctcacctccatatcccacatggtcatgtggtgactggatattagctttagccccaggatgggcacaaagcttcatgccccaaggatggggtgttctaacagacaagtacaaaccccaaccattctaacaatagtccaaggaaggacttttatcagggagagttaatttcagacgtaccaagacaaggctgtagctaaaagaaactaacagtcaagcatgacccagggagggttcatgctgatacttgtcaaattggacaacaatgacagctaaataactgatttaactagcatgccactcccacatttcatcagtagaatctcaactgtacctagcttaggcatggcatttcttgttgaagcatgaaccatttagcaaaacctacccttctatagtcctgctgttacctagaccaaatgcatttgatatatgaccagcgactacttgtgtaacaaactcatcttttctttgcaaatgattagatgcaccaactaacattttatttgatctttcagttgatagcttgcatctaggtggtcaaggctctaaggagagcctgtgcccctaatcagacacaggttcagagtagtgctaatgtttgtttttagcacttggcactacctcctgtcactccaaacacagtattggggactccaaagaaggctttggagtaaccaagcaatgctgtgtaactcattaacacaatggacccatagataaatttttattgtcttgggtcaccccactcatgtagatgtcattacttctcagtgtcactaccatggttaggtccaggccccacctccccaaccccttttcctccccctcccccttctctctctctctctctctctctctctctctctctgcacagccagagaccttagttctctttaatctaccaggcatggtggttgtaataatgaagtagcactatgctactcgtaggacatgaagaactatttgttattccacccttcatatgtacttaatatcctgtccatttcagttcagtagttggtacttatttccaaccattgttgtgcaccatataatgttgtgtaatatatgtcctctgtgctgcacatttcttagtcatatggccttgttccagttgaatgtattattacatctgtgaaagtatgcatttgaaagcatttacttcatataataggataacactatgaaggcttagaatcttaaggtaacacccttgcctaatagcattttagttgaataaattccaatggttgcggaagctagca

SEQ ID NO: 2621 - DNA, 1030 bp, Hordeum vulgare
cgctctccccacccctttctcctctaacctttagcttttcctcactcactccctctctctcccaccgttcctctaacaagacccgccgctcgtagcgtcctagcccaattcagatccttagctgcagctgctttcagtcgtttcctcttcctcgaggcggcggcgtcgccatgagcccgccgagcgtgatggggcagttcggggacacgacctacaccaaggtgttcgtgggggggctggcgtgggagacgcagaaggagaccatgaggaagtacttcgagcagtttggggagatcctcgaggccgtcgtcatcaccgacaagaacaccggcagatccaagggctacggatttgttaccttccgggacccggatgcggcgatgaggtcttgcgtcgatcccgcgccggtcatcgacgggaggagagccaactgcaacctggcttcccttggtgttcagagatccaggcctccaaccccacagcacgggggtgctaggagctttcgagtgatgaagtcctttgggcagcagcaggctgcggggatccaaggtgcgctgggcgcagcttttccttcgcaggccaccttccctcattatgccatcccacagggcctcccttaccacgtctatgggtactctccttattctccagactacggttttcccgcaaactactacaacatctatggaggaaaccagtacccattttacggaggagcaggaactggcatggtgactggaaccagtcccttctatccatatttccagtttgggcaatccggaagcactacgcccaactatgcaactggacaggggtacaacatgcaatacccacagatgtttcccttctcaactgtggcttctacagccgctgctgtaacaggctttgcacagcaatatggagggccattgtcacttgcagcgagtcctcaagcccaagcagtgtgtatccccattaaacaggcatgactatggctctcacagcaccaaccttgccaagtccaactcaggctgctcatccttaccggctc

SEQ ID NO: 2622 - DNA, 2236 bp, Panicum virgatum
ccccttttcctctaacctttagctttcctccctccttccctctcctctcctctcttcttcccttcctctaacaagaactagtcctagccattcagatcctaagttgctggccttgctgcttcttgttggagaaagatttgttggttccaagttggaagtatcatgagtccaccgagtgtgatggggcagtttggagacacaacctacaccaaggttttcgttgggggactcgcatgggaaacccagaaggagaccatgaggaagtacttcgagcagtttggggagatcctggaggccgttgtcatcactgacaagaataccggcagatccaagggctacggatttgttaccttccgggaccccgatgcagcgatgagagcttgcgttgatcctgcgcctgtgattgacgggaggagggccaactgtaatctggcctcacttggggttcaaagatctaggcctccaacaccccagcacggaggatctaggagctttagggtgatgaaatccttcagccagcaggcagggatccaaggtggactgggcgcagcttttccttctcatgccaccttccctcattatgccatcccacaaggcctcccctaccatgtctatgggtactctccctatactccagactacggctatccaacaaacttctacaatatctatggaggggcccagtacccattttatggaggaggagcagctggcatggtgactggaacaagtcccttttatccatatttccagtttgggcagtcaggaaacactacaaccaactacacatctggacaaggctacaacttgcaatacccacatatgttccacttctctactgtatcatctacagctgcagctgtgacgggctttgctcagcagtttggaggaccattgtcactagcagcgagccctcaagcccaagcagtgtgtgtccccattaaacaggcatgactatggcactcacagctccaacactgccaactccaactcaggctgctcatccttaccggctgattccctcacactttgcggtgtctgctgctccagagcaacccttggcctaaccatggtctcccttcccactgtcgctgtcttgttctcgtttccaaagtgttgagtccatgcatccatctctaacaccaaaaggcactattgtggatcctgttcatcagtcaaagtgctcacctccatatcccacataattatgtggtgattggaaattagctttagccccaggatgggctcaaagcttcatgccccaaggacggggtgcactaacagacaagcataaaccccaaccattctaacaacagtccaaggaaggacttcatctgggagagttagtttcagcccagcaagacaaggctgtagctaaagaaactctatcagtcaagcatgacccagggagggttacttcatgatgatactagtcaaattggacaagaatgacaactaaacaactgactgagctagcatgccactcccacatataatcagtagaatcccaactgtatctagcttaggcatggtgcttcagggtgaagcatgaaccatttagtgtttctaatttagtcttggtgttacctagagcaaatggatttgacatataaccagtgactacttgtggtaaccaaccgctcacttttcctatgcaaatgattagatgtaccaactaacagttcaaatgatctttcagttgatagcttgcatctaggtggtcaaggctctaaggagagcctgtgcccctaatcagagacaggttcagagtagtgctaatgtttgtttttagcacttggcactacctcctgtcgttccaaacacagtattgggtgctccaaagaaggctttggggtagccaaacactactgtgtaactcattaacacaatggacccatggataaatttttattgtcttgggtcacccgctcatgtagatgtcattacttctcggtgttactaccatggttaggtccaggtctccacacccaccccctcccttccccttctatgtgcgcagcgcagagaccttgctattaatctactattcccaggcatggttgttgtattaataaagtagcactatgctacttgtaggacatgaaccatttcttattttcatgtgtacttaatatcctacccatttcaattcagtagctggtacgttatttccaaccattgtagtactatataatgttgtttgaaatatgtccagtgtgttgcacatttcttagtc

SEQ ID NO: 2623 - DNA, 850 bp, Saccharum officinarum
ccctcctctaacaagaactagtcccagccattcagatcctaagttgctgaccttgctgctgcttgttggagacagatttgttggttctaagttgaaagtaccatgagtccaccgagtgtgatggggcagtttggggacacaacttacaccaaggtttttgttggtggactcgcgtgggaaacccagaaggagaccatgaggaagtacttcgagcagtttggggagatcctggaggctgttgtcatcactgacaagaacactggcagatccaagggctacggatttgttaccttccgggacccggatgcggcgatgagagcttgcgttgatcccgcaccggtgattgacgggaggagggctaactgtaaccttgcttcccttggggttcaaagatctaggcctcctactccccagcatggaggggctaggaactttagagtgatgaaatccttcagccagcaggcaggaatccaaggtggactgggcgcagcttttccttctcatgccaccttccctcattatgccatcccacaaggcctcccctaccatgtctatgggtactctccatataccccagactacggttatccaacaaacttctacaatatatatggaggagctcagtacccattttatggaggagcagcaactggcatggtgacaggaacaagtcccttctatccatatttccaatttgggcaatgaggaaacactactaccaactatacaagtggacaaggctacaacttgcaatacccacaaatgttccagttctcaactgtatcttctacagctgcagctgtgaccggctttgctcagcagtatggaggaccattgtcactagcagcaa

SEQ ID NO: 2624 - DNA, 2482 bp, Brachypodium distachyon
aggatggtgcatcgtagcaaacaaacgctggtatatattgctcctctgtacccttccttcccctctctccgactctctctccctttcctctaacctttagcttttccaccttctctccctcctctacccttactctaacaagagctagtgctagcaaaattcagatccttagttgctggtttcgttgtttctctttggagtttgggtttgtagttgcttgaggtgaagaagtttgcaccatgagtccaccgagtgtgatggggcagtttggagacacaacctacaccaaggtgttcgtaggcgggctggcgtgggagacccagaaggagaccatgaggaagtatttcgagcagttcggggagatcctggaagccgtcgtcatcactgacaagaacaccgggagatccaagggctacggatttgttaccttccgggacccggatgcggcgatgaggtcttgcgttgatcccgcgccggtgatcgacgggaggagggctaactgtaacctggcttcccttggtgttcagagatctaggcctccaaccccacagcacggaggcgcaaggagctttagggtgaagtcttttagccagcaggcagggatccaaggtgggctgggtgcagcttttccttctcaggccaccttccctcattatgccatcccacagggcctcccttaccatgtctatgggtactctccatattctccagactacggttatcccacaaactactataacatctatggaggaacccagtacccattttatggaggagcgggagctggcatggtgactggaaccagtcccttttatccatatttccagtttgggcagtcaggaagcactacgaccaactatggaaatggacagggctacaacatgcaatacccacagatgttccaattctccactgtagcttctacacctgctgctgtaacaggctttgcaccgcaatatggaggaccattgtcacttgcagcgagtcctcaagcccaagcagtgtgtattcccattaaacaggcatgactatggctctcacggctccaaccttaccaagtccaactccggctgctcatccttaccggctcatcacctcgcactttgctgtgtctgctgctccagagcaatccttggcctaaccatggtctcctttctcatcgtcatcgtctcacttttattttctacgtgttgagtccatgcatccatctctaacaccaaagggcactattgttgattccacgttcatcggtcaaagtgcctccctctccatatcccacatggttatgtggcgaatggagatcagcttaagccccaggatgggctcaaagcttgatgccccaaggatggggttgtactaacaatcgagcacaaaccagacactttacccacagtcccaaggacttcatccaagagagttaatttcagccatacaagagaaaggatgtgggcaaacgaaaccctaacaatcaagcatgaccccaaggagggttcatgttgatacaagccaaattggacaaaactgacatctaggtaactaattgagctagagcatgccactctgaaatttcaacagtggaatttatactgtatttagcttaggaaaagtgcttctggatgaagcagggaccatttagcatgaatttaacacttgaccagtctataacttgaattctatgcatatccccccaccccaccagcagcagctttcacaacatcctgtgtaaccaaccactcacctttcctatgcactgagtagatgcaccaactaacagttctttttatccttcagttggtagcttgcatctaggtggttaaggctctaaggagagcctgtgcccctcatcagagacaggttcaggagtgctaatgtttgtttttggcacttagcactaccttctgtcatttttaacacagtgatgggactccaaagaaggctttggatacaccaagcactgagtgcaactcagtaaccccaatggacccacagatatatttttattgtcttgggtcacccactcatctagttcatcttctccagtgtcactaccatggttaggtccaagactccctccctcgcaccccgcccccctccctcccctccagcaccactactttctgcctttctctgtggacagagacgggccttaatgctttttaatgtactattatcaaacatggcagttgtaataataaagtggcactatgctacttgtaggacaaaaactgtactattttatcatgcggatgtagccaagtattctgtcaatttatagccagtactttctatatcgatattgtaggtcaccctataatgtaatgtaaaatcgccagctgtgttgcacatttcttattcattatctttaactatttcgtcttggcacttattaactgaatgtagtgatgcgaaattaagtccaaaaaacattcttcctcaatatatgatgcaattgatgcatacagtaaggttgagagttttgaag

SEQ ID NO: 2625 - DNA, 829 bp, Setaria italica
gttttggagttggaggcggcggcggctggctgctgcctcccctgacctccccgcccgccccttttaaagctggactgctcgcttccgcttcgggtcctcggctgctgctagggtttcgtctcgaggagaaggccgggcgaagctcccagagctccctacacccgtcccgcgttcgaggctaggtagccgccatgagccgatcggggcagcctccggatctcaagaagtacatggacaagaagcttcagatcaagctgaatgcaaaccgtgttgttattggcacactccgaggatttgatcagttcatgaatctggtggtggataacactgttgaggtcaatggaaatgacaagactgatattggaatggtggttatcaggggaaatagtgttgtcatgatcgaggcgctggagcctgttgccaagtctcagtgaagtgaatcatcactcagcttcagtagatgtagcccctgctgcttgaatactgatgtaaatgttatcagtcctgttgtacgttgacaatatttgcacagcaatataactttggacgtgaaaagtttagccctgttccgccgtttgtactccttgattgtgattatgtaattcttctgccattgcttatgataaattcaatttaactcagcttgtttatgcatgattgtcaccttcacagcaggcctagctacctgtgctggctcctggttcaaaggtgactacatgaattgcctcactcagctttactgcgggcgatgagtggttctgcatttgttaccgcatcgcctgttgctttgtgagggacagtggttccattggagtgtcttcatcatgta

SEQ ID NO: 2626 - DNA, 730 bp, Saccharum officinarum
ctctgtctgttttagggtttcgtccgggcggagctcctaaatccctctcctcgctcgcgttcgaggctaggtagccgccgccatgagccgctcggggcagcctccggatctcaagaagtacatggacaagaagcttcagattaagctgaatgcaaaccgtgttgttattggcacacttcggggattcgaccagttcatgaatctggtggtggacaacactgtggaggtcaatggaaatgacaagacagatattggaatggtggttatcaggggaaacagtgttgtcatgatcgaggcactggagccagttgccaagtcgcagtgaatcatcattcttcagctgatgtagcactagcagcgtgaaaactgatgtaaatgatcagtaaaccctgttgtactttgactaatgcttttgcacagcaacataacttcggaggtggattgtttacccctttttctatgtggtgcttgtggctatgcaagcacctactctagctcatctacctggtttttactcaagtaccatgtcaccttcacagcaggcctggctaccagtgctggcgcctggtttaatggtgactacatttactgccttctcggcgctaacactggcaatgagtcatttcttctattgttctacattgcccgttgccttgtgaggaacatgtgatttgtgatccatatccacagtggggcatctgggctgcccttaatggaatcagaatcagat

SEQ ID NO: 2627 - DNA, 592 bp, Panicum virgatum
cctccctccgccgcttttgaagccagactgctcgcttccgcttctcccctgctcctgctgctagggtttcgtctcgaggagaaggccgggcgaagctcccacagatcccttcacctgtcccgcgtccgaggctaggtcgccgccatgagccgatctgggcagcctccggatctcaagaagtacatggacaagaagcttcagatcaagctgaatgcaaaccgtgttgttattggcacacttcgagggtttgaccagttcatgaatctggtggtggataacactgttgaggtcaatgggaacgacaagactgatattggaatggtggttatcaggggaaacagtgttgtcatgatcgaggcgctggagcctgttgccaagtctcagtgaatcatcattctgcttcagcagatgtagaggcaccaactgcatgaaaactgatgtaaatgatatcagtcaacctgctgtactttaacattatttgcacagcaatataactttgaatgcggagagccttgttttgttcatactccttgattgtgactatgtaatcaactgccgatgcttatgataatacttaatttaactcaagctt

SEQ ID NO: 2628 - DNA, 642 bp, Panicum virgatum
gaccgcctcaacgtctcgatggcgttagggttttgggcggcggcggcggcggcggttgcctggcccgccccttttaaagccagactgctcgcttccgcctcggtcctccgctgctgctagggtttcgtctcgaggagaaggccgggcgaagctcccgcaggtcccttcacctgtcccgcgttcgaggctaggtagccgccatgagccgatcggggcagcctccggatctcaagaagtacatggacaagaagcttcagatcaagctgaatgcaaaccgtgtcgttattggcacacttcgaggatttgaccagttcatgaatctggtggtggataacactgttgaggtcaatggaaatgacaagactgatattggaatggtggttataaggggaaacagtgttgtcatgatcgaggcgctggagcctgttgccaagtctcagtgaatcatcattctgcttcagcagatgtaggcaccaactgcatgaaaactgatgtaaatgatatcagtcaacctgttgtactttaacagtatttgcacagcaatataactttgaatgctggagagtcatgccctgtgcatactccttgattgtgactatgtaatcatctggcgatgcttatgataaatacttaatttaactc

SEQ ID NO: 2629 - DNA, 976 bp, Sorghum bicolor
ggcgggcaggaggaggcggcggcggcggcggcggcggcttgtcctcttttaaagctggactgctcgattctgcctaccctcctcggctgccatctgtgtttgttagggtttcgtccgtgcggagctccgaaatccctccgccgctctcgcgttcgaggctaggtagccgccgccatgagccgctcgggacagcctccggatctcaagaagtacatggacaagaagcttcagattaagctgaatgcaaaccgtgttgttattggcacacttcggggattcgaccagttcatgaatctggtggtggacaacactgtggaggtcaatggaaatgacaagacagatattggaatggtggttatcaggggaaacagtgttgtcatgatcgaggcactggagccagttgccaagtcccagcagtgaatcattgttcttccgctgatatagcactagcagcgtgaaaactgatgtaaatgatatcagtgaaccctgttgtactttgactaatgcttttgcacagcaacataacttcggagcaatgtctatccctttttctatgtggtgcttgtggctatgtaatcatctgcccgtattgctcgatctaactcaagcccgtctgctcatctacatggtttttctgaagtacaccacatatcaccttcacaacaggcctggctaccagtggtggcacctggctcaacggtgactacatttacagccttctcggcgctcatactggcaatgagtaatttcttctagtgttttacattgcccgttgccttgtgaggcacatgtattttgtgatccatcatccatagtggtgcatctggtctgcccttgttaattgaatcagaataaggttcttctatagtgtatcgttgtacactgtcccgttgatttgtggggaacatgttttgtggtgcatctggtctgccattctagtgcaatcggattcttctattagctgtcttgaaccata

SEQ ID NO: 2630 - DNA, 1109 bp, Sorghum bicolor
catcgcgctagggttttgaggcgggcaggaggaggcggcggcggcggcggcggcggcttgtcctcttttaaagctggactgctcgattctgcctaccctcctcggctgccatctgtgtttgttagggtttcgtccgtgcggagctccgaaatccctccgccgctctcgcgttcgaggctaggtagccgccgccatgagccgctcgggacagcctccggatctcaagaagtacatggacaagaagcttcagattaagctgaatgcaaaccgtgttgttattggcacacttcggggattcgaccagttcatgaatctggtggtggacaacactgtggaggtcaatggaaatgacaagacagatattggaatggtggttatcaggggaaacagtgttgtcatgatcgaggcactggagccagttgccaagtcccagcagtgaatcattgttcttccgctgatatagcactagcagcgtgaaaactgatgtaaatgatatcagtgaaccctgttgtactttgactaatgcttttgcacagcaacataacttcggagcaatgtctatccctttttctatgtggtgcttgtggctatgtaatcatctgcccgtattgctcgatctaactcaagcccgtctgctcatctacatggtttttctgaagtacaccacatatcaccttcacaacaggcctggctaccagtggtggcacctggctcaacggtgactacatttacagccttctcggcgctcatactggcaatgagtaatttcttctagtgttttacattgcccgttgccttgtgaggcacatgtattttgtgatccatcatccatagtggtgcatctggtctgcccttgttaattgaatcagaataaggttcttctatagtgtatcgttgtacactgtcccgttgatttgtggggaacatgttttgtggtgcatctggtctgccattctagtgcaatcggattcttctattagctgtcttgaaccatataatatagcatctaatagcaggggataagtatttgattcaataactatatgcacctagtacacagccgctgctgctcttaatgctagtgtctgatagactacgttctcccatgt

SEQ ID NO: 2631 - DNA, 735 bp, Triticum aestivum
agggtttgttagggtttcgtccgtgcggagctccgaaatccctccgccgctctcgcgttcgaggctaggtagccgccgccatgagccgctcgggacagcctccggatctcaagaagtacatggacaagaagcttcagattaagctgaatgcaaaccgtgttgttattggcacacttcggggattcgaccagttcatgaatctggtggtggacaacactgtggaggtcaatggaaatgacaagacagatattggaatggtggttatcaggggaaacagtgttgtcatgatcgaggcactggagccagttgccaagtcccagcagtgaatcattgttcttccgctgatatagcactagcagcgtgaaaactgatgtaaatgatatcagtgaaccctgttgtactttgactaatgcttttgcacagcaacataacttcggagcaatgtctatccctttttctatgtggtgcttgtggctatgtaatcatctgcccttattgctcgatctaactcaagcccgtctgctcatctacatgtttttctgaagtacaccacatatcaccttcacaacaggcctggctaccagtggtggcacctggctcaacggtgactacatttacagccttctcggcgctcatactggcaatgagtaatttcttctagtgttttacattgcccgttgccttgtgaggcacatgtattttgtgatccatcatccatagtggtgcatctggtct

SEQ ID NO: 2632 - DNA, 628 bp, Cynodon dactylon
aggcggctgctagggtttggaggaggcgaggcgaagctccgagatctcgcgcccccgcccctgcgttcgagtctaggcttccgccatgagtcggtcggggcagcctccggatctcaagaagtacatggacaagaagctccatatcaagctgaatgcaaaccgtgttgttattggcacactccgtggatttgatcagttcatgaatcttgtggtggacaatactgtggaggtcaacggaaatgacaagactgatattggaatggtggttatcaggggaaacagtgttgtcatgattgaggcgctggagcctgttgcaaaatcacagtgaatttgcgtgggattgttcttcagttgatctagtcctagcattgtgaaagctgatgtatatgttcagtgaacatgttgtaccttaactaatattttgcacagcattataacgtttgatgtggaaacttgtctgtggtcaccactatacagttgactcagttaagccgaagctttcttgtgtttgctcattgtgtcaccttcacagcaggccttgcaactcatgctggctcctggttcaagggtgactatatcaatccaatgcttttcagcatttccggtgcttgctgcgagcaattagcac

SEQ ID NO: 2633 - DNA, 614 bp, Eragrostis curvula
  misc_feature (41)..(41): n is a, c, g, or t
  misc_feature (222)..(222): n is a, c, g, or t
  misc_feature (614)..(614): n is a, c, g, or t
aatggaaggaagagaaaggggaaaaagaaagaaaaaggccntgggggccgcaggagtcttttaaactggacgcttgccgcaggtctctgacggcggctgctagggttttgagaaggcgaagcgaagcacagattccccatcccctcatctgagttctagtcggtagccgccatgagccggtctgggcagcctccggatctcaagaagtacatggacaagaancttcagatcaagctgaatgcaaaccgtgttgttgtcgggacactccgtgggttcgatcagttcatgaacctggtggtggacaatactgtggaggtcaatgggaatgataagactgatatcggaatggtggttatcaggggaaacagtgttgtcatgatcgaggcgctggagcctgttgccaaatcacagtgaattcatcatcagtagatgctacttggcactttgaaagctgatgtatatgatcagtgaacatgttgttccttgactaatgttttgcacagcaatataacttaggacgtggttgacagttgaaacctctttgcatgtagtatcttttgttctgcgcacatgtgtttacctattaactaagattacgtcaatgcttgtatgcn

SEQ ID NO: 2634 - DNA, 915 bp, Zea mays
atcgcgctctagggttttgacgcgccggcggcttgtgttccctttaaagcttggctgctcgtctgctcctgctgctgtctttcttctgctcttccatcgcgccagtgttttgagaagctggtcggcgctcctagatcccttcgcctctctcgcgttcgaggctaggtagccgccaccatgagccgctcggggcagcctccggatctcaagaagtacatggacaagaagcttcagattaagctgaatgcaaaccgtgttgttattggcacacttcggggattcgaccagttcatgaatctggtgatcgacaacactgtggaggtcaatggaaatgacaagacagatattggaatggtggttatcaggggaaacagtgttgtcatgatcgaggcactggagccagttgccaagtcgcagtgaatccttatttttcagctgatatagtcgcagcatgaaaactgatgtaaatgctatgagtgaaccctgttgtacttcggactcgtgcttttgcacagcaacataactcggctaccagcacccctgtttcaatggtgacttcattactgccttggcgctaacattggcaatgcatcatttcgtctattgttctacatagccggtgccttgtgaggcacatgagatctgtgattcatcgtcaatgctctgtttggatattgatattagagagcatggaattcaattagattcaataccaaattagctatgatattaaaatgagatgtcaccgtaaaattagattcaataccaaattctattgtttggatgtcactgtattggagttcggaattgagtggtctaatttcatgcaatatagttcggaattgagtggtctaattccatgcaatatagagttgatctgtaatgggagaggagtttttagttatagttcaatac

SEQ ID NO: 2635 - DNA, 672 bp, Pennisetum glaucum
ctcggctgctgctagggtttcatctctacaggagacggcccgacgaagctccccctacacgaaccccgcgttcgaggctaggtatccgccatgagccggtcggggcagcctccggatctcaagaagtacatggacaagaagcttcagattaagctgaatgcaaaccgtgttgttattggcacgcttcgaggatttgatcagttcatgaatctggtgattgataatactgttgaggtcaatggaaacgacaagactgatattggaatggtggttatcaggggaaatagtgttgtcatgattgaggcgctggagcctgttgccaagtctcagtgaagggaatcattgctctgcttcagtagatgtatcccttgctgcttgaaaactgatgtaaatgttatcagtctgttgtacgttgacataatgcagagtgatataatacctgtggagttttagccctgttcatactcctttgtcatgtaattcttctgccattgcttatgttatgttcaaactcagcttgattatgcatgattgtcaccttcacagcaggcctggcaacctgtgctggctcctggttcaaaggtgactataagaattgcctcactgtgggtggtgttgttctgtactgcaataacgcttgataagctttatgagggatagtcgttccattgt

SEQ ID NO: 2636 - DNA, 810 bp, Panicum virgatum
tgtctcagcaagcaaggcttagggtttggtggttggacgcagaagcttgtagtagatccttcgttagggagtcgccatgagccggtcggggcaacctccggatctgaagaagtacatggacaagaagctccaaatcaagctgaatgcaaaccgtgtagtcattggcacgctgcgtggatttgatcagttcatgaatctggtcgtggacaacacagtggaggtcaatggaaacgacaagaatgacatcggaatggtggttatcagggggaacagtgttgtcatgatcgaagccctcgaaccggttgccaaagctcagtgaactgtcagcctgctttggtagttaataagttggtagtgttaatttaaaactgatgtatgccgttgggcaccattgtatcctgagttcctaacccttattcatgtgcaagtgttaagcacttttgtatagttgagcctgtgtttcgactttccagttgcacagcctgctggttgttattctgctgggatttgtgctatcatggtagagagcgtgtgatattcctgttctgggcagggagctatcagttaagtttgcgggaaatgagacgcccttcagtgccttagtgttgagcgagtaatgtgcacatatacccccaggccccaatacttagtgtgataatgtgatttctcacagactcgagataaaattttttgctgtgccttaaaatcaaggacatgttgcatagcatgatcttagtgttaggcaactccatgtttttaacaattccatattttcagccaagcatgtataacaataccatatttttgttt

SEQ ID NO: 2637 - DNA, 636 bp, Panicum virgatum
aaaccttttgcggtagacgacccggggataattagggttctggggttctcgacgcggcgacggcggctacccctttctgtctcagcaagcaagggttagggtttggtggttggacggagaagcctgtagtagatccttcgttagggagtcgccatgagccggtcggggcagcctccggatcttaagaagtacatggacaagaagctccaaatcaagctgaacgcaaaccgtgttgtcattggcactctgcgtggatttgatcagttcatgaatctggtcgtggacaacacagtggaggtcaatggaaacgacaagaatgacattgggatggtggttatcagggggaatagtgttgtcatgatcgaagcccttgaaccggttgccaaagctcagtgaactgtcagcctgttttagtagttaataagctggtagtgttaaattgaaactgatgtatgccatggggcaccgatgtatcctgagttcctgaatcctgacccttattcatgtgcaagctttaagcacctttgtatagtttagcctgtgtttcgactttccagttgcacagcctgcttattgttattctgctgggatttgtgctatcatggtagagagcgtgttatattcctgatctgggca

SEQ ID NO: 2638 - DNA, 696 bp, Hordeum vulgare
gagaggcggctcgtcccagtcctccctcgtcttatatctagctagggttttcagggttcttgcggcggcggcgacttccttccccctcttgcgaaggtctagggtttggctgagtagagaagagaggcttccccttcgtccagtcgggagccgccatgagccgatcggggcagccgccggatctgaagaagtacatggacaagaagctccaaatcaagctgaatgcgaaccgcgttgtcattggcacgcttcgtggatttgatcagttcatgaatttggtggtggacaacactgtggaggtcaatggagatgagaaaaccgacatagggatggtggttctgagaggaaatagtgttgtgatgatagaagcccttgaaccaattgccaggtctcagtgatattttgacttacctgcttctggttcagtacttgagctaatagtgtttggtcaaaaccaatctgtacgcaatcgggcaaattgtatcctaatatttgtaatgtgcgagatttagcacttattgtatagtttggagtgtgaactgtctttagatgcttgccttgctcactcaaacttacattgttgggtttcaatgctattttggtccagactgggcccactatttgtgcaatgtttttgcttataagtgttgtgtgaaccggatgcttgacatcaaatttggctgctgttgtgaggtg

SEQ ID NO: 2639 - DNA, 589 bp, Secale cereale
ggctcgctcctgtcctccctcgtcttatatctagggttcagggttcttgcggcggcgtcgtctgcttccttccccctcttgcgaaggtctagggtttggctgggtagagaagagaggctttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacatcgggatggtggttctgagaggaaatagtgttgtgatgattgaagcccttgaaccaattgccaggtctcagtgatattttggcttacctgcttctggtttagtacttaatagtgtttggtcaaaaccgacgcttatggaatcaggcatattgtatcctaatatttgtaatgtgtgagatttagcacttgctgtatagtttggagtttggactgtctttaaagatgcttgccttgctcactcaaacttacattgttgggattcaatgctattttcg

SEQ ID NO: 2640 - DNA, 502 bp, Secale cereale
tttctttgtcggtcggtcgttcgttcttgtcttccttccccctcttgcgaaggtctagggtttggctgggtagagaagagaggctttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacatcgggatggtggttctgagaggaaatagtgttgtgatgattgaagcccttgaaccaattgccaggtctcagtgattattttggcttacctgcttctggtttagtacttaatagtgtttggtacaaaaccgcgcttatggaatcaggcatattgtatcctaatatttgtaatgtgtgagtatttagctacttgcttgtattaggtttggtagtttggacttgt

SEQ ID NO: 2641 - DNA, 597 bp, Secale cereale
tcagggtttcttagggtttctttgtcggtcggtcgttcgtctgcttccttccccctcttgcgaaggtctagggtttggctgggtagagaagagaggctttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacatcgggatggtggttctgagaggaaatagtgttgtgatgattgaagcccttgaaccaattgccaggtctcagtgatattttggcttacctgcttctggtttagtacttaatagtgtttggtcaaaaccgacgcttatggaatcaggcatattgtatcctaatatttgtaatgtgtgagatttagcacttgctgtatagtttggagtttggactgtctttaaagatgcttgccttgctcactcaaacttacattgttgggattcaatgcttattttcgtccagacgtcgggcccacttatttgtga

SEQ ID NO: 2642 - DNA, 676 bp, Secale cereale
cccgcgtgtcattgacccttcagcccgtctgccctatttagagaggcggctcgctcctgtcctccctcgtcttatatctagggttcagggttcttgcggcggcgtcgtctgcttccttccccctcttgcgaaggtctagggtttggctgggtagagaagagaggctttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacatcgggatggtggttctgagaggaaatagtgttgtgatgattgaagcccttgaaccaattgccaggtctcagtgatattttggcttacctgcttctggtttagtacttaatagtgtttggtcaaaaccgacgcttatggaatcaggcatattgtatcctaatatttgtaatgtgtgagatttagcacttgctgtatagtttggagtttggactgtctttaaagatgcttgccttgctcactcaaacttacattgttgggattcaatgctattttcgtccagactgggcccactatttgtgcaatgtttgtgttcca

SEQ ID NO: 2643 - DNA, 557 bp, Secale cereale
cttccttccccctcttgcgaaggtcgtagggtttgggtctgggtaggagaagagaggctttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacatcgggatggtggttctgagaggaaatagtgttgtgatgattgaagcccttgaaccaattgccaggtctcagtgatattttggcttacctgcttctggtttagtacttaatagtgtttggtcaaaaccgatgcttatggaatcaggcattttgtgtcctaatatttgtaatgtgtgagatttagcacttgttgtatggtttggagttcggactgtcttcagagatgcttgccatgctcactcaaacttacattgtttgggttcaatgctattttggtccagactgggcccactatttgtgcaat

SEQ ID NO: 2644 - DNA, 990 bp, Hordeum vulgare
cttatatctagctagggttttcagggttcttgcggcggcggcgacttccttccccctcttgcgaaggtctagggtttggctgagtagagaagagaggcttccccttcgtccagtcgggagccgccatgagccgatcggggcagccgccggatctgaagaagtacatggacaagaagctccaaatcaagctgaatgcgaaccgcgttgtcattggcacgcttcgtggatttgatcagttcatgaatttggtggtggacaacactgtggaggtcaatggagatgagaaaaccgacatagggatggtggttctgagaggaaatagtgttgtgatgatagaagcccttgaaccaattgccaggtctcagtgatattttgacttacctgcttctggttcagtacttgagctaatagtgtttggtcaaaaccaatctgtacgcaatcgggcaaattgtatcctaatatttgtaatgtgcgagatttagcacttattgtatagtttggagtgtgaactgtctttagatgcttgccttgctcactcaaacttacattgttgggtttcaatgctattttggtccagactgggcccactatttgtgcaatgtttttgcttataagtgttgtgtgaaccggatgcttgacatcaaacccaaacaagaaaaacaaagaagtgggacaacagtaaaaagaagagagggagggggcgggggaaaaaaataaataaaaacctgggggggggggcccgcccccacattcccctatatggaggtggtttacaatcaaggggcgcgggttgtaaacgggggggtgggaaaaaccgggggtaccaaattatatagtgggaaaaatcccccttgtcccgcggggtaatagaaagagccccccgacccctctccaaagttgccacccgaaggggaagggaaatgaggccgtatttgtgtaaaatgccgaatttgtgaaaaacgtctttaacaaaggcaaaaggagaacttt

SEQ ID NO: 2645 - DNA, 602 bp, Brachypodium distachyon
aggcggcggctcgcgtctccgctccgcccttacctttaaaagtggactcacccgcgtcctgcctacgccgtcgctagggttttgtcacgcagagaagaagaggaggcggagtgctagcttcaggatccccttcgattcgtagccagcatgagccgatcggggcaacctccggatctcaagaagtacatggacaagaagctacaaatcaagatgaatgcaaatcgtgttgttattggcaccctccgaggatttgatcagttcatgaatctggtggtggacaacaccgtggaggtcaatggaaacgagaagaccgatattggaatggtggttgtcaggggaaacagtgtagtcatgattgaggcactggagccgattgccaaatcgcaacagtgatttccaaggcaggcatctatctggtagtgtgagaactgatgtacatgctgttatttgctcatattgtatcttgactaatgttttcttggaagtactatgaattgaatgtggttcaccgacttatattttattgcaagctcatgatcttatgtttttatttgctttcagtgcttattagtgatgcatactactatattgctttgtcctca

SEQ ID NO: 2646 - DNA, 1969 bp, Brachypodium distachyon
gggttttgaggcggcggctcgcgtctccgctccgcccttacctttaaaagtggactcacccgcgtcctgcctacgccgtcgctagggttttgtcacgcagagaagaagaggaggcggagtgctagcttcaggatccccttcgattcgtagccagcatgagccgatcggggcaacctccggatctcaagaagtacatggacaagaagctacaaatcaagatgaatgcaaatcgtgttgttattggcaccctccgaggatttgatcagttcatgaatctggtggtggacaacaccgtggaggtcaatggaaacgagaagaccgatattggaatggtggttgtcaggggaaacagtgtagtcatgattgaggcactggagccgattgccaaatcgcaacagtgatttccaaggcaggcatctatctggtagtgtgagaactgatgtacatgctgttatttgctcatattgtatcttgactaatgttttcttggaagtactatgaattgaatgtggttcaccgacttatattttattgcaagctcatgatcttatgtttttatttgctttcagtgcttattagtgatgcatactactatattgctttgtcctcacatcccgcctctctactcatactctttttgaactgagaccatacatcattgctttgttcgtttgtggccctaccacggatgctgtgaagaacaagtagtattccttcagttgctgttttggataagtcatctataaagcaaataggttactaggtaccaaatttgtgtcggaagatggctatattgattcttgccatccagttttcttcaaggaggctttggtaataagcctttaaatttttaaactggtcggtgacaatcttttggatactgcggagaacaagtagatttttttcttattagtgttcttttatttatttttccatttgctcttttggataagtcatctataaagcaaataggttactaggtaccaaatttgtgtcggaagatggctatattgattcttgccaaccagttttcttcaaggaggctttggtaataagtctttaaatttttgaactggtcggtgacaatctttcgcattgacttttgaagtttagattcaatctcttgttggaccgtcgtggtaaaattttaaatctcttattcattaaaacatctctgatttttccaatacttcttgtgtttgcattttcccaggctattttgagcagtgttgagaaggtatctagttctgcaggattgtgtgtatcggctttacgctaatgcggtgcgtcttgccgaaagtatttcctgctatattaatacgaggaaagtgggcagttaggttaacatcgataatttgttttcagtaacaatcattttcccctcatgcaacctcgaattagagaactctttcaatttgcatgtttgttatgtttgacatactttggctgtggaagttggcttacgtagagtgataattagtgagctccgcaggattttgtgtataggctttatgctgtgggtggcttgctatatgtatttcctgatgtgtttttctagaatatactatttcctgatatatcaatttgagtaaggtgggcagttagggtagcatgcgaccacagtgaagattcttcaggctgttgcgatgctctagaggagattggcataagttacttgtctggttttctaatgttatgaaatttgcaagcttgctatagttctcaattgttaatttatgcttacttcgctgatctggttctgaggttcgctgagctagattgtcaaattctttgacatgtatttcaactctgtaactctgacatctatttcaactatgtagtctgtactgtcatggcgcagattacacctacgtgcctttgctggtcttaagtacttccattctctgaaacactaacacttcacacagcctggatgcgtttttaagatgatcagtgggcaaagcccccg

SEQ ID NO: 2647 - DNA, 565 bp, Cynodon dactylon
aagagtgtgctaaaaaatactcacaaaaaccggtcccaagctctcgcgagctccggaccttactttagggttcaagggttcttgcagcgtgcggcggcgggtcgtctttcgagggcgtagggtttggctgcgcggagaagctttagatcctttgtttgggagtcgccatgagccgatcggggcaacccccggatctgaagaagtacatggacaagaagctgcaaatcaagctgaatgcaaaccgtgttgtgattggcacacttcggggatttgatcagttcatgaatttggttgtggacaacacagtggaggtcaatggaaacgaaaagaatgatatagggatggtggttatcaggggaaacagtgttgtcatgattgaagccctcgaaccagttgccaaggctcagtgaacctttagcttatccagtcagggtttagtagttaagctggccgtgttaattcaaaactggtgtatatgccattgggcatgttgtatcctgaatttcttacccttattcatgtgaaaacttaagcacctttgtatagtttatccttgtctttcgtt

SEQ ID NO: 2648 - DNA, 502 bp, Secale cereale
  misc_feature (402)..(402): n is a, c, g, or t
gttcttgcggcggcgtcgtctgcttccttccccctcttgcgaaggtctagggtttggctgggtagagaagagaggctttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacatcgggatggtggttctgagaggaaatagtgttgtgatgattgaagcccttgaaccaattgccaggtctcagtgatattttggcttacctgcttctggtttagtacttaatagtgtttggtcaaaaccgangcttatggaatcaggcatattgtatcctaatatttgtaatgtgtgagatttagcacttgctgtatagtttggagtttggactgtctttaaagatgcttgc

SEQ ID NO: 2649 - DNA, 635 bp, Triticum aestivum
ctcctccctcgtcttatatctagggttcagggttcttgcggcggcggcgcgacttccttccccctcttgcgaaggtctagggtttggccgagtagaggagagaggctttccccctcgtccagccgggagccgccatgagccgatcggggcagccgccggatctgaagaagtacatggacaagaagctccaaatcaagctgaacgcgaaccgcgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttacctgcttctggtttagtacttaatagtgtttggtcaaaaccgatgcttatggaatcaggcattttgtgtcctaatatttgtaatgtgtgagatttagcacttgttgtatggtttggagttcggactgtcttcagagatgcttgccatgctcactcaaacttacattgtttgggttcaatgctattttggtccagactgggcccactatttgtgcaatgtttgtgcttttatgttttgtgtgaaccg

SEQ ID NO: 2650 - DNA, 630 bp, Triticum aestivum
gtcttatatctagggttcagggttcttgcggcggcggcgcgacttccttccccctcttgcgaaggtctagggtttggccgagtagaggagagaggctttccccctcgtccagccgggagccgccatgagccgatcggggcagccgccggatctgaagaagtacatggacaagaagctccaaatcaagctgaacgcgaaccgcgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttacctgcttctggtttagtacttaatagtgtttggtcaaaaccgatgcttatggaatcaggcattttgtgtcctaatatttgtaatgtgtgagatttagcacttgttgtatggtttggagttcggactgtcttcagagatgcttgccatgctcactcaaacttacattgtttgggttcaatgctattttggtccagactgggcccactatttgtgcaaaaaaaaaaaaaaaagggcggccgctctggaatcac

SEQ ID NO: 2651 - DNA, 639 bp, Triticum aestivum
agagaggcggctcgtcccactcctccctcgtcttatatctagggttcagggttcttgcggcggcggcgcgacttcctcccccctcttgcgaaggtctagggtttggctgcgtagaggagagaggctttccccctcgttcagtcgggagccgccatgagccgatcggggcagccgccggatctgaagaagtacatggacaagaagctccaaatcaagctgaatgcgaaccgtgttgtcattggcacgcttcgtggatttgatcagttcatgaatttggtggtggataacactgtggaggtcaatggagatgagaagaccgacatagggatggtggttctgagaggaaatagtgtggtgatgattgaagcccttgaaccaattgccaggtctcagtgatattttggcatacctgcttctggtttagtacttaatagtgtttggtcaaaaccgacgcttatggaatcaggcaaattgtatcctaatatttgtaatgtgagatttagcacttgctgtatagtttggagtttgtactgtctttagagatgcttgcctggctcactcaaacttacattgttgggattcaatgctattttggtccagacttggcccactatttgtgcaaaaaaaaaaaaaaaacga

SEQ ID NO: 2652 - DNA, 675 bp, Triticum aestivum
agagaggcggctcgtcccagccctccctcgtcttatatctagggttcagggttcttgcggcggcggcgcgacttcctcccccctcttgcgaaggtctagggtttggctgcgtagaggagagaggctttccccctcgttcagtcgggagccgccatgagccgatcggggcagccgccggatctgaagaagtacatggacaagaagctccaaatcaagctgaatgcgaaccgtgttgtcattggcacgcttcgtggatttgatcagttcatgaatttggtggtggataacactgtggaggtcaatggagatgagaagaccgacatagggatggtggttctgagaggaaatagtgtggtgatgattgaagcccttgaaccaattgccaggtctcagtgatattttggcatacctgcttctggtttagtacttaatagtgtttggtcaaaaccgatgcttatggaatcaggcaaattgtatcctaatatttgtaatgtgagatttagcacttgctgtatagtttggagtttgtactgtctttagagatgcttgcctggctcactcaaacttacattgttgggattcaatgctattttggtccagacttggcccactatttgtgcaatgtttgtgccttttgtgtgaaccgtaagcttaacatcaaattcggctgctgtt

SEQ ID NO: 2653 - DNA, 694 bp, Triticum aestivum
agagaggcggctcgtcccagccctccctcgtcttatatctagggttcagggttcttgcggcggcggcgcgacttcctcccccctcttgcgaaggtctagggtttggctgagtagagaagagagacttccccctcgtccagtagggagccgccatgagccgatcggggcagccgccggatctgaagaagtacatggacaagaagctccaaatcaagctgaatgcgaaccgtgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttgcctgcttctggtttagtactacttgagctaatagtgtttggtcaaaacctatgcgcatgcaattgggcaaattgtatcctaatatttgtaatgtgtgagattcagcacttattgtatagtttggagtttgaactgtctttagatgcttgccttgctcactcaaacttacattgttgggattcaatgctattttggtccaaactggacccaccatttgtgcaatgtttgtgcttatatgttttgtgtgaaccggaagagtggcatcaaaacctcggccgcgaccacgc

SEQ ID NO: 2654 - DNA, 769 bp, Triticum aestivum
tgatttgtgtgggcccgtcgggccggcatgtcattgaccctttagcccatctgccctcgttaccgcgtctgggagagagaggcggctcgtcccagccctccctcgtcttatatctagggttcagggttcttgcggcggcggcgcgacttcctcccccctcttgcgaaggtctagggtttggctgagtagagaagagagacttccccctcgtccagtagggagccgccatgagccgatcggggcagccgccggatctgaagaagtacatggacaagaagctccaaatcaagctgaatgcgaaccgtgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttgcctgcttctggtttagtactacttgagctaatagtgtttggtcaaaacctatgcgcatgcaattgggcaaattgtatcctaatatttgtattgtgtgagattcagcacttattgtatagtttggagtttgaactgtctttagatgcttgccttgctcactcaaacttacattgttgggattcaatgctattttggtccaaactggacccaccatttgtgcaatgtttgtgcttatatgttttgtgtgaaccggaagagtggcatcaaaacctcggccgcgaccacgc

SEQ ID NO: 2655 - DNA, 686 bp, Triticum aestivum
ggagagagaggcggctcgtcccagtcctcctccctcgtcttatatctagggttcagggttcttgcggcggcggcgcgacttccttccccctcttgcgaaggtctagggtttggccgagtagaggagagaggctttccccctcgtccagccgggagccgccatgagccgatcggggcagccgccggatctgaagaagtacatggacaagaagctccaaatcaagctgaacgcgaaccgcgttgtcattggcacgcttcgtggatttgatcagttcatgaatttggtggtggacaacactgtggaggtcaatggagatgagaagaccgacatagggatggtggttctgagaggaaatagtgttgtgatgattgaagcccttgaaccaattgccaggtctcagtgatattttggcttacctgcttctggtttagtacttaatagtgtttggtcaaaaccgatgcttatggaatcaggcattttgtgtcctaatatttgtaatgtgtgagatttagcacttgttgtatggtttggagttcggactgtcttcagagatgcttgccatgctcactcaaacttacattgtttgggttcaatgctattttggtccagactgggcccactatttgtgcaatgtttgtgcttttatgttttgtgtgaaccgtaagcttaacatcaaattcggctgc

SEQ ID NO: 2656 - DNA, 850 bp, Setaria italica
cattgctgtagaccacggtcgacggcccggggattatttagggttctgggttctcgaggcggcggcggcggctacccctttctctgtcttcgcaaggcttagggtttggttggtcggagaagcttgtagtagatccttcgttagggagtcgccatgagccggtcggggcagcctccggatctgaagaagtacatggacaagaagctccaaatcaagctgaatgcaaaccgtgttgtcattggcacccttcgtggatttgatcagttcatgaatctggtcgtggacaacacagtggaggtcaacggaaacgacaagaacgacatcgggatggtggttatcagggggaacagtgttgtcatgattgaagccctcgagccggttgccaaggctgctcagtgaatcgtcagcctggtttagtagctaataagctggtagtgtcaattcaaaactggtgtatgccattgggcacgttgtatcctgagttcctgacacttattcatgtgcaagcttaagcacctttgtatagtttagccagcatttcgatttggagttgcacaacgccacaacctgccagagtgttatgcacttatgctggtgggattcgtgctatcttggtagcgaacgtgttatgtacctgttctggcaggagttatcagttaacttaaaatccaatacgtagtaggtaataatgtggctgtcaaatcatcgggcatgtttgcatctcttaacaatttcgtttctcagaagcatgaatgcattatctccctttggatgttcttggatctcttaacaagacaagcatgaatgcatgatctccctttggtctcttcggagatgatgttggggttac

SEQ ID NO: 2657 - DNA, 709 bp, Pennisetum glaucum
ggggaggggattatttagggtttgtgggttctcgaggaggcggcggcggcggctacacttttctctgtcttcgcaaggattagggtttggttgctcggagaagcttgtagtagatccttcgttggggattcgccatgagccggtcggggcagcctccggatctgaagaagtacatggacaagaagctccaaatcaagctgaatgcaaatcgtgttgtcattggcacccttcgtggatttgatcagttcatgaatctggtcgtggacaacacagtggaggtcaatggaaacgacaagaatgacatcgggatggtggttatcagggggaacagtgttgtcatgattgaagccctcgagccggttgccaaggctgctcagtgaatcgttagccatgttccctggctaataagctggtagtgttaattgtgtatgccattgggcacgatgtatcctgagtaagacacttattctgcaagcttaagcacctttgtatagtttagccaacattttgatttggaattgcgcaacctgccagagtgttatgcacagctgctcggatttgtgctatcttggtagcaatcgtgttatgtacctgttctggccaggagttatcagttaacttcattggaaatgaggtgccattcagggcctcgttaaatccaatatgtagtaagtgatttcataaaaactgtccctttggtcgttcttgg

SEQ ID NO: 2658 - DNA, 696 bp, Avena sativa
aaaacctggatgcgccgcctatttgtttacggtatcacgcagagaagaggaaaaaggctcagagatcccatcgtcttttctagttcgccgtcatgagccgatctggccagcctccggatctcaagaagtacatggacaagaagctacagatcaagatgaatgcaaaccgtgttgttattggcaccctacgaggatttgatcagtttatgaatctggtggtggacaacaccgtggaggtcaatggggatgagaagactgatattggaatggtggttgtcaggggaaacagcgttgtcatgattgaggcactggaaccgattgccaaatcgcagcagtgaatttccatggctcctgcctgttttgtgggctttgtactggtagtgtaaaactggtgtatatgatattcatgttcatgttgtatcttgactaatgttttctggaagtattatgatttcagtgttgtcggttgacctgttacatttttgttttaaatgttgtcttctggtgtcatggtacatttcttttacatccgcatgttttatcttatttagtgatgtatctttacctagttatatgctggctcctcttgttcaacagttactgctttattgtattcgtttgtacaaatatcctctttttgttactgcatcacccattgcactggattcacacagttattttgtttcctccattagc

SEQ ID NO: 2659 - DNA, 240 bp, Musa acuminata
atgagccgatcgggccagcctccagatctcaagaagtacatggacaagaagcttcaaataaagttgaatgcaaaccgagttgtggttggcactcttcgtgggtttgatcaatttatgaacctcgttgttgacaacaccgtggaggtgaacggcaatgagaagaatgatattggcatggtggttattcgaggaaacagtgtggtgatgattgaagctctcgagccggttgccagaacataa

SEQ ID NO: 2660 - DNA, 530 bp, Fagus grandifolia
tctctctctctcgcactagttcactctcagagtcttcaacatgagcagagtcgggccaaccaccggatctcaagaaatatatggacaagaagctccagatcaagatgaatgcaaatcgtatggtcattggtactcttcgtgggtttgaccagtttatgaatctagtggttgacaacactgtagaagtgaatggcaatgagaagactgatattggcatggtggtgatcagaggaaatagtgtggtcaccgttgaggctctcgaaccagtaaacagatcatagtggtttcacaatgctgtcggttctatctatgatttagggttattttggatggtatcaatatgataattgggaaggagatgttctgtaatctggattaggtggaccattctagacttctagtgctctatttctgttacttccccttttttctaagcagacttaatagtagtatagtctaatctgtatggtttctgattgaatggcagtgactttggttaatataatgcttatatggtcttaattagctgg

SEQ ID NO: 2661 - DNA, 539 bp, Allium cepa
aaaagacctaaaattttataatcttcatccgtcgccatgagcagatcaggacagcctccggatctcaagaaatatatggacaagaaacttcaaatcaagctcaatgcaaaccgagttgtgattggtaccctgcgtggatttgatcaatttatgaaccttgtgatagacaatacagttgaagtcaatggcaatgacaaaaacgacattggaatggtggtgttgagagggaatagtgttgtcatgattgaagcgctcgagccagtcaacagaactcagtaggatgatccttagcagcttatcatacaatgctgccttattatgaattaattagcttttgagattgaattttttaatatatacatgtgcacaactctgttcctgatctctgattaactcttataaattgcaatgcagaatctaccaaggttagttaaagccttgtgttctatgctttttgttgtgcctgttagtctgtttatttaacgatgatgggtttgctgtacttgcaaatccgtttatttaatgatgatgcgattgct

SEQ ID NO: 2662 - DNA, 586 bp, Allium cepa
catccgtcgccatgagcagatcaggacagcctccggatctcaagaaatatatggacaagaaacttcaaatcaagctcaatgcaaaccgagttgtgattggtaccctgcgtggatttgatcaatttatgaaccttgtgatagacaatacagttgaagtcaatggcaatgacaaaaatgacattggaatggtggtgttgagagggaatagtgttgtcatgattgaagcgctcgagccagtcaacagaactcagtaggatgatccttagcagcttatcatacaatgctgccttattatgaattaattagcttttgagattgattttttaatttatacatgtgcacaactctgctcctgatctctgatgtactcttataaattgcaatgcagaatctaccaggttagttaaagccttgtgttctatgctttttgttgtgcttgttagtctgtttatttaacgatgatgggtttgctgtacttgctaatccgtttatttaatgatgatgggtttgctgttggcttgtcaagagtttcgaaccccattattttttgcaaatcatgggttatttatgcgatggtatatgcttt

SEQ ID NO: 2663 - DNA, 520 bp, Allium cepa
ttcttatattttccaaaaaacctaaaattttataatcttcatccgtcgccatgagcagatcaggacagcctccggatctcaagaaatatatggacaagaaacttcaaatcaagctcaatgcaaaccgagttgtgattggtaccctgcgtggatttgatcaatttatgaaccttgtgatagacaatacagttgaggtcaatggcaatgacaaaaatgacattggaatggtggtgttgagagggaatagtgttgtcatgattgaagcgctcgagccagtcaacagaactcagtaggatgatccttagcagcttatcatacaatgctgccttattatgaattaattagcttttgagattgaattttttaatatatacatgtgcacaactctgttcctgatctctgattaactcttataaattgcaatgcagaatctaccaggttagttaaagccttgtgttctatgctttttgttgtgcctgttagtctgtctatttaacgatgatgggtttgctgtacttgc

SEQ ID NO: 2664 - DNA, 543 bp, Secale cereale
cagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggagtcaatggagatgagaagaccgacatcgggatggtggttctgagaggaaatagtgttgtgatgattgaagcccttgaaccaattgccaggtctcagtgatattttggcttacctgcttctggtttagtacttaatagtgtttggtcaaaaccgacgcttatggaatcaggcatattgtatcctaatatttgtaatgtgtgagatttagcacttgctgtatagtttggagtttggactgtctttaaagatgcttgccttgctcactcaaacttacattgttgggattcaatgctattttcgtccagactgggcccactatttgtgcaatgtttgtgttccaaatttggcctctgttgtgcaatgtttggaactttggagtattagg

SEQ ID NO: 2665 - DNA, 465 bp, Secale cereale
cttccttccccctcttgcgaaggtctagggtttggctggctagagaagagaggatttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacatcgggatgggtgttctgagaggaaatagtgttgtgatgattgaagcccttgaacctattgccaggtctcagtgataatttggcttacctgcttctggtttagtacttaatagtgtttggtcaaaaccgacgcttatggaatcaggcatattgtatcctaatatttgtaatgtgtgagatttagcacttgctgtatagtttggagtttggactgtc

SEQ ID NO: 2666 - DNA, 589 bp, Secale cereale
gggttttcttagggtttctttgtcggtcggtcgttcgttctgtcttccttccccctcttgcgaaggtctagggtttggctgggtagagaagagaggctttcccctcgttcagtcgggagccgccatgagccgatcggggcagccgccggatctgaagaagtacatggacaagaagctccaaatcaagctgaatgcgaaccgcgttgtcatcggcacgcttcgtggatttgatcagttcatgaatttggtggtggacaacactgtggaggtcaatggagatgagaagaccgacagtcgggatgggtggttctgagaggaaatagtgttgtgatgattgaagcccttgaaccaattgccaggtctcagtgatattttggcttacctgcttctggtttagtacttaatagtgtttggtcaaaaccgacgcttatggaatcaggcatattgtatcctaatatttgtaatgtgtgagatttagcacttgctgtatagtttggagtttggactgtcctttaaagtactgcttgccttgctcactcaaacttacattgttgggattcaatgctattttcgtccagactgggcccac

SEQ ID NO: 2667 - DNA, 735 bp, Brachypodium distachyon
atgacccacatgtcagagatcttaagggtctgcgtggtattttagggttccagcctcccagagcgttggcgttttgggttcagggttctcgcggcggcggctcgtacttcctttcgcgtcttctgaaggtttgggtttagcagcgcggaaaagcttgtggatcgttcgttagggagtcgccatgagccgatcggggcagccgccagatctaaagaagtacatggacaagaagctccaaatcaaactgaatgcaaaccgtgtagtcattggcacacttcgaggatttgatcaattcatgaatttggtcgtggacaacactgtggaggtcaatgggaatgacaggaacgacataggaatggtggttctcagaggaaacagtgttgtgatgattgaagcccttgaaccaattgccaagtctcagtgaaaatcggtttacgtacttctggttgagactttgagctgctagtttttgtaaaaattgatatgtatgcgattgggcgtattatactgtaacgtcgatgctgtatgagctttgccacctatgtatgtttagcctccctttggttgcatacaccgctgaagtcattgctatttagctgcattccatgcaatactgtgtttttatcttgtgtagatggccatggaagcttggtattgtgtggaccacaaactagacatctgtcggtactgtcgatagagatcataggcatatttggttgcaagaaaataacttcg

SEQ ID NO: 2668 - DNA, 1150 bp, Brachypodium distachyon
ggcaggggctccggctgacggcatctcctctcgcccacgctctgggtgctccgcacgcggtagagtccggggctcggaggagttcgcgcaatcgcgcgccgtggtgagctccgaacctccgatgctccgatggtagtttttgcagatacacccctgttcttagctctatttctctctttacgtctctcctgcaatttacgaaggggactatgacccacatgtcagagatcttaagggtctgcgtggtattttagggttccagcctcccagagcgttggcgttttgggttcagggttctcgcggcggcggctcgtacttcctttcgcgtcttctgaaggtttgggtttagcagcgcggaaaagcttgtggatcgttcgttagggagtcgccatgagccgatcggggcagccgccagatctaaagaagtacatggacaagaagctccaaatcaaactgaatgcaaaccgtgtagtcattggcacacttcgaggatttgatcaattcatgaatttggtcgtggacaacactgtggaggtcaatgggaatgacaggaacgacataggaatggtggttctcagaggaaacagtgttgtgatgattgaagcccttgaaccaattgccaagtctcagtgaaaatcggtttacgtacttctggttgagactttgagctgctagtttttgtaaaaattgatatgtatgcgattgggcgtattatactgtaacgtcgatgctgtatgagctttgccacctatgtatgtttagcctccctttggttgcatacaccgctgaagtcattgctatttagctgcattccatgcaatactgtgtttttatcttgtgtagatggccatggaagcttggtattgtgtggaccacaaactagacatctgtcggtactgtcgatagagatcataggcatatttggttgcaagaaaataacttcgtcaatgttcctctcatcgtctgatctttgatttgcagagcaccctttagcttttgatctctgttgccactataagttcgtgtgaagtcctgttagctcgtttcaaaagaatttagaggattcacagatgggtcacatgctctggagtgctacgaattcttgtagttttctcctgatctatttgcaatcctctttgaactcccacat

SEQ ID NO: 2669 - DNA, 398 bp, Leymus cinereus x Leymus triticoides
gcacgaggcttctccctcttacgaaggtctagggtttggctgagtagagaagagaagaaaggcttccccctctttcagtcgggagccgccatgagccgatcggggcagccgccggatctgaagaagtacatggacaagaagctccaaatcaagctgaatgcaaaccgcgttgtcattggcacgcttcgtggatttgatcagttcatgaatctggttgtggacaacactctggaggtcaatggagatgagaagaccgacatagggatggtggttctgagaggaaatagtgttgtgatgattgaagcccttgaaccaattgccaggtctcagtgatattttggcatacctgcttctggtttagtacttgagctgatactgtttggtcaaaaccaatgcgc

SEQ ID NO: 2670 - DNA, 537 bp, Oryza sativa
ctcgctttaaaactggacgcgtcggctcgggttcctcatcgcgagggttttttgctgctgccgagaggagtggaggcgcttccagatctcctcccctctctactcccgtcatgagccgatcggggcagcccccggatctcaagaagtacatggacaagaagctccagatcaagctgaatgcaaaccgtgtaattgttggtacgctccgtggattcgatcagtttatgaatttggtggtggacaacacggtagaggtcaatggaaatgacaagactgatattggaatggtggttgtcagggggaacagtgttgtgatgattgaggcattggagccagtgcccaaatcccagtgactcccgtggcatattcctgattcagtagctatagagctggtagcaagaaaactgatgtatatgctgttgatgttcttgttgtaccttgtccttaactgatgtgtggaatattgacttcgtttcttgaatatggaatgacaaacctttgatatttttgtttgcaagccccaattccgtgttgtgc

SEQ ID NO: 2671 - DNA, 485 bp, Oryza sativa
atcgcgagggttttttgctgctgccgagaggagtggaggcgcttccagatctcctcccctctctactcccgtcatgagccgatcggggcagcccccggatctcaagaagtacatggacaagaagctccagatcaagctgaatgcaaaccgtgtaattgttggtacgctccgtggattcgatcagtttatgaatttggtggtggacaacacggtagaggtcaatggaaatgacaagactgatattggaatggtggttgtcagggggaacagtgttgtgatgattgaggcattggagccagtgcccaaatcccagtgactcccgtggcatattcctgattcagtagctatagagctggtagcaagaaaactgatgtatatgctgttgatgttcttgttgtaccttgtccttaactgatgtgtggaatattgacttcgtttcttgaatatggaatgacaaacctttgatatttttgtttgcaagcccc

SEQ ID NO: 2672 - DNA, 1233 bp, Oryza sativa
tccggcagaattcgacaaatatcacataacccgagtagagccacaagccaacacagccaatttaagctctcacctcgttctgataagcaacggcgaccctggtacctgcatcatcaccaaaacccaaaccaccatcaaatcgcgcgacgcggagctaatcttaagctacgagacggggggagaaaaagcaacacaccgaagaggtggcggaaggcgtcgcggcaggcctcggtgacgtgcgcggcgtagccgtcgtccttctccgccgcccgcatgatctccggctgcgccgcctcagggaaccgccgcggacgcgcgggggccccgccggaaccgccgcccctcgagctggtgcccgcatccccgccgccgccgccgcgcatctctctcgccgtcgacctcctcacgcgatagagagttcagagctccaaggagttctcgcctcgtccgcgcttcgtcgtgctccaggctgggctggtggtatatttgcagatacacccctgagtttaataatatttctgtatctattcgtcttcttgtgttcgcgatggagcggagacgcgggcccacatgtcagcgactatttatagtgtggagatagcaatcccgtctcgggctattttagggttcagggttctcctctctgcggcggcggcggcggctattttctctcgcctactccgaagatttggctttggttgagcggagaaggtctagatcttccgtcggggagtcgccatgagccgatcggggcagcctccggatctgaagaagtacatggacaagaagctccaaatcaagctgaatgcgaaccgtgttgtcattggcactcttcgaggattcgatcagtttatgaatttggtcgtggacaacacagtggaggtcaatggaaacgagaagaatgacatagggatggtggttatcaggggaaacagtgttgtgatgattgaagccctcgaacctgttcccaagccgcagtgaactttcagctcgcctagtttgcttcggtacttgatttggacatttggtagtgccatgtcaaacctaattgttattccagatgtttatgcccgcgggcattttgtatcctgacctggtttatatgcaagctcgtgcacctttgtatagtctagccagcgttacgatttatgcgctctagcctgaacgttactatattgctgtgatgattttccggagcattttgaggtcacggattgtgaatttcgtagcatc

SEQ ID NO: 2673 - DNA, 621 bp, Oryza sativa
cgggctattttagggttcagggttctcctctctgcggcggcggcggcggctattttctctcgcctactccgaagatttggctttggttgagcggagaaggtctagatcttccgtcggggagtcgccatgagccgatcggggcagcctccggatctgaagaagtacatggacaagaagctccaaatcaagctgaatgcgaaccgtgttgtcattggcactcttcgaggattcgatcagtttatgaatttggtcgtggacaacacagtggaggtcaatggaaacgagaagaatgacatagggatggtggttatcaggggaaacagtgttgtgatgattgaagccctcgaacctgttcccaagccgcagtgaactttcagctcgcctagtttgcttcggtacttgatttggacatttggtagtgccatgtcaaacctaattgttattccagatgtttatgcccgcgggcattttgtatcctgacctggtttatatgcaagctcgtgcacctttgtatagtctagccagcgttacgatttatgcgctctagcctgaacgttactatattgctgtgatgattttccggagcattttgaggtcacggattgtgaatttcgtagcatc

SEQ ID NO: 2674 - DNA, 710 bp, Sorghum bicolor
accgtcttgtgtgttgtactccgagagaaaccggcgcaaccgcccttaaccactcggtccctggattatttagggttctgggttctcgagtcggcggcgagcgctttctttgtcttggaagacgatttggtttggcggggagagaaggttgtgctagtaattgatccaagttaaggcgtcgccatgagccggtcagggcagcctccggatctgaagaaatacatggacaagaagctccaaatcaagctgaatgcaaaccgtgttgtcattggcacacttcgtggatttgatcagttcatgaatctggtcattgacaacacagttgaggtcaatggaaacgaaaagaatgacatcgggatggtggtcatcaggggaaatagtgttgtcatgattgaagcactcgaaccagtcgccaaggctcagtgaactttcagcggatctagatgtggttcagtcgttaagctagtagtattaattcaaaactgttgtatggcattgggcatgttttagcctgagttccctcattcttacttatctgcaagcttgcgcacctctgtatgactgtatagctcagcaagatttacactgctttctggtgttattctgatgggatttgtgcgtcgtggtatcatgctaaaaagggtgtgaattgtgatgtgttccttatctaaactggagatgctagttcagatccgcattttggtgttttt

SEQ ID NO: 2675 - DNA, 737 bp, Sorghum bicolor
gtgtcggattaccgtcttgtgtgttgtactccgagagaaaccggcgcaaccgcccttaaccactcggtccctggattatttagggttctgggttctcgagtcggcggcgagcgctttctttgtcttggaagacgatttggtttggcggggagagaaggttgtgctagtaattgatccaagttaaggcgtcgccatgagccggtcagggcagcctccggatctgaagaaatacatggacaagaagctccaaatcaagctgaatgcaaaccgtgttgtcattggcacacttcgtggatttgatcagttcatgaatctggtcattgacaacacagttgaggtcaatggaaacgaaaagaatgacatcgggatggtggtcatcaggggaaatagtgttgtcatgattgaagcactcgaaccagtcgccaaggctcagtgaactttcagcggatctagatgtggttcagtcgttaagctagtagtattaattcaaaactgttgtatggcattgggcatgttttagcctgagttccctcattcttacttatctgcaagcttgcgcacctctgtatgactgtatagctcagcaagatttacactgctttctggtgttattctgatgggatttgtgcgtcgtggtatcatgctaaaaagggtgtgaattgtgatgtgttccttatctaaactggagatgctagttcagatccgcattttggtgtttttagtatatgctctcgtta

SEQ ID NO: 2676 - DNA, 633 bp, Saccharum officinarum
ttaaccactcggtccctggattatttagggttctgggttctcgagtcggcggcgaccgcttcctctatcctcgcaaaagacggtttgtttgggcggggagaaggttgtactagtagtagatctaagttaaggagtcgccatgagccggtcagggcagcctccggatctgaagaagtacatggacaagaagctccaaatcaagctgaatgcaaaccgtgttgtcattggcacacttcgtggatttgatcagttcatgaatctggtcattgacaacacagttgaggtcaatggaaacgaaaagaatgacatcgggatggtggtcatcaggggaaacagtgttgtcatgattgaagcactcgaaccagttgccaaggctcagtgaactttcagcggatctagatgtggttcagccgttaagctagtagtattaattcaaaactgctgtatgccattgggcatgttttagcctgagttccctcacccttattcatctgcaagcttgagcacctttgtatagttcagcaagatttacactgcttcctggtattattctgctgggatttgtgcttcgtggtatcatgctaaagagggtgtgaattgtgatgtgttccttatctaaactggagttgctag

SEQ ID NO: 2677 - DNA, 398 bp, Citrullus lanatus
gggttttttccatctctctgacctttgttctccaaaaacctcttaacatctctttcgttcgttcttcaccatgagtaggtcaggacagcctccggatctcaaaaagatacatggacaaaaagcttcagataaaactcaatgctaatcgcttggtaattggaactcttcgtgggtttgaccaatttatgaatctagtggttgacaacaccgtggaagtgaatggcaacgagaaaactgatattggcatggtggtgattaggggcaatagtgttgtcactgttgaagcacttgaacctgtaaacaggatgcagtgattgtgaacttattctgtttgaagttggttggattcttgctgctgatctgttttatagattgagtgagtaaaacattcggaactg

SEQ ID NO: 2678 - DNA, 745 bp, Citrullus lanatus
cgaagactcgccgtgaccatctgctcgattaattagggttttttccatctctctgacctttgttctccaaaaacctcttaacatctctttcgttcgttcttcaccatgagtaggtcaggacagcctccggatctcaaaaaatacatggacaaaaagcttcagataaaactcaatgctaatcgcttggtaattggaactcttcgtgggtttgaccaatttatgaatctagtggttgacaacaccgtggaagtgaatggcaacgagaaaactgatattggcatggtggtgattaggggcaatagtgttgtcactgttgaagcacttgaacctgtaaacaggatgcagtgattgtgaacttattctgtttgaagttggttggattcttgctgctgatctgttttatagattgagtgagtaaaacattcggaactgtagtatgtataattttgggatgttatggattttagatggacttcttgtattccatcattcttgacaggcggataataattccagcaatggggtttctgtattattatgggatggagagattcgttgcattaggtgagacttttcttaccaaacctttcattcggtctctgttacagcgccaagatccaattatattgcaatcctagtgtatgagtatcactgtatcactttgaaatgtgcacattaatctttctatggagagaatccaaagagagttggtttcaacagaaatcattgccaaattgaccaattt

SEQ ID NO: 2679 - DNA, 538 bp, Castanea mollissima
aatttttagggttttgcagaatctcactctctctctctgaaactcactctctctcagtgtcttcaacatgagccgatcgggccagcctccggatctcaagaaatacatggacaagaagctccagatcaagatgaatgcaaatcggatggtcgttgggacgcttcgggggtttgatcagtttatgaatctagtggttgacaacactgtagaagtgaatggcaatgagaaaactgatatcggcatggtggtgatcagaggaaatagtgtggtcactgttgaggctcttgaaccagtaaacagatcatagtgtgggttctacttatgcttttgtgttattttggatgtatcaatatgacattgggaaggagatcttctgtaatctggattaggtggcccattctagtgctttattcccccccttttcttttcaagcagacttgatggtaatatagtgtattctgtatgggttatgatggatggcagtgacttttggttaatataatgcttatatggtcttaccaactgggttaaaaaaaaa

SEQ ID NO: 2680 - DNA, 682 bp, Cucumis sativus
actcgccgtgacctttttctcgattaattagggtttttttcatctctctgacctctgtcctgttgaatcctcttcacagctcttttttttttgcgttcttcaccatgagtaggtcaggacagcctccggatctcaaaaaatatatggacaaaaagcttcagataaaactcaacgctaatcgcttggtaattggaactcttcgaggctttgaccagtttatgaatctagtggttgacaacaccgtggaagtgaatggcaacgagaaaactgatattggcatggtggtgattagaggaaatagtgtggtcactgttgaagcacttgaacctgtaaacaggatgcagtgattgcgaacgtgttggaagttggtttgattcttgctgctgatctgtttaatagatggattgagttaaacattcggatttgtagtatgtataattttgggatgttatggattttagaacgaattcttgtactccatcattctggacagtcaggattctaatgtcagcaatggggtttctgtattattctgggaaagatagattcattgcattaggtaagatttttctcacgaaaccaaatattctctcttctgccacagccccaagatccaaattctatttgttccaagtctatgagtgccactgtatcatttcgaaatgtgctcattaatcatttc

SEQ ID NO: 2681 - DNA, 608 bp, Cucurbita pepo
ttcctttcttctgatcactgttctaccaaaacctcttcccatctctcgttcttcaccatgagtaggtcaggccagcctccagatcttaaaaaatacatggacaagaagcttcagataaaaatgaatgctaatcgcttggtagttggaactcttcgtgggtttgaccaatttatgaatctagtcgttgacaacaccgtggaagtgaacggtaacgagaaaaccgatatcggcatggtggtgattaggggcaatagcgtggtaaccgttgaagcacttgaacctgtaaacaggatgcagtgatggtgcacgcgttggaatttgctgctctgtttcatagattgagtgagtaaaacattcggaactgttgcatttataattttgggatgttacgaatatcaggtggatttcttgtgctgccatcattctgaacacctggcttattaatttcagcgatggggtttctgtattttggattcaattaccttgcaaatcttagtgtatgaaacccatcgtatcacttgaagatgtgttcattaatcccattacagaggacccgaaaagagaaatagtttcaacccagtttgtatcaagtcccaacttcattacta

SEQ ID NO: 2682 - DNA, 602 bp, Cucurbita pepo
ttccttcttctgatcactgttctaccaaaacctcttcccatctctcgttcttcaccatgagtaggtcaggccagcctccagatcttaaaaaatacatggacaagaagcttcagataaaaatgaatgctaatcgcttggtagttggaactcttcgtgggtttgaccaatttatgaatctagtcgttgacaacaccgtggaagtgaacggtaacgagaaaaccgatatcggcatggtggtgattaggggcaatagcgtggtaaccgttgaagcacttgaacctgtaaacaggatgcagtgatggtgcacgcgttggaatttgctgctctgtttcatagattgagtgagtaaaacattcggaactgttgcatttataattttgggatgttacgaatatcaggtggatttcttgtgctgccatcattctgaacacctggcttattaatttcagcgatggggtttctgtattttggattcaattaccttgcaaatcttagtgtatgaaacccatcgtatcacttgaagatgtgttcattaatcccattacagaggacccgaaaagaagaaatagtttcaacccagtttgtatcaagtcccaacttca

SEQ ID NO: 2683 - DNA, 513 bp, Ipomoea nil
aaaactttcttcttcacttctctggtctgagacgaaaacgggaagcgcagcagcatgagtcggtcgggtcagcctccggatctaaaaaagtacatggacaagaaactccaaattaagatgaatgccaatcgcatggtagtcgggactcttcgtgggtttgatcagttcatgaatttggtcattgataacactgtggaggttaacggcaatgaaaagaatgatattggcatggtggttattcggggaaacagcgttgttactattgaagcattggagcccgttgccagatcgtagcgctagtagctgctgatgcagtcatcaccttgttaatttcatctatgtaccaatgcctgctgctttgtggaagcattataggtctactagtactttttgttaggtttccaaagtattgaagcagaacaagttatcatatgactgagctgaatttgattgctattatgtactttggtggcaatggattttaatttttagtttatctagtcaaaaaaaaaa

SEQ ID NO: 2684 - DNA, 732 bp, Cucumis melo
actcgctgtgaccttcttctcgattaattagggttttttccatctctctgacctctgttctgtagaaacctcttcacagctctttctttcgttcttcaccatgagtaggtcaggacagcctccggatctcaaaaaatatatggacaaaaagcttcagataaaactcaatgctaatcgcttggtaattggaactcttcgaggctttgaccaatttatgaatctagtggttgacaacacagtggaagtgaatggcaacgagaaaactgatattggcatggtggtgattagaggaaatagtgtggtcactgttgaagcacttgaacctgtaaacaggatgcagtgattgcgaacttggaagttggtttgattcttgctgcagatctgtttaatagatcgagtgataaacattcggaatgttaatgtataattttgggatgttatggattttagttggaattcttgtactccatcattctggacagccaggattataatttcagcagtggggtttctgtattattctgggaaaaagagattcattgcattgggtaagatttttctcacgaaacattacattctctcttctaccaaagcaccaagatccaaattctatttgttccaagtctattagtgccactgtatcatttcgaaatgtgctcattaatctttatacagaaaatccaaaaagagatagtttcaacaatacgttgccaaatcaaccaatttctaaac

SEQ ID NO: 2685 - DNA, 629 bp, Momordica charantia
ttttctttttcttctctgccaaaaccctccacagctctccttcttcgttcgtcaccatgagtaggtcaggccagcctccagatctcaaaaaatacatggacaaaaagctccagataaaactcaatgccaaccgcttggtaattggaacccttcgtgggtttgaccaatttatgaatctagtggttgacaacaccgtggaagtgaatggcaatgagaaaactgatattggcatggtggtgattaggggcaatagtgttgtcaccgttgaagcacttgaacctgtgaacaggacgcagtgatgggtggatgtgtcggttcaactcttgctgatctgttttatagattagtgggtatcattcggaactgtaggatgtataattttgggatgttatggatattagatggaactctttgtactccattgttctgcataggtggattataaatttgagaaatatgaggtttctgtatcattctgagagagatattcattgccttaggtaagatcttctcacaaaactttttatcctcatgctacagcaccaagatccaattacattgcaatacgaggtgtgtgaacccattgtatcattttatattgtgcacattgatctgcctcgtcatggtta

SEQ ID NO: 2686 - DNA, 548 bp, Mimulus guttatus
accataatttctagggtttctgaagagcgataaacccagaacagaatccccattgtcggaatttttttttaagaattttgctatgagcagatcagggcagcctccggatctcaagaaatacatggacaagaagctacaaataaaacttaatgccaatcgtatggtggttggaacccttcgtggattcgatcagtttatgaatctggtggtggacaacaccgtcgaagtcaatggaaatgagaaaactgatataggcatggtggtcatcaggggaaacagtgtagttacggttgaagctctcgagccagtcgctagagctcaatgattgtatatgtattgattcaatctaatttttagtctcggattattatctttgatgtggtagtttttcactgtttatgaccggttgttggtcacatttcttgattggtagccttgtctgaatcgttcgtatccaacgtaatcatttgaaatgttagcgtatgaggcggctgtctgcggtcctggatttaattcagcatatattactaacataattctttttatga

SEQ ID NO: 2687 - DNA, 520 bp, Quercus alba
cagagtacatgggctcaaatttttagggttttgcagaacctctctctctctctctctctgtaactcactctctcaaagtcttcaacatgagcagatcgggccagcctccggatctcaagaaatacatggacaagaagctccagatcaagatgaatgcaaatcggatggtcgttgggacgcttcgtgggtttgaccagtttatgaatctagtggttgacaacactgtagaagtgaatggcaatgagaaaactgatatcggcatggtggtgatcagaggaaatagtgtggtcactgttgaggctcttgaaccagtaaacagatcatagtgtgggttctacttatgcttttgtgttattttggatggtatcaatatgacattgggaaggagatcttctgtaatctggattaggtggcccattgtagtgctttattcccccccttttcttttcaagcagacttaatgataatattgtgtattctgtatgggttatgatggatgacagtgacctttggttaatat

SEQ ID NO: 2688 - DNA, 685 bp, Quercus alba
cactttctacttaagtacagtggtatcaacgacagagtacatgggcgtcaattttaaggttttgcagaacctctctctctctctctctcaaagtcgtcaacatgagcagatcgggccagcctccagatctcaagaaatacatggacaagaagctccagatcaagatgaatgcaaatcggatggtcgttgggacgcttcgtgggtttgaccagtttatgaatctagtggttgacaacactgtagaagtgaatggcaatgagaaaactgatatcggcatggtggtgatcagaggaaatagtgtggtcactgttgaggctcttgaaccagtaaacagatcatagtgtgggttctacttatgcttttgtgttattttggatggtatcaatatgacattgggaaggagatcttctgtaatctggattaggtggcccattgtagtgctttattccccccccttttcttttcaagcagacttaatgataatattgtgtattctgtatgggttatgatggatgacagtgacctttggttaatataatgcttatatggtcttaccagctgggttaatatgcttcgcttttcttcatgggtcataattgcaacttagcatagtgttgagcgggttattactcacaaatcatgtcaaatcagcccgaatatatggtcggggcgtaaattattacct

SEQ ID NO: 2689 - DNA, 542 bp, Lippia dulcis
tcttcgtttttccaaatatctctgatcgtcaaaatttctagggttttgaagagcgataaaccccatttgcttttaccctagaatttcgtcatgagcagatcaggacagcccccggatctcaagaagtacatggacaagaagctacagataaagcttaatgccaatcgtatggtggttgggacccttcgtgggtttgatcagtttatgaacctggtggtggacaacaccgttgaagtgaatggaaacgagaaaaccgatataggaatggtggtcatcagggggaatagtgtggttaccgttgaagccctcgagccggttgctagagcacaatgagattgtatatgtttatgtattgttcaatctaattgtagcttcagattttcgtgatgttgaagttgtggcagtttttactggtctcaacttttaactgttgtcagtttctacctctataacttgattttgcggattggttgtatccaacggaatgggcttaaatgtaaggtattgggaatcttttccagttaccatgactttggtgctag

SEQ ID NO: 2690 - DNA, 477 bp, Lippia dulcis
agttctagggttttgaagagcgataaaccccgactgaaactcgcttttctctcaaggatttgatcatgagcagatcgggacagcctccggatctcaagaaatatatggacaagaagctgcagataaaacttaatgccaatcgtatggtggtcgggacacttcgcggtttcgatcagttcatgaacctggtggtggacaacactgttgaagtgaatggaaatgagaaaacggacataggcatggtggttatcaggggaaacagtgtggttaccgttgaagctcttgaacccgttgctagagcacaataattgtatatgtttaatggttatgcaccaaaccattctaacttgtagtggccgatatcttggatgctcaagcaggactaattatgacctttttgattctaatcttttgtaaacacttcgaaatagataagcttgcttgttgcaaatctatcagtatccaacagtatgattt

SEQ ID NO: 2691 - DNA, 479 bp, Vinca minor
attcatcctctccagtctcccgtacctcttcctgtccctccctgtaccgtcgtctctttcacagagttaactttgttgtcgatagatttcgccatgagtcgatcaggccagcctccagatctcaagaagtatatggacaagaagctacagataaagttgaatgccaatcgcatggtggttggaacgctccgtggttttgatcagttcatgaacttggtggtggacaatacagttgaggttaatggcaatgaaaagacagacataggcatggtggttatcaggggaaatagtgttgtcactgtcgaagcactggaaccagttgcgagaacccagtgattgtacatctccagcattattatgggataaaatgtaacattgtcatggaatgtttttttgtgagagatgctgctggctgtagtattaaatctaaaaaactgactagatttttagtgtttctttttatattgttattgccaacc

SEQ ID NO: 2692 - DNA, 660 bp, Musa acuminata
gatgacctcagacacccccaccgacgtctagggtttactgttccagagcggctgcaagtgtcctcggagacccaccggtcccttctcgcttctcatcaccatgagccgatcgggccaacccccggatctcaagaagtacatggacaagaagctacagataaaactgaatgcaaaccgggtcgttgtgggtactctccgcggatttgaccaatttatgaaccttgttgttgacaacacagtggaggtgaatggcaatgagcaaaatgatattggcatggtggttattcgaggaaacagtgtggccatgattgaagctcttgaaccagtcgccagaacgtaatcacatattttctcttcttcggattgatgcttgtaccagacatgttcttaatgaacgcttatgatatttgtaatgatttagctggagttcattgtctacattgtattcccttgatgcaaaacctggttaagccaatgtagcatgacattgtccttcctttaaatcttgtctttgtctgttgggtgtaggatctctctagtacctattgttaaactatttatagtatgacattctatttctgttggatgcctagtgggcagctaaggtaaataataataataatttagaactgatcggacaattagttccttttgtttgac

SEQ ID NO: 2693 - DNA, 952 bp, Musa acuminata
tgagaggccgcggcgcaaaggaagtatcagccacttaataaaatctggccctaaaaattcatcaagattcgtgacaagtctttcgattgagaggctgagtcgcagaggaaatgatatgggttggtacgcataagaaggtttcctttctcgtgggcaaacctttaggcattcccattgtttctacgaccgataaatacggtcgtgcttctcgccgcggatatttagggtttagggttctcgagctgtcgagagatacgtgcttggagacccaccgatccattcccctcttcacgtcgcaatgagccgatcgggtcaacccccagatctcaagaagtacatggacaagaagctacaaataaaattgaatggtaaccgagttgtggttggcactctccgtgggtttgatcaatttatgaaccttgttgttgacaatacagtggaggtgaatagcaatgagaagaacgatattggcatggtggtcattcgaggaaatagcgtggtcatgattgaagctctcgagccagtcgccagaacttaatatcacttcttttcttctgtccgttgacagttgtaccagatatgttcttgttgaatgcttatgggattgttaaatctgtcagaagtcagttaaatattatgtacgcttaatgcaaaaccaggttactacaatgtagcatgatattatcctaatgatcttttttatgtatctttgtcacctgtcattaagatctttatcctatcggcatcatcctaattatatctgattttgatgaatagctgaaaggggaagaaaaacaccatattattacaatgatactcggttcatcatattacagctgaaaggggaaaaaaaacaccatcatatctgcaaatttgcattggccatctttgaatgctgtcttactgaactagttgggttagagttgcactttgcttttggcatgcatgtaat

SEQ ID NO: 2694 - DNA, 1096 bp, Gossypium hirsutum
gctgtgcgctgccttgtgggtgtagttgctcgtgtgcgatcgtattagtatgggcgctgtcgatgtggctgttgtcgctctgtcgttgctgggtcgttcacttcagctgctacggtaagaggaactgtgctgctgtgtcagccagcgtttgctttgtgttggtattgctccagtcgtcgttattgctccggttgtcgttgctagtatctgttgtgttcctgccctagttctcgtcacggtgtgggccattggcgctgtcgttggtctgtttcgccagctcgagtgtgtcgactgttgtttttctcggtaggcgccgttgtgtggtacccgtgtattcgccattttgccctgggcgagctttcatttgtagtctacgaatcgcggctcgtgtgcctccccttgaccctattcccctctttctcgctctcccgctccgcagtagaccaacctgccgtcactatgagcagatcaggccagcctccagatctcaaaaagtacatggacaagaaactccagatcaagctgaatgcaaatcggatggttgttggtactcttcgtgggtttgatcagtttatgaatctagtggttgacaacacagtagaggtgaatggcaatgagaaaactgacataggcatggtggtgatcagaggaaatagcgttgttactgttgaagcccttgaacctgttggcagaatgcagtgattctggtttttctattgatttatcactttgatgtatctcttcgctttgttgtttcaatggcatccctgctagtttgggattgggattgggatattttatgtaattgagaatttgtcggaagttagatgggtctccatggaatctgcttttcgtttctcaactttacccgatggattgccctttgtgcatttcaaacggatttaactgaatgtagagaatggttactgcaattcttatttttagtgcttaggcctcattgaaacttcggtgctgaatatgttaaagcttttattgttcttgttcttcaatgcattcatttttgtccctctggattagattagtccttaagtctttaaccatccatggtttggccaaaccttaattcacacagggt

SEQ ID NO: 2695 - DNA, 772 bp, Gossypium hirsutum
tattaatcatactaattaaacataaataaattcaaaaacttattattaatttttgaaacgtataattttactcaagaaaatcaatggagggagacttgatgacgtccaacaatttgtaaggatttcaattttgactccaataatcaaaacattaaactcttcgtcttcccctaaagccctacgctctaaatcagtagttgagcaaacctctttcacaatgagcagatccggccagcctccagatctcaaaaagtacatggacaagaagctccagattaagctgaatgcaaatcggttggttgttggtacacttcgcggatttgatcagtttatgaacctagtagttgacaacaccgttgaggtgaatggcaatgagaaaactgatataggcatggtggtgatcagaggaaatagcgttgttactgttgaagcacttgaacccgtaggccggatgcagtaattcaggtttttcgttccaaaacttggatttcactttctgtatctctttcacttattgtgtctaggctgctagcttagggcttgatatgttacatgatcgagaattcgtaggaagttgttagattgatatccatggattctgttctttcttttcgctatcctttgatctattatcactttgacggaaacaaggctctccaagtaaacgaaagcatcaaaaccatcaaatatcagatgcctatgaatcttaaacttcttaaattcgtgtttaccaggattgtaagacaccatttcattattgagtgctaggttt

SEQ ID NO: 2696 - DNA, 580 bp, Eschscholzia californica
gaaaaatagttttggccaagagaaacttgagttcgagagttagggttttgcggacatattcgtcacctttcattctctcaatcgtattctcgtttctctctcaaaatgagcaggtcaggtcagcccccagatttgaagaagtacatggacaagcagcttcagattaagctgaacgctaatcgtgtggtggttggtactctacgtgggtttgaccagtttatgaatctggtggtggataacactgtagaaatgaatggcaatgagaagaacgacatagggatggtggttattcgtggaaacagtgtggttatgattgaagctctcgaacccgttcctagagctcagtagctacctttaacatcggccaacgatgtttgctgcactatatcgtccagaagtttttttttggaacatatcggtattagctttatagcagttttcatgaaacttttagctggtgtgttagcacagaagatttcttgtattaatatgatggttttagacttttactgatgaattgggaggccttttagttcatgatacattgatctaatttggtattttgtttaaaatagagata

SEQ ID NO: 2697 - DNA, 2074 bp, Gossypium raimondii
agtggtatgattcttacttcgggtgcgagaggtctcgagttcgattctcgcaccaccccaattatcattaatttttaattatctaatattattttttaatctcatttgaaattttcaaccgtgggccgcctcttgatcaacatcaggccctctacaatctcagaggctttcatttttagtctaggaatcacagctttcttcctcccctaaaccctattcccctctttctcgctctcccgctccgcagtagaccaacctcccgtcactatgagcagatcaggccagcctccagatctcaaaaagtacatggacaagaaactccagatcaagctgaatgcaaatcggatggttgttggtacgcttcgtgggtttgatcagtttatgaatctagtggttgacaacacagtagaggtgaatggcaatgagaaaactgacataggcatggtggtgatcagaggaaatagcgttgttactgttgaagcccttgaacctgttggcagaatgcagtgattctggtttttctattgatttatcactttgatgtatctcttcgctttgttgtttcaatggcatccctgctagtttgggattgggattgggatattttatgtaattgagaatttgtcggaagttagatgggtctccatggaatctgcttttcgtttctcaactttacccgatggattgccctttgtgcatttcaaacggatttaactgaatgtagagaatggttactgcaattcttatttttagtgctcaggcctcattgaaacttcggtgctgaatatgttaaagcttttattgttcttgtgcttcaatgcattcatttttgtccctctggattagattagtccttaagtctttaaccatccatggtttggccaaaccttaattcacacagggtaaaaaacaaaagtagcttgtttttactgttaaactatggagtatctagtaaacttgattagtctacttgcttctgataaaaaactctaggaagtttacattacagccgttgttggttcctgggaagtaagctagatggtatttgttcttacaggatgcactttttacaagctgttgtagagtacctctaaaagttggtccagattcgtttttagccgttggtgtttggcttggccattgacatcagaatcccacaccaactgatctatgtttatattctgggtgtatgtatttccaaaaagaagaaaagagaaaagggaaagaaacaaaaaccaacgaaagcttagggtagaaagctcatctttttacacttttgcatgcagcatggctggcacttttaacaagcatcattctgcaaaattcatggcattggggttaacgatcacttctaaaaaggccaaaagagcagaggctgtacggaatcaaagtataaagatgtgaagtatagccgcgaaattagattcaaatttgaaacagtggacattgtacaacgggcaacagttttgcctaaagactctttttgcttgaagcagctccttcactttcactttatgttttccctttgtaaaggcatcccccttgcaaaatgcagcttacccttttcaaccattcattgcttcatcaactatgtttctcaaattcggctgttagttagtattggatgcatgttcaaattggggcttcatatctatcccaatatccagaagaaatgaggagtttgaactagaaaatcaatgataagaaggggaaaaaaatgggtttttgtgaatgatatcatccacagctcatccaacaggcaacaacagctccgaaatggaatccatcttttcttgttattgccaattggcaaatttttatgtggaaagtgggtggcacatgtttggtggcattttttaagattttaaggatatgattacaattggcagcttaatttacttgtgcaacacttttccttattttgtttcctggtccttaactctttaattatattcataatgagaatttagttgacaaacaaaagagttatttggtgagacaatggagatcattattgttttctttgtatttttctataattttccaatctaattacaagcatgtggaagattgg

SEQ ID NO: 2698 - DNA, 958 bp, Gossypium raimondii
atttaccaaaaaaaaaatctaataaactccatcttcgattaaggtttagactctaataatattatatatgttgaaaatataattgatgcattaatgtaccatcaaataattttaataatattgaaaggtttaaaaaatattttaaaaataaatattaatcatactaattaaacataaataaattcaaaaacttattattaatttttgaaacgaataattttactcaagaaaatcaatggagggagacttgatgacgtccaacaatttgtaaggatttcatttttgactccaataatcaaaacattaaactcttcgtcttcccctaaagccctacgctctaaatcagtagttgagcaaacctctttcacaatgagcagatccggccagcctccagatctcaaaaagtacatggacaagaagctccagattaagctgaatgcaaatcggttggttgttggtacacttcgcggatttgatcagtttatgaacctagtagttgacaacaccgttgaggtgaatggcaatgagaaaactgacataggcatggtggtgatcagaggaaatagcgttgttactgttgaagcacttgaacccgtaggccggatgcagtaattcaggtttttcgttccaaaacttggatttcactttctgtatctctttcacttattgtgtctaggctgctagcttcgggcttcatatgttacatgatcgagaattcgtaggaagttgttagattgatatccatggattctgttctttcttttcgctatcctttgatctattatcactttgacggaaacaaggctctccaagtaaacgaaagcatcaaaaccatcaaatatcagatgcctatgaatcttaaacttcttaaattcgtgtttaccaggattgtaagacaccatttcattattgagtgctaggttttccaccataataacttcattgttttcccgaactg

SEQ ID NO: 2699 - DNA, 502 bp, Elaeis guineensis
tggagaggggcaggggtcggagatccttctaaaaccctagactattcgtattctcttctctctcgaattccgccaccatgagtagatctggccagcctccggatctcaaaaagtacatggacaagaagcttcaaatcaagctgaatgcaaaccgggttgtggttggcactcttcgtggatttgaccaatttatgaacctggtgattgacaatactgtggaggtcaatggcaatgagaagaatgatattggaatggtggttatcagggggaacagtgtagtcatgatagaagctctggagccagtcagcaaaacgcagtagctgtcccttgctcgtagtctcgtgttttgaaccaaatggctgtcaagtatatggtttatgtactctaatgacccaatgactttgtagttcttttttttttttttgtattgctaaaatgacaaattttgctcgctggtatggaaagatggtcttgatctccttcgcttaaaaaaaaaaaaaaa

SEQ ID NO: 2700 - DNA, 517 bp, Elaeis guineensis
tctcgtgccgaattcggcacgagcggcacgagggagaggggcaggggtcggagatccttctaaaaccctagactattcgtattctcttctctctcgaattccgccaccatgagtagatctggccagcctccggatctcaaaaagtacatggacaagaagcttcaaatcaagctgaatgcaaaccgggttgtggttggcactcttcgtggatttgaccaatttatgaacctggtgattgacaatactgtggaggtcaatggcaatgagaagaatgatattggaatggtggttatcagggggaacagtgtagtcatgatagaagctctggagccagtcagcaaaacgcagtagctgtcccttgcttgtagtctcatgttttgaaccaaatggctgtcaagtatatggtttatgtactctaatgacccaatgactttgtagttcttttttttttttttgttattgtctaaattgtactaaattttgctcgctggtatggaaagatggtcttgatctcctt

SEQ ID NO: 2701 - DNA, 525 bp, Elaeis guineensis
gaggggcaggggtcggagatccttctaaaaccctagactattcgtattctcttctctctcgaattccgccaccatgagtagatctggccagcctccggatctcaaaaagtacatggacaagaagcttcaaatcaagctgaatgcaaaccgggttgtggttggcactcttcgtggatttgaccaatttatgaacctggtgattgacaatactgtggaggtcaatggcaatgagaagaatgatattggaatggtggttatcagggggaacagtgtagtcatgatagaagctctggagccagtcagcaaaacgcagtagctgtcccttgcttgtagtctcatgttttgaaccaaatggctgtcaagtatatggtttatgtactctaatgacccaatgactttgtagttcttttttttttttttttttgtattgctaaaatgacaaattttgctcgctggtatggaaagatggtcttgatctccttcgcttgatgtgaatgttcaatgagaattacaagtactcgtggt

SEQ ID NO: 2702 - DNA, 463 bp, Elaeis guineensis
ggagaggggcaggggtcggagatccttctaaaaccctagactattcgtattctcttctctctcgaattccgccaccatgagtagatctggccagcctccggatctcaaaaagtacatggacaagaagcttcaaatcaagctgaatgcaaaccgggttgtggttggcactcttcgtggatttgaccaatttatgaacctggtgattgacaatactgtggaggtcaatggcaatgagaagaatgatattggaatggtggttatcagggggaacagtgtagtcatgatagaagctctggagccagtcagcaaaacgcagtagctgtcccttgctcgtagtctcgtgttttgaaccaaatggctgtcaagtatatggtttatgtactctaatgacccaatgactttgtagttcttttttttttttgttagttgtctaaataagtacaaatttagttctcgtcgtggt

SEQ ID NO: 2703 - DNA, 472 bp, Elaeis guineensis
agcgggaataggtcggaggtaatttgaatccctagtcaatttgatcgaattcttttctctctcgaatcccgcgaccatgagtagatccggccagcctccggatcttaagaagtacatggacaagaagcttcagatcaagctgaacgctaaccgggttgtagttggtactcttcgtggatttgaccaatttatgaatctggtggttgacaatactgtagaggttatcggcaatgagaagaatgatattggaatggtggtcatcagggggaacagtgtagtcatgattgaagctctcgagccagttggcagaacttaataactgtccattgctcgtgcaatcatgtttggaccaaaaggctgtgaaatatatggttttatgtagactgttctggtctcttctctttctttttttttttttttcctgtattactttattgactaaaaataactaaattttattcaccattatgga

SEQ ID NO: 2704 - DNA, 851 bp, Papaver somniferum
aagcagcgcaaccattttgtctgttttttttttttttttggtttcagcattgggctagtttagttaaggcttacgctaaacgttggtaatatgataggcccattaaggaaaaatggtcttgagtatatataaaacgagcagtcgctgatagacatctcttttcttataacagtagtactcgagacacgcacaaactcagggtttttagggtttcgaaaacgaaatcgttcctctcaactcatcttctcctccgtcaccatgagtagatccggtcagcctccagatttgaaaaagtacatggacaagcagcttcaaattaagctgaatgctaaccgtgttgtggtcgggactcttcgtgggtttgaccagttcatgaatctcgtggtcgataatactgttgagatgaacggaaatgacaaaaacgacattggcatggtggtaatcagaggaaacagcgtggttatgattgaagctttggagcctgttagtaaagcacagtagttaatcagtagctttggttatgataaactgtatctataagcacacttgtcgtccgctagcaatttagcatgtagctctttgacactgacttctcactaatgatagctgctgcctgctgatgatgttcgatcaatgaacatactgatgcccaactccttactgctggttaattaagtttcaacatgtaattgagtaggtttatttcactaatgatcatgttgtgtcgggtcttacatcataatccacagtgggtaattaatcataatccatttccaatatcttattgtggtacttactcctgcattaggtgaccgcagctaatcaaagcttaagtggagaaaataaagtgg

SEQ ID NO: 2705 - DNA, 620 bp, Eutrema halophilum
ctagacttccaaaaaccgaaactttaggtttttttcgcaagtctctgtgcgcagtgcaaactcgttcttcttctggccgagaaactaaaaccctaagctcgatttcgattctgcaactatgagtcgttcaggtcagcctccggatctcaagaagtacatggataagaaactccaaatcaaacttaatgcaaaccggatggttgttggaactcttcgtggtttcgaccagttcatgaatctcgttgtggataacaccgtggaggtgaacggtaatgacaaaacagacattgggatggtggtgattagaggaaacagcattgtcaccgttgaagctcttgaaccagtgggtagatcttcttagctccggttatatgcatcagtaatcacctcttttgtactaaggactagtttttatgctctgtttgagaaactgggtggtagattcgctgttattatgaactgatccagtaagaagtcttcatgaatactctttcttgtactaaaagattgcgatgaaccccaaggaatgtgatggataggcgaatttcttttttatctttcttgagcattaatttggggaacttttgaaaatacctaacgttgttgtttctttgatgata

SEQ ID NO: 2706 - DNA, 681 bp, Antirrhinum majus
  misc_feature (36)..(36): n is a, c, g, or t
  misc_feature (53)..(54): n is a, c, g, or t
  misc_feature (566)..(567): n is a, c, g, or t
  misc_feature (570)..(570): n is a, c, g, or t
  misc_feature (572)..(572): n is a, c, g, or t
  misc_feature (575)..(575): n is a, c, g, or t
  misc_feature (577)..(577): n is a, c, g, or t
  misc_feature (579)..(582): n is a, c, g, or t
  misc_feature (592)..(592): n is a, c, g, or t
aaaaaaaaaaaagcgcgccgcgagatcaaattaatnaataattcattcagggnntttgaatagcgataaaccctaaccccttttctctctctctctctctctctgtaaaatctcggcatgagcagatcagggcaacctccggatcttaaaaagtacatggacaagaagctacaaataaagctgaatgccaaccgaatggtggttggaacccttcgtggttttgatcagtttatgaacctggtgattgacaataccgtcgaagtgaatggaaatgagaaaactgatatcggcatggtggtcatcaggggaaacagtgtggttaccgttgaagcacttgagccagttgccagaccacaatgatcctatgggttcaattacgaatcaaatctaatttgtatttttcggattctgttggatgctcaatttgtagtaatcgtaaatttcgtgactatgattagtgtcacctcttcaacttgacaagcatgctctctagatcaaatatatcgagaagtgctttgtggtttctccatttgggagtctaattcattcacataatttcatactanntantnttntntnnnntaatatactntgcgttggtaccactgcttcctagtgccgggaaatcgtgttctttacaattcctaaaagtacaatccggatcataaatgtatatctggg

SEQ ID NO: 2707 - DNA, 558 bp, Arabidopsis lyrata
aacatttgacttcaaaaaatcaaaactttagggtttcactgcaaactctttcttcttcaagccgagagcgaaaaccctaagtttaattccgattctgcaaccatgagtcggtcagggcagcctccggatctcaagaagtacatggataagaagctccaaatcaagcttaatgctaaccgaatggttactggaactcttcgtggttttgaccagtttatgaatcttgttgtggataacactgtcgaggtgaacggtaatgacaaaaccgacatcggtatggtggtgattagaggaaacagcattgtcactgttgaagctcttgaaccagtgggcagatcttcttagcttgttatatgcatcggtaatgatctttttttttgtactaagtactagcgatgagaaatcttggtggtagcttcgcagttacgatgaactgattcagtaagaagtcttcatgaatacttttttcttgtactaaaaagattgcaaatgaatcccaccgatgtgatggcttgtacttttactctggatacaaagcttaaacctctaatagtcatc

SEQ ID NO: 2708 - DNA, 559 bp, Arabidopsis thaliana
aacactagacttccaaaaatcaaaactttagggtttcagagcaaactctgtcttcttcaagccgagagcgaaaaccctaagctcaattccgattttgcaactatgagtcgttcaggtcagcctccggatcttaagaagtacatggataagaagctccaaatcaagcttaatgctaaccgaatggttactggaactcttcgtggatttgatcagttcatgaatcttgttgtggataacactgttgaggtgaacggtaacgacaaaaccgacatcgggatggtggtgattagaggaaacagcattgtcactgttgaagctcttgaaccagtgggcagatcttcttagctcgttatattcattggtaatgatctttttgtactaagcactagctatgagaaatcttggtggtagattcgcagttacgatgaattgattctgtaagaagtctacatgaatactcttttcttgtactaaaaagattgcaatgaacccccaccgatgaatgtgatggcttgtacttttcactcttgatacaatgctcaaacctctattagtcatc

SEQ ID NO: 2709 - DNA, 620 bp, Musa acuminata
gaccgacgtctagggtttactgttcccgagcggctgcaagtgtccttggagacccaccggttccttctcgcttctcatcaccatgagccgatcgggccaacccccggatctcaagaagtacatggacaagaagctacagataaaactgaatgcaaaccgggtcgtcgtgggtactctccgcggatttgaccaatttatgaaccttgttattgacaacacagtggaggtgaatggcaatgagaaaaatgatattggcatggtggttattcgaggaaacagtgtggccatgattgaagctcttgaaccagtcgccagaacgtaatcacatattttctcttcttcggattgatgcttgtaccagacatgttcttaatgaacgcttatgatatttgtaatgatttagctggagttcactgtctacattgtattcccttgatgcaaaacctggttaagccaatgtagcatgacattgtccttcctttaaatcttgtctttgtcagttggctgtaggatctctcaagtacctattgttaaactatttatagtatgacattctatttctgttggatgcctagtgggcagctaaaggtaaataataataataatttagaactgatcgt

SEQ ID NO: 2710 - DNA, 472 bp, Musa acuminata
gagggtttagggttctcgaggtgtcgagagataagtgcttggagacccaccgatccattcccctattcacgtcgcaatgagccgatcgggtcaaccgccagatctcaagaagtacatggacaagaagctacaaataaaattgaatggtaaccgagttgtggttggcactctccgtgggtttgatcaatttatgaaccttgttgttgacaatacagtggaggtgaatagcaatgagaagaacgatattggcatggtggtcattcgaggaaatagcgtggtcatgattgaagctctcgagccagtcgccagaacttaatatcacttcttttcttctgtcggttgacagttgtaccagatatgttcttgttgaatgcttatgggattgttaaatctgtcagaagtcagttaaatattatgtacgcttaatgcaaaaccaggttactacaatgtagcatgatattatcctaatgat

SEQ ID NO: 2711 - DNA, 765 bp, Gossypium hirsutum
agtggtatgattctcgtttcggatgcgaaagttcacgagttcgatcctcacaccacctcagttgtcattaatttttaattatctaatttattttttaatctcatttgaaattttcaaccgtgggccgcctcttgatcaacatcaggccctctacaatctcagaggctttcatttttagtctaggaatcacagctttcttcctcccctaaaccctattcccctctatttcgctctcccgctccgcagtagaccaacctcccgtcactatgagcagatcaggccagcctccagatctcaaaaagtacatggacaagaaactccagatcaagctgaatgcaaatcggatggttgttggtacgcttcgcgggtttgatcagtttatgaatctagtggttgacaacacagtagaggtgaatggcaatgagaaaactgacataggcatggtggtgatcagaggaaatagcgttgttactgttgaagcccttgaacctgttggcagaatgcagtgattctggtttttctattgatttatcactttgatgtatctcttggctttgttgtttcaatggcatcactgctagtttgggattgggaagttttatgtaattgagaatttattggaagttagatgggtctccatggaatctgcttttcgtttctcaactttacccgatggattgccctttgtgcatttcaaacggatttaattgaatgtagagaatggttactgcaatacttatttttagtgctcaggcctcattgaaa

SEQ ID NO: 2712 - DNA, 966 bp, Gossypium hirsutum
gttacatttgcaaaaaaaatctaaataaactccatcttcaattaaggtttagactctaataatattatatatgttgaaaatataattgatgcattaatgtaccatcaaataattttaataacattgaaaggtttaaaaaatattttaaaaataaatattaatcatactaattaaacataaataaattcaaaaacttattattaatttttgaaacgtataattttactcaagaaaatcaatggagggagacttgatgacgtccaacaatttgtaaggatttcaattttgactccaataatcaaaacattaaactcttcgtcttcccctaaaaccctacgctctaaatcagtagttgagcaaacctctttcacaatgagcagatccggccagcctccagatctcaaaaagtacatggacaagaagctccagattaagctgaatgcaaatcggttggttgttggtacacttcgcggatttgatcagtttatgaacctagtagttgacaacaccgttgaggtgaatggcaatgagaaaactgacataggcatggtggtgatcagaggaaatagcgttgttactgttgaagcacttgagcccgtaggccggatgcagtaattcaggtttttcgttccaaaacttggatttcactttctgtatctctttcactctttgtgtctagcctgctagcttcgggcttcatatgttacatgatcgagaattcgtaggaagttgttagattgatatccatggattctgttctttcttttcgctatcctttgatctattatcactttgacggaaacaaggctctccaagtaaacgaaagcatcaaaaccatcaaatatcagatgcctatgaatcttaaacttcttaaattcgtgtttaccaggattgtaagacaccatttcattattgagtgctaggttttccaccataataacttcattgttttcccgacctgcgcgg

SEQ ID NO: 2713 - DNA, 524 bp, Eschscholzia californica
gaaaaatagttttggccaagagaaacttgagttcgagagttagggtttggcggacatattcgtcacctttcattctctcaatcgtcttctcgtttctctctcaaaatgagcaggtcaggtcagcccccagatttgaagaagtacatggacaagcagcttcagattaagctgaacgctaatcgtgtggtggttggtactctacgtgggtttgaccagtttatgaatctggtggtggataacactgtagaaatgaatggcaatgagaagaacgacatagggatggtggttattcgtggaaacagtgtggttatgattgaagctctcgaacccgttcctagagctcagtagctacctttaacatcggccaacgatgtttgctgcactatatcgtccagaagttttttttttggaacatatcggtattagctttatagcagttttcatgaaacttttagctggtgtgttagcacagaagatttcttgtattaatatgatggttttagacttttactgatgaattggga

SEQ ID NO: 2714 - DNA, 677 bp, Vitis vinifera
cttgtattagtctcaaaatattcgaatctttttgcctcaagagcccatcatccatctggaccgtgattttcaccccctctcctcaaaagccaccttcgtcctctgattttctagggttttgaagaccgaaccacctcctccaaaaccccctttctcggtttctctctctcaacagctgtgaacatgagcagatcaggccagcctccggatctcaagaaatacatggataagaagcttcaaatcaagttgaatgcaaaccggatggtggttggaactcttcgtgggtttgaccagttcatgaacctggtggtggacaacactgtggaagtgaatggaaatgagaaaactgatataggcatggtggttattagaggaaatagtgtggttactgttgaagctcttgagccagtaagccggatgcagtgaattgatttttgtatcaatgcctaatgctgtatctacaggcatgttttccttatttggataatgtagtttgttgtaatgtgaaggaaaatgttctagttgtggatttaaaggtgggtgagtgaatgtttctacatttgtggattcaaaattctcagtagtttaatgaaatggagaatttatattggtattgacagaacatgatttacatatcttggttaacatgacatttatatgaagctgctcgatcttgc

SEQ ID NO: 2715 - DNA, 379 bp, Heritiera littoralis
tggtccatttacggccggggagggtttttaattttgcttccaataatctgaaagtcaaaagcttttattcctccccaaaccctaatcccatatctctcgctctctcactcggctgtcgacccaatttctgcaacatgagcagatccggccagcctccagatctcaaaaagtacatggacaagaaactccagatcaaactgaatgcaaatcggatggttgttggtacacttcgtgggtttgatcagtttatgaatctagtggttgacaacactgtggaggtgaatggcaatgagaaaactgacataggcatggtggtgatcagaggaaatagtgttgttaccgttgaagcccttgaacccgtaggcagaatgcagtaatt

SEQ ID NO: 2716 - DNA, 502 bp, Ipomoea batatas
tctttgtctgagacgaaaacgggaagcgcagcagcatgagtcggtcgggtcagcctccggatctcaaaaagtacatggacaagaaactccaaattaagttgaatgccaatcgcatggtagtcgggactcttcgtgggtttgatcagttcatgaatttggtcattgataacactgtggaggttaacggcaatgaaaagaatgacattggcatggtggttattcggggaaacagcgttgttactattgaagcattggagcccgttgccagatcgtagcgctagtagctgctgatgcagtcatcaccttgttaatttcatctatgtaccaatgctgctgctttgtggaagcattataggtctagtacttttattaggtttctaaatttctgaagcagaacaagttatcatataactgagctgaatttgattgctgttatgtactttggtggcaatggaatgtctcttgtattacaaacattgaatcatggtctgatattgtgaac

SEQ ID NO: 2717 - DNA, 584 bp, Actinidia deliciosa
cacactcgggatttggggcgtcggagcgcgctgtttctctctctagggttttacaccatgagcaggtcaggccagcctccggatctcaagaaatacatggacaagcagctgcagatcaagttgaatgcaaatcgaatggtggttggcacactccgtggtttcgaccagtttatgaatctggtggttgacaacactgtggaggtgaatggcaatgacaaaacggacataggcatggtggttatcagaggaaatagcgtggtcactgtcgaagctctggaaccagtaagccgaacacagtgattgctgtttgatcgttattggttgaatgtaagacattgctagcattactatcctagtaaaaccatgttcaactttttttgtgtgtgtgacgagtaaaaaaccagtttcagatgttttgtagagaagattaacttcatatgctcggttgtggaactagtctgacttgattgggatttggttatgtaactattgctagtttgtttgataagctcttgtgccttttaagagcttatgccttttacacttgaatggagaagcatgttttaaatttaaaaaaaaaaaaa

SEQ ID NO: 2718 - DNA, 659 bp, Avena sativa
ggcttttcggagaggcggctcgtccccttatttagggttcagggttcaagcggcggctacttcctcctcttctctcctcttctcaaggtttgggtctagtcgagtagagaggttctagatcttccgttggagagacgccatgagccgatcggggcagccgccggatttgaagaagtacatggacaaaaagctacagatcaagctgaacgcaaaccgtgttgtcattggtacgcttcgagggttcgaccagttcatgaatttggttgtggacaacactgtggaggtcaatggagatgaaaggaacgacatagggatggtggttctgagaggaaatagcgttgtgatgattgaagcccttgaaccaattgcgaaatctcagtgatatttcagcttacctacttctggtttggtacctgagctgatgtgttaagtcaaaactgatatgtatgcagtcagtcgtattttatgagaacttcgtcaatgtgtgagatttagcacctttgtataggctgactgtctttcgatgcttgtgctgctcactcaaagttaacagtgccgggattattccatgctatgatattccggtctagattgagcccaacttttggggtgctgtttttgtgtttgtcttttgatgaactgtcgctgaagcttcattc

SEQ ID NO: 2719 - DNA, 545 bp, Avena sativa
tcctcttctcgcctcttctcaaggtttgggttctagtcgagtagagaggttctagatcttccgttggggagtcgccatgagccgatcggggcagccgccggatctgaagaagtacatggacaaaaagctacagatcaagctgaatgcaaaccgtgttgtcattggcacgcttcgagggttcgatcagttcatgaatttagttgtggacaacactgtggaggtcaatggagatgaaaggaacgacatagggatggtggttctgagagggaatagcgttgtgatgattgaagcccttgaaccaattgcgaagtctcagtgatatttcagttgacctacttctggtttagtacctgagctgatgtgttaagtcaaaactgatgtgtatgcagtattgcagtcagtcgtattttatcaaaactttgtcaatgtgtgagatttagcatctttgtataggctgactgtctttcgatgcttgtgttgctcacttaaagttaatggtgcatggattattacatgctataacggtctatattgagcccttctct

SEQ ID NO: 2720 - DNA, 636 bp, Elaeis guineensis
  misc_feature (488)..(488): n is a, c, g, or t
  misc_feature (514)..(514): n is a, c, g, or t
  misc_feature (517)..(517): n is a, c, g, or t
tctcgtgccgaattcggcacgagcggcacgagggagaggggcaggggtcggagatccttctaaaaccctagactattcgtattctcttctctctcgaattccgccaccatgagtagatctggccagcctccggatctcaaaaagtacatggacaagaagcttcaaatcaagctgaatgcaaaccgggttgtggttggcactcttcgtggatttgaccaatttatgaacctggtgattgacaatactgtggaggtcaatggcaatgagaagaatgatattggaatggtggttatcagggggaacagtgtagtcatgatagaagctctggagccagtcagcaaaacgcagtagctgtcccttgcttgtagtctcatgttttgaaccaaatggctgtcaagtatatggtttatgtactctaatgacccaatgactttgtagtcttttttttttttttttggtattgctaaaatgacaaattttgctcgctngtatggaaagatggtcttgatctccntcncttgacgtgaatgttcaacgagaattacaagtactcgtggccttttccaatcacaccggccaacatcatttgtctcactttaaattacgctcataatgaatcaaactatgctacgcttt

SEQ ID NO: 2721 - DNA, 484 bp, Lippia dulcis
agggttttcgatttgagctgcaaccgaacatcgacagtaactgaattgcattctcgcgtcactctaagctttcgccatgagcagatcaggacagccgccggatctcaagaagtacatggataagaagctgcagatcaagcttaatgccaaccgtatggtagttggaacccttcgtggctttgatcagtttatgaacctggtggtggacaacaccgttgaagtgaatggagatgaaaagaccgatattggcatggtggtcatcaggggaaacagtgtggttaccgttgaagctcttgagccagtcgctagagcacaatgattgtacatgtctatgcatctgcgccttctagtttagcgttgcatctgtattttttttctcgtgttatgcggtgacaggtaatatcattgcgggagttttagattgataaaacatgacctcatctgtgccccagcttatgccctctaattctatgcagaattgctg

SEQ ID NO: 2722 - DNA, 457 bp, Ananas comosus
cagcggaggacgaaagctagggttttagcgagggagcggcgacacatctaatcaaacccctaacccatctcgatctatccctcatccgaccatgagccgatcggggcaacccccggatctcaagaagtacatggacaagaagttgcaaatcaaactgaatgcaaaccgtgttgttgttggggctcttcgtggttttgaccaatttatgaacttggtgatcgataacactgtggaggtcaacggcaatgagaagaacgaaattgggatggtggttatcaggggaaatagtgtggtcatgattgaagctctggagccggttgcgcgaacgcaatagcttcgttttcgatttgatgttgtgttcagaactcaactaatgtacaatgaaaacatatgctggtgctgttatgtaacttgatgaatcagtcaatttgctctgctctgttatttgcagttccac

SEQ ID NO: 2723 - DNA, 865 bp, Primula obconica
atttaaatcagacagtctaaccaaacaaaaccactcaatggaaatgaagatattaatcgtgtgttaaattgtaatttgtggctaaatactcactaaagtgcaattatcccaaaaataaataaaactgattttaagtgggcctatatctataacaggcattgattagggttttggctcagagtatttttcaatctctctctctctctttcatcatgagcaggtcaggccagcctccggatctcaaaaagtacatggacaagaagctacagattaagttgaacgcaaacaggactgtagttgggacgcttcgtggatttgatcaatttatgaatcttgtgattgacaacactgtggaggttaatggaaatgataaaactgacataggcatggtggtcattagaggaaacagtgtggtgactgtcgaggcacttgaaccagttccgagaacacagtgatggtttatggtattggtaaatcggaatgtaaaacttgtactttattctcttttgagggagcagatctgtgtgtactgaagtgtcgaatgtttggtctttagatcatttttcaggagttgattgaagaagtgtctacttttagaccgccttgtgtaaaattgatgcaaattgattgaagcattctccattactgttaatttccattatttttcacttgctcctatcttgtggcttactttgcagcccaaaaaaatgcaaatcaaatttttgattggttgcagtgagacttaaacctttaggtttccacttgctatagttcccatattaaataatgtgctcttttcatataaaaactgtagttgtagagctgtattacattatttagtactgtatattcaacgtgattgttg

SEQ ID NO: 2724 - DNA, 465 bp, Raphanus sativus
ggctctcgaatcaatcgagcgagttctgagctgagctgagctgagaaaaaccctaatctctcccttttccatcgtcttctccgatttctacaagcatgagtcgatcaggtcaacctccggatctcaaaaagtacatggacaagaagctccaaattaagctcaacgccaacagaatggtgattggaactctccgtgggtttgaccagttcatgaatcttgttgtggataatactgttgaagtcaatggtgatgacaaaactgacattggcatggtggtgataagaggaaacagcattgtcaccgttgaagctcttgaaccagttggaagatcttagttttttttattacactgcactatctgtaatgacttcctatattttgactctctgtattggaacttaattagtaaaactatcagctgaatcgatcatgaagaagtttgatatgatgaatttactcttcttt

SEQ ID NO: 2725 - DNA, 521 bp, Salvia sclarea
aggaattcggcacgaggtactcttaagttttgccatgagcagatcaggacagccgccggatctcaagaagtacatggataagaagctgcagatcaagcttaatgccaaccgtatggttgttggaacccttcgtggcttcgatcagtttatgaacctggtggtggacaacactgttgaagtgaatggaaatgaaaaaactgatattggcatggtggtgataagaggaaatagtgtggttactgttgaagctcttgagccagtgagtagagcacaatgattgtacatgtttatgcatcaacgccttccaatttggcgttgaatctgaaatttttcttatgttatgtggtgacatataacatgaattctgcagttgtagattgataaacagtatctcaattgtgcgcagctgagttatttgaaattttaaggatgtgaggcagctgacattagtagtaattacagactcaagtatgctaagagctaatatatactgtaatttggattaatggattttcttggga

SEQ ID NO: 2726 - DNA, 399 bp, Salvia sclarea
gcacgaggatttctagggttttgactagcgctaaacgcctaaaccctgaccggaatcctctctaggaactagccatgagcagatcgggacagccgccggatctcaagaagtacatggacaagaagctacagataaagcttaacgccaaccgcatggtggtcggaactctgcgtggtttcgatcagttcatgaacctggtggtggacaatactgtcgaggtgaatggaaatgagaaaactgacatcggcatggtggtaattcgaggtaacagcgtggttactgtcgaagctcttgagccggttagtagagcacaataaacttgtatattgcttgtgtatgcatccaatctgatctgtagtggcagctcatatggaatgctgtgactgtagttatttcaaa

SEQ ID NO: 2727 - DNA, 480 bp, Tabernaemontana elegans
ggaggaaattatactctgctccctccctcttcgtctctcccttagtcgtctcgtgtttcttgcactctagcgttcaccatgagtcgttcgggccagcctccagatctcaagaaatatatggacaagaagctacagattaagttgaacgccaatcgcatggtggttggaacactccgtggttttgatcagttcatgaacttggtggtggacaatacggtggaagttaatggcaatgaaaagactgacataggcatggtggttatcaggggaaatagtgtagtcactgttgaagcacttgaacctgttgggagaacacagtgattgtacatttctagtgccatgaattaaacgtaaatgtgatgtaatgttattttggacacatgctgtagtatggaatctaaggctgactaaaaccttctagtataatatttctgatgtttcttttcgtaatttctgtgtgggcagagatgaatcaatgat

SEQ ID NO: 2728 - DNA, 538 bp, Thellungiella halophila
gaaaactttaggtttttttcgcaagtctctgtgcgcagtgcaaactcgttcttcttctggccgagaaactaaaaccctaagctcgatttcgattctgcaactatgagtcgttcaggtcagcctccggatctcaagaagtacatggataagaaactccaaatcaaacttaatgcaaaccggatggttgttggaactcttcgtggtttcgaccagttcatgaatctcgttgtggataacaccgtggaggtgaacggtaatgacaaaacagacattgggatggtggtgattagaggaaacagcattgtcaccgttgaagctcttgaaccagtgggtagatcttcttagctccggttatatgcatcagtaatcacctcttttgtactaaggactagtttttatgctctgtttgagaaactgggtggtagattcgctgttattatgaactgatccagtaagaagtcttcatgaatactctttcttgtactaaaagattgcgatgaaccccaaggaatgtgatggataggcgaatttctttttt

SEQ ID NO: 2729 - DNA, 461 bp, Fagus grandifolia
tctctcgcactagttcactctcagagtcttcaacatgagcagagtcgggccaaccaccggatctcaagaaatatatggacaagaagctccagatcaagatgaatgacaaatcgtatggtcattggtactcttcggtgggtttgacctagtttatgaatctagtggttgacaacactgtagaagtgaatggcaatgagaagactgatattggcatggtggtgatcagaggaaatagtgtggtcaccgttgaggctctcgaaccagtaaacagatcatagtggtttcacaatgctgtcggttctatcataatttagggttattttggatggtatcaatatgataattgggaaggagacgttctgtaatctggattaggtggaccattctagacttctagtgctctattttctgttatttcccctttttcaagcagacttaatagtagtatagtctaatctgta

SEQ ID NO: 2730 - DNA, 588 bp, Papaver somniferum
gttcctcttcgtctctgtttatctgataaactgggttttagggtttcgaaatcgaagtcgttccactcaactcgtcttctcctctctcaccatgagtagatccggtcagcctccagatttgaagaaatacatggacaagcagcttcaaatcaagctaaatgctaaccgtgttgtggttgggactcttcgtgggtttgaccagttcatgaatcttgtggtcgataacactgttgagatgaacggaaatgacaaaaacgacataggcatggtggtaatcagaggaaacagcgtggttatgattgaagctttggagcctgttagtaaagcacagcagtagttacagttggatacaagtcctgtttgacgcccttatctatgggagtatgttctctggattatatatctactaggacttttgtgaaccaattgtgtttagtttttcagcatgaacataaaacgctgatcggctaatgtaatgaaactaaagatttttttttttgtagcatgatactccctccgtcccactcctaagtgacctatttgaaatttgcacaatttttaaggcaagcaagtaaaatattactttta

SEQ ID NO: 2731 - DNA, 652 bp, Papaver somniferum
ttttttttttaatacactagtagtactcgagacacgcacaaactgagggtttttagggtttcgaaaacgaaatcgttcctctcaactcatcttctcctccgtcaccatgagtagatccggtcagcctccagatttgaaaaagtacatggacaagcagcttcaaatcaagctgaatgctaaccgtgttgtggttgggactcttcgtgggtttgaccagttcatgaatctcgtggtcgacaacaccgttgagatgaatggaaatgacaaaaacgacattggcatggtggtaatcagaggaaacagcgtggttatgattgaagctttggagcctgttagtaaagcacagcagtagttaattaagggattgtatctatagcgtgcttgtcgtccgctagcaatttagcatgtagctctttgacactgacttctcactaatgatagctgctgcctgctgatgatgtttgatcaatgaacatattgatacctaactccttagtccttactgctggttaattaagttttcaacatgtaattgattaggtttatttcactaatgatcatgttgtgtcgggtcttacatcctttctcaaagcgggatatcgactttgaacacttaatttacttatccatggtgggtaactaatcgtattcc

SEQ ID NO: 2732 - DNA, 692 bp, Zostera marina
caggggtctatttaatatccccttaaaagacaaatccctcaaattaaaacccatcggccatctcagaatcgtctcaacagttaaccctacttggctatttctccgtcggcggcccaaatcggaagttttccatttctttagatcttcttgcttagacgctacttcctcgcaatctctctcattcgctatgagcaggtcgggtcagcctccagatctcaagaaatatatggacaagaaactccagatcaagctgaatgccaacagagttgtggttggaactctgaggggttttgatcaattcatgaatcttgtggttgataacacagaggagataaatggcaatgagaagaacaatattgggatggtggtcattaggggaaacagcgttgttatgatcgaagcccttgagccagtccagaggagtcagcagtagtagctgttgataattccctagctatttttataaaaaaattacattaaccatgacgatgatacctgactcttatgtttctctttatcattaaatgctgctgtcattttttctattatagtttagaatgtttttacctttttatcacaattcgaatgcgagtgtcttttgaaccattctatcatagtttagaatgtcacaggctcacaatgtgtgatggatacctaggtatttctgttggtattagtgtagacatggtgtt

SEQ ID NO: 2733 - DNA, 545 bp, Brassica rapa
attttctctccgcaatagaattgagcaagttacttccgatctgagagaaaaccctaatctctctccgtctccgtcttctctgattccgcaagtatgagtcgatcaggccagcctccagatctcaagaagtacatggacaagaaactccaaattaagcttaatgccaacagaacggtagttggaactctccgtgggtttgaccagttcatgaatcttgttgtggataacaccgttgaagtcaatggtgatgacaaaactgacattggcatggtggtgataagaggaaacagcattgtcactgttgaagctcttgagccagttggaagatcttagcttttttattacttttgcaccaccagtttccgtattttgacttgagtttactctctgtattggaacttaattagtatctatcagcatgaatcttaaagaagtttgatatgatgaatttattcctcttttttgttctgaggatttctttgaatctgctgtgaggggcagtctgataatgaactataccagattaaagggctctctctaggtcg

SEQ ID NO: 2734 - DNA, 570 bp, Brassica rapa
tgcttattctctctctctggaatcattcgagttcgttccgagctgagctgagctgagaaaaaccctaatctctcctccttttccatcgtcttctccgattctgcaagcatgagtcgatcaggtcaacctccggatctcaagaagtacatggacaagaagctccaaattaagctgaatgccaacagaatggtggttggaactctccgtgggtttgaccagttcatgaatcttgttgtggataacactgttgaagtcaatggtgatgacaaaactgacattggcatggtggtgataagaggaaacagcattgtcaccgttgaagcgcttgaaccagttggaagatcttagctttcttattactttgcactatccgtcaccatcttctgtattttgactctctgtattgaaacttaattagtagactatcaacatgaatctacctcgaccaagtttgatatgatgatgaattcctcttctttgtttactcttgtgttctgaagtttctctctactgtttttgtaattactatccttgagttatgaactgtggcaggttaaacgggtctctcta

SEQ ID NO: 2735 - DNA, 648 bp, Brassica rapa
aaatctttagggtttctctaaagtctctgtgccgcactgcaaacttcttcttctagtcgagtacgaaaacctaaaccccaagctcaaattcggattttgcagctatgagtcggtcaggtcaacctccggatctcaagaagtacatggacaagaaactccaaatcaagcttaatgctaaccgaatggttgttggaactcttcgtgggtttgaccagttcatgaatcttgtcgttgacaacactgttgaggtgaacggtgatgacaaaaccgacattggaatggtggtgataagggggaacagcattgtcaccgtggaagctcttgaaccagtgggcagatcttcttagctccgtatatgcatccagttaatcatctctttgttctaatcacttagttttttttttcttattctctgtttgataacacttggtggtagattctgaactgatcagtaagaagtctacatgattactctttcttgtactaaaatgattggaatgagcccccaagaatgtgatgaatatgcagatttttttcgttctatttgtgtgtttatcctagattcattgctttctttctcaaacaagagatttatggaacttttagaaaatacataattgttgaggtttattgatgaaaatatcataa

SEQ ID NO: 2736 - DNA, 432 bp, Brassica rapa
aagttacttccgatctgagagaaaaccctaatctctctccgtctccgtcttctctgattccgcaagtatgagtcgatcaggccagcctccagatctcaagaagtacatggacaagaaactccaaattaagcttaatgccaacagaacggtagttggaactctccgtgggtttgaccagttcatgaatcttgttgtggataacaccgttgaagtcaatggtgatgacaaaactgacattggcatggtggtgataagaggaaacagcattgtcactgttgaagctcttgagccagttggaagatcttagcttttttattacttttgcaccaccagtttccgtattttgacttgagtttactctctgtattggaacttaattagtatctatcagcatgaatcttaaagaagtttgatatgatgaatttattcctc

SEQ ID NO: 2737 - DNA, 726 bp, Cannabis sativa
cacacaaccatttctcaaaaaccctaaaactctcctttgccatcacactcttccgcatcgtctcctgctccctccctgtgctctccacaacgtaatcgggttttgctgctactcgctttctatctctaacaaatttaccgattaaagaatgagtaggtcagggcagccaccggatcttaaaaaatacatggacaagaagcttcagatcaagttgaatgccaatcgcatggttgttgggactcttcgggggttcgatcagttcatgaatctagttgttgacaacactgtggaagtaaatggaaatgagaacaatgatataggcatggtggttattaggggaaatagtgtggtcactgttgaagctcttgaacctgttgccagagcacagtgaggtgtgtttttgtagttggtactagtaactatatgaattcttggctggtattagtttggacatataactgttgttatgggaagaaaaatgttttgtaattttggatttgatgttaattagttaggttcgttatacaactactcctttcccatttccagcatttatcctggtattgtactttgaatcagatgaactagctgtgaattcttacttggcttgtctccaatcacaatctctaaatgtaattgatgttttcttaaacgagctttgtttcaaagcactcttaagtttacttctccaatttaatatttattctgagtcaaattattctagat

SEQ ID NO: 2738 - DNA, 749 bp, Gossypium hirsutum
atttcttttagtcatatattttacgaacctaaaaatccaatttcatttgcctcctcccataaccctactctcctctcttccaaaccaaatttctgacgcaatgagcagatccggccaacctccagatctcaaaaagtacatggacaaacaactccagatcaagctgaatgctaatcggatggttgttggtacacttcgtgggtttgatcagtttatgaatctagtggttgacaacaccgtggaggtgaatggcaatgagaaaactgatataggcatggtggttatcagaggaaatagcgttgttactgttgaagcacttgaacctgtaggcagaatgcagtgattcggttttttctactggaaattccggaatcacttgatggtatctggtggttggataacatagatgctggcctcctagtttgtgatggactattaaatttaattaagaactcataggaactttagactgttattggtggattctgctccttttccttctctgtaccggattgattgcccttgagcattccgaatagggttttaattgaatgtagagaagggtagtaacagtgaatacttaccatcttaaatgctcaggtctagattgaaacttatggtgcatatgttaaagcttgtttctattccttgatgtgttttaatgcatccattgccgtagtttgatagcaccgtcctatctttgagcaatcgaaccatgattctgagcctcaactaccccagctcttaaa

SEQ ID NO: 2739 - DNA, 1175 bp, Gossypium raimondii
catggacaggtctattctcgcggtaccccctttccatttctttttattttcttaacatttcttttagtcatatattttacgaacctaaaaatccaatttcatttgcctcctcccataaccctactctcctctcttccaaaccaaatttctgacgcaatgagcagatccggccaacctccagatctcaaaaagtacatggacaaacaactccagatcaagctgaatgctaatcggatggttgttggtacacttcgtgggtttgatcagtttatgaatctagtggttgacaacaccgtggaggtgaatggcaatgagaaaactgatataggcatggtggttatcagaggaaatagcgttgttactgttgaagcacttgaacctgtaggcagaatgcagtgattcggttttttctactggaaattccggaatcacttgatggtatctggtggttggataacatagatgctggcctcctagtttgtgatggactattaaatttaattaagaactcataggaactttagactgttattggtggattctgctccttttccttctctgtaccggattgattgcccttgagcattccgaatagggttttaattgaatgtagagaagggtagtaacagtgaatacttaccatcttaaatgctcaggtctagagtgaaacttatggtgcatatgttaaagcttgtttctattccttgatgtgtttcaatgcatccattgccgtagtttgatagctccgtcctatctttgagcaatcgaaccatgattctgagcctcaactaccccagctcttaaaagaactaaatcagccttttattatggatccttaccctagatggaactggtttggagatatcaaaagtgagtggaggatcatagtactgaatgacaaatgagtattcatcatcactgtatgatttctcaacgaaaaggatatttctttgatgcccaatcattgcttgtatttcaagtctcaattccaaaaattctaagctaccgataccaaaccccaaaagcataaccgacgaagcaaaccgaaaacctgattgtccacatctagcaagccaaaacgcccaacaccaaataccagtgaaatgtggtttttcttctactatatccctaaattttttcctcttttcaaaaaattccaaaagaaataatgtgcc

SEQ ID NO: 2740 - DNA, 646 bp, Elaeis guineensis
gttcaggtaagaacctgagcggactcgaggggtgctgccccccccccccgcctctatattagggatgtgagctggttagcgccgagttttgctagggtttaggtacagtgagagagaggtcggagatctttccgaaacgttagacgattccagctccttgctctctgaaatcccgccgacatgagtagatctggccagcctcctgatctcaagaagtatatggacaagaagcttcagatcaagctgaatgcaaaccgggttgttgttggcacgctccgtggatttgaccaattcatgaatctggtggttgacaatactgtggaggttaatggcagtgagaagaatgatattgggatggtggttatcaggggaaatagtgtggtcatgattgaagcattggagccagtcagcaaaacataataactgcgtattgctaatggttccatattttgaaccaaatggccgaggaatttacggtttatgtactttaatgacttgatgactgttgtcttgtctatttctattctgtatatttatgctaaaatgatctaaattttactcattgatatggaaagatggaattgctgtcgatgactagatgcttgtgaatgtttgatcagagtttttgaaaactaaatgaatggat

SEQ ID NO: 2741 - DNA, 423 bp, Plantago ovata
ctcagtcgccgagtagtaccagttaaaacccagatatcaattcacctcacctcaaagagtttgcaactcaacatgagcagatcaggtcagcctccggatttgaagaagtacatggacaagaagttgcagataaagctaaatgccaacagaatggtggttggaactcttcgaggtttcgaccagtttatgaacttggtcattgacaacactgttgaggttaatgggaatgagaagacagacattggcatggtggtcatcagaggaaatagtgtggtaacggttgaagctcttgagcctgttcaaagagcacaatgaatgtaatgtattggttctactaaattcttgacttgttaattaatttggtctgttgtttatatactatgtgaccttgctagatcatactttattataatagactcatct

SEQ ID NO: 2742 - DNA, 496 bp, Eutrema parvulum
ttccgaaaaatcaaatctttagggtttcttcaagtctctgtgcgcagtgcaaactacttcttcttcttcttctcctagccgatagcgaaaacctaaacgctaatctttgttctgattctgcaactatgagtcggtcaggtcagcctccggatctcaagaagtacatggacaagaaactccaaatcaagctcaatgcaaaccgaatggttgtgggaactctccgtgggtttgaccaattcatgaatcttgttgtggataacactgtggaggtgaacggtgatgacaaaacagacattgggatggtggtgatcagaggaaacagcattgtcaccgtagaagctcttgaaccagtgggcagatcttcttagctcggtatatgcatcagtaacgtcatctccttgtactaagcactagttttttatcctctgtttgagaaaacttggtggtagattcgtagttgttatgaattgatcagtaagacttctgcatgaatatg

SEQ ID NO: 2743 - DNA, 759 bp, Gossypium hirsutum
agtggtatgattctcgtttcggatgcgaaagttcacgagttcgatcctcacaccacctcagttgtcattaatttttaattatctaatttattttttaatctcatttgaaattttcaaccgtgggccgcctcttgatcaacatcaggccctctacaatctcagaggctttcatttttagtctaggaatcacagctttcttcctcccctaaaccctattcccctctatttcgctctaccgctccgctgtagaccaacctcccgtcactatgagcagatcaggccagcctccagatctcaaaaagtacatggacaagaaactccagatcaagctgaatgcaaatcggatggttgttggtacgcttcgcgggtttgatcagtttatgaatctagtggttgacaacacagtagaggtgaatggcaatgagaaaactgacataggcatggtggtgatcagaggaaattgcgttgttactgttgaagcccttgaacctgttggcagaatgcagtgattctggtttttctattgatttatcactttgatgtatctcttggctttgttgtttcaatggcatcactgctagtttgggattgggaagttttatgtaattgagaatttattggcagttagatgggtctccatggaatctgcttttcgtttctcaactttacccgatggattgccctttgtgcatttcaaacggatttaattgaatgtagagaatggttactgcaatacttatttttagtgctcaggcctca

SEQ ID NO: 2744 - DNA, 542 bp, Amsonia hubrichtii
gtttctccctcaatcgtctcctctgagagtaaatattccttctcgctaggtttcgccatgagtcgatcgggccagcctccagatctcaagaaatatatggacaagaagctacagattaagttgaatgccaatcgcatggtggttggaacgcttcgtggtttcgatcagttcatgaacctggtggtggacaatactgtggaagttaatggcaatgaaaagaatgacataggcatggtggttatcaggggaaacagtgtagtcactgttgaagcactcgaacctgttgggagaacacagtgattgtacatttttagtgctatggattagtgtaacattttgatggaatgttattttggacagagatgctgtctattttagtgtattgatttctgatgtttcttaatgtctgtgagcggagatgaatcagtgatgatatttcatgcttttgaaggcgtttgttgtcatgcgatcgagcctttaaatgccccattcgagtttaaaatgtgcccttgtagatgtattttaaaatcccaaaactcttt

SEQ ID NO: 2745 - DNA, 532 bp, Antirrhinum majus
  misc_feature (23)..(23): n is a, c, g, or t
tttagaatttgagctaaacccanaacttctctctcttctctctctctctctaagatttcgccatgagcagatcaggacagcctccggatctcaagaagtatatggacaagaaattacagataaagctgaatgccaatcgtatggtagttggaacccttcgtggatttgatcagttcatgaacctggtgattgacaacactgtcgaagtgaatggaaatgagaaaactgacattggcatggtggtcatcaggggaaacagcgtggtcaccgtcgaagctcttgagccagttccgagaccccaatgattgtaaatgtgttgtgtatgtattgcagtttaatttgtactagcagattctcttataagctcaacttgcagtattttcaacagttggagaatggatttatgcttcctctctaaattgatgagcttccttggttgatcgaatgtacaactctatggttttgaaatgtggttggggccatcttgccaatttgattttcttatggagtaaagtttttataagttttcaat

SEQ ID NO: 2746 - DNA, 531 bp, Arabidopsis lyrata
ctggaatcaatcgagtaaagtgttcatagctgagaagaaagaaaaaaaaccctaagctctcgtttttcgtcttctccgattctgcaagtatgagtcgatctggtcagcctccggatctcaagaagtacatggacaagaaactccaaattaagcttaatgccaaccgaatggttgttggaactctccgtgggtttgatcagttcatgaatcttgttgtggataacactgttgaagtcaatggtgatgacaaaactgacattgggatggtggttataagaggtaacagcattgtcaccgttgaagctctcgaaccagttggaagatcttagcttatgactttgcaccctcaagtaatcatcttctgtaatatgagtttgacttagtttgctctctgtaccggcatgaatcgaacttgagttttatttgatgaaatcctcttctttggctcattttacccgtgttcggtcctgcttatgctctattgatttttctgaacccttgattagatggcaacaaaccaatctggatact

SEQ ID NO: 2747 - DNA, 590 bp, Arabidopsis thaliana
actctagttttgcagaccgacgtcattttttttctttctctttcgctctggagactggaatcaatcgagtaaagtgttcgtagctgagaaaaaccctaagctctcgtttttcgtcttctccgattctgcaagtatgagtcgatcaggtcagcctccagatctcaagaagtacatggacaagaaactccaaattaagcttaatgccaacagaatggttgttggaactctccgtggctttgatcagttcatgaatcttgttgtggataacactgttgaagtcaatggtgatgacaaaactgacattgggatggtggtgataagaggaaacagcattgttactgttgaagctctcgaaccagttggaagatcttagcttatgacttttcacccccaagtaatcatcttctgtaatatgagactttgacttactttgctctctgtaccggcatgaatcaatcttgattttatttgatgaattcctcttctttggctcctctacttatgtcattttacccttgttcggtcctgtttgttccctatagatttttctgaacccttgatttgatggatacaaggaaatttggatactt

SEQ ID NO: 2748 - DNA, 755 bp, Aristolochia fimbriata
atgtacaggtggctgtcgggagggaaatccagaggtttagggtttagagcgaagcaagcgttggcggtcgctgccgcgggagtttcactttattcttcgttaatctcgcggctgtttttgttgttttcgcgccatgagcagatcagggcagcctccggatctcaagaagtacatggacaagaagcttcagattaagcttaatgcaaacagggttgtcgttggcaccttaagaggatttgatcaattcatgaatctggtgattgacaacacacttgagataaatggaaatgagaaaaatgacatagggatggtggtcatccgaggaaacagcgttgtcatgatagaagcccttgaacctgtcggtagaacacagtagttgttcctgttcacagattaattggacaatatccgattgtaccatctacaaaaactattatgtattttaagtcgtgggagaaactatggcctttgtgtctttacgttgtgaccccgtagcaatttctggcatgtctccgcgaatgtttatattaatgtagtgcgagaaaaggcatatttgtatatgttggaggtcatccaagttgaggggcaataatctctactgccctcctgaatgcattagatcgcggtactgtagattctcgagcgagacattcttacatggtcgtgcccaggtttcggactctggatggatgaggtacgttaaaatggcctcaaacgtaacatatatgataaatacattctgtttcttgctttaa

SEQ ID NO: 2749 - DNA, 456 bp, Brassica juncea
attctctctctctggaatcattcgagttcgttccgagctgagctgagctgagaaaaaccctaatctctcctccttttccatcgtcttctccgattctgcaagcatgagtcgatcaggtcaacctccggatctcaagaagtacatggacaagaagctccaaattaagctgaatgccaacagaatggtggttggaactctccgtgggtttgaccagttcatgaatcttgtggtggataacactgttgaagtcaatggtgatgacaaaactgacattggcatggtggtgataagaggaaacagcattgtcaccgttgaagcgcttgaaccagttggaagatcttagctttcttattactttgcactatccgtcaccatcttctgtattttgactctctgtattgaaacttaattagtagactatcaacatgaatctacctcgaccaagtttgatatgat

SEQ ID NO: 2750 - DNA, 622 bp, Brassica juncea
agtctctgtgccgcaccgcaaacttcttctacgaaaacctaaacaccaagctcaattcggattctacagctatgagtcggtcaggtcagcctccggatctcaagaagtacatggacaaaaaactccaaatcaagcttaatgctaaccgaatggttgttggaactcttcgtgggtttgaccagttcatgaatcttgttgttgacaacaccgttgaggtgaacggtgatgataaaaccgacattggcatggtggtgataagaggaaacagcattgtgaccgtggaagctcttgaaccagtgggcagatcttcttagctttggtatatgcaatcatctatttgtagtaagcactagttcttttgttattctctgtttgagaacacttgatggttgattggcagttattgtgaactggtcagtaagaagtcttcaggattactctttcttgtgctaaaagattgcgatgaacccccaaagaatgtgatggatagacgggatttcatatatttttctgtgtttatttatcctagtttcattgcttcttctatctctaacaagttacttgggaaacataattgcttttatggataaatgcctaaacatatgtagcagttttataaaat

SEQ ID NO: 2751 - DNA, 704 bp, Brassica juncea
agggtttctctagagtctctgtgccgcaccgcaaacttcttctacgaaaacctaaacaccaagctcaattcggattctacagctatgagtcggtcaggtcagcctccggatctcaagaagtacatggacaagaaactccaaatcaagctcaatgctaaccgaatggtcgtcggaactcttcgtgggtttgaccagttcatgaatcttgttgttgacaacaccgttgaggtgaacggtgatgataaaaccgacattggcatggtggtgataagaggaaacagcattgtgaccgtggaagctcttgaaccagtgggcagatcttcttagctttggtatatgcaatcatctatttgtagtaagcactagttcttttgttattctctgtttgagaacacttgatggttgattggcagttattgtgaactggtcagtaagaagtcttcaggattactctttcttgtgctaaaagattgcgatgaacccccaaagaatgtgatggatagacgggatttcatatatttttctgtgtttatttatcctagtttcattgcttcttctatctctaacaagttacttgggaaacataattgcttttatggataaatgcctaaacatatgtagcagttttataaaatacttaaacatcatgaccaagttctacattatttcattgagttatgagttacttaggttatgacaggaaa

SEQ ID NO: 2752 - DNA, 401 bp, Brassica juncea
ctccttttccatcgtcttctccgattctgcaagcatgagtcgatcaggtcaacctccggatctcaagaagtacatggacaagaagctccaaattaagctgaatgccaacagaatggtggttggaactctccgtgggtttgaccagttcatgaatcttgtggtggataacactgttgaagtcaatggtgatgacaaaactgacattggcatggtggtgataagaggaaacagcattgtcaccgttgaagcgcttgaaccagttggaagatcttagctttcttattactttgcactatccgtcaccatcttctgtattttgactctctgtattgaaacttaattagtagactatcaacatgaatctacctcgaccaagtttgatatgatgatgaattcctctt

SEQ ID NO: 2753 - DNA, 596 bp, Brassica juncea
gaacaacgcagagcacgcgggggcttattctctctctctggaatcattcgagttcgttccgagctgagaaaaaccctaatctcttctccttttccatcgtcttctccgattctgcaagcatgagtcgatcaggtcaacctccggatctcaagaagtacatggacaagaagctccaaatcaagctgaatgctaaccgaatggtggttggaactctccgtgggtttgaccagttcatgaatcttgttgtggataacactgttgaagtcaatggtgatgacaaaactgacattggcatggtggtgataagaggaaacagcattgtcaccgttgaagcgcttgaaccagttggaagatcttagctttcttattactttgcactatccgtcaccatcttctgtattttgactctctgtattgaaacttaattagtagactatcaacatgaatctacctcgaccaagtttgatatgatgatgaattcctcttctttgtttactcttgtgttctgaagtttctctctactgtttttgtaattactatccttgagttatgaactgtggcaggttaaacgggtctctctactgtttttgtaatta

SEQ ID NO: 2754 - DNA, 483 bp, Brassica juncea
aaaaaccctaatccctccttttccatcgtcttctccgattcttcaagcatgagtcgatcaggccagcctccggatctcaagaagtacatggacaagaagctccaaattaagctgaatgccaacagaatggtggttggaactctccgtgggtttgaccagttcatgaatcttgttgtggataacactgttgaagtcaatggtgatgacaaaactgacattggcatggtggtgataagaggaaacagcattgtcaccgttgaagctcttgaaccggttggaagatcgtagcttccattacttcgcactatccgtaaaccatcttctgtattttgactctctgtatcggaacttaattagtagactatccacatgaatcaatctcgacgaagtttgatgtattactcttctttttgaacctgttagatggttataaagtcattctcttggctgtttttgtaaccgatatcctttttttatacattg

SEQ ID NO: 2755 - DNA, 518 bp, Brassica oleracea
ccgagctgagctgaggaaaaccctaatctctccttttccatcgtcttccccgattctgcaagaatgagtcgatcaggtcagcctccggatctcaagaagtacatggacaagaagctccaaattaagctgaatgccaacagaatggtggttggaactctccgtgggtttgaccagttcatgaatcttgtggtggataacactgttgaagtcaatggtgatgacaaaactgacattggcatggtggtgataagaggaaacagcattgtcaccgttgaagcccttgaaccagttggaagatcttagcttctttttttttttttactttgcactatcggtaaccatctactgtatcttgactctctgtattggaacttaattagtagactatcaacatgaatctactacctcgaccaagttcctcttctttgtttactcttatgttctgaagtttctctctactgtttttgtaattactatccttgagttatgaattttgcctggttaaacgggtctctcta

SEQ ID NO: 2756 - DNA, 413 bp, Brassica oleracea
aatcgaattgagtgagaaaccctaatctctctccgtctccgtcttctccgattctgcaagtatgagccgatcaggccagcctccggatctcaagaagtacatggacaagaaactccaaattaagcttaatgcaaacagaatggtagttggaactctccgtgggtttgaccagttcatgaatcttgtcgtcgataacaccgttgaagttaatggtgatgacaaaactgacattggcatggtggtgataagaggaaacagcattgtcactgttgaagctcttgaaccagttggaagatcttagcttttttttattactttgcacgaccagtttctgtattttgacttgagtttactctctgtattggaacttaattagtagaccatcttatcaccatgaattgatgatcttaaag

SEQ ID NO: 2757 - DNA, 650 bp, Brassica oleracea
  misc_feature (607)..(607): n is a, c, g, or t
gctctaaagtctctgtgccgcattgcaaacttcttgttcttctagtcgagtacgaaaacctaaacctcaagctcaaattcggattctgcagctatgagtcggtcaggtcagcctccggatctcaagaagtacatggacaagaaactccaaatcaagcttaatgctaacagaatggttgttggaactctccgtgggtttgatcagttcatgaatcttgttgttgacaacactgttgaggtgaacggtgatgacaaaaccgacattggaatggtggtgataagaggaaacagcattgtcactgtggaagctcttgaacctgtgggcagatcttcttagcttttggtatatgcttccagtaatcatctctttgtactaagctctagttttttattcctctttgagaaaacttggtgttagtcgtagttattgtgaactggtcagtaagaagtcttcattattactctttcttgtactaaaagattgccaagaaccccaagaatgtgatcgatagacgggacatatactttcgtgtgtctatttatcctagattccttgcttcttctatctcaaacaagtgacttgggaacttaggaaaatacataattgntgtgttcttttttggataaatgcataaacatgtgtagctgttt

SEQ ID NO: 2758 - DNA, 427 bp, Brassica rapa
  misc_feature (426)..(426): n is a, c, g, or t
gcttctagtcgagtacgaagacctaaaccccaagctcaaattcggattctgcagctatgagtcggtcaggtcagcctccggatctcaagaaatacatggacaagaaactccaaatcaagcttaatgctaatcgaatggttgtcggaaccctccgtgggtttgaccagttcatgaatcttgttgttgataatactgttgaggtgaacggtgatgacaaaaccgacattggaatggtggtgataagaggaaacagcattgtcaccgtggaagctcttgaaccagtgggcagatcttcttagctccgtatatgcttccagtaatcatctctttgtactaagcacttagtttacatgattactctttcttgtactaaaatgattggagtgagcccccaagaatgtgatgaatatgcagatttttttcgtnc

SEQ ID NO: 2759 - DNA, 449 bp, Brassica rapa
  misc_feature (5)..(5): n is a, c, g, or t
ggagnaagttacttccgatctgagagaaaaccctaatctctctccgtctccgtcttcgtcttctctgattccgcaagtatgagtcgatcaggccagcctccagatctcaagaagtacatggacaagaaactccaaattaagcttaatgccaacagaacggtagttggaactctccgtgggtttgaccagttcatgaatcttgttgtggataacaccgttgaagttaatggtgatgacaaaactgacattggcatggtggtgataagaggaaacagcattgtcacagttgaagctcttgagccagttggaagatcttagctttttattacttttgcaccaccagtttccgtattttgacttgagtttactctctgtattggaacttaattagtatctatcagcatgaatcttaaagaagtttgatatgatgaatttattcctcttttttg

SEQ ID NO: 2760 - DNA, 503 bp, Brassica napus
gctgagaaaaaccctaatctcttctccttttccatcgtcttctccgattctgcaagcatgagtcgatcaggtcaacctccggatctcaagaagtacatggacaagaagctccaaattaagctgaatgccaacagaatggtggttggaactctccgtgggtttgaccagttcatgaatcttgtggtggataacactgttgaagtcaatggtgatgacaaaactgacattggcatggtggtgataagaggaaacagcattgtcaccgttgaagcgcttgaaccagttggaagatcttagctttcttattactttgcactatccgtcaccatcttctgtattttgactctctgtattgaaacttaattagtagactatcaacatgaatctacctcgaccaagtttgatatgatgatgaattcctcttctttgtttactcttgtgttctgaagtttctctctactgtttttgtaattactatccttgagttatgaactgtggcaggt

SEQ ID NO: 2761 - DNA, 497 bp, Brassica napus
acggaatccatgggtcgaaaacgcgtccgcggacgctccgcggccctaatctctccttttccatcgtcttccccgattctgcaagaatgagtcgatcaggtcagcctccggatctcaagaagtacatggacaagaagctccaaattaagctgaatgccaacagaatggttgttggaactctccgtgggtttgaccagttcatgaatcttgtggtggataacactgttgaagtcaatggtgatgacaaaactgacattggcatggtggtgataagaggaaacagcattgtcaccgttgaagctcttgaaccagttggaagatcttagcttctttttttcttactttgcactatcggtaaccatctactgtatcttgactctctgtattggaacttaattagtagactatcaacatgaatctactacctcgaccaagttcctcttctttgtttactcttatgttctgaagtttctctctactgtttttgtaattactat

SEQ ID NO: 2762 - DNA, 613 bp, Brassica napus
ccttggaaagtctctgtgccgcactgcaaacttcttcttctagtcgagtacgaagacctaaaccccaagctcaaattcggattttgcagctatgagtcggtcaggtcagcctccggatctcaagaagtacatggacaagaaactccaaatcaagcttaatgctaaccgaatggttgttggaactcttcgtgggtttgaccagttcatgaatcttgtcgttgacaacactgttgaggtgaacggtgatgacaaaaccgacattggaatggtggtgataagggggaacagcattgtcaccgtggaagctcttgaaccagtgggcagatcttcttagctctccgtatatgcatccagttaatcatctctttgttctaatcacttagttttttttttctattctctgtttgataacacttggtggtagattctgaactgatcagtaagaagtctacatgattactctttcttgtactaaaatgattggaatgagcccccaagaatgtgatgaatatgcagatttttttcgttctatttgtgtgtttatcctagattcattgctttctttctcaaacaagagatttagggaactttagaaaatacataattgttgagg

SEQ ID NO: 2763 - DNA, 458 bp, Brassica napus
ggtctccccccaatcgaattgagtgagaaaccctaatctctctccgtctccgtcttctccgattttgcaagtatgagtcgatcaggccagcctccggatctcaagaagtacatggacaagaaactccaaattaagcttaatgcaaacagaacggtagttggaactctccgtgggtttgaccagttcatgaatcttgtcgtcgataacaccgttgaagttaatggtgatgacaaaactgacattggcatggtggtgataagaggaaacagcattgtcactgttgaagctcttgaaccagttggaagatcttagcttttttattacttttgcacgaccagtttctgtattttgacttgagtttactctctgtattggaacttaattagtagaccatcttatcagcatgaattgatgatcttaaagaagtttgatattatgaattattattcctcttgtgt

SEQ ID NO: 2764 - DNA, 481 bp, Brassica napus
agtcgagcacgaaaacctaaaccccaagctcaaattcggattctgcagctatgagtcggtcaggtcagcctccggatctcaagaagtacatggacaagaaactccaaatcaagcttaatgctaacagaatggttgttggaactctccgtgggtttgatcagttcatgaatcttgttgttgacaacactgttgaggtgaacggtgatgacaaaaccgacattggaatggtggtgattagaggaaacagcattgtcaccgtggaagctcttgaaccagtgggcagatcttcttagcttttggtatatgcatccagtaatcatctctttgttctaagcactagttcttttgttattctctgtttgagaacacttggtggtagattgacagttattttgaactgatcagtaagaagtcttcatgattactctttcttgtactaaaatattgccaagaacccaaagaatgtgatggattgacggga

SEQ ID NO: 2765 - DNA, 843 bp, Brassica napus
gttcttctagtcgagtacgaaaacctaaacctcaagctcaaattcggattctgcagctatgagtcggtcaggtcagcctccggatctcaagaagtacatggacaagaaactccaaatcaagcttaatgctaacagaatggttgttggaactctccgtgggtttgatcagttcatgaatcttgttgttgacaacactgttgaggtgaacggtgatgacaaaaccgacattggaatggtggtgataagaggaaacagcattgtcactgtggaagctcttgaacctgtgggcagatcttcttagcttttggtatatgcttccagtaatcatctctttgtactaagctctagttttttattcctctttgagaaaacttggtgttagtcgtagttattgtgaactggtcagtaagaagtcttcattattactctttcttgtactaaaagattgccaagaaccccaagaatgtgatcgatagacgggacatatactttcgtgtgtctatttatcctagattccttgcttcttctatctcaaacaagtgacttgggaacttaggaaaaatacataattgttgtgtctttttttggataaatgcataaacatgtgtagctgttttattaaatacttaaacatcatgagtagttctacaatatctcatgaggaatgagttacttaggttatggcagaatttcttgggcattcctttaaatacaccatgatttgaaatgttttgtatatgctgaggatgtcgcatgtcgtatgtgcctttttcactctgcataaaaatttggcagttttgaaattgccaaaagattcagtacagttatgtaaatattcacaat

SEQ ID NO: 2766 - DNA, 536 bp, Brassica napus
tcagctctccgtctccgtcttctccgattccgcaagtatgagtcgatcaggccagcctccagatctcaagaagtacatggacaagaaactccaaattaagcttaatgccaacagaacggtagttggaactctacgtgggtttgaccagttcatgaatcttgttgtggataacaccgttgaagtcaatggtgatgacaaaactgacattggcatggtggtgataagaggaaacagcattgtcacagttgaagctcttgagccagttggaagatcttagcttttttattacttttgcaccaccagtttccgtattttgacttgagtttactctctgtattggaacttaattagtatctatcagcatgaatcttaaagaagtttgatatgatgaatttattcctcttttttgttctgaggatttctttgaatctgctgtgaggggcagtctgataatgaactataccagattaaagggctctctctaggtcggacaagttaatatttttgttaagcattgttacaattttgttacaaag

SEQ ID NO: 2767 - DNA, 674 bp, Ricinus communis
ccttttcattttcgaagcccacaacctggtctcttcaatgcttaactgaaacgaaatcatagtgattattacatttctagggttttagattgaaaccaaaaacctcttattcttcctgcccgtttctgctgcttctttcaaatctgttatcaacatgagtaggtcaggtcaacccccagatctcaagaagtacatggacaagaagcttcagattaagctaaatgcaaataggatggtggttggaactcttcgtggatttgaccaatttatgaatttggtggtcgacaacactgtggaggtaaatggtgatgagaagactgacatagggatggtggtgattcgaggaaatagcgtggtaaccgtcgaagctttagaacctgtcaatagaatgcaatgattatgatttgtattcgtgctggtataatgtagctttgactcttgtgtattttggctaatatggcaacttatggtatgtaaggcattctatatttgcagatacaatggaggttatgatttgtaagtcattcgtagttttctctaaattgcacttgtaacgagaatcgaatgctttcagttctgctggaattaccatgatatgcgtagcataattaatggctacttgttatctgtgcttgagttatatgcaagccctttgggcttgaaatttgatggct

SEQ ID NO: 2768 - DNA, 770 bp, Coffea canephora
ggagagcacatacggtagggttttgaccactggtaaaccctgttagagctgcttctcgctccctattttgtcgtccctcactggtgcttcgcgagtctctctctctctcacacaaacacacacacacactctcgctctctgtgtgtgtgtgtagggttttcaccatgagtcgatcgggccaacctccggatctgaagaagtacatggacaaaaaactccagatcaagttgaatgccaaccgcatggtggttggaacacttcggggttttgatcagttcatgaacctggtggttgatgacacagtggaagtgaatggcaatgataagattaagatagggatggttgttatcagaggaaatagtgtagtcactgttgaagcactcgaaccagttgccagagcacagtgattgtacatttctcaggcattggttttatcttatcatgcaatccgatgttattgtggaggttaagtgatactagcatgtaactttttaatactttactaagcaaatggagtggcctgtggcatattatgtagtttttggtgtaaaattcttgggttacttggtttgttgtgttgtgagttatgactcctgatatgattagctgtgacgacgtctatcttggaaagcatttcttccgtctaaaactatatatttccagtattgaggtctttgatgtcagcaggtggagaaaaagcaagtcgatattcttcttagaaaagttgttctggtgcttgaactgttgaattagggagattcctcttcgtc

SEQ ID NO: 2769 - DNA, 1205 bp, Gossypium hirsutum
atttcttttagtcatatattttacgaacctaaaaatccaatttcatttgcctcctcccataaccctactctcctctcttccaaaccaaatttctgacgcaatgagcagatccggccaacctccagatctcaaaaagtacatggacaaacaactccagatcaagctgaatgctaatcggatggttgttggtacacttcgtgggtttgatcagtttatgaatctagtggttgacaacaccgtggaggtgaatggcaatgagaaaactgatataggcatggtggttatcagaggaaatagcgttgttactgttgaagcacttgaacctgtaggcagaatgcagtgattcggttttttctactggaaattccggaatcacttgatggtatctggtggttggataacatagatgctggcctcctagtttgtgatggactattaaatttaattaagaactcataggaactttagactgttattggtggattctgctccttttccttctctgtaccggattgattgcccttgagcattccgaatagggttttaattgaatgtagagaagggtagtaacagtgaatacttaccatcttaaatgctcaggtctagattgaaacatatagtccttgtaggaggaaagagggaagtctaagcatttccaatattccaagggagtggagataaagataagatcaaaaaatcaaatatgaagctgctgctgcttctttttgggtccaactccaacaccaagtccaaggctgtgccttttatggtgtttgtgttggtccttacaggtatggtggaacaaggcgagggcaccacttgtcacagcacattcttgtcagcactggtgcagttaataccctgcagagcagcagttgctccctttagccgtattccaccaagtgagacttgctgcaatgccatcaaagctctgggacaaccttgtctgtgtgttcttgttaatggtcctcccataactggtgtggatcggaacatggcccgccagctgcctcagaaatgtactgccaacttcgaaccatgtgatgcaatgaagtagatgcatgtctgacttctttaagaataaaattgtgcagagctcctcatcagaacatttccctgttcgtactatctgtagattgcacaaaaatgaaaagattcatatattatatcaaaagattgcttagttagttgcatattaaacaata

SEQ ID NO: 2770 - DNA, 645 bp, Mimulus guttatus
cactgtttcaacctccgatttctagggtttgtgaactccgataaacccagcaccagaatctctctctctctctctaagatttcgccatgagcagatcggggcagcctccggatttgaagaagtacatggacaaaaagttacagataaagctgaatgcaaaccgcatggtggttggaacccttcgtggttttgatcagttcatgaacctggtgattgacaatactgttgaagtgaacgggaatgagaaaaccgacataggcatggtggtcatacggggaaacagtgtggttactgttgaagctctcgagccagttcaaagagcacaatgaattgtacatttttgtgcttgggtcccaatcttaatttgtaggacgaggttacgttggatgctgtaatttttagtaatttcaacattttatgacgagcttgcttactgaatcgattatatgtaacggttatgattttgatgcaatgttttttgaaccagattactttgttcaaatgtgaaccagtcgttgatttggtcaacatatcagctaaaaacaggattgaaggttcgaacgtaaaacccctcttgaaactgtaaaaaaatcgggatcagtgtgatttttgtacgttactttcagtaaaccgatggtaattagt

SEQ ID NO: 2771 - DNA, 473 bp, Nicotiana benthamiana
gggagacaagaggccgctgaacatccaaaagacatttagctagttacctctctgccactcagcagactcaaagacagaaaaagggaaaacaatgagcagatcgggtcagcctccggatctcaaaaagtatatggacaagcagctccaaatcaagttgaatgccaaccgcctagttgtggggactcttcgtgggtttgatcagttcatgaatttggttattgacaacaccgttgaggttaatggcaatgataagaatgagatcggcatggtggtaattcggggtaatagcgtggtgacaattgaagcactggaacccgttgccagagcacagtaatatgaatgacgcgatcagtagagggtttttatctatagtcatgatgttactgctcttttggaacctaaactactaatgtattatattggcattaactagtttttgactagataaaagctgactgtcgatttctcttctc

SEQ ID NO: 2772 - DNA, 497 bp, Carica papaya
tttagggttttcagtttgaagacgacgtcctccctcctctttattatcctctctgtctcagcggtaatcaaccaaattctgcaactatgagtcgttcgggtcagcctccagatctcaagaaatacatggataagaagcttcaaatcaagctgaatgcaaataggatgattgttggaacacttcgtggatttgatcaatttatgaatctggtggttgacaacactgttgaggtgaatggcaacgagaaaactgacataggcatggtggttatcagaggaaatagcgttgtcacggttgaagctcttgaacctgttagcagagcacagtgattcttgttgggtggatttgtgttttgtgtttttcttctattagatttcaggtgtgatatggttgatactctcggaaagtaattaaatgtataattctggtgattctgatggaatgttaaattacatgctttagacctagtagttatgccacatagctcatgttattcc

SEQ ID NO: 2773 - DNA, 636 bp, Lippia dulcis
ttttcaaatgttcatgattgtttgctcctaaattctagggtttttgatgaaagttaaaccctgactggaatcctctctctctaggaatcagccatgagcagatccggacagccgccggatctcaagaagtacatggataagaagcttcagataaagcttaatgccaaccgcatggtggttggaactctgcgtggtttcgatcagttcatgaacctggtggtagacaatactgtcgaggtgaatggaaatgagaaaagtgacatcggcatggtggtaattaggggtaacagcgtggttactgtggaagctcttgagccagttagtagagcacaataaactgtacattgtttgtctatgcatccaatctaatatgtagtggcagctcatatgggatgctgcagctgtagtgatttcatcattatgcaacttatgtctattgtccaaacttaatagcttacctgttgtttctaatttctatgcctgagaatgttggagcctttttggtcatcacttcagtggagtattatttttttcatagtttctataaaaatattgtgacttggaaagaattattatttgtattagcggttggaactctccttttcacaaagtagggagcgtccaagaatatgtatt

SEQ ID NO: 2774 - DNA, 508 bp, Plantago ovata
ctcagtcgccgagtagtaccagttaaaacccagatatcaattcacctcacctcaaagagtttgcaactcaacatgagcagatcaggtcagcctccggatttgaagaagtacatggacaagaagttgcagataaagctaaatgccaacagaatggtggttggaactcttcgaggtttcgaccagtttatgaacttggtcattgacaacactgttgaggttaatgggaatgagaagacagacattggcatggtggtcatcagaggaaatagtgtggtaacggttgaagctcttgagcctgttcaaagagcacaatgaatgtaatgtattggttctactaaattcttgacttgttaattaatttggtctgttgtttatatactatgtgaccttgctagatcatactttattataatagactcatctagtgttggctgtctttgttgcttgattatattgttgcatgttctcttcatatgctggctttggttcccatggggactgagctcga

SEQ ID NO: 2775 - DNA, 577 bp, Solanum tuberosum
cgcaaaagacaaaaagaggaagaaaagatgagcagatcaggtcagcctccagatctcaaaaagtatatggacaagcagcttcaaatcaagttgaatgccaaccgccaagttgtggggactcttcgtgggttcgatcagttcatgaatttggttatcgacaatactgttgaggtcaatggaaacgataagaatgagattggcatggtggtaattcggggtaatagcgtggtgacgattgaagctctggaaccggttgccagaccacagtaatacgacggaagctgataattcaaggatctttatctatgttcaaaatatttactactcttatggaacctaagtgaaattatgtattgtacctgaattatctagctttcgactagtttatctttgatatctctgaaaatgaaagtcatcgatatctctgttcatctagagcacatgttcagaatttcatctggtgagttttgtatacaatgacaatgtcgggacatgagtgtttgttcatgagatacctgttgaacgtattatggtaccttggagcaatgcaacaatgaaattttccttgatccttctc

SEQ ID NO: 2776 - DNA, 586 bp, Raphanus sativus
  misc_feature (96)..(96): n is a, c, g, or t
gggactttccagaaatcaaaatctttagggtttctctaaagtctctgtgccgcactgcaaacttcttctacggaagaaaaccaagctcaattcggnttctgcagctatgagtcggtcaggtcagcctccggatctcaagaagtacatggacaagaaactccaaatcaagcttaatgctaaccgaatggtcgtcggaactcttcgtgggtttgaccagttcatgaatcttgttgttgacaacactgttgaggtgaacggtgatgacaaaaccgacattggaatggtggtgattagaggaaacagcattgtcaccgtggaagctcttgaaccagtgggcagatcttcttagctttggtataatatgcaatccagtaatcatctctttgtactaagcactagttcttttgttattctctgtttgagaacacttgctggtagattggcagttattttgaactgatcagtaagaagtctacattaatactcttgcgtgtactaaaagattgcaatgaaccccaagaatgtgatggatagatgggatttcatatatttctgtgtgtttatttatcctagattcattgctcca

SEQ ID NO: 2777 - DNA, 579 bp, Raphanus sativus
  misc_feature (491)..(492): n is a, c, g, or t
  misc_feature (504)..(504): n is a, c, g, or t
  misc_feature (513)..(513): n is a, c, g, or t
  misc_feature (516)..(516): n is a, c, g, or t
  misc_feature (544)..(544): n is a, c, g, or t
  misc_feature (558)..(558): n is a, c, g, or t
ggatctattttctctccggaatcgaattgagcgagatacttccgacctctaagagagaaaaccctagtctctctccgtctccgtctccgtcttctccgattctgcaagtatgagtcgatcaggccagcctccggatctcaagaagtacatggacaagaagctccaaattaagcttaatgcgaacagaatggtagttggaactctccgtgggtttgaccagttcatgaaccttgttgtcgataacactgttgaggtcaatggtgatgacaaaactgacattggcatggtggtgataagaggaaacagcattgtcactgttgaagctcttgagccagttggaagatcttagtctactttgcaccactggtgtctgtattttgacttttgagtttgctctctgtattggaacttatttagtaaaagacgattatcagcatgaatcatgaggatcttgtagaagttttctatgattaattattcctcttctttgnnctgaatatttcnattgagatntgngaaccagttatgagccaatctgataacngttttattgtgtgngaataactctcctttgagtta

SEQ ID NO: 2778 - DNA, 560 bp, Raphanus sativus
  misc_feature (10)..(12): n is a, c, g, or t
ggaatcgaannnagtgagatacttccgagctctaagggagaaaaccctagtctctctccgtctccgtctccgtcttctccgattctgcaagtatgagtcgatcaggccagcctccggatctcaagaagtacatggacaagaagctccaaattaagcttaatgccaacagaatggtagttggaactctccgtgggtttgaccagttcatgaaccttgttgtcgataacactgttgaggtcaatggtgatgacaaaactgacatcggcatggtggtgataagaggaaacagcattgtcactgttgaagctcttgagccagttggaagatcttagcctactttgcaccactggtgtctgtattttgactttgagtgttctctctgtattggaactttaattagtaagacaatctatcagcatgaatcgaggatcttaaagaaattttctagtaagataatctatcagcatgaatcgaggatctgaaagaaattttctatgattaattatctcctcttcttttgttctgaatatttctgtgaaccagttatgacttatgagcca

SEQ ID NO: 2779 - DNA, 496 bp, Raphanus sativus
aatcgagcggagttctgagctgagctgagaaaaaccctaatctctccttttccatcgtcttctcccaggcgattctacaagcatgagtcgatcaggtcagcctccggatctcaagaagtacatggacaagaagctccaaattaagcttaatgccaacagaatggtggttggaactctccgtgggtttgaccagttcatgaatcttgttgtggataacactgttgaagtcaatggtgatgacaaaactgacattggcatggtggtgataagaggaaacagcattgtcaccgttgaagctcttgaaccagttggaagatcttagcttttctttttttattacattgcactatctgtaatgatttcctctattttgactctcgctgtattggaacttaattagtagaactatcagctgaatcgatcatgaagaagtttgatatgatgaatttactcttctttgtcaacactctcctatgttatgtatgaacctgttaga

SEQ ID NO: 2780 - DNA, 537 bp, Rosa hybrid cultivar
gaccagaaatcgcagtgtctagggttttgctgaaagtcgaaaccttcctcacccaaaacctctctctctctctctaatccttcaccatgagcaggtcaggccagcccccggatctcaagaagtacatggacaagaagcttcaaatcaagctaaatgcaaaccgaatgattattggaaccttgcgtggatttgaccagttcatgaatctggtggttgataacactgtagaagtgaatggtgatgaaaagaccgacataggcatggtggtgatcagaggaaacagtgtggttacagttgaagcacttgaacctgtggccaaaatgcagtagtttttgttttaaaattttttatctggatgtaggatgcaaagggaaactctgtaactttgttatgatggtgaggtgaattctttatcacccttgccaccaagcagattgtgatgaatgtaattctgtcgttctatatggaatagcagttaattgagtgtaagatacaaaatgtggtaatgctactgctttgactttgaaaaaaaaaaaa

SEQ ID NO: 2781 - DNA, 527 bp, Rosa hybrid cultivar
gaccagaaatcgcagtgtctagggttttgctgaaagtcgaaaccttcctcacccaaaacctctctctctctctctaatccttcaccatgagcaggtcaggccagcccccggatctcaagaagtacatggacaagaagcttcaaatcaagctaaatgcaaaccgaatgattattggaaccttgcgtggatttgaccagttcatgaatctggtggttgataacactgtagaagtgaatggtgatgaaaagaccgacataggcatggtggtgatcagaggaaacagtgtggttacagttgaagcacttgaacctgtggccaaaatgcagtagtttttgttttaaaaaaatttatctggatgtaggatgcaaagggaaactctgtaactttgttatgatggtgaggtgaattctatatcacccttgccaccaagcagattgtgatgaatgtaattctgtcgttctatatggaatagcagttaattgggtgtaagatacaaaatgtggtaatgctactgctttgactttgaa

SEQ ID NO: 2782 - DNA, 338 bp, Salvia sclarea
gagcagatcgggacagcctccggatctcaagaagtacatggacaagaagctacagatcaagcttaacgctaaccgaatggtggttgggacactacgtggtttcgatcagttcatgaacctggtggtggacaacactgttgaggtgaatggaaatgagaaaactgacattggcatggtggtaattagaggtaacagcgtggttactgtggaagctctcgagcctgttagtagagcacaataactgtgcattgcttgtgtatgcatccattctaatctgtagtggcagctcatatggaatgctgtagctgttgatttcaacattatgcgactttgtttat

SEQ ID NO: 2783 - DNA, 548 bp, Sarracenia psittacina
gcacaatgagccgatcaggccagcctccagatctcaagaaatacatggacaagcaattgcagatcaagttgaatgcaaatcggatggtggttggtacgcttcggggttttgatcagtttatgaatctcgtggttgacaacactgtggaggtgaatggcaatgagaaaactgatataggcatggtggttataagaggaaatagtgtggtcactgtggaagcacttgaacctgtaagccgaacacagtgatggaggttgtattgtttttgttggaatgctatgcatgctagcaaatgcttttctaagtgaaaattggagctgctagtagtaaaaggaagaatgtcccattaaacttcttttttctttttcttttttttttctatgctgttgacagaaaatgataccttttcatagggttgtggaactgatttgtatttgattagcatttgttaggcatccattggtgttgcgctggtaagctcttgtttcttgtttatgagaccaacatgatggctgggtaatgagacatacttcgtttggctaaggttg

SEQ ID NO: 2784 - DNA, 509 bp, Solanum phureja
ctttttaggggtttatttagagcacaagcggccgctgagcatcggaaattttttcatctcctccattgtttctctctcaaaagacaaaaagaggaagaaaagatgagcagatcaggtcagcctccagatctcaaaaagtatatggacaagcagcttcaaatcaagttgaatgccaaccgccaagttgtggggactcttcgtgggttcgatcagttcatgaatttggttattgacaatactgttgaggtcaatggaaacgataagaatgagattggcatggtggtaattcggggtaatagcgtggtgacgattgaagctctggaaccggttgccagaccacagtaatacgacggaagctgataattcaaggatctttatctatgttcaagatacttactactcttatggaacctaagtgaaattatgtattgtacctgaattatctagctttcgactagtttatctttgatatatctgaaaatgaaagtcattgatatctctgttcatct

SEQ ID NO: 2785 - DNA, 515 bp, Solanum lycopersicum
ctttttaggggtttatttacagcacaagcagccgctgagcatcggaaaaattttcatctcctccattgtttctctctcaaaagacaagaagagtgaagaaaagatgagcagatcaggtcagcctccagatctcaaaaagtatatggacaagcagcttcaaatcaagttgaatgccaaccgccaagttgtagggactcttcgtgggttcgatcagttcatgaatttggttatcgacaatactgttgaggtcaatggaaacgataagaatgagattggcatggtggtaattcggggtaatagcgtggtgacaattgaagctctggaaccggttgccagaccacagtaatacgaatgaagctctgattattcaaggatctttatctatgttcaagatatttactactcttatcgaacctaagtgaaattatgtattgtacctgaattaaactagcttatctttgatttctctgttgattctgaaaatgaaaagatcatcgatatctctgttcatcttg

SEQ ID NO: 2786 - DNA, 452 bp, Elaeis guineensis
gactattcgtattctcttctctctcgaattccgccaccatgagtagatctggccagcctccggatctcaaaaagtacatggacaagaagcttcaaatcaagctgaatgcaaaccgggttgtggttggcactcttcgtggatttgaccaatttatgaacctggtgattgacaatactgtggaggtcaatggcaatgagaagaatgatattggaatggtggttatcgagggggaacagtgtagtcatgatagaagctctggagccagtcagacaaaacgcagtagctgtcccttgcttgtagtctcattgtttgaaaccaaatggctgtacaagtatagttggtttatgtactactaatcgaacccaatgtactttgtagttctttttttttttttttgggtattgctaaaaatgacaaattttgctcgctggtatggaaagatggtcttgatc

SEQ ID NO: 2787 - DNA, 1060 bp, Brassica rapa
  misc_feature (51)..(52): n is a, c, g, or t
  misc_feature (59)..(60): n is a, c, g, or t
  misc_feature (62)..(62): n is a, c, g, or t
  misc_feature (64)..(64): n is a, c, g, or t
  misc_feature (79)..(79): n is a, c, g, or t
  misc_feature (81)..(81): n is a, c, g, or t
  misc_feature (1020)..(1021): n is a, c, g, or t
cggacccgtttaacctgccacagttcataactcaaggatagtaattacaannacaggtnnananaaatcttcagaacanangagtaaacaaagaagaggaattcatcatcatatcaaacttggtcgaggtagattcatgttgatagtctactaattaagtttcaatacagagagtcaaaatacagaagatggtgacggatagtgcaaagtaataagaaagctaagatcttccaactggttcaagcgcttcaacggtgacaatgctgtttcctcttatcaccaccatgccaatgtcagttttgtcatcaccattgacttcaacagtgttatccacaacaagattcatgaactggtcaaacccacggagagttccaaccaccattctgttggcattcagcttaatttggagcttcttgtccatgtacttcttgagatccggaggttgacctgatcgactcatgcttgcagaatcggagaagacgatggaaaaggagaagagattagggtttttctcagctcagctcagctcggaacgaactcgaaaagggatcgacatatatttcgaaaacgtgggaggcaaaatgttggatgcagtgctgataaacatgaagttgaatggtcgtatcgcagtttgtggaatgatctcacagtataatttagtggatccagaaggtgtacacaatctaaccacgatcctttacaagaggataaaggttcaaggctttgctgtctctgatttctacgacaaatactcaaagtttttggattttgtgcttccttacataagacaagggaagataacgtatgtcgaagacataactgaaggactcgagagtggaccttctgctttgttaggactcttccacggtaaaaacgttggtaaacaactctttgtggttgctcgtgagtgagaccactagcgccactagagtttagtcctttggtgacttgtgaccatttatttttagttatttcttttgtacggactaaccaatttgataaccagcaaaaacactgctnntagtcaaaaacagtttttttttttcgaaacttgaaatct

SEQ ID NO: 2788 - DNA, 466 bp, Vinca minor
  misc_feature (119)..(119): n is a, c, g, or t
tctctccagatttctaccatgagtcgatccggcccagcctccagatctcaagaaataatatggacaagaagctacagataaagttgaatgccaatcgcatggtggttggaacactccgnggtttcgatcagttcatgaacttggtggtggacaatacagttgaagttaatggcaatgaaaagactgacataggcatggtggttatcaggggaaatagtgttgtcactgtcgaagcacttgaaccagttgggagaacacagtgattgtacatctctagcattattatgggttaaatgtaacaaaacatgtaatggaatgttatttttattttttttggagagatgctgctgtagtatgaaacctaaaactaacccgtaaaggttgtatgttaatgaattagtcaggttccattcgagattgaggatcttatgctctttgaaattcagcattcatattaaatgatacc

SEQ ID NO: 2789 - DNA, 591 bp, Papaver somniferum
ctctgtttatctttatcagataaactcagggttttagggtttcgaaatcgaagtcgttcctctcaactcgtcttctcctctctctatcacaatgagtagatccggtcagcctccagatttgaagaaatacatggacaagcagcttcaaatcaagctaaatgctaaccgtgttgtggttgggactcttcgtggctttgaccagttcatgaatctcgtggtcgataacactgttgagatgaacggaagtgacaaaaacgacataggcatggtggtaatcagaggaaacagcgtggttatgattgaagcgttggagcctgttagtaaagcacagcagtagttacagttggatactagtcctgtttgtcccttttatctatgggagtatgttctttggattatatatctactaggacttttgtgaatgaattgtgctgtagaggttggaatgctgaacggctgatgtaatgaaactagagattttctgtatttctaacggaagttaatctggtctagtattcttattctctgatgtaaagacctttgttatctcaacctagttcttggaaaaagatttatcttttcctttggtta

SEQ ID NO: 2790 - DNA, 810 bp, Solanum tuberosum
atcaggcagaggacgagacagaacgctgaaacccgactgcgcagcaaaagtacaaaatttcttccatttttcaacttcatcttctctggcagtgagcaaaaggtaaaactctcaaggatgagcaggtctggtcaacctccggatctcaaaaagtatatggacaagcagcttcaaatcaagttgaatgcaaaccgcttagtcactggaactcttcgtgggtttgatcagttcatgaatttggtcattgacaacacagtggaaattaatggcaatgataagaatgaaattgggatggtggtaattcgcggtaatagcgtggtgacaattgaagcgttggagccagtcgctagatcacagcagtagctctaacggatctttgtttatgccccagatgctgctgctgctcgtttaaagggaaccttaggaacataagtttgtactgtcagttaactttctcaaaaaaaaaaatgtttgtactgtcaggattcagtattcgattagataacagttgaaaaatttgtgctgaatgcagtttgtatgtgttcttgttttttcccaactgaaaggtgcacgatgtgatgttcccttttaatgctcttgaggtaaaaatacttcctcatttgagttgagtttgtcacgctgggtttgccttgtgtgatttccatctcctttgacacgttgggtttgccttgtgtggtttccatctccttgcgagttattgcatatgattgagttttgctcagtgcacacactatcctccaagtgcgaatttctgtgttcaaataaataattaaatcatgatatcatctc

SEQ ID NO: 2791 - DNA, 626 bp, Prunus persica
atggccggcatggcatttgtctctaagaaaataaaagcacagttgacacgaaaaggttttgctgaaagtcttcgtctcccaaaacctctctctctctctctctctctctctctccaattcttcaccatgagcaggtcaggtcagcctccggatctcaaaaagtacatggacaagaagcttcaaatcaagctgaacgcaaatcggatggttattggaacacttcgtggttttgaccagttcatgaatctagtggttgacaacaccgtagaagtgaatggcaatgaaaagaatgatataggcatggtggtgattcggggaaatagtgtggttaccgttgaggcacttgagccagtggccaaaaatatgcagtgattctggccttgggctattttggattggatgtattctgtgttggtatgtagtttggacatatagctgcttgtatgcaaaggaaatttgtgaaagtttgggccttatggtggttaggtgatttctagattcccctttcaggagatttatgagcaaaatgtacttgtattggatctttgcaatatcagttcattgacttggtatgatatgcaatgtaatggtcagccggaatgctaattataaggtttccattgcta

SEQ ID NO: 2792 - DNA, 592 bp, Solanum lycopersicum
gagtcccgactgcgcagcaaaagtacaaaacttcttccatttttcatcttcacttcatcttctccggcaagtgagcaaaaggtaaaactctcaaggatgagcaggtcgggtcaacctccggatctcaaaaagtatatggacaagcagcttcaaatcaagttgaatgcaaaccgcttagtcactggaactcttcgtgggtttgatcagttcatgaatttggtcattgacaacacagtggaagttaatggcaatgataagaatgaaattggcatggtggtgattcgcgggaacagcgtggtgacaattgaagcattggagcctgtcgctagaccacagcagtagctcttaacgaatcgttgtttatgccccagatgctgctgccgcttgtttaaaggaaccttagggaacttaagtttgtaccgtcaggattcagtattcgactagatatcagtcaaacttgtcaatggatttctgttttaagtttgatcatcaattctctctattcaattagtgcactatgtactgaatgcattttgaacgtgttcctgtttctttttcctactaaaaggtgcacgatgtgatatttacttta

SEQ ID NO: 2793 - DNA, 528 bp, Brassica juncea
tacgaaaacctaaacctcaagctcaaattcggattcggcagctatgagtcggtcaggtcagcctccggatctcaagaagtacatggacaagaaactccaaattaagcttaatgcgaacagaatggttgttggaactctccgtgggtttgaccagttcatgaaccttgttgttgacaacactgttgaagttaatggcgatgagaaaactgacattggcatggtggtgataaggggaaacagcattgtcacagttgaagctcttgaaccagttggaagatcttagctgcttttagcagcactggtgtttgtattttgactttgaggttgctctctgtattggaacttaattagtagactatctttcagcatgatatgaggatattgaagaagttttctatgattaatttttcctcttctttgttctgaatatttttatgaaccagttatgagccaatctgataactgttttattgtatgtgaacgactctcctttgagttatgagttgtgacagattatatggctctctc

SEQ ID NO: 2794 - DNA, 490 bp, Fagus grandifolia
tctctctctctctcgcactagttcactctcagagtcttcaacatgagcagagtccgggccaaccaccggatctcaagaaatatatggacaagaagctccagatcaagatgaatgcaaatcgtatggtcattggtactcttcgtgggtttgaccagtttatgaatctagtggttgacaacactgtagaagtaaatggcaatgagaagactgatatcggcatggtggtgatcagaggaaatagtgtggtcaccgttgaggctctcgaaccagtaaacagatcatagtggtttcataatgctctgcgggttctatctatgatttagtgttattttggatggtatcaatttgataattgggaaggagatgttctgtaatctggattaggtggcccattctagacttctagtgctcattttctgttattccccttttttctaagtcagagttaatagtagtatagtgtaatctgtatggtttctcattgatggtc

SEQ ID NO: 2795 - DNA, 544 bp, Cicer arietinum
gttattcgctgttctcttttctcatctcttgatcatgagcaggtcaggccagccaccggatttgaagaaatacatggacaaacagcttcagatcaagctgaatgcaaatcgcatgattgttggtactctccgaggattcgaccagtttatgaatttggttgttgacaatactgtggaggtgaatggcaatgacaaaacggacatagggatggtggtaatcagaggaaatagtgtggtcactgtagaagcacttgaaccagtgaacaggacctcctgatttctggttataccctgctgggtgtaaaatgtaattgtggatctcttaaattggtcatgttaacacaaacctgagtttattttgatggttgatttgtgagtgctggatacctctatggttttagtgggacacattggcctaattaaaatgatgacatttatgtacatcttttttagttgaattcttcttttttaatgcacataacattaactattctcacataattttaaggaaatcatatttgttttgaatggaatggaacagttc

SEQ ID NO: 2796 - DNA, 582 bp, Carpinus betulus
gcagactcttcaacatgagcaggtcgggccaaccaccggatctcaagaagtatatggacaagaagctccagatcaagttaaatgcaaatcggatggtcgttggaacgcttcgtgggtttgaccagtttatgaatctagtggttgacaacactgtggaagtgaatggaaatgagagaaatgatattggcatggtggtgatcagaggaaatagcgtggtcaccgttgaggctcttgagccagtaaacagatcttcttagtggtttcataatgccgtggattctgtgtatgatctggtgtttattttggacgccatgactactattatgagaaggaaatattctgtaatctggattaggtgccgattaggtgccgattaggtggaccatttttagcccttatttctgcattccttttttcaagtggacttgtagtatagtatatttctgatggaatggcagcgactttggtccatataaatgcttatatgctccactttttcttgctgtgtcatacatgtccggcgtgtgcgtatcctgtcgaatcgcctgaatattatatttttagctgtggttgagactatca

SEQ ID NO: 2797 - DNA, 517 bp, Carpinus betulus
tgcccaatctctctctctctctcactcgcagactcttcaacatgagcaggtcgggccaaccaccggatctcaagaagtatatggacaagaagctccagatcaagttaaatgcaaatcggatggtcgttggaacgcttcgtgggtttgaccagtttatgaatctagtggttgacaacactgtggaagtgaatggaaatgagagaaatgatattggcatggtggtgatcagaggaaatagcgtggtcaccgttgaggctcttgagccagtaaacagatcttcttagtggtttcataatgccgtggattctgtgtatgatccggtgtttattttggacgccatgactactattatgagaaggaaatattctgtaatctggattaggtgccgattaggtggaccatttttagcccttatttctgcattccttttttcaagtggacttggttgtagtatagtgtatttctgatggaatggcagcgactttggttcatataaatgcttatatgctccactttt

SEQ ID NO: 2798 - DNA, 446 bp, Eutrema halophilum
aatcgactgagttctgagctgagaataaaccctaatcttcccttcccgtcttctccgattttgcgagtatgagtcgatcaggtcagcccccggatctcaagaagtacatggacaagaaacttcaaattaagcttaatgccaatcgaatggttgttggaactctccgtgggtttgatcagttcatgaatcttgttgtggataacactgttgaagtgaatggtgatgtgaaaactgacattgggatggtggtgataagaggaaacagtattgttaccgttgaagctcttgaaccagttggaagatcttagctttattactttgcaccatctgtaatcaacttttgtatcatgacttagttttccctctgtgtcgatcttaaaagaagtttaattttgatgaatttcctcttctttggctcctttactcctatgttccgaagattcctg

SEQ ID NO: 2799 - DNA, 594 bp, Brassica juncea
cgtctccgtcttctccgattctgcaagtatgagtcgatcaggccagcctccggatctcaagaagtacatggacaagaagctccaaattaagcttaatgccaatagaatggtagttggaactctacgtgggtttgaccagttcatgaatcttgttgtggataacaccgtcgaagttaatggtgatgacaaaactgaaattggcatggtggtgataagaggaaacagcattgtcactgttgaagctcttgaaccagttggaagatcttagcttccattacttcgcactatccgtaaaccatcttctgtattttgactctctgtatcggaacttaattagtagactatccacatgaatcaatctcgacgaagtttgatgtattactcttctttttgaacctgttagatggttataaagtcattctcttggctgtttttgtaaccgatatcctttttttatacattgtggtgctaggttaaacgggtctctctgccttctatattccttattgtttagatatttggttcctacgatttaagaatgtaagcattgctacaactttttacaaaagaaataacaacaaagcagacattaga

SEQ ID NO: 2800 - DNA, 1016 bp, Amorphophallus konjac
agggatacgatttattctttaaaatatccatctcccaagtcccaaccctaattcgaaaccctcttccgaacgcggcctccgccgtctcccctttctttcttccctctcttctcttcgtgttgctgcagttgctccttcttcctgctcggccgacggtgggtgcggcctcggcgcctccgccgcttcctcactcaccgtccgccagatcgacctcgccggctcccccttctggttcaccgtggactcctgctcccgtctcgccgccatccgcccctgccggacggacctgcgcagtccgtctcccaactgcaccggcgctcgcggcggagcaaccggcgtctgagaggggcgcctcctctcctggccgcttctgctgctctcaccattcccgacttcctgcggacgggcgtctggatcgagttgcggcgccgccatagcgtcgtcggctgtcggagacctggttgccggatcgtgtgtgtgccaccgtaccggcgtcaaaccttggtcgcaatgagtcggtctggacagcctccggatttgaagaagtacatggacaagaagctccagatcaagttgaatgcaaatcgggccattgtgggcactctccgtggatttgaccagtttatgaatctggtgattgataatactgtggaagtgaatggaaatgagagaaatgatatagggatggtggttatcaggggtaacagtgtcgtcatgattgaagccctggagccagtgagtagagctcagtagctgttttaggatttttcgactatcattgtcttacaaaattgtactgaatctttgtggtgactttacgtgccctagcaagatggtactctcgaaaatgggtcactggtaccttgttgaacgtgaacatcgggtggaccttaacagggaggcacccgaagtagcccttctgttgttaagctccgtagagcgtaatttggatccctatttccggtgatgttctttttttttttttttcctcttccacgaatgtgaagaagggtgtt

SEQ ID NO: 2801 - DNA, 602 bp, Malus domestica
tagtcgactcagtctcccaaaacctcactctctctctcaagttcctcgccatgagcagatcaggccagcctccggatctgaaaaagtacatggacaaaaagctccaaatcaagctgaatgctaatcgcatggttgttggtaccctccgtggttttgaccagttcatgaacctggttgtggacaacaccgtagaagtgaacggcaatgaaaagaatgaaattggcatggtggtgatccgaggcaatagtgtggttacagttgaagcactagaaccggtggctaaaatgcagtgatgattccggctttgcattcttcgagttagatgtgttttctttcggtaatatgtacttgtgttggttgttatggaataccagttagttgccttgtgataatgtacaatgtacatgtcagcttggacgtcgattgaatgactcactttgacttattctctttgccaatttctactttctagacttgtgtaaatgagctactacagctgcgtgcttcccgcatcccctgcagttgaaatgggacgaggtcttatttgtttacgagctactgagttagctcatattttgcacatatatcagtctggttggatg

SEQ ID NO: 2802 - DNA, 510 bp, Malus domestica
tttatccgaagtcgacttcgcccgaagcctctctctctctctctctctctccctcattcctcgccatgagcagatcaggccagcctccggatctgaaaaagtacatggacaaaaagctccaaatcaagatgaatgccaaccgcatggttgttggaaccctccggggttttgaccagttcatgaacctggtcgttgacaacaccgtagaagtcaacggcgacgaaaagaatgaaattggcatggtggtgatcaggggcaatagtgtagttacagttgaagcactcgaaccggtggctaaaatgcagtgatgattccgggtttgcattcctttgagttcgatgtattttctgttggtcatatgtagattcccttttcatagagattttatggtaatatgtacttgtgttggttgtcatggaattctagttagttgacttgactagtgataatatacaatgtaattgtcaccctggacgtcgattatatgactcacttcgaatttattctctt

SEQ ID NO: 2803 - DNA, 474 bp, Brassica juncea
cgcagagtactttttttttttcatttattttctccctgcaatcaaattgagtgagatacttccgagctctgagagaaaaccctaatctctctccgtctccgtcttctccgattccgcaagtatgagtcgatcaggccagcctccggatctcaagaagtacatggacaagaaactccaaattaagcttaatgccaacagaatggttgttggaactctccgtgggtttgaccagttcatgaatcttgttgtggataacaccgtcgaagttaatggtgatgacaaaactgaaattggcatggtggtgataagaggaaacagcattgtcactgttgaagctcttgagccagttggaagatcttagcttttttattatttgcacgaccagattctgtattttgacttgagtttactctctgtattggaacttaattagtatctatcagcatgaatcttaaagaagtttgatatgatgaa

SEQ ID NO: 2804 - DNA, 489 bp, Brassica juncea
gattgcaaacttcttgttcttctagtcgagcacgaaaacctaaaccccaagctcaaattcggattctgcagctatgagtcggtcaggtcagcctccggatctcaagaagtacatggacaagaaactccaaatcaagctcaatgctaacagaatggttgttggaactctccgtgggtttgaccagttcatgaaccttgttgttgacaacactgttgaagttaatggcgatgagaaaactgacattggcatggtggtgataaggggaaacagcattgtcacagttgaagctcttgaaccagttggaagatcttagctgcttttagcagcactggtgtttgtattttgactttgaggttgctctctgtattggaacttaattagtagactatctttcagcatgatatgaggatattgaagaagttttctatgattaatttttcctcttctttgttctgaatatttttttgattcaaatggattgattatctt

SEQ ID NO: 2805 - DNA, 811 bp, Phaseolus coccineus
aaagtacatagaagaggaaacattgcctccgaagttaggttttggttttggcactttcgtggagtgaaccaaattttctttgctactgtcatctctcatctcatcaccatgagcagatcagggcaaccaccggatttgaagaagtacatggacaagaagcttcagatcaagctgaatgctaatcgcatgattgttggtactctccgtggctttgaccagtttatgaatttagttgttgacaacactgtggaagttaatggcaatgagaaaactgacatagggatggtggtaatcagaggaaatagtgtggtcactgttgaggcgcttgaacccgtgaacagaacctgatctctgtttcttgtaaacacttataagtacattttctggttttaacagttgtgtatttgaacaatgtagctggtgagagtagcttgtaattggggatcttaagagggtcatcttggccactaattctgggtttgtttctggctaaattgtggggtgggatacttacgattttggctgtgagttgactctattgaattgttcgtatttatccctcttagtgaattatccctcatctttttatattgtatttatagcacggaaacctctgtatttctttctgtccacccttaagtctaaacatgggggttgttgattgagctattagaagtttcactataactcctttgtctaaggagtaaggaatcatatttgttgttacacataattttaggctgatttgtttgaatgtgaagctctatgtggtcttacacatgtttgaatgcttccagtaaccttggcaatt

SEQ ID NO: 2806 - DNA, 807 bp, Phaseolus coccineus
gaaagttcatagaagaaggaacattgcctccgaagttaggttttggttttggcactttcgtggagtgaaccaaattttctttgctactgtcatctctcatctcatcaccatgagcagatcagggcaaccaccggatttgaagaagtacatggataagaagcttcagatcaagctgaatgctaatcgcatgattgttggtactctccgtggctttgaccagtttatgaatttagttgttgacaacactgtggaagttaatggcaatgagaaaactgacatagggatggtggtaatcagaggaaatagtgtggtcactgttgaggcgcttgaacccgtgaacagaacctgatctctgtttcttgtgaacacttataagtacattttctggttttaacagttgtgtatttgaacaatgtagctggtgagagtagcttgtaattggggatcttaagagggtcatcttggccactaattctgggtttgtttctggctaaattgtggggtgggatacttacgattttggctgtgagttgactctattgaattgttcgtatttatccctcttagtgaattatccctcatctttttatattgtatttatagcacggaaacctctgtatttctttctgtccacccttaagtctaaacatgggggttgttgattgagctattagaagtttcactataactcctttgtctaaggagtaaggaatcatatttgttgttacacataattttaggctgatttgtttgaatgtgaagctctatgtggtcttacacatgtttgaatgcttccagtaaccttgg

SEQ ID NO: 2807 - DNA, 846 bp, Theobroma cacao
aaatgttagttaagttaaccaaatttttaatcctttgggccttgatgaacccggctcttttcagaaaccaggcctctaaaatttcactagggttttaacttcctagtttacgagtcaaaactcttcgtcctccccaaaaccctactctcctctctcttctctctctcacactcaggattcgaccaaatctctgtcacaatgagcagatccggccagcctccagatctcaaaaagtacatggacaagaagctccaaatcaagctgaatgcaaatcggatggttgttggtacacttcgtgggtttgaccagtttatgaatctagtggttgacaacactgtggaggtgaacggcaatgagagaactgacataggcatggtggtgatcagaggaaatagtgttgttactgttgaagcacttgaacctgtaggcaaaatgcagtgattctggtttttcaattggaaatttggaattcacttgatgtatctcttttactttgttgtttggataaaatcgctgctagcctgctagtttgggatgggatatgttatgtaattgagaattggtaggaagttagatggatctctgctgattctgcactttctttgaatttcactgtgcccaatggattaccctttgggctttccagatgggtataattgaatgtagagaatggtaacagtggtacttattttaaatgctctggcctagattgaaacttgtggtactgcacatgttaaagcttgtttcttgttcttcatgctctcaatgtagttgcttcctttgtgcacccagagcttggcatcagatgaatttctctccatagtttaataacaccatttgtttcag

SEQ ID NO: 2808 - DNA, 679 bp, Cedrus atlantica
tcgagcagccttcggcaagcccatgatttacaactgtaaatgctccgtacacagcgagtgagaaaacaaaattcaataaaattctgccgttcccgttaaccctgtgagatttgatctctgccacagcgtcgttatcgtgagcgagctaccagagtttcggttcagacgtagccgctctttgtaagcttttgattgtgtttccccgttctaagaggcatcatgagcagatcagggcagcccccggacctcaagaagtacatggacaagaaacttaacataaagttgaacgccaacagagtggtggttggcactttacgaggatttgaccagttcatgaatttagttctggatggtactgtagaagtaaatggcaatgacagaaatgagataggcatggtggtcattagagggaacagtgttgtgatgattgaagctttggaaccagtcaataggtcatcataattaatttgacaccttttgatgtttgagagattcatgggtacagaacttttgtaagccatgcaccatttgttaaaatgttccagtaaatgattagtaagcccagaaaattttgcaaggtttattttgactggatgtcatgaacaaagtatgaaggagagttttcctcccccttttcttatgcttttaagagttggaagataacttaaatagctgcatg

SEQ ID NO: 2809 - DNA, 522 bp, Cleome gynandra
tccctctcttcgtgtcgagggtttttcgtaatcccccaagtagacactcgattgtcctatttcaccaaaaccctaatctctcatttcttaggtttctgcaatcatgagccgatcaggacagcccccggatctcaagaagtacatggataagaagcttcaaatcaagcttaatgctaaccgtatgatcgtcggaactctgcgtggatttgaccaattcatgaatcttgttgtggacaacactgtggaagtgaatggaaacgagagaaccgacattggcatggtggtgataagaggaaacagtgttgtcacggttgaagctcttgagccagtgggcagatcttaaaatccttatcatatccattggtaatcatcttttgtaatatgcccttgtttgctgtctgtatggatacttagtagttgttggaattagccgatgatattgacgcttgcctgtgctatgaacccctgattaaacattctgaattggcgaatgtagatactaaacacagggttattatggtt

SEQ ID NO: 2810 - DNA, 780 bp, Vigna unguiculata
aaagaagagggaacattgccaccgaagttaggttttggttttggcactgtcgtgaagtgaaccaaattttctttgctactgtcatttttcatctcatcaccatgagcagatcagggcaaccaccggatttgaagaagtacatggacaagaagctccagatcaaactgaatgctaatcgcatgattgttggtactctccgtggctttgaccagtttatgaatttagttgttgacaacaccgtggaagtgaatggcaatgagaaaactgacatagggatggtggtaattagaggaaacagtgtggtcactgttgaggcgcttgaacccgtgaacagaacctgatccctgtttattgtaaacatttataagtacattttctggttttaatagtcgttatttgaacaatgtagctgttgagagtagcttgtaattggggatcttaagagggttatcttggtcactaattcatggtttgtttctggctaagttgtgggggtgacctatgattttggctgtgacttgactctattgaaatattcgtatttatccctcatagcgaagtattccttgtctttttatattgtatttaacacggaaagctctgaatctctttctgtatctgctaagtctaaatatggggttgttgtttgagctatttgaagtttcggtatggagttaggaaccatatttgttgttatacgtaattttaagttgatttgtttgaatgtttgtagctgtgtggtcatacatgtttgaatgcttccagtagccttgtcatttc

SEQ ID NO: 2811 - DNA, 784 bp, Vigna unguiculata
gacaaagaagagggaacattgccaccgaagttaggttttggttttggcactgtcgtgaagtgaaccaaattttctttgctactgtcatttttcatctcatcaccatgagcagatcagggcaaccaccggatttgaagaagtacatggacaagaagctccagatcaaactgaatgctaatcgcatgattgttggtactctccgtggctttgaccagtttatgaatttagttgttgacaacaccgtggaagtgaatggcaatgagaaaactgacatagggatggtggtaattagaggaaacagtgtggtcactgttgaggcgcttgaacccgtgaacagaacctgatccctgtttattgtaaacatttataagtacattttctggttttaatagtcgttatttgaacaatgtagctgttgagagtagcttgtaattggggatcttaagagggttatcttggtcactaattcatggtttgtttctggctaagttgtgggggtgacctatgattttggctgtgacttgactctattgaaatattcgtatttatccctcatagcgaagtattccttgtctttttatattgtatttaacacggaaagctctgaatctctttctgtatctgctaagtctaaatatggggttgttgtttgagctatttgaagtttcggtatggagttaggaaccatatttgttgttatacgtaattttaagttgatttgtttgaatgtttgtagctgtgtggtcatacatgtttgaatgcttccagtagccttgtcatttca

SEQ ID NO: 2812 - DNA, 612 bp, Solanum melongena
ccacaaaataaaaagcgaactgaaggtaaacattttagttcccgactgccgcagcagaaaaacaattttttcccattctccatctcctccggcagtgagcaaagagcagaattcaaaggatgagcaggtcgggtcaacctccggatctcaaaaagtatatggacaagcagcttcaaataaagttgaatgccaaccgcttagtcactgggactcttcgtgggtttgatcagttcatgaatttggttattgacaacactgtggaagttaatggcaatgagaagaatgaaattggcatggtggtaattcgaggtaatagcgtggtgacaattgaagcattggagccagtcgctcgaccacagtagctctaactgatcgtttgtgctccagatgttgctgctgctcgtttaaagggaccttagggaacagaagtttgtactactaggattcagtattcgactagattacagttaacatgacaatggatttctatcttaagtttgataatcaattctctcttttcaatcagtgcattatctgttgaatgcagtttgtatgtgttcctgtttttttcctgcctccaattaataggagcagaatgtgatgtttccgttt

SEQ ID NO: 2813 - DNA, 530 bp, Solanum melongena
aagcagccgctgagcatcggaaaaaattccagttctctcaaacacaggaaaaagagaagaagatgagcagatcagggcagcctccagatctcaaaaagtatatggacaagcagcttcaaatcaagttgaacgccaaccgccaagttgtagggactctccgtgggtttgatcagttcatgaatttggttattgacaacactgttgaggtcaatggcaacgagaagaatgagattggcatggtggtaattcggggtaatagcgtggtgacgattgaagcactggaaccagttgccagaccacagtaatacgaatgaagccgattattcgagggatctttatctatgttcaagatatttagtacccttatggaacccaagtgaactatcaagagctttcatctgatgagttttgtacttcttaccccccctccccccaaaccaaccccaatggtatacaatgacgatgtcgggatatgagtgcctgatcatgagattacagatacttgttgaatgtcttatggcacctttact

SEQ ID NO: 2814 - DNA, 770 bp, Eucalyptus grandis
gtcattacgacgctctagggttttgggagcgcatcgtgcactgtaacttcaccactccaaaagctcccctctgcttgtcccgcgcatccctgcgaaagtcgtcaccatgagcagatcgggccagcctccggatctcaagaagtacatggacaagaagctccaaattaagcttaacgcaaataggatggttgttggaacactccgtgggttcgatcagttcatgaatctagtggtagataatactgtcgaagtgaatgggaatgagaagaatgacatagggatggtggttataagaggaaacagtgttgtaactgtggaagctcttgaacctgtgaacaggacataatccatttagctatgtatttggtagatttaaagaactctttacttgcagttgattctgatgctaccaagctgcgtgtaaggaggatgttgtataaactcgacctatcttatgcttcatgaaatattgaccttcaagtggagtagtgcacttggcgcaggccagatttgaatttcaatgaaattatgtatctccatacattgtgaccaaattattcactggctcgtacagtgttgggaagtcttaagtttatcaacattatgctgcttgaattagagtgaatttgagagaagttcaaattcatcaggctgacttataagttgcctcttttatctttcattttacagtatttatatctaaatatatggcttgagatacggcaagtgattcacatgtctgtggcatgtgaaatcagtctgtacccaac

SEQ ID NO: 2815 - DNA, 543 bp, Euonymus alatus
cggccgggggccgatcgacgaacgtccctcagaccctcacaattcgttctcctagggttttgaacttgcgaatactcctgcaaaagccttttctctgtcgctcattctctactcaactacaaaccatgagcaggtccgggcagccaccagatctcaagaagtatatggataagaagcttcagatcaagctaaatgcaaaccggatgattgttggaacgctgcgtggatttgaccagttcatgaatttggtgattgacaacaccgttgaggtgaatggcaatgagagaaatgatattggcatggtggtgatcagaggaaacagtgttgtcacagtagaagcacttgaacctgttgcgagatcgcagtgatgtatgtttgtatatgaatatcagtcagttgtacttccaactcttggtactttcgaagataatttctaattgtatggatgaatgggtgttctattatggatcttaagtgcattcttctgtgcatttttggcgttctacaagttggccttgtgaaatttaaaaatagctttgttac

SEQ ID NO: 2816 - DNA, 526 bp, Euonymus alatus
ttcccaatttgttctcctagggttttgaacttgcgaatactcctgcaaaagccttttctctgtcgctcattctctactcaactacaaaccatgagcagatccgggcagccaccagatctcaagaagtatatggataagaagcttcagatcaagctaaatgcaaaccggatgattgttggaaccctgcgtggatttgaccagttcatgaatttggtgattgacaacaccgttgaggtgaacggcaatgagagaaatgatataggcatggtggtgatcagaggaaacagtgttgtcacagtagaagcacttgaacctgttgcgagatcgcagtgatgcatgtttgtatatgaatatcagtcagttgtacttccaactcttggtactttcgaagataatttctaattgtatggatgaatgggtgttctattatggatcttaagtgcattcttctgtgcatttttggcgttctacatgtatctgttctaaaagttggccttgtgaaatttaaaaatagctttgttctttg

SEQ ID NO: 2817 - DNA, 631 bp, Linum usitatissimum
gaaaccctatccccgatcgctttgtctctcttcatcagctcattgacgactgttagtgccgccgcttccttccctctttgtctctccttccaggcgattgaacaatgagcagatccggtcagcctccggatttgaagaagtacatggataagaaacttcaaatcaagctgaatgcgaacagaatggtggtcggaactctccgtgggtttgaccagttcatgaacttggttatcgacaacactgtggaagtgaatggtgaagacaaaactgacatagggatggtggtgataagaggaaatagcgttgtgactgtggaagctctggagcctgtaaacagagggatataagtcttagactctgtatcgtgtggatatcatgtagacttttaactactctgtcggctgggaatgtggttgccttttgtcatttggatgcatcattttaggctcttagctgccagaaatttcatcctgtgattcctatcctagattgagcacaaactatgaatggttgaatcaattgagctctaacggctatctttgaagagttgaatttctgttttcgctttatggttttagaaacatcctcatccactcatacatgaagctttgtttgccgactggctttcaat

SEQ ID NO: 2818 - DNA, 805 bp, Fraxinus spp
cggccgggggtaccgattcaagattagcacccacctctctctctctcgctcgctcgctctactgtttgtccgccccttctctctctccacttctagggtttgttcgcccctgtcgcagcataccgcctctctaaaaccttctccggccaaggttctaatcatgagcagatcaggccagcctccggatcttaaaaagtacatggacaagaagttgcaaatcaagctgaatgcgaatcggatggtggttggaacacttcgtggttttgatcagtttatgaacttggtggtggacaacactgtcgaagtgaatggcaatgagaaaaatgaaattggcatggtggtcatcaggggaaatagtgtagtcactgttgaagcacttgaacccgttagtagaccacagtaattgtgtatttgcagtggtatggattcatgtaacttggtagtggattatgttggattctgaagctttatgacaccagaggaacctctaagatttacttaaaatatgctgttgtgagaattatccacttcaatattccgtatttaatagctccttgtggcttatgacttgaatgttgtgttgtgcaagttacatgtccctttaagttaatagtcttgtttgccagttaaatgcatctgatttatgacctagaactctttgagatgttagctgtgattctgctggcgatctgtcaattttttcaagggaatatatgccttactggggaaaattagcaagatcgtgtgcagatggcatcgctttaagcttgctttactggtatagctgtacctggtgtatgttcac

SEQ ID NO: 2819 - DNA, 574 bp, Panax ginseng
attcttttcctttaaaacctccgtctgtgtttctctctgggtctgatcttcttccatctccctctttgctcgtctaggctttcacgatgagtcgctccggccagcctccagacctcaagaagtacatggacaagcaactgcagattaagatgaatgccaatcgcatggtggttgggacacttcgtggttttgatcagtttatgaacctagtgattgacaacactgtggaagtgaacggcaatgagagaactgatataggcatggtggttattagaggaaacagtgtggtcattgttgaagctcttgaaccagtcagcagagcacagtgattgcagatatgtattaatatgatataaatgtatgtactgacaatcttccacctttaaacaaagcctgccaagaaaattgtaagacaaaccattttaagtaggtaggtaggtgggacatcaacagcaccaatggcttggatgaaatgacttttgttatgtttgtatattatgcatgataacatttacagatggtctgtaactgtatctgtattgcatgtgaagcataattgaagtgtttaattagt

SEQ ID NO: 2820 - DNA, 500 bp, Actinidia deliciosa
  misc_feature (96)..(96): n is a, c, g, or t
  misc_feature (418)..(418): n is a, c, g, or t
aaaacctttcctagggttttagaggcgaacaccaccttctctctctctctctcgtgtttaaccatgagcaggtcgggccagcctccggatctcaanaagtacatggacaagcaactgcagatcaagttgaatgcaaatcggatggtgatagggacacttcgtggttttgatcagttcatgaatcttgtggttgacaacactctggaggtgaatgggaatgagcaaactgatataggcatggtggttatcagaggaaacagcgtggtcacagtcgaagcactggaaccagtaagcagagcacagtgattgtggattgtattggcattgttggaatgtagtatgtactaccttgtctttgtaggtgtattgagctgttagtatgaaggttgaatcttcttttaaaagataatttccgtgngttttattggacaaatttgtcgtttacatgttatataactattagtatgaaggttgaatcttcttttaaaagataaaaaaaa

SEQ ID NO: 2821 - DNA, 494 bp, Glycyrrhiza uralensis
ggagcagccgccgccaccttcttcgttcgttcgttttgtcgtctcattcatcccttcaccatgagcaggtcagggcagccacctgatttgaagaagtacatggacaagaagctccagatcaagctgaatgcaaatcgcatgattgttggtactctccgtggctttgaccaatttatgaacttagttgttgacaatactgtggaggtgaatggcaatgagaaaaatgacatagggatggtggtaatcagaggaaatagtgtggtcaccgttgaggcacttgaacccgtgaacaggagtagttgatttctgtttcttgtaaacatctattattagtaaatttcaaggtttcaacagaaacagacatgtaattgtggatcttaatatggtcatgttagccactaatctatgggttttagtgtgtggtagtggctttagttaaactgatatttatgtaccgccttttttttagttgaatcatctattttctattgcat

SEQ ID NO: 2822 - DNA, 595 bp, Nuphar advena
gggcgtcggaggttgggtctctctctctctctctcgccctaacttgttgcttcaatttttgggtttctgttgactgtcttccaccatgagcaaatcagggcagcccccagatctcaaaaagtacatggacaagaagcttcacataaaactgaatgccaatcgtgtggtggttggcacgctccgcgggtttgatcagttcatgaatttagtgattgacaacacagtggaggttaatggcaacgaaaagactgaaatagggatggtggtaatcagagggaacagcgtggtgatgattgaagctcttgagccagttagcaggggttaatagattccacttgaacatcggtcgatatgaagaatcgtttatcctgtcatagcctgctttaaccctagttaatgttataatgaagaatcctatacctttgatttttaatttcctgcctctcaactgcctcatgccatacggttggccttgatgttgccatcactgttatgcagcttttcctttgatcttttctacattctgcctgatagtggtgcactacttatcttaatggtgttgaatttaatactaaatctttccagcatctccttt

SEQ ID NO: 2823 - DNA, 482 bp, Nuphar advena
tttttgggtttctgttgattgtcttccaccatgagcaaatcagggcagcccccagatctcaaaaagtacatggacaagaagcttcacataaaactgaatgccaatcgtgtggtggttggcgtgcttcgtgggtttgatcagttcatgaatttagtgattgacaacactgtggaggttaatggcaatgaaaagactgaaatagggatggtggtaatcagggggaacagcgtagtgatgattgaagctcttgagccagttagcaggagttaataggttctgctagaacatcggttgatatgaagactcatttatgctatgtcatagcctgctttaaccctagttattgttataatgaagaatcatgtacctatgaattttaatttcctgcctcatgccatacagttggccttgatgttgccatcactgttatgcagctttatctttgatcttttcccacattctgcctgatagtggtgcgctac

SEQ ID NO: 2824 - DNA, 460 bp, Olea europaea
ctctctctctaaaactttctccggcctagggttttaaggtcatgagcagatcaggccagccctccggatctaaagaagtatatggacaagaagcttcagatcaagctgaatgctaatcggatggtggttggaacacttcgtggttttgatcagtttatgaacctggtggtggacaacactgttgaagtgaatggcaatgagaaaaacgaaatcggcatggtggtcataaggggaaatagtgtagtcaccgttgaggcacttgagcccgttagtagaccacagtaattatacattcgcaatggtatggattcatgtaacttgtagtggagtgttatttcggatgctgaagctttatgataccccaaaagaacctgttcttagatttacttaaaatgtgttgtgagaattatccgcttcaatattctgtatttaatggctgaattaataatcttgctgaacg

SEQ ID NO: 2825 - DNA, 514 bp, Capsicum annuum
tcagcatagtagtgaaaaaaggaagcagcaaatagtagaaagcaaggatgagcaggtcgggtcaacctccggatctcaaaaagtatatggacaagcagcttcaaatcaagttgaatgccaaccgcttagtcactggaactcttcgtgggtttgatcagttcatgaatttggtcattgacaacactgtggaagttaatggcaatgagaagaatgaaattggcatggtggtgattcggggtaatagcgtggtgacaattgaagcgttggagccagtcgctagaccacagtagctctaagggatctttgtttatgctacagatgctgctgccgcctgtttaaaggaacataagtttgtactaccaggattcagtatttgattagataacagttactaagacaatggatttctgtccaagtttgatcatcaattctcgctattcaattagtgcactatgttatgtgctgcatgcagtttgtacgagtcccaatgccttttaattggaaattgatgttt

SEQ ID NO: 2826 - DNA, 517 bp, Capsicum annuum
gtaaaaaaaggaagcagcaaatagtagaaagcaaggatgagcaggtcgggtcaacctccggatctcaaaaagtatatggacaagcagcttcaaatcaagttgaatgccaaccgcttagtcactggaactcttcgtgggtttgatcagttcatgaatttggtcattgacaacactgtggaagttaatggcaatgagaagaatgaaattggcatggtggtgattcggggtaatagcgtggtgacaattgaagcgttggagccagtcgctagaccacagtagctctaagggatctttgtttatgctacagatgctgctgccgcctgtttaaaggaacataagtttgtactaccaggattcagtatttgattagataacagttactaagacaatggatttctgtccaagtttgatcatcaattctcgctattcaattagtgcactatgttatgtgctgcatgcagtttgtacgagtcccaatgccttttaattggaaattgatgtttccttttgatgctct

SEQ ID NO: 2827 - DNA, 487 bp, Petunia hybrida
gcgggggccgctgaacattaacaaaacattaccttcttctctttgtctcaaacacataaagagtaaaaagatgagcagatcgggtcagcctccagatctcaaaaagtatatggacaagcagctccaaatcaagttgaatgccaaccgtctagtcacggggactcttcgtgggttcgatcagttcatgaatttggttattgacaacacagttgaggtcaatggcaatgagaaaaacgagattggcatggtggtaattcggggcaatagcgtggtgacaattgaagcactggagcctgttgctagagcacagtaacatgaagcaattattagagagttctttatctatgtttaaaatgttgctgctgtttggaacataagcaacctatgtattgtatctggattaactagcttttgactagagtaaagttgactgacagtggattttcttcccgcatttagaaatgaagaatcatatatttctcggttc

SEQ ID NO: 2828 - DNA, 752 bp, Cajanus cajan
cggggggacgaagagagggaaccaaaccatatcgaatcaaatcattacctagaaccgaaagttagggtttaaggttcgtttgtctcatctcatcatcatgagcagatcaggacaaccaccggatttgaagaagtatatggacaagaagcttcagatcaaactgaatgcaaaccgcacgattgttggtactctccgtggctttgaccagtttatgaatttagttgttgacaatactgtggaagtgaatggcaatgagaaaaatgacatagggatggtggttatcagaggaaatagtgtggtcactgttgaagcgcttgagcccgtgaacaggagctgatttcgtgtgaacatttataagaattttttcatgtttcaacggttgtgtatttgaacaacgtagctattgagggtaacttgtaattgggaatcataatagaatcacgttggccagtaatttggggttcattttctggcaaaattgtcgggtgggataactgtagtgatttagtgtgattgctgtgatttgaccctattgaaaatttgaaatatatcacttttagctgatttctcatctttttatgaagtatttagtatgaaaacttcgctttctctctttgcactaaagtctgaactcggggttgttggtggagctgttagagtttttactatatgcatttatctaaagtcatttgttgtaaccacggatgtaattttgtctaattcatatgaatgtgtggagctttatgtagtca

SEQ ID NO: 2829 - DNA, 754 bp, Cajanus cajan
aatacgaagagagggaaccaaaccatatcgaatcaaatcattacctagaaccgaaagttagggtttaaggttcgtttgtctcatctcatcatcatgagcagatcaggacaaccaccggatttgaagaagtatatggacaagaagcttcagatcaaactgaatgcaaaccgcacgattgttggtactctccgtggctttgaccagtttatgaatttagttgttgacaatactgtggaagtgaatggcaatgagaaaaatgacatagggatggtggttatcagaggaaatagtgtggtcactgttgaagcgcttgagcccgtgaacaggagctgatttcgtgtgaacatttataagaattttttcatgtttcaacggttgtgtatttgaacaacgtagctattgagggtaacttgtaattgggaatcataatagaatcacgttggccagtaatttggggttcattttctggcaaaattgtcgggtgggataactgtagtgatttagtgtgattgctgtgatttgaccctattgaaaatttgaaatatatcacttttagctgatttctcatctttttatgaagtatttagtatgaaaacttcgctttctctctttgcactaaagtctgaactcggggttgttgatggagctgttagagtttttactatatgcatttatctaaagtcatttgttgtaaccacggatgtaattttgtctaattcatatgaatgtgtgaagctttatgtagtcactcaaa

SEQ ID NO: 2830 - DNA, 480 bp, Plantago ovata
ggagctgattcttcaacaactttcctaatttcttttcacttcctagggttttcagcagagataaaccctattcactttcatcttcttctacaacacttcgattaatcatgagcagatcaggccagcctccggatttgaagaagtatatggacaagaagctacagataaagctgaatgccaatcgcatggtggttggaactcttcgaggttttgatcaattcatgaacctggtgattgacaacactgttgaagtgaatggagatgagaaaactgacattgggatggtggtcatcaggggaaacagtgttgtgactgttgaagctcttgagccagttcaaagagcacaatgattgtaaccgatgggttattctagactctcaagtagataggttccggatcttctagtctcgattatatctttcgaaatttgtatcagacttgtgttaactgttgagatttattggacaaaaattgtttctc

SEQ ID NO: 2831 - DNA, 504 bp, Populus trichocarpa
gttttttaagcccacaaatagagcccaatctggccttcgaatccctagggtttaacaagaggtgtaaacccctagtccagcgctcattttgttgctctctctctcgacaaccacactcagaaaatctttcagtcttcgtttcagtcatgagccgatcgggtcagccaccagatctcaagaagtatatggacaagaagcttcaaatcaagctgaatgcaaataggatggtggttggaacacttcgtgggtttgaccagttcatgaatttagttgttgacaacactgtggaggtgaatggtgatgagaaaactgatataggcatggtggtgctcagaggcaatagtgttgtcacagttgaagcattggaacctgtaaacagagcacagtgatggatggctgtgtacttgtactgatttaggcgggctttaagtcatatgtaatttgacccggatggctacactttgtatgagataaagttgtttaataatttctgttgcaatgaag

SEQ ID NO: 2832 - DNA, 511 bp, Populus trichocarpa
atgggattttcaaatgtcgtgggtgtttggtctagtgtgccccttcaatcgagcgctcgttctcctgctttctatcgcgaccaacaaaaaaaaaaaaaaaaagagtccatcaaagtcttcgtttcagtcatgagcagatcggggcagccaccagatctcaagaagtacatggataagaagcttcaaatcaagctgaatgcaaataggatggtggtcggaacactccgtgggtttgaccagttcatgaatttggtggttgacaacactgtggacgtgaatggtgatgagaaaactgacataggcatggtggtgatcagaggcaatagtgttgtcactgttgaagcgttggaacctgtgaccagaacgcagtgatgaatggttttgtactcgtagcgttctaggatggctttaactcttatgcttttttactcagatgtgtacacttgtatgagatgaagaagtttaatattttatgacgcaatgaaggtcatatgaatcctttatttgacca

SEQ ID NO: 2833 - DNA, 535 bp, Raphanus sativus
gaatcaatcgagcggagttctgagctgagctgagaaaaaccctaatatctccttttccatcgtcttcccccgatttctacaagcatgagtcgatcaggtcagcctccggatctcaagaagtacatggataagaagctccaaattaagctaaatgccaacagaatggtggttggaactctccgtgggtttgaccagttcatgaatcttgttgtgtataacactgttgaagtcaatggtgatgacaaaactgacattggcatggtggtgataagaggaaacagcattgtcaccgttgaagctcttgaaccagttggaagatcttagtttttttttttattacattgcactatctgtagtgacttcctgtattttgactctctctctgtattggaacttaattagtagaactatcagctgaatcgatcatgaagaagtttgatatgatgaatttactcttctttgtctactctctcctatgttatgtatgaacctgttagatttgttatatgcattgtaattgctatacttgagtcta

SEQ ID NO: 2834 - DNA, 596 bp, Rhizophora mangle
agcctcccgccgtctctcacaccttctcgcagcgaacaactgagagataatcaaagtcgtccaaacatgagcagatcaggccagcctcctgatctcaagaagtacatggacaagaagcttcaaattaagctgaatgctaatagacttgtggttggaacactccgtggatttgaccagtttatgaatttggtggttgacaatactgtggaggtgaacggcgatgagaaaactgatataggcatggtggtaatcagaggaaacagtgttgtcacggttgaagcactggaacctgtgaacaagtcatagttataatggtttggtttatgttcatgccgatcttatagcttcttggagaagtttttcctatgtatttggacacaatgaaacttaactggatctcccttatgttaggatattacctagattattagtatcagcatcaggcttttattgatcatcatggaatcctaatgataggcctctagtgtaacacacttttttgggttgttggaaaatttagaagcttgagatttgcttgcctggactgattttggtgcctgaattattgtaaccttcaattaaagtttgcttggaat

SEQ ID NO: 2835 - DNA, 560 bp, Sarracenia psittacina
tctctctctctctcatcaagggtttagcaccatgagccgatcgggccagcctccagatctcaagaatacatggacaagcaattgcagatcaagttgaatgcaaatcggatggtggttggtacgcttcggggttttgatcagtttatgaatctcgtggttgacaacactgtggaggtgaatggcaatgagaaaactgatataggcatggtggttataagaggaaatagtgtggtcactgtggaagcacttgaacctgtaagccgaacacagtgatggaggttgaattgttttgttggaatgctatgcatgctagcaaatgcttttctaagtgaaaattggagctgccagtagtaaaaggaagaatgtcctattaaactcttttttcttttctttttttccctatgctgttgacagaaaaggataccttttcatagggtttgtggaactgatttgtatttgattagcattttgttaggtatccattggtggttgccctggtaagctcttgtttcttgtttatgagaccaacatgatggctgggtaatgagacatacttcgtt

SEQ ID NO: 2836 - DNA, 668 bp, Sarracenia psittacina
cgctttacaatcttccaccgccggcgccaccgtgatccacacccccgacacccgggctctcaagaagtaattataaattatagcggaaaacataatattagaatctctcttcattctctctctctctcatcaagggtttagcacaatgagccgatcaggccagcctccagatctcaagaaatacatggacaagcaattgcagatcaagttgaatgcaaatcggatggtggttggtatgcttcggggttttgatcagtttatgaatctcgtggttgacaacactgtggaggtgaatggcaatgagaaaactgatataggcatggtggttataagaggaaatagtgtggtcactgtggaagcacttgaacctgtaagccgaacacagtgatggtggttgtattgttttgttggaatgctatgcatgctaagtgaaaattggagctgctagtagtaaaaggaagaatgtcctattaaacttcttttcttttttttttcttatgctgttgacagaaaatgataccttttcatagggtttgtggaactgatttgtatttgattagcattttgttaggcatccattggtggttgcgctggtaagctcttgtttcttgtttatgagaccaacatgatggctggataatgagacatacttcgtttggctaaggttg

SEQ ID NO: 2837 - DNA, 518 bp, Scabiosa columbaria
ttttgggggaggggggagaaccgtattgcggggctgagtctgcttctgcaagtgttggttcttttctatctgagtagactatttttaatcttcatcgaatcatgagcaggtcgggtcaacctccggatcttaagaaatatatggacaagaagcttcagatcaaattgaacgcgaaccgaatggttgttggaacccttcgtggctttgatcaattcatgaacctggtgattgacaacactgttgaagttaatggcaacgagaggaacgatatcggcatggtggttcttaggggtaacagtgtggtcacagtcgaggctttggagccggtcgctagatcgcagtagctactcataagtagttgagttgcagaaaaaggaagagagtaggtattgctgcacatgtttactactgatgatgacaatctctatgtttgttttgtagactgcatttggattcattttgaacaccaagtgaacttagtaattcttgttttatcgttttgaaatttcaatgtaaac

SEQ ID NO: 2838 - DNA, 783 bp, Glycine max
gagtatagcctccgatgttagggtcttgagtgagcgtagttgaggttttgccacttcgaaaccaaattttcttccttcgttggcatctgtgatctcttctcctcacaatgagcagatcagggcaaccaccggatttgaagaagtacatggacaagaagcttcagatcaagctgaatgcaaatcgcatggttgttggtactctccgtggcttcgaccagtttatgaatttagttgttgacaacactgtggaagtgaatggcaatgagaaaaatgacatagggatggtggtaatcagaggaaatagtgtggtcactgttgaggcgcttgaacctgtgaacaggacttgatttctgtggcttgtaaacattctatataagtattttctggttaatggttgtgtatttgaacaatgtagctattgagagtagcttgtaattgtggattgtaagatggtcatgttgaccactcatttgggttctccaggttaaattgttagggaaggatacctatagtgttttagtgtgagggctgtgactagatccaattgaaatgtttacatatatcccttttagctgatttttcctcttctttttatattgcatttagcgtgaaaacttctctcttcctctccatgctctaaagtctaaacttggggttgttgatggagctattagagtttacactaaaatgtatttgtctaaggagtcatagtgtgtgtttggtttgcagttgataactcgcaagcccacgttcaatggaaaatatgaaaaaacttgcttcctg

SEQ ID NO: 2839 - DNA, 709 bp, Glycine max
ggccgggggagcgtagttgaggttttgcttttgccacttcgaaaccaaattttcttcgttcgtccttctgtgatctcttcttccaccatgagcaggtcagggcaaccaccggatttgaagaagtacatggataagaagcttcagatcaagctgaacgcaaatcgcatggttgttggtactctccgtggctttgaccagtttatgaatttagttgttgacaacactgtggaagtgaatggcaatgagaaaaatgacatagggatggtggtaattagaggaaatagtgtggtcactgttgaggcgcttgaacccgtgaataggacttgatttctgtttgttgtaaacatttatatgagtatttcctggttttaacggttgtgtatttgaacaatgtagctatggagagtcacatgtaattgtggatcttaagaagagggtcatgttggccactcatttgggttcttcgggctaaattgttcgggaaggatacctatagtgttttagtgtgatggctgtgactagactcaatcgaaatgtttacgtatatcccttttagccgatttttttctctttttatattgcatttagtgttctcttcctctctatgctctaaagtctaaacttagggtttgtctaaggaatcatattgtgtgtttggtttgcagttgattacttaatggaatagataaaaaagcttgattgattccta

SEQ ID NO: 2840 - DNA, 518 bp, Camellia sinensis
gggggaactcacccacgttttctagggttgggattccaaaacacagcttttctgtctcacgcccgagctcgctctctcctctctcctctctcctctctctaggtttcaccatgagcaggtcaggtcagcctccagatctcaagaaatacatggacaagaagctacagatcaagttgaatgcaaatcggatggtggttgggacactccgtggctttgatcagtttatgaatcttgtggttggcaacactgtggagatgaatggcaatgagaaaactgatataggcatggtggttatcagaggaaatagtgtggtcactgttgaagcgcttgaaccagtaagcagagcacagtgaggttgtactagtattagtggaatgtagccacatactagtatgctttctttaggagaatagagctgctagtgtgggaatgaagaatgtaccaacttcaatgtggcttttggtgtatactagttgtctttgtaaccatgatattataacaatcagtagtttgttgac

SEQ ID NO: 2841 - DNA, 500 bp, Nicotiana tabacum
ggctttagggttgtatttgtatagaccaacgagcggccgctgaacatccaaaaaaacattcagctcgttacctctctgcccctcagtagactcaaagacagaaagaagaaaaaagatgagcagatcgggtcagcctccggatctcaaaaagtatatggacaagcagctccaaatcaagttgaatgccaaccgcctagttgtggggactcttcgtgggttcgatcagttcatgaatttggttattgacaacactgttgaggttaatggcaatgagaagaatgagattggcatggtggttattcggggtaatagtgtggtaacaattgaagcactggagcctgtcgccagagcacagtaatatggatgatgcgatcagtagagggatctttatctttagtaaaagatgttactgctcttttgaaacctaaactacttgtgtattatactgggattaaccagtttttgactatatataagtttgaccgtctatttctcttccc

SEQ ID NO: 2842 - DNA, 603 bp, Utricularia gibba
cgctcggatttgtttctagggtttacgttagcggaaaaccggaatccgaaggacgtcgtcgccatgagcagatcaggacagcctccggatctcaagaagtatatggacaagaagttgcagattaagctgaatgcgaatcgcacggttgtcgggacacttcgtggttttgatcagttcatgaacttggtggtggacaacactgttgaggtgaatggaagtgagaaaactgatattggcatggtggttatcagaggaaacagcgtagtgactgtcgaagctcttgaacctgtcactaaagcacaatgatcccattatgatgtgtgtcttggttcaacctaactatgggatcgtgctgaagctggcgttttacttgtgggcagccactgaaaaactcccttgccatcagttctgtcatttagattgattcctagatgggttttgtacgaatctatggaccgtgcagatcctttgtattgccatccgttaggatgctttccttgagattgtaaggggaaccttcatgttggattaccttgttagctttaggtgattttcatctcactccctagagatttgtttgtcgctgctgttaattttcttgaa

SEQ ID NO: 2843 - DNA, 542 bp, Valeriana officinalis
cttcagtgtaaaaccctcttttatcgccttccaccatgagcaggtcgggccagcctccggatctcaagaagtatatggacaagaagcttcagatcaaactgaatgcaaatcgaatggttgttgggactcttcgcggctttgatcagttcatgaatctggtgattgacaacactgtggaagtcaatggcaatgagaggaatgatatcggcatggtggttctgaggggtaacagcgtggtaacagtggaggctctggagccagttgccagatcccagtagccgatcaaattgtcacattacatttttcatagttgatgcatgtagagtatgatttccaatggatatttccttttgttaagtcttaagagtttactatgtacaaactgaagtgcatgttgttcttggtgaatcaagttgtaatgactttgaatgtggagtactacattatagattctggatactattatggaacctgtttatgcttttttgcttcattacatggatcaaagaagtggcttagactatatgccaagagtttcttaa

SEQ ID NO: 2844 - DNA, 391 bp, Brassica napus
tttcgatctgagagaaaaccctaatctctctccgtctccgtcttctctgattccgcaagtatgagtcgatcaggccagcctccagatctcaagaagtacatggacaagaaactccaaattaagcttaatgccaacagaacggtagttggaactctccgtgggtttgaccagttcatgaatcttgttgtggataacaccgttgaagttaatggtgatgacaaaactgacattggctggtggtgataagaggaaatagcattgtcactgttgaagctcttgagccagttggaagatcttagcttttttattactttgcacgaccagtttctgtattttgacttgagtttactctatgtattggaacttaattagtagactatctatcagcatg

SEQ ID NO: 2845 - DNA, 452 bp, Phalaenopsis aphrodite
tccttgcaaacatgagcaggtcaggccagcctccggatctcaagaagtacatggacaagaagctccaaatcaagttgaatgctaatcgcaccgtagttggcaccttgcgcggattcgaccagttcatgaacctcgtgattgacaacaccgtcgatgtcagcggcagcagcgagaagcatgatatcggaatggtggttataaggggtaacagtgtggtcatgatcgaagcccttgaaccggtaaacagatcacagtaacatctatctatgctggctgctgctgtcttctatttctctcatctctcttttgaactatattttgtactcgttaagtagctttttgcagtgcttctgatttaagcttgatgactatgaactcctttttttaaaaaaaaaaactgatgcttgattgttaaacaggttaatatttttggaaattatgttcgtgtttat

SEQ ID NO: 2846 - DNA, 659 bp, Solanum phureja
gagtcccgactgcgcagcaaaagtacaaattatcttccatttttcatcttcatcttctccggcagtgagcaaaaggtaaaactctcaaggatgagcaggtctggtcaacctccggatctcaaaaagtatatggacaagcagcttcaaatcaagttgaatgcaaaccgcttagtcactggaactcttcgtgggtttgatcagttcatgaatttggtcattgacaacacagtggaaattaatggcaatgataagaatgaaattggcatggtggtaattcgcggtaatagcgtggtgacaattgaagcgttggagccagtcgctagaccacagcagtagctctaacggatctttgtttatgccccagatgctgctgctgctcgtttaaaggaaccttaggaacataagtttgtactgtcatttaactttctcaaaaaaaaaaaaaagtttgtactgtcaggattcagtattcgactagataacagttaagatgacaatggatttctgttttaagtttgatcatcaattctctctattcaattagtgcactatgtgctgattgcagtttgtatgtgttcttgttttttttccaactgataggtgcacgatgtgatgttcccttttaatgctcgaggtaaaaatacttcctcatttgagtttgt

SEQ ID NO: 2847 - DNA, 478 bp, Primula obconica
gtttgcatggtttattatcaggtcaggccagcctccagatctacaaaaagtacatggacaagaagcttcagattaagttgaatgcaaaccggactgtagttgggacgcttcgtggatttgatcaatttatgaatcttgtgattgacaacactgtggaggttaatggagatgataaaactgacataggcatggtggtcattagaggaaacagtgtggtgactgtcgaggcacttgaaccagttccgagaacacagtgatgctttatggtattggtaaattggaatgtaaaacttgtttactttattctcttttgagagagcagatctgtttgtactgaaatgtagaatgtttggtctttagatcattttttcaggagttgattgaagaagtgtctacttttagactgccttatgtaaaattgattgaagcattctccattacctgttaattttcattattttccacttgcccctaaaaa

SEQ ID NO: 2848 - DNA, 768 bp, Amborella trichopoda
tattagtcgttcgcagtgtcgagcagaccttggggttttaggaattagggttttggtctctctccctctccttacagtgtcgagcagaagttagggtttaaggaataagggtttttggcctctctcaccatgagcaagtcagggcagccaccggatctcaagaagtacatggacaagaagcttcacattaaactcaatgcaaaccgagtggtggttggcactttgcgtgggtttgaccagttcatgaacctggtgattgataacacggtggaagtcaacggcaacgagagaaatgatatagggatggtggtaatcaggggtaacagtgtggttatgattgaagctcttgaaccagttagcaagacccaatagtggaatcttgctttgattttggcaatgtgttaaagtagaactggggtacagcagggggttgtgtagactatacttgcagtgctatacatctttaggctgcagttctttaaggctttggtattgctttagccagttaaaactgtgtaatgcttgataatattttctcttgaatacatgtgctttttcatgacttgaatcgaaatctatcgattgtcgttcgaatgtgtttcatgctttgattgaaactccctatctttaccactctagtttatctcttgtttcattttgggtacataagcatggtttagaacctttgacctaagtcgagagacaagtccaggccattaagtcgtgggcttccaccccatgttctctcatgaatccatatacttctca

SEQ ID NO: 2849 - DNA, 569 bp, Brassica juncea
aaaacctaaaccccaagctcaaattcggattctgcagctatgagtcggtcaggtcagcctccggatctcaagaagtacatggacaaaaaactccaaatcaagcttaatgctgaccgaatggttgttggaactcttcgtgggtttgaccagttcatgaatcttgttgtggataatactgttgaggtgaacggtgatgtcaaaaccgacattggaatggtggtgattagaggaaacagcattgtcaccgtggaagctcttgaaccagtgggcagatcttcttagctccgtatatgcttccagtaatcatctctttgtactaagcacttagttttattttttgttattcgctgtttaagaaaacttggtggtggatttgcagttattgttaacttgttaagtgaccagtaaggaatctacatgattactctttcttgtactaaaactttgcgatgaaccccaagaatgtgatagataagcggatttctcttatctttttgtgtgtttatccttgctttttaaaaagaaatctcaaacaatagatgcagattacttttctaaaattttggtgc

SEQ ID NO: 2850 - DNA, 510 bp, Vaccinium corymbosum
ttggttttaaccatgagcaggtcaggccagcctccagatctcaagaaatacatggacaagaagctacagatcaagttgaatgcaaatcgaatggtagttgggacactccgtggttttgaccagttcatgaatcttgtgattgacaacacggaggaggtgaatgggaatgagagaaccgacatcggcatggtggttattagaggaaatagcgtggtcactgttgaagcgctcgaaccagtaaccagagcacagtgatttcggagtgtattgttctggtagactgacatgcatttttattcaatatgactgtattaatatgactgaagaatgtgattttagaagatatttttggtgggtttctttgtagacagactgtcatcctttccataattccatttaataagaagcactagtttgttcaatctagaaccgagtagcaactgtgaaataaatgtcacggtggcactgaagcttgttaacttgcgctggattgtcaggtcatttgatgat

SEQ ID NO: 2851 - DNA, 561 bp, Bupleurum chinense
ttttcagggttttgcgagagtccatccgtctccgctctccattcttaaatttgtgccctaattttcccaatttcttcagccgttaaagatgagtcgctccggccagcctccagatctgaaaaagtatatggacaagaagcttcaaatcaagatgaatgctaaccgcatggtagttgggacccttcgtggttttgatcagttcatgaacctggtgattgacaacactgtggaagtgaatggcgacgagagaaatgatataggcatggtggttattaggggaaatagtgtggtcactgttgaagcacttgagccagtaagcagaggacagtagctgcgactttaaatatgtatggaaatgtttctagtatttgaagagacacttttaagagtggaccatttgatgcaaaactcatgtacaagggcagaccatttgagggtgaattttatgggatgatttttgacctatctcttggttgatattgtaatcgtaatcaatatcatgtctagataattgtattgtgttggctgaactttgattgaatatggagtgattctaacctt

SEQ ID NO: 2852 - DNA, 605 bp, Catharanthus roseus
  misc_feature (26)..(26): n is a, c, g, or t
  misc_feature (544)..(544): n is a, c, g, or t
gtggatccaaagaattcggcacgagnctttctcccggtgtttcctctgagagtatactgtcttcccaccgattttcaccatgagtcgatcaggccagcctccggatctcaagaaatatatggacaaaaagctacagattaagctgaatgctaatcgcatggtagttggaacacttcgtggtttcgatcagttcatgaacttggtggtggacaataccgtggaagttaatggcaacgagaagaatgaaataggcatggtggttatcagaggaaatagtgttgtaaccgttgaagcacttgatccagttgggagaacacagtgattctcgtttgtattaagggttaattgtaacatttgatgggatgttattttggacagagatcctggtagtatcgaatcgaaaacttattagatattattagtgtatttggtctctgttgctctttcattttcaatttttgttacgggaggtgaatcaatgatgagatgtatttatcgtcattcaatcaatctatgaatgttgcaaatttatgcccagtaaggntgtatatgaatgaatatccagtggacttatttgggtttggaaattgcattttctctcaaaa

SEQ ID NO: 2853 - DNA, 562 bp, Helianthus annuus
aaccactacgcgcgataaacctcacaaaatttctctaatttcgtttagtcatcgttttcactctctctctagggtttcgccatgagcagatcaggtcagccgccagatctcaagaagtacatggacaagcaactacagatcaagctgaatgcgaatcgaacagtggtgggaacacttagggggtttgatcagttcatgaacctggtgattgacaacacagtggaagttaatggtgatgacaaacatgatattggcatggtggtcataagagggaatagtgtggtcactgttgaagcgctcgagccggtcagcagaggccaatgattcccgactcgtattggtatggttctggtgtattgtgtggctggttttgtaattctgagaactattatggtggtaattgatgtttaacttcatagcttgctgtgacttccgtgtataaatttgaccataaaaacataataactggtgttcaagctgaattgcatggtcaaatgcacattcggttgttggtcattatgaatcttgcaaacactcggatgaccttcctgatccaaatcgt

SEQ ID NO: 2854 - DNA, 675 bp, Abies balsamea
gatatagggtctacccgcagaggtgttcttctccacggaaggttttttaagggttgtgctgataggcaacagcgttgctattcagacgctgagctatcagagtttcgattcagacgcagccactcttttcaagtttttgattgtttttccccctctctaagaggcatcatgagcaggtcagggcagcccccagatctcaagaagtacatggacaagatgctcaacattaagttgaacgccaacagagtggtgatcggcaccttacgaggatttgaccagttcatgaatctagtcctggatggtactgtagacgtaaatggcaatgaaagaaatgagataggcatggtggtcatcagagggaacagtgttgtgatgattgaagctttggaaccggtcaataggtcacaataatttatttcgactcctttttatgtttgagagattcatgggtacagaacttttgtaagcgatgcaacatttgttaaaatgttccagtaaatgattagtaagcctagcattttttgcaaggttttattttgaatggatctcatgaacaaagcatgaaggagagttttccttcaccttttcttatgcatttgagacttagaagatagtttatataactgcatgtgaagatggcagcaatgtagacaactgaactttacagtgtacttt

SEQ ID NO: 2855 - DNA, 443 bp, Ambrosia trifida
aatcttcgttgtatcaaattctagtgtttcaatatgagcagatccggtcaacctccagatctcaaaaagtatatggacaagcaattgcaaatcaagctgaatgcaaatcggacagtggttgggacgcttcgtggttttgatcagttcatgaaccttgtcattgacaacacagtggaagtgaacggtgatgagaaaaatgatattggcatggtggttataaggggtaatagtgtagtaactgttgaagctctagagccagtcgcaagggcacagtaaacattgttatgttgcggacttattagggtattatcgcttttatgctgtttgtatccaccaaacgaatctaatgcgttatttggtacaaacacgtgatatacttattcagacttgtagaattttatgcatttaaatttcggttcaatgtcgattttatggttttttca

SEQ ID NO: 2856 - DNA, 699 bp, Manihot esculenta
gagcatctcctccgtttctctttcccactctctgcttcttcgccagtcgcaaagcacgctccgtcaaggcaactcatcatgagcagatccggccagcctccagatctcaagaagtacatggacaagaagcttcaaatcaagctgaatgcaaataggatggtagttggaacacttcgtggatttgatcaattcatgaatttggtggttgacaacactgtggaggtgaatggtgatgagaaaaatgacataggcatggtggtaatcagaggaaatagtgttgttactgttgaagctctagagcctgtaaacagagcaatgtgataattgtgttgtggtagtaatgatctatttagtataaactcatgtattttgcctgatatggttattgtgggacgcaaatcggtctgtatgcatagatggaaggcaatataggccttttaaatttcggtatcaacaatcgtatgccttctggaattacttgatacttcgcttttaagtagcagacactttgattacgaaatatggctgaggccatttggctattgctagagcccgtaccgaatttgcctcgctgaaaaatcttatttttctgatgatatgcagttcagaggcattgaattatgttgtctttcctttgaggaaaaaattttatgctgtcctttttggtaatttaattcctccacttgatgattgcctggc

SEQ ID NO: 2857 - DNA, 551 bp, Catharanthus roseus
cgtctttctcccggtgtttcctctgagagtatactgtcttcccaccgattttcaccatgagtcgatcaggccagcctccggatctcaagaaatatatggacaaaaagctacagattaagctgaatgctaatcgcatggtagttggaacacttcgtggtttcgatcagttcatgaacttggtggtggacaataccgtggaagttaatggcaacgagaagaatgaaataggcatggtggttatcagaggaaatagtgttgtaaccgttgaagcacttgatccagttgggagaacacagtgattctcgtttgtattaagggttaattgtaacatttgatgggatgttattttggacagagatcctggtagtatcgaatcgaaaacttattagatattattagtgtatttggtctctgttgctctttcattttcaatttttgttacgggaggtgaatcaatgatgagatgtatttatcgtcattcaatcaatctatgaatgttgcaaatttatgcccagtaaggctgtatatgaatgaatatccagtggacttat

SEQ ID NO: 2858 - DNA, 651 bp, Citrus sinensis
  misc_feature (576)..(576): n is a, c, g, or t
  misc_feature (603)..(603): n is a, c, g, or t
  misc_feature (605)..(605): n is a, c, g, or t
  misc_feature (610)..(610): n is a, c, g, or t
  misc_feature (612)..(612): n is a, c, g, or t
  misc_feature (619)..(620): n is a, c, g, or t
  misc_feature (624)..(624): n is a, c, g, or t
  misc_feature (627)..(627): n is a, c, g, or t
  misc_feature (632)..(632): n is a, c, g, or t
  misc_feature (635)..(637): n is a, c, g, or t
  misc_feature (642)..(642): n is a, c, g, or t
  misc_feature (645)..(645): n is a, c, g, or t
  misc_feature (650)..(650): n is a, c, g, or t
gccggggtcttttccaattatcgctcgctgcagctcactcgctttgctttcttccttgcttttcctctgaaacgatccgctaagcttcgacaatgagcagatcaggccagcctccggatctcaagaagtacatggataagaagcttcagatcaagctcaatgctaataggatgattgttggaacacttcgtggatttgatcagtttatgaatcttgtgattgacaacacagttgaggtcaatggcaatgagaaaaatgatatagggatggtggttatcagagggaatagtgtagtcactgttgaagcccttgaacctgtaagcaaatcacagtgacgtggtttgccactggggtcgatgtaatgtgctttctgatcttcgttgtgtactattatgaatattaaggctgttagtgtgcaatgggagatgtttcatgctgtggtactggtacctgagaaaattaggccattttctttgtaatgcttattctaagggagctcgttttgaacaggtaattagaattaatcattgaatgaccaacggaatgaatcagcaaagatttaacacttcgatacanaaaaaaaaaaaaaaaaaaaaaaaaaananaaaananaaaaaannaaanaanaaaanaannnaaaanaanaaaana

SEQ ID NO: 2859 - DNA, 562 bp, Citrus sinensis
tcttttcacaattatcgctcgctgcagctcactcgctttgctttcttccgtgctttttctctgaaacgatccgctaggcttcgacaatgagcagatcaggccagcctccggatctcaagaagtacatggataagaagcttcagatcaagctcaatgctaataggatgattgttggaacacttcgtggatttgatcagtttatgaatcttgtgattgacaacacagttgaggtcaatggcaatgagaaaaatgatatagggatggtggttatcagagggaatagtgtagtcactgttgaagcccttgaaccggtaagcaaatcacagtgacgtggtttgccactggggtcgatgtaatgtgctttctgatcttctttgtgtactattatgaatattaaggctgttagtatgcaatgggagatgtttcatgctgttgtacctgagaaaatttaggccattttctttgtaatgcttattctaagggagctcgtttgaacaggtaattagaattaatcattgaatgaccaatggaatgaatcagcaagatttaacacttcgaaaaa

SEQ ID NO: 2860 - DNA, 569 bp, Citrus clementina
aaaccctcttttcacaattatcgctcgctgcagctcactcgctttgctttcttccttgcttttcctctgaaacgatccgctaagcttcgacaatgagcagatcaggccagcctccggatctcaagaagtacatggataagaagcttcagatcaagctcaatgctaataggatgattgttggaacacttcgtggatttgatcagtttatgaatcttgtgattgacaacacagttgaggtcaatggcaatgagaaaaatgatatagggatggtggttatcagagggaatagtgtagtcactgttgaagcccttgaacctgtaagcaaatcacagtgacgtggtttgccactggggtcgatgtaatgtgctttctgatcttctttgtgtactattatgaatattaaggctgttagtgtgcaatgggagatgtttcatgctgtggtactggtacctgagaaaattaggccattttctttgtaatgcttattctaagggagctcgtttgaacaggtaattagaattaatcattgaatgaccaacggaatgaatcagcaaagatttaacacttcg

SEQ ID NO: 2861 - DNA, 536 bp, Cleome spinosa
aggtgagagactcgtcgtcgtccaacccgcgaaaccctaatctctcatttcttcggtttctgccaccatgagccgatcaggacagcccccggatctcaagaagtacatggataagaaacttcaaatcaagctcaacgctaaccgtatgattgtcgggactctccgtgggttcgatcagttcatgaatcttgttgtggacaacaccgtggaagtgaatggtaatgagagaaccgatatcggcatggtggtgataaggggaaacagtgttgtcacagttgaagctcttgagccagtgggcaaatcttaaagctttatttatgtccatcggtaatcatctttttgtaatatgcactctcctttccttcctctgctgcctgtaacggaacctagttgaatttcggaattaactgacgataatgaaccttgtctgcgttccaagacatcggtatgaaccccttattaaacattctgattagttggatgtagatactaatcacatgatcataatgctagcggaattgttaccgttctctccg

SEQ ID NO: 2862 - DNA, 446 bp, Cucurbita pepo
tctttcgttcgctctacaccatgagtagggcaggccagcctccggatctcaaaaagtacatggacaagaagctccagataaaactcaattccaatcggttggtagttggaactcttcgtgggtttgaccaatttatgaatctagtggttgacaacaccgtggaagtgaacggcaacgagaaaaatgatattggcatggtggtgatcagaggcaatagtgttgtcaccgttgaagcacttgaacctgtaaacagaatgcaatgatggtggatgttgaaatttagctgaatctgtttatagattgagcgggtaaatcgttcggaactgtagtatgtataattttgtgatgttatggattttagatggaattattgtaccccattctggacaggcggattataagttcaaacaataggatttctgtattattgtgggagaaattcattg

SEQ ID NO: 2863 - DNA, 532 bp, Cucurbita pepo
cgtctctttcgttcgctctacaccatgagtagggcaggccagcctccggatctcaaaaagtacatggacaagaagctccagataaaactcaattccaatcggttggtagttggaactcttcgtgggtttgaccaatttatgaatctagtggttgacaacaccgtggaagtgaacggcaacgagaaaaatgatattggcatggtggtgatcagaggcaatagtgttgtcaccgttgaagcacttgaacctgtaaacagaatgcaatgatggtggatgttgaaatttagttcaattcttgctgaatctgtttatagattgagcgggtaaatcgttcggaactgtagtatgtataattttgtgatgttatggattttagatggaattattgtaccccattctggacaggcggattataagttcaaacaataggatatctgtattattctgggagaaattcattgcattttgttagatcttctcacgaaacctttcgttcttctctgcttcagcatcaatgtccatgaacattgca

SEQ ID NO: 2864 - DNA, 682 bp, Euonymus alatus
gagactgcttacacgaggcccataggcattctctccaattcgttctctagggttttgaacttgcgatctctgctgcaaaacccctttctatctgccactcattctctactcaagtacaattacaaaccatgagcagatcagggcagccaccagatctcaagaagtatatggataagaagcttcagatcaagcttaatgcaaaccggatgattgttggaacacttcgtggatttgaccagttcatgaatttggtgattgacaacactgtagaggtgaacggcaatgagagaaatgaaataggcatggtggtgatcagaggaaatagtgttgtcacggtagaagctcttgaacctgttgcgagatctcagtgatgcatgttgcatatgagtatcagtcagatgtactcctaactcttattttcgaagatatttctgctagcatgtgatgaatgggtagtattgctattatggatcttaggtggattcactcttcagtgcattttaagctttctacatttatctgttccaagttggccttgttaaatataaaaatactaattgtatggcttaggtttgactcctaatggttattttatatccttgggtttctgcttttgagtttaatgttgaacagatactaagcatattcgactattcgtactgaaatctggcgatgagtagtc

SEQ ID NO: 2865 - DNA, 695 bp, Euonymus alatus
gcttacacgaggcccataggcattctctccaattcgttctctagggttttgaacttgcgatctctgctgcaaaacccctctctatctgccactcattctctactcaagtacaaattacaaaccatgagcagatccgggcagccaccagatctcaagaagtatatggataagaagcttcagatcaagcttaatgcaaaccggatgattgttggaacacttcgtggatttgaccaattcatgaatttggtgattgacaacactgtagaggtgaacggcaatgagagaaatgaaataggcatggtggtgatcagaggaaatagtgttgtcacggtagaagctcttgaacctgttgccagatctcagtgatgcatgttgcatatgagtatcagtcagatgtactcctaactcttattttcaaagatatttctgctagcatgtgatgaatgggtagtgctattatggatcttaagtggattcattcttctgtgcattttaagctttctacatttatatctgttccaagttggccttgttaaatatagaagtactaattgtatggcttaggtttgactcctaatggttattttatatccttgggtttctgcttttgagtttaatgttgaacagatactaagcatattcgtactgaaatctggcgataagtagtcatgcgtatccaaaaaaaaaaaaggccg

SEQ ID NO: 2866 - DNA, 530 bp, Fraxinus spp
ctccggctagggttttaaacatgagcagatcaggccagcctccagatctgaagaagtatatggacaaaaagccgcagatcaagctgaatgctaatcgaatggtagttggaacacttcgcggttttgatcagtttatgaaccttgtggtggacaatactgttgaagtgaatggcaatgagaaaaacgaaattggcatggtggtcataaggggaaatagcgtagtcactgttgaggcacttgagcccgttagtagaccacagtaattgtcattcgcaatggtgtagattcatgtaacttgtagcatatcgatatttcagacacagaagctttatgataccccaaaagagcctgatcttagatttacttaaaatatgttatgagaattatcacttcaatattcggtatttaatggctccttggtatttaggagatctcatgatgtttatattcttctcgattatgcacagtgatttgtggcattatttgcaccttttgttttcaatatttgcaaatggttacttaataattct

SEQ ID NO: 2867 - DNA, 617 bp, Mesembryanthemum crystallinum
gtcgacaattcccgccggtgaaacaaaaccctcactttctctctctacctctttctctttctctctctagggttcaacgatgagcagatcgggccagcctccagatctcaagaagtacatggacaagaagcttcaaatcaagctgaatgctaatcgcatggtgattggcacacttcgtggattcgaccagtttatgaatctggtgattgacaacactctggaagtaaatggcaatgagaaaactgatataggcatggtggttattagaggaaacagcgtggtcacagttgaggctctcgaaccagttaaacaaaattagtgtatgcctatgtaaataatgctagatgcagaaccatcaggtttgcgaggtcatatcagatttgctttggagggtggtttgaagattatggctggtggtaagggaggaagatgttatcaagttgtatgttaatcatgtttttactttcatctttactgggttgctcattctggagcgttttcgttgttctgctatgacattcggagcagcttggatttccaaccctcatttctgtattaaaatgttgtgcttttcttagtattctgcttttagtgcaatatcaagtactggttgcttc

SEQ ID NO: 2868 - DNA, 486 bp, Jatropha curcas
acgcggggctgcttctctctttctcgctcgcaagcaaggcagtcaatccaagccattgaagccgttcaacatgagcagatcaggacagccaccagatctcaagaagtacatggataagaaacttcaaatcaagctgaacgcaaacaggatggtggtcggaacacttcgtggatttgatcagttcatgaatttggtggttgacaacactgtggaggtgaatggtgatgagaagaatgacataggcatggtggtgatcagaggaaatagtgttgtcaccgttgaagcgctagaacctgtaaacaaaacacagtgattatggctttttattagtgctaatgacatagcttcgagcgctgtattttggctaatatggctacttgtagttattggatgtaagtgattctaaatttgcagatgcgagaaagcgtggacctattagtttactggtacttttgattgctagaaatatatgagctttctatttta

SEQ ID NO: 2869 - DNA, 1232 bp, Pinus pinaster
tacttatctgactttgtatataatgtaattgtgttctgagttaatatttagttgcctccccaccgggttcggcccactatacatgtatgcgctgccatcgtagctattgtacttatctgactttgtatataatgtaattgtgttctgggttaatataaagcttcacaaagagacttcccctcgtttaaaaaaaaaaactgttttataccaattaaaataaacaaattcaattgattattatataaatatataacatttaagccagtattcccctttgattgcgccaaggtttagggtttaactgtggaggaaaacccctccccatcctttcgaggcaaacggagttcgactaactagtctttccactcgcgaggaaggtattacaggtgagcgtgaggttccaaagttgcctccgatgattcaaccactcgaggaaatcctctgtcttgcttttgttacttttccagcctaggtctgaggattgttcacacgttgctgctcgtttttttgtttgtgctttttctctcttaagaggcattatgagcaggtcagggcagcccccggatctcaagaagtacatggacaagaagcttaacataaagttgaacgccaacagagtggtggttggtactctacgaggatttgaccagttcatgaatttagtcctggatggtactgtcgaagtaaatggcaatgaaagaaatgagataggcatggtggtcatcagagggaacagtgttgtgatgattgaagctttggaaccggtaaataggtcataataatttattttgaaaccttttcatgtttgggagattcatgggtacataacttttgtaagcaatgcaccatttgttaaaatattcctgtaaatgattagtaagcctagcaatttttgtaaggttttattttgaatggatgttatgagcaaagtatggagagtattcttcccccttttttatgcttttaggagttagaagatggctgaaatagctgcacgggaagatggcagcagtgtagacaactgaatttcacaatgtagtttattttcttgatatagtaaccacatcctaacatgttgtttaatagtgacatcaattcttattggctgtgaatgcttttagatggttggaacaatttgccttctattaaggcttcataagtttgtgtgtgcaatgttctcagctagcattctgatgatgttatataatgtaggtcctttatttacaaaaaaa

SEQ ID NO: 2870 - DNA, 671 bp, Medicago truncatula
gttgtggtttagaaataggaagtattcaatgtgtgtgtaaataggaagtattcaatgtcaaaaagcaattttccttcaaataaattctcaaaagttagggttgtggtttagaaatttttgaacgagtaccctccaaatcatcttcgttctacgtttgttctttcaattcctgaattcaccatgagtaggtcagggcagccaccagatttgaagaagtacatggacaaacagcttcaaatcaagctgaatgcaaatcgcatgattgttggtactctccgtggcttcgaccaatttatgaatttggttgttgacaatactgtggaggtgaatggcaatgagaaaaatgacatagggatggtggtgatcagaggaaatagtgtggtcactgtagaagcgcttgaaccagtgaacagaagcatctaatatctgtttattgtaaacatttataagtaaatttcaaggtttcaacagaaaccgcttaggtgctgggagtaaaatgtaattgtgggttgtaatatggtcatcttagcgagaaatctgaggttcttttctggttggtttgtgagtgctggatgcatttagggttgtagtggatggtaatggcttaactaaaatgatgttaatgcatgtcctttttagtttttagttgaaatcacatttctctattgcat

SEQ ID NO: 2871 - DNA, 713 bp, Medicago truncatula
gttgtggtttagaaataggaagtattcaatgtgtgtgtaaataggaagtattcaatgtcaaaaagcaattttccttcaaataaattctcaaaagttagggttgtggtttagaaatttttgaacgagtaccctccaaatcatcttcgttctacgtttgttctttcaattcctgaattcaccatgagtaggtcagggcagccaccagatttgaagaagtacatggacaaacagcttcaaatcaagctgaatgcaaatcgcatgattgttggtactctccgtggcttcgaccaatttatgaatttggttgttgacaatactgtggaggtgaatggcaatgagaaaaatgacatagggatggtggtgatcagaggaaatagtgtggtcactgtagaagcgcttgaaccagtgaacagaagcatctaatatctgtttattgtaaacatttataagtaaatttcaaggtttcaacagaaaccgcttaggtgctgggagtaaaatgtaattgtgggttgtaatatggtcatcttagcgagaaatctgaggttcttttctggttggtttgtgagtgctggatgcatttagggttgtagtggatggtaatggcttaactaaaatgatgttaatgcatgtcctttttagtttttagttgaaatcacatttctctattgcatgatataacagttatcacattctttctgtgctctttaatcgat

SEQ ID NO: 2872 - DNA, 570 bp, Citrus sinensis
aaaccctcttttcacaattatcgctcgctgcagctcactcgctttgctttcttccgtgctttttctctgaaacgatccgctaggcttcgacaatgagcagatcaggccagcctccggatctcaagaagtacatggataagaagcttcagatcaagctcaatgctaataggatgattgttggaacacttcgtggatttgatcagtttatgaatcttgtgattgacaacacagttgaggtcaatggcaatgagaaaaatgatatagggatggtggttatcagagggaatagtgtagtcactgttgaagcccttgaacctgtaagcaaatcacagtgacgtggtttgccactggggtcgatgtaatgtgctttctgatcttcgttgtgtactattatgaatattaaggctgttagtgtgcaatgggagatgtttcatgctgtggtactggtacctgagaaaattaggccattttctttgtaatgcttattctaagggagctcgttttgaacaggtaattagaattaatcattgaatgaccaacggaatgaatcagcaaagatttaacacttcg

SEQ ID NO: 2873 - DNA, 558 bp, Orobanche aegyptiaca
tttttttttttttttggtctctgaaattctagggtttttggaagagtaataaaacccaaaacgagaatcccttttctatatctctagaaattcgccatgagcagatcgggacagcctccggatcttaagaagtacatggacaagaagctacagataaagcttaatgccaatcgcatggtggtgggtacccttcgtggttttgatcagtttatgaacatggtgatagacaatactgttgaagtgaatggaactgagaaaacagacataggcatggtggtccttagaggaaacagtgtggtcactgtagaagctcttgagcctgttatcagatcacaatagctgtacatgtttgttagttgattaattcttcgtgtgatgagattaaatggtgatgccgtactgtataattgcaaattaattgcaaagtttctacagtgcttgaacaactttgttgtctgtatttcttgacattgtctcgattttgaactactacttgttctgctatattgtagtgtttacgttttgcgtatctaaaatgattattaattttaacaaagt

SEQ ID NO: 2874 - DNA, 616 bp, Cajanus cajan
aaagtgagaggttttggttcccaaaaacctaatttcgtatttcgttgatcgctgttatctcatcaacatgagcaggtcagggcaaccaccggatttgaagaagtacatggacaagaagcttcagattaagctgaatgcaaatcgcatgattgttggtactctccgtggctttgaccagtttatgaatttggttgttgacaacactgtggaagtgaatggcaatgagaaaaatgacattgggatggtggtaatcagaggaaacagtgtggtcactgttgaagcgcttgaacctgtgaacaggacttgatttatatttcctgtaaacatgtataagtatattttctggttttaacggttatgtatttgaacattgtagctattgagagtaacatgtaattgtggcacttaagaggttcatgtcatgctggcactaatttggggttctaaattgtcagggatccacctctagtgttttagtttgatgtctgtgacttgactcattttgaaatggttacatatatcccttttaggtggtttcttctcatcttctatattacatttttcgtgaaaacttctcatcataatgggtaaagctctatgtgatcacactcatatt

SEQ ID NO: 2875 - DNA, 938 bp, Pinus taeda
gtggttattaaacaaaccattcacactcaactataaatgccaaagctttctaaaattttgaaacaaatggcagtggaagcatataatgccaaagctttctaaaattttgaaacaaatggcagtggaagcatataatgccaaagctttctaaaattttgaaacaaatggcagtggaagcatcagcgttgctatattgagtacgctaccgagtttcggttcagtcgttgctgctcattttttgtttgtgcttttcccctctgaagaggcatcatgagcaggtcagggcagcccccggatctcaagaagtacatggacaagaagcttaacataaagctgaacgccaacagagtggtggttggtactctacgaggatttgaccagttcatgaatttagtcctggatggtactgtagaagtaaatggcaatgaaagaaatgagataggcatggtggtcatcagagggaacagtgttgtgatgattgaagctttggaaccggtcaataggtcataataatttattttgaaaccttttcatgtttgggagattcatgggtacataacttttgtaagcaatgcaccatttgttaaaatattcctgtaaatgattagtaagcctagcaatttttgtaaggttttattttgaatggatgctatgagcaaagtatggagagtattcttcccccttttttatgcttttaggagttagaagatgctgaaatagctgcacgggaagatggcagcaatgtagacaactgaagttcacaatgtagtttattttcttgatatagtaaccacatcctaacatgttgcttaatagtgacatcaattcttattggctgtgaatgcttttagatggttggaacaacttctattaaggcttcataagtttgtgtgtgcaatgttctcagctagcattctgataatatataatgtaggtcc

SEQ ID NO: 2876 - DNA, 828 bp, Pinus taeda
aaaaacccctccccatcctttcgaggcaaacggagttcgactaactagtctttccactcgcgacgaaggtattacaggtgagcgtgaggttccaaagttgcctccgatgatccaaccactcgaggaaatcctgtgtcttgcttttgtttcttttccagcctaggtctgagggttgttcacacgttgctgctcattttttgtttgtgcttttcccctcttaagaggcatcatgagcaggtcagggcagcccccggatctcaagaagtacatggacaagaagcttaacataaagttgaacgccaacagagtggtggttggtactctacgaggatttgaccagttcatgaatttagtcctggatggtactgtcgaagtaaatggcaatgaaagaaatgagataggcatggtggtcatcagagggaacagtgttgtgatgattgaagctttggaaccggtcaataggtcataataatttattttgaaaccttttcatgtttgggagattcatgggtacataacttttgtaagcaatgcaccatttgttaaaatattcagtaatgattttgcctagcaatttttgcaatgttttattttgaatggatgttatgagcaaagtatggagagtattcttcccccccctttttatgcttttaggagttagaagatggctgaaatagctgcacgggaagatggcagcaatgtagacaactgaatttcacaatgtagtttattttcttgatatagtaaccacatcctaacatgttgcttaatagtaacatcaattcttattggctttgaatgcttttagatggttggaacaatttcctt

SEQ ID NO: 2877 - DNA, 882 bp, Pinus taeda
aaggtttagggtctaactgtggagaaaaacccctccccatcctttcgaggcaaacggagttccactaactagtctttccactcgcgacgaacgtattacaggtgagcgtgaggttccaaatttgcctccgatgattcaaccactcgaggaaatcctctgtcttgcttttgtttcttttccagcctaggtctgagggttgttcacacgttgctgctcattttttgtttgtgcttttcccctcttaagaggcatcatgagcaggtcagggcagcccccggatctcaagaagtacatggacaagaagcttaacataaagttgaatgccaacagagtggtggttggtactctacgaggatttgaccagttcatgaatttagtcctggatggtactgtcgaagtaaatggcaatgaaagaaatgagataggcatggtggtcatcagagggaacagtgttgtgatgattgaagctttggaaccggtcaataggtcataataatttattttgaaaccttttcatgtttgggagattcatgggtacataacttttgtaagcaatgcaccatttgttaaaatattcagtaatgattttccctagcaatttttgcaatgttttatcttgaatggatgttatgagcaaagtatggagagtattcttccccccccctttttatgctttaaggagttagaagatggctgaaatagctgcacgggaagatggcagcaatgttgacaactgaatttcacaatgtagtttatttgcttgatatagtaaccacatcctaacatgttgcttaatagtaacatcaattcttattggctgtgaatgcttttagatggttggaacaatttccttatattaaggcttaataagtttgtgtgtgc

SEQ ID NO: 2878 - DNA, 585 bp, Platanus occidentalis
agcaaacgcgcgccgtaaagacccttcgttagagcatagtttttttgggggtttagggttttgagaagtatctctatctgcatccaccatgagcaggtcaggtcagcctcccgatttgaagaagtacatggataaacagcttcagattaagctgaatgcaaaccgggttgtggttgggacactgcggggattcgatcagtttatgaatctggtgatagacaacactgtggaagtgaatggcaatgagaaaaatgaaatagggatggtggttatcaggggcaatagtgtagttatgattgacgcactagagccagttagcaaagcgcagtaattgcagtttggtgaggatgctgatttaagtatgttttggatgatataattgctagaatggaaaggaaggtcttgtgtaaattgcatactagatggaagttggacgagatttctattcacatcttcctgtggcctttggttcgatgatttttgttgttttgacatgatgactagatgtattgatagaaaacattaggcttattgtattgctcaagatgatggtgggaacccagttattaatagaccaaatgatca

SEQ ID NO: 2879 - DNA, 572 bp, Platanus occidentalis
tggcaccctgactgatttcctcgagcctacaggcttccgggcgttctgtgcactgaatttttttcgttagaaacagcctgtttggggtttagggttttgagaagaatctatctctgtccatcatgagcagatcaggtcagcctccagatctgaagaagtacatggacaagcagctgcagatcaagctgaatgcaaaccgggttgtggttgggacccttcggggattcgatcagtttatgaatctggtgattgataacaccgtggaagtgaatggcaatgagaaaaatgaaataggaatggtggttatcaggggcaatagcgtggttatgattgatgctttagagccagttagcaaagcacaataatcacaagttgcgctatttggtgagggtgctgattcactgtatcattggcaagtatgttttagattatataacttgtagtatggaaggtgttttgtaattgcaatttagatggaagttgttgagcttttcatttactttcttttaatggctttaggtgggatgattaattggatatattattagtgagcaccattaggctaaatttat

SEQ ID NO: 2880 - DNA, 785 bp, Pseudotsuga menziesii
ggagatgaaagctttcattaaacgaacttttcacactgacgaactttataaatacgaagttatttaaaattttgaatacaaatagcagtgtgggcaccagcgttgcaatcttgagcgcgctaccagagagttggttcagacgtaaccacactttttaagtttttgatttcgctttcttctctccgagaggcatcatgagtaggtcagggcagcccccggatctcaagaagtacatggacaagaagcttaacataaagttgaacgccaacagagtggtggtcggtactcttcgaggatttgaccagttcatgaatttagtcctcgatggtactgtagaagtaaatggcaatgaaagaaatgagataggcatggtggtcatcaggggaaacagtgttgtgatgattgaagctttggaaccagtcaataggtcatcataatttattatgatgcctttttatgtttgagatgttcatgggtacagaacttttgtaagcgaagcaccgtttgtaaaatgttccagtaaatgattagtaagcctagcaaattttgcaaggttttattttgaatggttgtcatgaacaaattatgaaggagagaattcctccccttttcttatgctcttcggaattagaagataacttcaatagttgcacgggaagatggcagcaatgtagacagctgaacttcacaatgtacattatttgcttgatatagtaaccacatcctagcatgttgctcaatatgtattatgaacatcaattcttaatggctgtgtatgctattat

SEQ ID NO: 2881 - DNA, 471 bp, Scabiosa columbaria
gtgttttatgagaatacagagtttcgtcttgctgaagctgtttcttctgtgtgtaagctttgtagcctctcttcatccgccattttcagtcatgagcaggtcgggtcaacctccggatctcaagaagtatatggacaagaagctacagatcaaattgaacgcaaatcgcatggttgttgggacgcttcgtggctttgatcaattcatgaatctggtgattgacaacactgttgaagttaatggcaatgagaggaatgagattggcatggtggttctcaggggtaacagcgttgtcacagtcgaagctttagagccagtcgctagatcgcagtagctactcaaatgaattgcagtagatgagtagcttaaagacgaagggagtaggtactgctgcggattgacaattactatgaacgttttgtaaaaccgaatttggatttatttgcaacactttgtttgaacttgtagtct

SEQ ID NO: 2882 - DNA, 390 bp, Sesamum indicum
ctaattctagggttttgaagcgcgataaacccagaaatcgcttttcacgctctctctaggatttcgccatgagcagatcgggacagcctccggatctcaagaagtacatggacaagaagctacagataaagcttaatgccaaccgtatggtggttggaaaccttcgcggttttgatcaattcatgaaccttgtggttgacaacactgttgaagtgaatggaaacgagaaaactgacataggcatggtggtcattaggggaaaaagtgtggtgacagttgaagcccccgagccagttaatagagcacaatagttgtacatttttaagcacgggtccaatcttggatgccgaagttgtagtaatttcaacattatgctactcatttctgttg

SEQ ID NO: 2883 - DNA, 1014 bp, Picea glauca
attgtgtgtgagtaggaaataagagtcaaatgtgagggtgaaagagcatattgtgctcactctctacaccaccatgggggtttaggcgtgaaagtatggggtggggggtgaggacaatatgctcaccctctatccatcttcatcctcgggaagaaagaaaattactcatagtgacgtggaagaggtttctttgggtcattgaacgaactattcacaatgacaagtatgtaatgccaaagctttctaatttttttctaaaatttcgtatacaaatagcagtgaaggcaccagtgttgctatctggagcgcgttatcagagtttcggttcagacgtagcctctctttttaagtttttgattgtgctttcccctcttaagaggcatcatgagcaggtcagggcagcccccggatctcaagaagtacatggacaagaagcttaacattaagttgaacgccaacagagtggtggttggtactctacgaggatttgaccagttcatgaatttagtcctggatggtactgtagaagtaaatggcaatgaaagaaatgagataggcatggtggtcatcagggggaacagtgttgtgatgattgaagctttggaaccggtcaacaggtcatcataatttattttgaaacctttttatgtttcagagattcatgggtacagaacttttgtaagtgatgcaccatttgttaaaatgttccagtaaacgattagtaagcctcgcaatttttgcaaggttttattttgaatggatgtcatgaacaaagtatggagagtattcttcccacttttcttatgcttttgggagatagaagatagcttaaatagctgcacagggagattgcagcaatgtagacaactgaactttgcaatgtactttatttgcttgatatagtagtaacaacatcctagaatgttgcttaataggaacatcaattcttattgactgtgtatgctattagatggttggaacaatttcttttattaagccttcataagtttgtgt

SEQ ID NO: 2884 - DNA, 778 bp, Picea glauca
  misc_feature (114)..(114): n is a, c, g, or t
taattaaattaatccccccccccccccaaaaaaaatttggtatacaaatagcagtgaaggcaccagtgttgctatctggagcgcgttatcagagtttcggttcagacgtagccnctctttttaagtttttgattgtgctttcccctcttaagaggcatcatgagcaggtcagggcagcccccggatctcaagaagtacatggacaagaagcttaacataaagttgaacgccaacagagtggtggttggtactctacgaggatttgaccagttcatgaatttagtcctggatggtactgtagaagtaaatggcaatgaaagaaatgagataggcatggtggtcatcagggggaacagtgttgtgatgattgaagctttggaaccggtcaacaggtcatcataatttattttgaaacctttttatgtttcagagattcatgggtacagaacttttgtaagtgatgcaccatttgttaaaatgttccagtaaacgattagtaagcctcgcaatttttgcaaggttttattttgaatggatgtcatgaacaaagtatggagagtattcttcccacttttcttatgcttttgggagatagaagatagcttaaatagctgcacagggagattgcagcaatgtagacaactgaactttgcaatgtactttatttgcttgatatagtagtaacaacatcctagaatgttgcttaataggaacatcaattcttattgactgtgtatgctattagatggttggaacaatttctttttaatataaaaaa

SEQ ID NO: 2885 - DNA, 503 bp, Helianthus annuus
ggattctcttttcaaaaccactacgcgcgataaacctccctaaaatttctttaatttcgtttagtcatcgttttcgctctctctctctctctctctctctctagggtttcgccatgagcagatcaggtcagccgccagatctcaagaagtacatggacaagcaactacagatcaagttgaatgcgaatcgaacagtggtgggaacacttaggggttttgatcagttcatgaacctggtgattgacaacacagtggaagttaatggtgatgacaaacatgatattggcatggtggtcataagagggaatagtgtggtcactgttgaagcgctcgagccggtcagcagaggccagtgattcccgactcgtattggtatggttctggtgtattgtgtggctggttttgtaattctgagaactattatggtagtaattgatgtttaacttgctgcgacttccgtgtataaatttgaccgtaaaaacataataactggtattcatgtg

SEQ ID NO: 2886 - DNA, 491 bp, Triphysaria pusilla
aatttctagggtttgaaagcgataaacccattccgaaaaccccttctctctctagaaaatcgcgatgagcagatcgggacagccaccggatctcaagaagtacatggacaagaagctacaaataaagcttaatgccaaccgtatggtggttggaacactgcgtggttttgatcagttcatgaatctggtgattgacaatactgtcgaagtcagcggaaatgagaattccgacatcggcatggtggtaattagaggaaacagtgtggtcactgttgaagctcttgagccggttgctagagcgcaataatcgtacatgttttttagtgtgtttgtatgaactaattgagatttgtatgaaaaatatttcgacattttgcaaatcctgtttgataagctcttggacttatcaggtgtatctttccaaagagtatgatttgaattataactctattgctctatattttgaaatgtgttttcaggaatgggatggt

SEQ ID NO: 2887 - DNA, 741 bp, Cajanus cajan
agagtgaacttaatttttcgaaaagtgagcgaaagtgagaggttttggttcccaaaaacctaattttcgtatttcgttgatcgctgttatctcatcaacatgagcaggtcagggcaaccaccggatttgaagaagtacatggacaagaagcttcagattaagctgaatgcaaatcgcatgattgttggtactctccgtggctttgaccagtttatgaatttggttgttgacaacactgtggaagtgaatggcaatgagaaaaatgacattgggatggtggtaatcagaggaaacagtgtggtcactgttgaagcgcttgaacctgtgaacaggacttgatttatatttcctgtaaacatgtataagtatattttctggttttaacggttatgtatttgaacattgtagctattgagagtaacatgtaattgtggcacttaagaggttcatgtcatgctggcactaatttggggttctaaattgtcagggatccacctctagtgttttagtttgatgtctgtgacttgactcattttgaaatggttacatatatcccttttaggtggtttcttctcatcttctatattacatttttcgtgaaaacttctcatcataatgggtaaagctctatgtgatcacactcatatttcaatgcttccagcaaccttggcaattaattcttcttcacatttgcttgttatcttcacagacttctttgctatagtttttgttcgatttttg

SEQ ID NO: 2888 - DNA, 556 bp, Phalaenopsis aphrodite
ttcctcgattttttggtgctttgccgcagcgaggtgaccagttcggaaaccctagctcttcctccttgcaaacatgagcaggtcaggccagcctccggatctcaagaagtacatggacaagaagctccaaatcaagttgaatgctaatcgcaccgtagttggcaccttgcgcggattcgaccagttcatgaaccttgtgattgacaacaccgtcgatgtcagcagcagcagcgagaagcatgatatcggaatggtggttataaggggtaacagtgtggtcatgatcgaagcccttgaaccggtaaacagatcacagtaacatctatctatgctggctgctgctgtcttctatttctctcatctctcttttgaactatattttgtactcgttaagtagctttttgcagtgcttctgatttaagcttgatgactatgaactccctttttttttaaaactgatgcttgattgttaaacaggttaatattttgtggaaattatgttcgtgtttatagtaacaaaaaaaaaaaaaaaagaagagagttctatagtctatac

SEQ ID NO: 2889 - DNA, 451 bp, Centaurea maculosa
aacctcatcgattttcacccaatttccttcatcctcttcgattcctcgctgtatcgattcttagggtttcgccatgagcagatcaggtcaacctccagatcttaaaaagtacatggacaagcaactacagatcaaactgaatgccaatcggactgtggttggtacacttcgtggtttcgatcagttcatgaacctcgttatcgacaacacagtggaagtgaacggtgaagagaaaaatgatattggcatggtggttataagagggaatagcgtagtcaccgttgaagcacttgagccagtcagcagagcacagtgattggtatgtgacgtattatgtaacgggtttatttctttccccaaaaaatagatctagcagcaacggatatgatactctttccgagtatgatcggttttatgctgatttctatcttgtagacatatccttcatact

SEQ ID NO: 2890 - DNA, 826 bp, Centaurea maculosa
ctcgccataaacctcatcgattttcacccaatttccttcatcctcttcgattcctcgctgtatcgattcttagggtttcgccatgagcagatcaggtcaacctccagatcttaaaaagtatatggacaagcaactacagatcaaactgaatgccaatcggactgtggttggtacacttcgtggtttcgatcagttcatgaacctcgttatcgacaacacagtggaagtgaacggtgaagaaaaaaatgatatcggcatggtggttataagagggaatagcgtagtcaccgttgaagcacttgagccagtcagcagagcacagtaattggtatgtgacgtattatgtaatgggttgattttctttccccccaaaaaatagatctagcagcaactgatatgatacttgttctgagtatgattggtttattgctgatttctatcttgtagacaaatccttcatactctttatattttcatcttagtgagatatgtatcctgatttcaagctttctgagaagttaaattcttgttaagtgtcaaaaaagaaaacagccccatgaaaccaattaaaattcaagtttacccatcataacccaacaaatctctcacttctaaaatacaaaaatcccttttcttctatcatgactacaaactattttcaccttttctggccaaatacaaacacatttgagctccaaaaaaaacccaaattctaccttttccttcgagtggacgagcttcttcgttcagcttcgcgttcagcaaccaaaacactaaattcagcaccgagcatctcgtgtatatcgagacccttagagttgcttag

SEQ ID NO: 2891 - DNA, 484 bp, Centaurea maculosa
ttcctcttcttctctgtttgtctcagggtttcgacatgagcagatcaggtcaacctccagatctcaagaagtacatggacaagcaactgcagatcaagctgaatgcaaatcggacggtggttggaacgcttcgtggtttcgaccagttcatgaaccttgtcatcgataacacagtggaagtgaacggtgaagagaaaaacgatataggcatggtggtcataagagggaatagcgtagtcactgttgaagcactcgagccagtcagcagaggacagtgagtcaagacccgtatctgtatggtctcccaacgtattgtgttattgttttttttttcttcttccaaaaacagtatttgagacagatatttaacttaaaaaagcttatttgcacctagttgacaatctttaagttgcatctcatgtgcaaacgagtagtgtatcggttgtagtctaacttcgactttttaagcgagttcgtgatagat

SEQ ID NO: 2892 - DNA, 512 bp, Helianthus annuus
tctttctagggttccaacatgagcagatcaggtcaacctccagatcttaaaaagtatatggacaagcaactacagatcaagctgaatgcgaatcggacagtggtggggactcttcgtgggtttgaccagttcatgaacctagtcatcgacaacacagtggaagtcaacggtgaagagaaaaatgaaatcggcatggtggttatccgaggtaacagcgtagtgactgttgaagctctagagccagtcgccagagctcagtaattgatgctaagtttattctgtatcgttttatcgccttttctagaaatttgatctagcagtaactgatgtgatacttgaaactttgtagagtatgatcggtttcatgctatactagacttgtaagaagttgaattatggttggatgtcgttattatcgttattttattatcagcagcagttttacctagggggtgtcagtcgtgtcgggttaaagggatataatgtgcaacccgaactcgacccatattatt

SEQ ID NO: 2893 - DNA, 527 bp, Eutrema parvulum
atttctcatctggaatcgatcgagtgagctctgagctgaaaataccctaatctctccttttccgtcttctccgattgtgcaagtatgagtcgatcaggccagcccccggatctcaaaaagtacatggacaagaatctccaaatcaagcttaatgccaaccgaatggttgttggaactctccgtgggtttgaccagttcatgaatcttgttgtggataacactgttgaagtgaaaggtgatgagaaaaccgacattgggatggtggtgataagaggaaacagcattgtcaccgttgaagctcttgaaccagtgggaagatcttagctttattactttgcattatcgataatcatcaatttgatcaccttgactgagttttgctctctgtattggaacttaattagtagactatcagcatggatcgatcttgaagaagtttgatttgatgaaatcatcttatttgtttactcctatgttctgcatatttctatgaacctgttagttggttataagccaatctgattact

SEQ ID NO: 2894 - DNA, 1013 bp, Aristolochia fimbriata
agaacaattttgtcggattatagtgctgattgcagaaccctggtagtggtaaggagacgactacgcttgtagtaggcttctctactgtggcgcgagcgcgacctgaggactgacaactgaaggagtgtgattaggggtttaagagggggatagggagacgctacggaaggatcttatttgatttctgacgttactttgtgcgtgcttctgccgtttagttgtcgtcatgagcagatcagggcagcccccggatttgaagaagtatatggacaagaagcttcagattaagctgaatgcaaacagggttgtggttggaattcttcgtggttttgatcagttcatgaatttggtgattgacaacacagtggagttaaaaggcaacgagaaaaatgacataggaatggtggtaatccggggaaacagtgtagtaatgatagaagctcttgagccagtcagttaaatcatagcactgtatatttgctgcaggaacttctcttggctgctaatgtacttgggggagcttactgtaatctgtgatagaggcgaattggcttttttctttcctttgtggagttcttctgttatactagaaagtagaggtttttcacttcacactttgtctaaaagaaaagtagcgtttgtgtgaactggaggggctcttttaaatgttaggcattattgtcttttattaggatcttgtgggtaactaccaacctttatggcttcgttcgtactagggcacttatttatttttaatgcttatattggactttaatgtttctttaagtatcaagtacctaggctcgttatcctaacaattaatcaacattataacagtatagcgtccccatggattgcttttagaacaaatatgttcagcaagaaatctctgttaagatagaatccgtgtgctaccatattgaacgaaattatttttgaaacatgaaaactttcttttaattttagatagtctattttcctaatttactaattcccttaaagtgggtatctac

SEQ ID NO: 2895 - DNA, 711 bp, Artemisia annua
tactccgacgggggacgccataaaccccacaaaaaactttcaccatccatcgtatcatcatcctctgcagcattttttgtttttagggtttcatcatgagcagatcaggccagcctccagatctcaaaaagtacatggacaaacagctacagattaagctgaatgctaaccggacagtggttggaacacttcgtggttttgaccagttcatgaatcttgtgatcgacaacacagtcgaagtcaacggtgatgcaaaaaatgagataggcatggtggtcataagagggaatagtgtggtcactgttgaagcactcgagccagtcgccagagctcaatgatttgagactcatagcagtttaatatcagctgtattgtgtaattgctctcttttctgaaacagttttagtagacctagtcgatattcatctatcaagcttatgtgccacctatttgacaattttcaattgcccatttggtgtaaatgagcaggactttatcctgactttaatgtttctaagtaaatcttggtagttcatcttggtaattcatcttcactggtttttgtgccctaggcgagtacctgtgtctagtaatgaggttctatattttctttttacatgtagtataggtattagataatttgtgtagcatggctcttgtgtaatacatgtgcttgttctttgtcacaatttgtgaaaacaaacattttgc

SEQ ID NO: 2896 - DNA, 486 bp, Bruguiera gymnorhiza
  misc_feature (35)..(35): n is a, c, g, or t
ggcgaaacaaaaccctcgaaaaatcgcccttccancctcccaccgtctctcctgctctcaggcggcgaacaaccgagagtaaatcaaagccgtccaaacatgagcagatcaggccagcctccagatctcaagaagtacatggacaagaagcttcaaatcaagctgaatgctaatagactggtggttggaacactccgtggatttgaccagtttatgaatttggtggttgacaataccatcgaggtgaacggtgatgagaaaactgatataggcatggtggtaatcagaggaaacagtgttgtcacggttgaagcactggaacctgtgaacaagtagtagttataatggtctggtttatattcatgccgatcttatgtagtattcttgagctatatagcttcttggagaagtttttcgatgtatttggatgtaataatacttaactggatctctgtttggttaggatataaactagattattagtat

SEQ ID NO: 2897 - DNA, 540 bp, Centaurea maculosa
  misc_feature (538)..(538): n is a, c, g, or t
cgggggcataacctcatcgattttcacccatttccttcatcctctacgattcctcgctgtatcgattcttagggtttcgccatgagcagatcaggtcaacctccagatcttaaaaagtacatggacaagcaactacagatcaaactgaatgccaatcggactgtggttggtacacttcgtggtttcgatcagttcatgaacctcgttatcgacaacacagtggaagtgaacggtgaagagaaaaatgatattggcatggtggttataagagggaatagcgtagtcaccgttgaagcacttgagccagtcagcagagcacagtgattggtatgtgacgtattatgtaacggctttattttctttccccccaaaaaatagatctagcagcaactgatatgatactctttcggagtatgatcggttttatgctgatttctatcttgtagacatatccttcatactctttatgttttcatctttggtaagatatgtattctgacttcaagctttttgagaagttaaaattcttgttaagtgncg

SEQ ID NO: 2898 - DNA, 535 bp, Cirsium arvense
gcggggagggtttatgcgcgcgataaacctcccaattttcatttcacttctgtcatcggcttctctttctctgtttctctcaagggtttcgccatgagcagatcaggtcaacctccagatctcaagaagtacatggacaagcaactacagatcaagctgaatgccaatcggacagtcgttggaacacttcgtggtttcgaccagttcatgaacctcgtgatcgataacacagtggaagtgaacggtgaagagaaaaatgatataggcatggtggtcataagagggaatagcgtagtcactgttgaagcactcgagccagtcagcagaggacagtgagtcaagacccatatcggcaaaattgtgtaattgctttcttttttcccgaaacagttctagtagtatctgagacaatagttaacctaaaagattatttgcacctagttggcaatcttcaaccgactgcagtctaacttcgtgcaaataatcttgtgtatcgactgcagtctaacttcgactttttaagtgagtttcttat

SEQ ID NO: 2899 - DNA, 570 bp, Cirsium arvense
tcataaacctcatcgattttcaaccaattcgataaccttccctcatcatcttccactcctttctgtctccattcatagggtttcgccatgagcagatcaggtcaacctccagatcttaaaaagtatatggacaagcaactacagatcaaactgaatgccaatcggactgtggttggtacacttcgtggtttcgatcagttcatgaacctcgttatcgacaacacagtggaagtgaacggtgaagaaaaaaatgatatcggcatggtggttataagagggaatagcgtagtcaccgttgaagctctcgagccagtcagcagagcacagtaattggtatgtgacgtactatgtaacgggttgattttctttcctcccaaaaaatagatctagcagcaactgatatgatacttgttccgagtatgatcggtttaatgctgatttctatcttgtagacatatccttcatactctttatattttcacctttggtaagatatgtatcctcatttcaagctttctaagaagttaaattcttgttaagtgccatttttatggctcttttctttatgaa

SEQ ID NO: 2900 - DNA, 569 bp, Cirsium arvense
tcataaacctcactgattttcaaccaatttggtatccctccctcatcatcttccagttctcgctgtctccattcatagggtttcgccatgagcagatcaggtcaacctccagatcttaaaaagtatatggacaagcaactacagatcaaactgaatgccaatcggactgtggttggtacacttcgtggttttgatcagttcatgaaccttgttatcgacaacacagtggaagtgaacggtgaagaaaaaaatgatatcggcatggtggttataagagggaatagcgtagtcaccgttgaagcacttgagccagtcagcagagcacagtaattggtatgtgacgtattatgtaatgggttgattttctttcccccaaaaaaatagatctagcagcaactgatatgatacttgttctgagtatgatcggtttaatgctgatttctatcttgtagacaaatccttcatactctttatattttcatcttagtaagatatgtatcctgatttcaagctttctgagaagttaaattcttgttaagtgtcatttttatggctcttttctttatgaa

SEQ ID NO: 2901 - DNA, 488 bp, Cirsium arvense
tcataaacctcatcgattttcaaccaattcgacaaccctcctcatcatcttccactccttgctgtctccattcatagggtttcgccatgagcagatcaggtcaacctccagatcttaaaaaagtacatggacaagcaactacagatcaaactgaatgccaatcggaccgtggttggtacacttcgtggttttgatcaattcatgaatctcgttatcgacaacacagtggaagtgaacggtgaagaaaaaaacgatattggcatggtggttataagagggaatagtgtagtcaccgttgaagcacttgagccagtcagcagagcacagtaattggtatgttacggttgcattgtattatattcaaagcttatttgagtatgatcggtttttatgctgatttataaaatatttgatactcttatattttcattgttggtaagatatgtattctgacttctgaattctaaaaaagaaaaaagtaccgactg

SEQ ID NO: 2902 - DNA, 772 bp, Cyamopsis tetragonoloba
caattgcatttggtgggaatggttttgctgatatgggaatcaagccaggggtggttttcttcacaggcgtgaaaggtaccgagtctaatgcaaattcgcgaggctcgtctccttcgacatagtcgcgaagagcagccgaaactcttctcaaggattcaatgtaggctatgtgtccggtggcaaatcgagttctttgctcaacggcttgtttgatgaaattctttctcactcactcaatcttctccttttgcgctgatctttgctctcttctcttcaccatgagcaggtctgggcagccaccagatttgaagaaatacatggacaagcagctgcagatcaaactgaacgctaatcgcatgattgttggaactctccgtggctttgatcagtttatgaatttagttgttgacaacactgtggaggtcaatggaaatgagaagaatgaaattgggatggtggtgatcagaggaaatagtgtggtcactgttgaggcacttgaacccgttaacagatcctgatttctgtttcttgtcaacaaaaacatttttatttgtatatttccaggtttcaaatggtgtgtatttgaacaatgtaactgctgagattaacatgtaattgtggatttgaatagaatcttgttggccattaatttgggctgaagttcttatgtttttctattgcgcatttagcatgatttgttttttaggagtgtagatcagggttttggattgagctagtagagtttatacaatgcttcgttaaggaatcaaaa

SEQ ID NO: 2903 - DNA, 569 bp, Taraxacum officinale
gcggggggcctttgctcgtgttaacctcaccgatttcaccaattcagtccctccctggctccctcatcatccttgaatcatcgctgtcttcatccataggttttcgccatgagcagatcaggtcaacctccagatcttaaaaagtacatggacaagcaactacagatcaagctgaatgctaatcggacagtagttgggacccttcgtggttttgatcagttcatgaatcttgtgattgacaacacagtggaagtgaacggtgatgagaaaaacgacataggcatggtggttataagagggaatagtgtggtaactgttgaagcactggagccagttagcagaggacagtaatggcttatatctttatgtattaagacaatatgacttcaaactattgtgaatttgaattcttgttcaatgccatttttatggttttcttgttttgaagttagtggttgaggtgatgtgtattgatttgattgtctttcttgatgctgtttctttgacttaatgggcttaatgggttaagcaattaatctggatgcttatgaaaaaaaaaaaaaaaaaaa

SEQ ID NO: 2904 - DNA, 568 bp, Linum usitatissimum
ctcctcctcagctcattgacgactgttagtgccgccgattcattctctcttcgtctcttccttccggcgattcaacaatgagcagatccggtcagcctccggatttgaagaagtacatggataagaagcttcagatcaagctgaacgcgaacagaatggtggtcggaacactgcgtggctttgaccagttcatgaacttggtcatcgacaacaccgtggaggtgaacggtgaagagaaaactgaaatagggatggtggtgataagaggaaatagcgtggtgactgtggaagctctggagcctgtaaacagagggatataggtcctagactctgtatcgtgttgatattatgtgtgacttttaactagtctgtatcctgcggaaatgtggttgctgttgtcatttggatgcatcactttaggatctcaagctgccagaaattttatcctgtgattcctatcctagattgagtacaaactgttcttatgaatgatgaatcaattgagctcaaacgtctatgttctctcttttattctcctaaagattcgtatcgtattggtttgcccagt

SEQ ID NO: 2905 - DNA, 648 bp, Humulus lupulus
agtctcagcgccactccggtctgcacagccaaccatccccggtctctcgctgtctcactccctccctccctcaaattgaggtttttgctgcgactagccttttctctttccaacatatcataccgattacagaatgagtaggtcagggcagccaccggatcttaagaaatacatggacaagaagcttcaaatcaagttgaatggcaatcgcatggttgttgggactcttaggggattcgatcagttcatgaatctagtggttgacaacactgtggaagtaaatggagatgagaggaatgatataggcatggtggttattaggggaaatagtgtggttactgttgaagctcttgaacctgttaccagaacacagtgaggtgcggctttgtagttggtagtgccatatgaattcttggctggtattagtttgaacatataactgctataatgggaaggaaaatgttttgtaattttggatttgatgttaattaaccaggttccttctatgagtactccgttcctatttccagcatttgttcctggtattgtactttgaatcatatgaactagctgtgaattcttacctggcttatataccaccatttgctccatctcttgtgatataaatgcactattagagttctacaa

SEQ ID NO: 2906 - DNA, 690 bp, Humulus lupulus
cggccggggacaagtgagaatcacagcacaggttttacttagtctcagctccaccccggtctgcacagccaaccagccactatctctcgccgtctcactccctccctcaaattgagggttttgctgcgactagctttttctctttccaacatatcatatcgattacagaatgagtaggtcagggcagcctccggatcttaagaaatacatggacaagaagcttcaaatcaagttgaatggcaatcgcatggttgttgggactcttcggggattcgatcagttcatgaatctagtggttgacaacactgtggaagtaaatggagatgagaggaatgatataggcatggtggttattaggggaaatagtgtggttactgttgaagctcttgaacctgttaccagaacacagtgaggtgcggctttgtagtcggtagccccatatgaattcttgactggtattagtttgaacatataactgctataatgggaaggaaaatgttttgtaattttggatttgctgttaattaaccagattccttctatgagtactccgttcctatttccagcatttgttcctggtattgtacttttaatcatatgaactagctgtgaattcttacttggcttatataccaccatttgccccatctcttgtgatataaatgcactattagagttctacaatttctt

SEQ ID NO: 2907 - DNA, 628 bp, Humulus lupulus
tcacagcacaggttttacttagtctcagctccaccccggtctgcacagccaaccagccactatctctcgccgtctcactccctccctcaaattgaggttatttcttggttttgctgcgactagctttttctctttccaacatatcatatcgattacagaatgagtaggtcagggcagcctccggatcttaagaaatacatggacaagaagcttcaaatcaagttgaatggcaatcgcatggttgttgggactcttcggggattcgatcagttcatgaatctagtggttgacaacactgtggaagtaaatggagatgagaggaatgatataggcatggtggttattaggggaaatagtgtggttactgttgaagctcttgaacctgttaccagaacacagtgaggtgcggctttgtagtcggtagccccatatgaattcttgactggtattagtttgaacatataactgctataatgggaaggaaaatgttttgtaattttggatttactgttaattaaccagattccttctatgagtactccgttcctatttccagcatttgttcctggtattgtactttgaatcatatgaactagctgtgaattcttacttggcttatataccacca

SEQ ID NO: 2908 - DNA, 475 bp, Ipomoea nil
ggttctgttccttcttcgttttccctctcctggtgaagtaaaagctgttagggtttaacgatgagccgatcgggtcaaccgccggatctcaagaagtacatggacaagaagctgcaaatcaagttaaatgctaacagaatggtggttggaacacttaggggttttgatcagttcatgaatctggttgtggacaacaccgttgaagtaaatggcaatgaaagaactgacattggcatggtggtccttagggggaacagtgtggttaccattgaagcacttgaacctttgccagaacttagtcatttgcatcacaggatggtaactttcaatgtattgtgtagttaaagttcactacttcagatcttgtaccatgaactaactgatacaaaagttatcaaattgaaatacattgaattgtattgaagagcatgattgttccagtgttaaaccagaagtttggtggacgaatggatgt

SEQ ID NO: 2909 - DNA, 604 bp, Liriodendron tulipifera
  misc_feature (59)..(59): n is a, c, g, or t
  misc_feature (118)..(118): n is a, c, g, or t
  misc_feature (211)..(211): n is a, c, g, or t
  misc_feature (219)..(219): n is a, c, g, or t
  misc_feature (307)..(307): n is a, c, g, or t
  misc_feature (341)..(341): n is a, c, g, or t
  misc_feature (353)..(353): n is a, c, g, or t
  misc_feature (370)..(370): n is a, c, g, or t
  misc_feature (436)..(436): n is a, c, g, or t
gggggaaaaaaaaaaaaaaaaaaaaaaaaaaaaaaaaaaactcgagatttttccttttnccatttcctcctttccattccttccatcgccatgagcaggtcaggccagcctccggatntcaagaaatacatggacaagaagcttcaaattaagctgaatgcgaacagggttgtggttggcacccttcgtgggtttgatcagtttatgaatntggtgatngacaacacccttgaactcaatggcaatgagaaaaatgatataggaatggtggttatcaggggaaatagcgtagtcatgattgaagctnttgaaccagttagcaaaacgcagtagccgctctntagatggactgntgggttagtgtatcatntgcgattgtgttgaagacataggtggtagtgttaatggatcagattgtggtttgtttttgtttatnttactgcatgctatacattcagaggcagttcacattggctcataagctgctgtaatgctgaggataaaaaggaaaatgaaaaggtaagtaggactttgctagttatggttgaatgatatgtgtatctcctacaatgtctacttaagtagctggccctttgatttttgc

SEQ ID NO: 2910 - DNA, 424 bp, Olea europaea
ccgaatctggaccttcataaaaatgagcacccaccccttctctctctcgcccctcctcattttctggggttttgaattgcgataaacccagtagcagcagactctccctctaaaactttctccggcaaaggtttaatcatgagcagatcaggccagcctccggatctcaaaaagtatatggacaagaagctgcaaatcaagctgaatgcgaatcggatggtggttggaacacttcgtggttttgatcagtttatgaacctggtggtggacaacactgttgaaatgaatggcaatgagaaaaatgaaattggcatggtggtcatcaggggaaatagtgtagtcactgttgaggcacttgaacccattagtagaccacagtaattgtaaatttgcagtggtatggattcatgtaacttgtagtgga

SEQ ID NO: 2911 - DNA, 913 bp, Arachis hypogaea
gggggggaaggtgaaacagtcactagggtttcggagtgcagcaacatcttgtactccaaaatttgttcttcgtctttgtcgcttctctactcaactcttcactatgagcagatcagggcagccaccggatttgaagaagtacatggacaagaagcttcagattaagcttaatgcaaacaggatgattgttggtaccctcaggggttttgaccagtttatgaacttagttgttgacaacactgttgaagtcaatggcaatgaaaagaatgaaatagggatggtggtaattagaggaaacagtgtggttactgttgaagcacttgaacctgtcaacaggggctgacttctgttttattgtaatatttctcagtatatttcaatgtttgaattggtgtgtattttgaacattctagatggtttagttctgagagtaacatggaattgtggatcttaaggtcatttggccattactttggggttcatttcctttcttcctgttccatttgttagtgtagcttactgtgtataccactatggttttttaatgggatggcactgaccttgccaaattgaaattatgtcgatagaattataatcttttctcccgttatatgtattgttatgatttaataatactttgatggttctctgtgctcaaaacttgcttttgggataaataagggggcaaaatgcctaaccaccgcacaaggatgccattaaagaaagattacgtgttacagaaaataaagcagtgtagaaagagaattagctgtagggggcaaatggtgaaacctcaggaagtgagggaccatgcttaccgagctctgaacacggggattattaggtacttgagtcatgtatttgtttgtttcattccgtgtgtttgagtaggtttttgttgttgctgaactaa

SEQ ID NO: 2912 - DNA, 676 bp, Carthamus tinctorius
  misc_feature (600)..(600): n is a, c, g, or t
  misc_feature (606)..(606): n is a, c, g, or t
aacaatcgaaaattaggattttcagccaattcgacatctctccctcatcgtcttcgattcctcgctgtatcggttcttagggtttcgccatgagcagatccggtcaacctccagatcttaaaaagtacatggacaagcaactacagatcaaactgaatgccaatcggactgtggttggtacacttcgaggtttcgatcagttcatgaacctcgttattgacaacacagtggaagtgaacggtgaagaaaaaaatgatatcggcatggtggttataagagggaatagcgtagtcaccgttgaagcactcgagccagtcagcagagcacagtaattggtatgcgacgtattatgtactgggtttattttctttaccccccaaaaaaatagatctagcagcaactgatatgatactccttccgagtatgatcggtttttttgctgatttctatcttgtagacaaatccttcatactctttatcttttcatctttggtaagatatgtattctgacttcaagctttctgagaagttaaattcttgttaagtgtcatttttatggctcttttcttttatcaagttaatggtaacaacccttgcgcntggagnaaaaaaatcaagaaaaaaatagtactttctcttgaataataattggaaaaaagacaaaaaaaagaaaaag

SEQ ID NO: 2913 - DNA, 797 bp, Glycine max
tcctcaaaattaaaatgaatcttttgaaaaataaagaaataaatgactaatcgtatattttgattgcagtaaagaaaaatagtttttagccaaaaaaagtaaaatattgttgctgattctagccacgctcataacatagtctatgactaattgactatgggtctacaattacttaattaccctcctcaaactcaaaagtcagaacctccaaagttaagttagggtttttgggggtgaagttgcgcttccggcacttccacttccacttcttcatcaccatgagcaggtcaggccaaccaccggatttgaagaagtacatggacaagaagcttcagattaaactgaatggaaatcgcatgattgttggcactctccgtggctttgaccagtttatgaatttagttgttgacaacactgtggaagtgaatggcaatgagaaaaatgacatagggatggtggtaatcagaggaaatagtgtggtcactgttgaggcgcttgaacccgtgaacagggcctgattactatttcttgtaaacatttataagtagattttctggtttctgtgtttgaacaacgtagctattgagagtaacatgtaattgtgaatcttaagagtgtcatgttggctgctaatttggggttctttttcaggctaaattgtcaaggcgggatgccttctattgttttagtgtgttgcctgtgtgacttgactcaattgaatatatcccttttagctgatttctccttattgcatctaacgtgaaaatttctctgtgctcttaagtataaaccagggt

SEQ ID NO: 2914 - DNA, 554 bp, Helianthus annuus
gcaaaatcgtatgatatgatattagggttttggtttggccgcgataaacctcaaccagttcgattctcccgtccccttcatcatctttctagggttccaacatgagcagatcaggtcaacctccagatcttaaaaagtatatggacaagcaactacagatcaagctgaatgcgaatcggacagtggtggggactcttcgtgggtttgaccagttcatgaacctagtcatcgacaacacagtggaagtcaacggtgaagagaaaaatgaaatcggcatggtggttatccgaggcaacagcgtagtgactgttgaagctctagagccagtcgccagagctcagtaattgatgctaagtttattctgtatcgttttatcgccttttctagaaatttgatctagcagtaactgatgtgatacttgaaactttgtagagtatgatcggtttcatgctatactagacttgtaagaagttgaattatggttggatgtcgttattatcgttattttattaactggtcaaacccacgaagagtccccaccactgtccgattcg

SEQ ID NO: 2915 - DNA, 516 bp, Tamarix hispida
  misc_feature (418)..(418): n is a, c, g, or t
  misc_feature (487)..(487): n is a, c, g, or t
gggggctgtgactgtgagcctttctctccgttcctcccggcgctaaaaccctactttcttctcccgctcctgcgttttgcgactccatatccgcgaaattactgaagatgagtaggtcgggccagcctccagatctgaaaaaatacatggacaagaagctacaaatcaagctgaatgcaaatagacaagtagtgggaacccttcgtggatttgaccagtttatgaatttggtgattgacaacaccgtagaagtaaatgggaatgagaaaaatgagatcggcatggtggtcattagagggaacagcgtagtcacggtggaggctcttgaacctgtgaacagaacgatgtgattgatcaaaatatagggccatgaatattgttcgggaaacctaggatatatggctggttatgttggacnatgcacttttcgatgcggatgtattattgtaatgagtcttttcatttcctcctttccctctagattaancatgttttgcggtaattggttggataact

SEQ ID NO: 2916 - DNA, 534 bp, Tragopogon dubius
cggggaagtaatttccattaggctttatatccgactatccgtagtgtttctgcgcgcgataaaccccaccaaaatttcatttcatttccgtcgtcggcttcgcttcttttgttcatctctagggtttcgccatgagcagatcaggtcaacctccagatctcaagaagtacatggacaagcaactacagatcaagctgaatgcgaatcggacagtggttggaacacttcgtggttttgaccagttcatgaaccttgtgattgacaacacagtggaagtgaatggtgaagagaaaaatgacataggcatggtggtgataagagggaatagcgtggttactgttgaagcactcgagccagtcagcagagcgcagtgattctatattgtgtaatttctttcttctttcttgaaacagttttagtagtaactgagaccttatttagttgaaaatggatttgctcatatgaagaagatatatgtttagaatctactaaaaaccataattatgatgagaatgttaagaactggtcatatta

SEQ ID NO: 2917 - DNA, 782 bp, Zamia vazquezii
  misc_feature (133)..(133): n is a, c, g, or t
  misc_feature (237)..(237): n is a, c, g, or t
aaggcgacggggttcctccttggaaggagtgttagaaggccaaggggctcctccttggttccttggttgcacctgctttcccctccaaagaagcggcgccatgagcaagtcagggcagcctccggatctcaanaagtacatggacaagaagcttaacataaagttgaatgccaatcgagtggtgattggtactttgcgaggatttgaccagtttatgaatcttgtcctggatggcanggtggaagtcaatggcaatgaaagaaatgagataggcatggtggtaatcagagggaacagtgtcgtgatgattgaagctttggagccagttaacaggtcttaactgtttattatgacactgagttaagagatttatatgcacaccacttttgaaaatatgtgccatttcggttttatggcaaatagattattgaaatttgtaggattttggcaactcaattattttgaatgattatgtggaacaaagagtgaattacagaattgtcccccttctttggactgatgttctgtgttaacaggctatatgttagaggaaatgtaagaattgtgatattggcaaaagcatatacacagcttgcagtaaaaatgtaacaattgaactattaataggccctagtttcttttgggattgttaacccagttgatcctctccatcaacccgagaatagcttcttactttttgcatatgtaaactgtggtaaaaaaatttctacaaatgttttttgccatagaaaatgttttctgttaatgcttaattgcttgat

SEQ ID NO: 2918 - DNA, 658 bp, Beta vulgaris
agaaaccctctctttctcactctctctcctatctcaatctagggtttaaggatgagcagatcaggtcagcctccagatctcaagaaatacatggacaagaaacttcaaatcaagctgaatgcaaatagaatggtggtgggtacacttcgtggctttgaccagtttatgaatcttgtggttgacaacactgtggatgtaatggcaatgagagcaatgagataggcatggtggttattagaggaaatagtgtggtcactgttgaggcgcttgaaccagtcgctcgatccatttagcaagatgatatagtctatgtttatgtaggaagcgctggtatattcagaacatgtgattaacctgatacattggggtgtggcttgaatcttatgggtggtggtattgtggaagtgagtaaagtaagagctttgtatcttaatcactcattgtgagcttctgaattggaaaatactttcaaaaatattcagagcaactttgtttttttgtacatcaggtatgcttttggcgtaaacatttgatttgaggactgtagtgatcctccggttatttgctggttttagtactcccactttatgttacattccttgcgtatagtagtaattactccacgtcagctatcttatactccctccgtttcttttta

SEQ ID NO: 2919 - DNA, 606 bp, Orobanche aegyptiaca
ttcacaaagagccaaatatcttgttggtccagcccatatacgataggagctgaatatcaaactcacagacttgcattcttcctcacaagttttggtccgaatcaaatatttagggttttgaagagcgataaacccaattttcacttgctttagaatttcaccatgagcagatcaggacagcctccggatctcaagaagtatatggacaagaagctacagataaagctcaatgcgaatcgtttagtgattggaacacttcgtggatttgatcagtttatgaacatggtgattgacaacactgttgaagtgaatggaaatgagaaaactgatatagggatggtgtgtttttcgtttgcaggtcatcagggggaacagtgtggtcactgttgaagctcttgagccagttgctagaccacaatgattgtatatttttatcatgtattgattttcagtctgattcgtgttgggagattatgttgacgttgtacttgtgagttttaactttttttagccgtatgctgtcatctttctaggttatggatgcgtttcagttttactcaatataatgattttgaatgttaagcttgcggtgtgctttttggatcc

SEQ ID NO: 2920 - DNA, 619 bp, Cenchrus ciliaris
gtcgacggtccggggaggggattatttagggttctgggttctcgaggcggcggcggcggcggctacacttttctctgtcttcgcaaggattatggtttggttgcacggagaagcttgtagtagatccttcgtcggggaatcgccatgagccggtcggggcagcctccggatctgaagaagtacatggacaagaagctccaaatcaagctgaatgcaaaccgtgttgtcattggcacccttcgtggatttgatcagttcatgaatctggttgtggacaacacagtggaggtcaatggaaacgacaagaatgacatcgggatggtggttatcagggggaacagtgttgtcatgattgaagctcttgagccggttgttttttttgctccccccctccctagccaaagtagctaataaaaaaaaagagttaattcaaaactggtgtatgccattgggcacgttgtatcctgtgttcctgacactttttcatgtgcaagcttaagcacctttgtatagttcagccagcattctgatttggagttgcgcaacctgctattatgcacttatgctggtgggattttttgctatcttggtagcgaacgtgttatacctgttctgggca

SEQ ID NO: 2921 - DNA, 446 bp, Ambrosia trifida
acaataataataaacctcattgattgtttttcaaccaattgaatcctccttctcatcgtcatcgtctcaaatttttaaggtttcagcatgagcagatcaggtcaacccccagatcttaaaaagtatatggacaagcaactacaaatcaagctgaatgcgaatcggacagtggtggggactcttcgtgggtttgaccagtttatgaatctcgtcatcgacaacacagtggaagtgaacggtgaagagaaaaatgaaattggcatggtggttatcagaggtaacagcgtagtgacggttgaagctctagagccagtcagcagagcccagtaactgatgttatgtttatcctgtaactgtttatctgtcttctcttaaaattagatctagcagtaactgatatgatactcaaaactttgtagagtatgatcggtttcatgctatactag

SEQ ID NO: 2922 - DNA, 422 bp, Ambrosia trifida
cagcatgagcagatcaggtcaacccccagatcttaaaaagtatatggacaagcaactacaaatcaagctgaatgcgaatcggacagtggtggggactcttcgtgggtttgaccagtttatgaatctcgtcatcgacaacacagtggaagtgaacggtgaagagaaaaatgaaattggcatggtggttatacgaggtaacagcgtagtgacggttgaagctctagagccagtcagcagagctcagtaattgatgttctgtttatccttgtatcggtttgttagtctttcctaaaaattagatctagcagtaactgatatgatactcaaagctttgtcgagtatgatcggtttcatgctatactagatttggctccttggtacaaacaagttgacttgtaagaagttgaattatggttggatgt

SEQ ID NO: 2923 - DNA, 700 bp, Artemisia annua
agcatggtatcaacgcagtactccgacggggaatttaattttgttcttcataaaccctaacgaattttcaaccaattcgatccattcatcttcaaattccaatttttaatcatgagcagatcaggccaacctccagatcttaaaaagtacatggacaagcagcttcagatcaagctgaatgcgaaccggacagtggtcgggacacttcgtggttttgatcagtttatgaacctcgtcattgacaacactgtagaagtgaatggtgaagagaaaaacgagattggcatggtggttataagaggtaacagcgtagtcactgttgaagcactggagccagtcagtagaccacagtaattggtatgttatggttgcaattcattgtctaatggaactgatatgatacttgaaacttgtacgaatatgatcggttttatgctgatttgtatccagtaaacaagtcctttgacatttgtataacgacttctgtctttctatgaagttgaattctggttcaatgttgtcttttatagtctgaagtaaacctaaatggtgggagggatgttcaagaaggtaattctttgggcgtcccttcaatcatgatgcatcacttgttgcaagaagtagttgctacatttaaccctttgtgggatttccaccactctttttgtcttcatcaatgactaaagttgattattcgaaa

SEQ ID NO: 2924 - DNA, 516 bp, Artemisia annua
agacgcactccgttcttcataaaccctaacgaatttccaatcaattcgatccattcatcttcaaattccaattcttaatcatgagcagatcaggccaacctccagatcttaaaaagtacatggataagcagcttcagatcaagctgaatgcgaaccggacagtggtcgggacacttcgtggttttgatcagtttatgaaccttgttattgacaacactgtagaagtgaatggtgaagagaagaatgagattggcatggtggttataagaggtaacagcgtagtcactgttgaagcactggagccagtcagtagaccacagtaattggtatgctatggttacaattcattgtcttatggaactgatatgatacttgaaacttgttccgagtatgaccggtttatgctgatttgtatccagtaaacaattcctttcacatttgtataacgacttgtatctttctatgaagttgagttctggttcaaaaaaaaaaaaaaaaacatgttggctctagaat

SEQ ID NO: 2925 - DNA, 509 bp, Fagopyrum esculentum
cataagtctgacgctcaaaccctcgaacaggaagctctcacatccgcctctctcgctttctcctcagtgcctagcttttacactcttcctagttcctcaccatgagcagatcgggccagcctccagatctcaagaagtacatggacaagaacctccaaatcaagctgaatgcgaataggatggtggtgggtacacttcgtggattcgatcaatttatgaatctggtgattgacaacactgtggaagtaaatggaaatgagagaaatgagatcggcatggtggttatcagaggaaatagtgtggtcacagttgaagctctggagcctgtaaacagatcgtaatttttttttttttttctgcatgactgtatgagctgctttaagaccctgttgtccttaactctagtttgaagggcagatgtgttttagatgcgaatatctggttcaggtaattgggtgactgtatttgggtgataatgtttcttcctttcaaaaccgtagcttatggtg

SEQ ID NO: 2926 - DNA, 684 bp, Fagopyrum esculentum
caaagcataaaccctggaacctcttctcagtctttacgctgcatccgcaactctctacgactatacctagttcttcaccatgagtaggtcgggtcagcctccggatctcaagaagtatatggacaagaacctccaaatcaagttgaatgcaaacaggatggtggtaggtacacttcgcggctttgaccaatttatgaacctggtgattgataacactgtcgaagtaaatggcaatgaaagaaatgaaattggcatggtggtaataagaggaaacagcgtggtcaccgttgaagcgcttgagcctgtaaacagatcatagtcttctagtgatgtaagaatgtaactcttggagattatctactttccatggtcattgaaaccctaaacctagacctctgtgatacttttgcgacgtgatatctgtctttcttactccaatttgcatcatatcagaatagttggtaaatttacaagtgaatcattgaagtagtcatttgatattctagatgtaaaacagctgattatgagcttcgttttgtcccaagtctggaccttttaagagacaagtgacttaaaacagaagcatctggataatttacttattagttataaagctaataaaagtacctaaaaaaaagaaaaaacaaaaaactaactagcgtgtatacaactcgcttcttgaga

SEQ ID NO: 2927 - DNA, 514 bp, Fagopyrum esculentum
gaacacgaagctctcacttccgcctctctcgctttctcctcagtgccaagcctttactctcttgctagttcctcaccatgagcagatcgggccagcctccagatctcaagaagtacatggacaagaaccttcaaatcaagctgaatgcaaataggatggtggtgggtacacttcgtggatttgaccaatttatgaatctggtgattgacaacactgtggaagtaaatggaaatgagagaaatgagatcggcatggtggttatcagaggaaatagtgtggtcacagttgaagctctggaacctgtaaacagatcatagttgttttttctgcatgactgtttgagctttaagaccctgttgtccttgagtctagtttgaagggcagatgtgtcttcaatgagaatatctgattcaggtaattggtaacaatggcgactatttcaagtgagatagatgtatttgggtgataatgtttcttcctttcaaaagcattagcttatggtacaaaatcattt

SEQ ID NO: 2928 - DNA, 496 bp, Flaveria ramosissima
tttttgccgtaataaaccccattgattcacaagcaatgaactccaccgtctcatcatctttgatccaccgttgtcaacacttttagggttccgacatgagcagatccggtcaacccccagatctcaaaaagtatatggacaagcaactacagatcaagctgaatgcgaatcggacagtggtggggactcttcgtggttttgatcagtttatgaacttagtcattgacaacaccgtggaagtgaatggtgaagagaagaatgaaataggcatggtggtcataagaggtaatagcgtagtcaccgttgaagctctagagccagtcaatagagctcagtgactgatatcatgttacggttgcaatgtattctgtaacggtttattttcttttcccaaaaatagatctagcagcaaccgatatgatactcaaaacttggtaaagagtatgatcggtttcatgctgatttgtacccgccagactatcagatactatttctt

SEQ ID NO: 2929 - DNA, 495 bp, Flaveria ramosissima
gggtttttctcgtgataaagataaacccttacagttttttcaagcatttcgattcgattcccccatcatcatcttgaatcgtcgttatctccatttctagggtttcaacatgagcagatcaggtcaacctccagatcttaaaaagtatatggacaagcaactgcagatcaagctgaatgcaaatcggacagttattgggacgcttcgtggttttgatcagttcatgaacctcgtcatcgacaacacagtggaagtcaatggtcaggagaaaaatgatattggcatggtggttataagaggtaacagtgttgtcactgttgaagcgctagagcccatcagcaaagcacagtaatcaacgttatgtcgcaaatctgttagtgtatgataagttttatgctgatttgtacccactagacaaatctgttactgtctttcgtgcgtacaagggagatgtgcattcggacttgtagaatttaagaatttgaatcatggttc

SEQ ID NO: 2930 - DNA, 476 bp, Flaveria ramosissima
accatctcatcatctttgattcaccgttgtcaacacttttagggttccgacatgagcagatccggtcaacctccagatctcaaaaagtatatggacaagcaactacagatcaagctgaatgcgaatcggacagtggtggggactcttcgtggttttgatcagtttatgaacctagtcattgacaacactgtggaagtgaatggtgaagagaagaatgaaataggcatggtggtcataagaggtaatagcgtagtcaccgttgaagctctagagccagtcaatagagctcagtgactgatgtcatgttacgtttgcaatgtattctgtaacggtttactttcttttcccaaaaatagatctagcagcaaccgatatgatactcaaaacttgttaaagagtatgatcggtttcatgctcatttgtacccgccagactatcagatactatttctcgttattacttttgtttcatcctag

SEQ ID NO: 2931 - DNA, 487 bp, Flaveria ramosissima
gccgtaataaaccccattgatttacaagcaatcgagctccaccctctcatcatctttgatccaccgttgtcaccacttttagggttccgacatgagccgatccggtcaacctccagatctcaaaaagtatatggacaagcaactacagatcaagctgaatgcgaatcggacagtggtgggtactcttcgtggttttgatcagttcatgaacctagtcattgacaacacagtggaagtgaatggtgaagagaagaatgaaataggcatggtggtcataagaggtaatagcgtcgtcactgttgaagccctagagcctgtcaatagagctcagtaactgatgtcatgttacggctgcaatgtattctgtaacgggttattttctttttcaaaaaatagatctagcagcaaccgatttgatactcaaaacttggtaagagtatgatccgtttcatgctgatttgtacccgccagactatcagatactatt

SEQ ID NO: 2932 - DNA, 434 bp, Flaveria ramosissima
gccgtaataaacccattgattcacaagcaatcgaactccaccatctcatcatctttgatccactgttgtcaacacttttagggtttccgacatgagcagatccggtcaacccccagatctcaaaaagtatatggacaagcaactacagatcaagctgaatgcgaatcggacagtggtggggactcttcgtggttttgatcagtttatgaacttagtcattgacaacaccgtggaagtgaatggtgaagagaagaatgaaataggcatggtggtcataagaggtaatagtgtagtcaccgttgaagctctagagccagtcaatagagctcagtgactgatgtcatgttacggttgcaatgtattctgttaacggtttatttctttaccaaaaatagatctagcagcaaccgatatgatactacaaaacttggtaa

SEQ ID NO: 2933 - DNA, 540 bp, Flaveria ramosissima
gccgtaataaaccccattgatttacaagcaatcgactccatacctctcatcatctttgattcaccgttgtcaacacttttagggttccgtcatgagcagatccggtcaacctccagatctcaaaaagtatatggacaagcaactacagatcaagctgaatgcgaatcggactgtggtgggaactcttcgtggttttgatcagttcatgaacctagtcattgacaacactgtggaagtgaatggcgaagaaaagaatgaaataggcatggtggtcataagaggtaatagcgtagtcactgttgaagccctagagccagtcaatagagctcagtaactgatgtgttacagttgaaatgtattctgtaacggtttattttcttttcgcaaaaatagatctagcagcaactgatatgagactcaaaacttgttaagagtatgatcggtttcatgctgatctgtacccgccagactatcagatactatttctcgttattacttttctttcatcctagagttaacatcacaaacaatgtgaaattg

SEQ ID NO: 2934 - DNA, 649 bp, Humulus lupulus
ttttactcagtctcagcgccactccggtctgcacagccaaccatccccggtctctcgctgtctcactccctccctcaaattgaggtttttgctgcgactagccttttctctttccaacatatcataccgattacagaatgagtaggtcagggcagccaccggatcttaagaaatacatggacaagaagcttcaaatcaagttgaatggcaatcgcatggttgttgggactcctaggggattcgatcagttcatgaatctagtggttgacaacactgtggaagtaaatggagatgagaggaatgatataggcatggtggttattaggggaaatagtgtggttactgttgaagctcttgaacctgttaccagaacacagtgaggtgcggctttgtagttggtagtgccatatgaattcttggctggtattagtttgaacatataactgctataatgggaaggaaaatgttttgtaattttggatttgatgttaattaaccaggttccttctatgagtactccgttcctatttccagcatttgttcctggtattgtactttgaatcatatgaactagctgtgaattcttacctggcttatataccaccatttgctccatctcttgtgatataaatgcactattagagttcta

SEQ ID NO: 2935 - DNA, 518 bp, Lactuca sativa
ggcggggatagggttttgctcttgtaaacctcgctgatttaaccaattcggcctctctctcatcgtcttcgaatcctcgctgtcttcattcctagggtttcgccatgagcagatcaggtcaacctccagatcttaaaaagtacatggacaagcaactacaaatcaagctgaatgcaaataggacagtggctgggacacttcgtggttttgatcagttcatgaacctggtgattgacaacacagttgaagtgaatggtgaagagaaaaatgaaataggcatggtggttataagagggaatagtgtggtaactgttgaagcactggagccagtcagcagaggacagtaattggtattttgtataatcatgctttatttactttttcatgaaaatagatgcttgcattaactgatatgatacttgaagcgtatgcaagtatgatcagttatgatgctgactaatcttttatatgtattgtgacttctaaacttttgtgaatttgaattcttgttcaatgtc

SEQ ID NO: 2936 - DNA, 520 bp, Lactuca sativa
gcggggatagggttttgctcttgttaacctcactgatttcaccaattcggcccctctctcatcgtcttcgtatcctcgctgtcttcattcccagggtttcgccatgagcagatcaggtcaacctccagatcttaaaaagtacatggacaagcaactacaaatcaagctgaatgcaaatcggacagtggttgggacacttcgtggttttgatcagttcatgaacctggtgattgacaacacggttgaagtgaatggtgaagagaaaaacgaaataggcatggtggttataagagggaatagtgtggtaactgttgaagcattggagccagtcagcagaggacagtaattggtattttgtataatcatgccttatttactttttcatgaaaatagatgctgcagtatcaactgatatgatacttgaagagtatgatcagctataatgctgactaatcttttatatgtattatgacttccatacttttctgaatttgaatccttgttcaatgtcaattttctg

SEQ ID NO: 2937 - DNA, 543 bp, Lotus japonicus
gggttgttctttctcactcaaaattttgcttcacaagaacgaaacgcagaactcgacgatttcgttcgttcttcacctcacaatctttcaccatgagcaggtcagggcaacccccggatttgaagaaatacatggacaagaatcttcagatcaagctgaatgcaaatcggatgattattggtactctccggggcttcgatcagtttatgaatttagttattgacaacactgtggaagtgaatggcaatgagaaaaatgatatagggatggtggtaatcagaggaaatagtgtggtcactgtggaggcacttgaacctgtgaccaagaattgagttctgtttgatgtaaacaattcgaagtatatttcttggtttaaactgtgtgtatgtgaactatgtagctgctgagagtaacatgtagtgttgcactttcaagttgttgctactctaaagtgaaggcttcttccttcgtttagctgatacttgccctgttgctctaacattctcattttgctctacatcaaatgatttggtttttggaagc

SEQ ID NO: 2938 - DNA, 296 bp, Orobanche aegyptiaca
aaaaaacattcagctcgttacctctccgcccctcagcagactcaaagacagaaagaagaagaaaatatgagcagatcgggtcagcctccggatctcaaaaagtatatggacaagcagctccaaatcaagttgaatgccaaccgcctagttgtggggactcttcgtgggttcgatcagttcatgaatttggttattgacaataccgttgaggttaatggcaatgagaagaatgagattggcatggtggtaattcggggtaatagtgtggtgacaattgaagcactggagcctgttag

SEQ ID NO: 2939 - DNA, 483 bp, Arachis hypogaea
agggtttctgagtgcagtgagggttttgttggttctctactctactcaactattcaccatgagcagatcagggcagccaccggatttgaagaagtacatggacatgaagcttcagataaaacttaatgcaaataggatgattgttggtaccctcaggggttttgaccagtttatgaacttagttgttgacaacactgtggaagtcaatggcaatgaaaagaatgaaatagggatggtggtaattagaggaaacagtgtagttactgttgaagcacttgaacctgtgaacagggcctgatttctgtttcattgtaatatttctcagtatattgcattgtttgaattggtgtgtattttgaacaatgtagatggctgagttctgtgagtaacatgaaattgtggatcttaaaggttcttttcctttctcagctgatttgttagtgtagcgtatggtgcataccgctatggttttattgggatggc

SEQ ID NO: 2940 - DNA, 473 bp, Arachis hypogaea
gttagggtttcagagttcagcgaaggttttgtgcacccaaattattgttctttcttcgtctttgttgcttctctactcaactattcaccatgagcagatcagggcagccaccggatttgaagaagtacatggacatgaagcttcagataaaacttaatgcaaataggatgattgttggtaccctcaggggttttgaccagtttatgaacttagttgttgacaacactgtggaagtcaatggcaatgaaaagaatgaaatagggatggtggtaattagaggaaacagtgtggttactgttgaagcacttgaacctgtgaacaggacctgatttctgtttcattgtaatatttctcagtatattgcattgtttgaattggtgtgtattttgaacaatgtacatgaaattgtggatcttaaggttcttttcctttctcagctgatttgttagtgtagcatactgtgcataccgcta

SEQ ID NO: 2941 - DNA, 462 bp, Senecio madagascariensis
tagggtttcgccatgagcagatcaggtcaacctccagatctcaaaaagtacatggacaagcaattgcagatcaagctgaatgccaatcggactgtggttggaacacttcgtgggtttgaccagtttatgaaccttgtgattgacaacactgtggaggttaatggcgaagagaaaaatgaaatcggcatggtggtcattagaggcaatagcgtcgtcactgttgaagcacttgaacctgtcagcagagctcaatgatttcagactcgtagctgtatggtctctcagtgtattctgtaattgatttctattttcccggaacagttctagtaatgtaaccgagttgatacttatctttaagaaagctgatttgcattcacttgacacaatcttgaattgcatattttggtgcaaataagcggtgtgacttcaatatttatcagtcgagttcttaatattttcatc

SEQ ID NO: 2942 - DNA, 434 bp, Senecio madagascariensis
aactttttctttttttctctctcttgaaaatttctagggtttcatcatgagcagatcaggtcaacctccagatctcaaaaagtatatggacaagcaattacagatcaagctgaatgctaatcggactgtggtaggaacacttcgtgggtttgaccagttcatgaaccttgtgattgacaacactgtggaagttaacggtgaagagaaaaatgaaatcgggatggtggtcataagaggcaatagcgtcgtcactgttgaagcactcgagccagtcagcagaggtcaatgatttcagactcgtagcagtatggtctttcagtgtattatgtaattgatttcgattttcccagaacagttctagtagtgtaattgagttgatacttatctttaagaaaaccgagtcgcattcacttgacacaatcttgaattgcata

SEQ ID NO: 2943 - DNA, 419 bp, Silene vulgaris
tctctttgaaaactctagggttttaacttttatcgacgatgagcaggtctggtcagcctccggatctcaagaaatatatggacaagaaacttcagataaagctgaatgcgaacaggatggtggttggtactctgcgtggttttgaccagttcatgaatcttgtggtcgataacacagaggaagttaatggcaatgagagaaatgagataggcatggtggtaatcagagggaacagtgtggtgacagttgaggctctagaaccagttagagggttgtaggtcatgtttaattcgattaactggttgtatgctatctggtatggtacgtaaaagatgttggtcttggtctgttttgtaactgaactggtgagatttttagctgtttcctttgaactcctttaaacgacttgtctccgttaa

SEQ ID NO: 2944 - DNA, 311 bp, Tragopogon dubius
atttcaaccaattcgcttccctccctcatcatctttgaatcatctccgtcttcctctctagggtttcgccatgagcagatcaggtcaacctccagatcttaaaaagtacatggacaagcaactacagatcaagctgaatgcaaatcggacagtggttgggacacttcgcgggtttgatcaatttatgaatctcgtgattgacaacacagtggaaatgaatggtgaagagaaaaatgacataggcatggtggttataagagggaatagtgtggtaactgttgaagcacttgagccagtcagcagagcacagt

SEQ ID NO: 2945 - DNA, 506 bp, Trigonella foenum-graecum
cgttgttctctcaactcatcaattcaccatgagcaggtctgggcagccaccggatttgaagaagtacatggacaaacagcttcaaatcaagctgaatgcaaatcgtatgattgttggtactctccgtggcttcgaccagtttatgaatatggttgttgacaatactgtggaggtgaatggcaatgagaaaaatgatatagggatggtggtaatcagaggaaatagtgtggtcactgtagaggcacttgaaccagtgaacaggaccatctaatttctgttcttgtaaacatttataagtaaatttcaaggtttcaacagaaatggcttagatgctcggagtaaaatgtaattgtggatcttaatatggtcatcttagcgagaaatctgaggttcttttctagttgatttgtgagtgttggatagttgtaattgggtggtagtggcttaactaaaatgatcagttgatctcatatttttctgttgcatatcacaattctcactttctg

SEQ ID NO: 2946 - DNA, 463 bp, Valeriana officinalis
agtttctgttcatctctctcgcgaatcgcgattcaccatgagcagatcaggccagcctccagatctcaaaaagtacatggacaagaagctacaaataaagctgaatgcgaatcggatggtggtgggaacacttcgtggttttgatcagtttatgaacatggtgattgaaaacaccgttgaagttaacggcaatgaaaaaaatgagataggcatggtggtcattagaggaaatagtgtgataactgttgaagctcttgaaccggttgctcgagcacagtgatcataaatctttagatgatgaaatcgttagatttcaagtattgttagagaggatggatttgagtttggttgtttgttatgtatttacttaattaaagtattacttaatacaaattaagttaaaaaagtaaaaacgtagttagttgtagtagttagtaagagcatctctagtggtagatgctag

SEQ ID NO: 2947 - DNA, 764 bp, Lactuca sativa
attaaatcataatacaagggaagaaaatcaagtaaaaatagaactatagaagagccgtatcccgtagtcgtatgatattagggttttgctcttgttaaacctcactgatttcaaccaattcggcccctctctcatcgtcttcgtatcctcgctgtcttcattcccagggtttcgccatgagcagatcaggtcaacctccagatcttaaaaagtacatggacaagcaactacaaatcaagctgaatgcaaatcggacagtggttgggacacttcgtggttttgatcagttcatgaacctggtgattgacaacacggttgaagtgaatggtgaagagaaaaacgaaataggcatggtggttataagagggaatagtgtggtaactgttgaagcattggagccagtcagcagaggacagtaattggtattttgtataatcatgccttatttactttttcatgaaaatagatgctgcagtatcaactgatatgatacttgaagagtatgatcagctataatgctgactaatcttttatatgtattatgacttccatacttttctgaatttgaatccttgttcaatgtcaattttctgattttctggttgcaaatatgtaccttgtggtgtgtgttgtctagttgggctagagatgtcaatttggatagaatgacttaatgggttaagccaaaaaaaaacctggctttatgtgttaagagttaagacactaaccttttacctatccacccttcattttttcctctccca

SEQ ID NO: 2948 - DNA, 489 bp, Platanus occidentalis
gtatctctatctgcatccaccatgagcaggtcaggtcagcctcccgatttgaagaagtacatggataaacagcttcagattaagctgaatgcaaaccgggttgtggttgggacactgcggggattcgatcagtttatgaatctggtgatagacaacactgtggaagtgaatggcaatgagaaaaatgaaatagggatggtggtatcagggcaatagtgtagttatgattgacgcactagagccagttagcaaagcgcagtaattgcagtttggtgaggatgctgatttaagtatgttttggatgatataattgctagaatggaaaggaaggtcttgtgtaaattgcatactagatggaagttggacgagatttctattcacatcttcctgtggcctttggttcgatgatttttgttgttttgacatgatgactggatgtattgatagaaaacattaggcttattgtattgctcaagatgatggtgggaa

SEQ ID NO: 2949 - DNA, 698 bp, Medicago truncatula
aagcagtggtatcaacgcagagtgcccattacggccggggaaaagagactgatagagtagccgccgactaactccctttcttctttctcatcacttcagacttcatctcaccaccaccaccatgagcagatcaggacaaccaccagatttgaagaagtacatggacaaacagcttcagatcaagctgaatgcaaatcgaatgattgttggcactctccgtggcttcgaccagtttatgaatttggttgttgacaatactgtggaggtaaacggcaacgaaaaaaatgacatagggatggtggtaatcagaggaaatagtgttgtcactgtagaggcacttgaaccagtagtgaacaggatcggatgatttatgtttctaattgtaaacttttataagtaaatttcaaggtttcaagaggaaaatgtaattgtggatctttaatatggccatgatggagactaatctgattctgtagttctttatcttgttgatttgtgaggacaactttagtgttttagtggctggttaatttttatatttggcaattctcattttctttctatgttatttaatctaaaatcactgttgttggttgagctattacagtttacacctaatgttatgttcttaggaaatcatttatttgagagattaaggatatcttatttgtttttaatgaatgtcaaaatcttataga

SEQ ID NO: 2950 - DNA, 649 bp, Medicago truncatula
cgccgactaactccctttcttctttctcatcacttcagacttcatctcaccaccaccaccatgagcagatcaggacaaccaccagatttgaagaagtacatggacaaacagcttcagatcaagctgaatgcaaatcgaatgattgttggcactctccgtggcttcgaccagtttatgaatttggttgttgacaatactgtggaggtaaacggcaacgaaaaaaatgacatagggatggtggtaatcagaggaaatagtgttgtcactgtagaggcacttgaaccagtagtgaacaggatcggatgatttatgtttctaattgtaaacttttataagtaaatttcaaggtttcaagaggaaaatgtaattgtggatctttaatatggccatgatggagactaatctgattctgtagttctttatcttgttgatttgtgaggacaactttagtgttttagtggctggttaatttttatatttggcaattctcattttctttctatgttatttaatctaaaatcactgttgttggttgagctattacagtttacacctaatgttatgttcttaggaaatcatttatttgagagattaaggatatcttatttgtttttaatgaatgtcaaaatcttatagaaaaaaaaaaaaa

SEQ ID NO: 2951 - DNA, 797 bp, Trigonella foenum-graecum
aaatccaaccccacccgtacccatgacccaactccaaaataatatatttactccgttttcttttcttctactaaagagactgatagactatccgccgcctaactctcttccttccttctcatctcaacatgagcagatcaggacaaccaccagatttgaagaagtacatggataaacagcttcagatcaagctgaacgcaaatcgcatgattgttggtactctccgtggtttcgaccagttcatgaatttggttgttgacaatactgtggaagtaaatggcaatgagaaaaatgacatagggatggtggtaatcagaggaaatagtgtggtcacagttgaggcacttgaaccagtagtgaacaggatctcctgatttatgtttctaattgtaaacatttttaagtaaatttcaaggtttcaacacaaactgtgtatgtgtgactcctgggattaaaatgtaattgtggatctaaatatggttatgttggagactaatcggagtatcttaatatgtgttctagtactgagttgttgtgtgtttttatgttttgttttcggcagagattcttaatatgcaggtacctgaatatgatgaatttggtgaattgctactttgtttcacctttgttccaatacattaagtagttttttccaatacattttaagtacagtaaaaaactggatgatattatttttggttccttaattaaatcaatggcttagatctttttgttcaaacctgtataaatattgtaatcacctctcaaattgaagatgaagcccattgattcaaatc

SEQ ID NO: 2952 - DNA, 547 bp, Vaccinium corymbosum
cgtcggtacgtacgtacgtactacgaaggacgaacgtgggttagtctaacgacgacgagtaggcgacttttaagttcccggggtacggggttttcggtacccactagtagacaggtcagggcagcctccagatctcaagaaatacatggacaagaagctacagatcaagttgaatgcaaatcgaatggtggttgggacactccgcggttttgatcagttcatgaatcttgttattgacaacactgaggaggtgattgggaacgagagaactgatattggcatggtggttatcagaggaaatagcgtggtcactgttgaagcacttgaaccagtaagcagagcacaatgatttggactgtgtattgttttggtggaatgtagtatgtcctaacataaacagagttgtgtttgtatgaatgaagaatgtgcttaaagattatatttgtggtctgtttaggcaaaatttgttgtcgtttcccggttatataataagcactagtttgttcatgaagtttcccctgccatcaatctggaattgagttgcaag

SEQ ID NO: 2953 - DNA, 637 bp, Flaveria ramosissima
caatacaaggacctaagtcaagacaaaacgaaaaatagaagtggcaaaatcgtatgaaattagggtttttctcgtgataaagataaacccttacagttttttcaagcatttcgattcgattcccccatcatcatctttgaatcgtcgttgtctccatttctagggtttcaacatgagcagatcaggtcaacctccagatcttaaaaagtatatggacaagcaactgcagatcaagctgaatgcaaatcggacagttgttgggacgcttcgtggatttgatcagttcatgaacctcgtcattgacaacacggtggaagtcaatggtcaagagaaaaatgatattggcatggtggttataagaggtaacagtgttgtcactgttgaagctctagagcccatcagcaaagcacagtaatcaacgtcgtgtcgcgaatctgttagtgtatgattggttttatgctgatttacacccactagacaaatctgttactatctttcatacgtagtagggagatgtgcattcagacttgtagaatttaagaatttgaattatggttctatttcagttatttccttctcaagaaacagtgtgaaagggctaaaagatggtattttgggcaaaagaccatttagtaag

SEQ ID NO: 2954 - DNA, 416 bp, Flaveria ramosissima
gggtttttctcgtgataaagataaaacccttacagttttttcaggcatttcgattcgattcccccatcatcatctttgaatcgtcgttgtctccatttctagggtttcagcatgagcagatcaggtcaacctccagatcttaaaaagtatatggacaagcaactgcagatcaagctgaatgcaaatcggacagtcattgggatgcttcgtggttttgatcagttcatgaacctcgtcatcgacaacacggtggaagtcaatggtcaagagaaaaatgatattggcatggtggttataagaggtaacagtgttgtcactgttgaagctcttgagcccatcaacaaagcacagtaatcaacttcgtgtcacgaatctgttagtgtatgtattggtttatgtctgatttacacctacta

SEQ ID NO: 2955 - DNA, 450 bp, Flaveria ramosissima
ttctcgtaataaagataaaccctcacagttttcaagcaattcgattcgattcctccatcatctccttttctagggtttcaacatgagcagatcaggccaacctccagatcttaaaaagtatatggacaagcaactgcagatcaagctgaatgcaaatcggacagttgttgggacgcttcgtggttttgatcagttcatgaacctcgtcatcgacaacacggtggaagtcaatggtcaagagaaaaatgatattggcatggtggttataagaggtaacagtgtagtcactgttgaagctctagagccaatcagcaaagcacagtaatcaacgttatgtcgcgaatctgctagtgtatgattggttttatgctgatttataccctctaaacaaatctgttaccttcgtacgtactagggagatgtgcattcgtacttgtagaatttaagaat

SEQ ID NO: 2956 - DNA, 613 bp, Lotus japonicus
tcttcccacccctctcatccatcatcttcatcttcttcttcttctccactgaactcttctctcatctctaaccatgagcaggtcaggacagccaccagatttgaagaagtacatggacaagaatcttcaaattaagctgaatgcaaatcgcatgattgttggcaccctccgcggttatgatcaatttatgaatatggttgttgacaatactgtagaagtgaatggcaatgagaaaaatgacatagggatggtggtaatcagaggaaatagtgtggtcactgttgaggcacttgaacccgtgaccagaacctcctgatttctgtttcttgtgaactatttttaaaagtaaatttcaaggtttaatagaaagacacagctgttgagacttgagagtagaacataattgtgaatcttaatgtgtcatgtgtactcagtcttgctatcttgtgcttctggaaagtagaaactttttcttaactaaggggaagttgatattaatgacagtgccttagcagttagcactactcagcacttcagtacttatgcgttgcttacaattattaattgtagatccataaagtatgtcaaaatcacataaaaaggagttatggta

SEQ ID NO: 2957 - DNA, 437 bp, Thalictrum flavum
cagatcaggtcagcctccagatctgaagaagtacatggacaagcaacttcagatcaagctgaatgcaaatcgtctagtgacgggtacacttcgtggttttgaccagttcatgaatctggtgatggagaatactgttgagatgaatgggaatgagaaaaatagagataggcatggtggttatcaggggtaatagtgttgtgatgattgaggcccttgagccagttagcagaaatcagtagtcagaattgaagaggtactacctgcaagcaaccactggaggaatgcataggtttcatatttgcagttgtgaactttcagtaatctaggatatcatgaaatccaattctcgttttaacttgttctatgcatattatatcgaactgtgtgggagaatgtaatctaacaaggatatttgcacacttgagacctaaaaatta

SEQ ID NO: 2958 - DNA, 362 bp, Tripterygium wilfordii
cagccaccagatctcaagaagtacatggataagaaacttcaaattaagcttaatgcaaaccggatgattgttggaactctgcgtggatttgaccagttcatgaatttggtggttgacaatactgttgaggtgaacggcaatgagagaaatgatataggcatggtggtgatcagaggaaacagtgttgtcacagtagaagctcttgaaccagttgcgagatcgcagtgatgtattgtttacatatgaatatcattcgggtgtactactaattcttgtactctcttagataatttttgctagtatgagatgaatggattgctgccttcctatcggagttggcagcggcccacttgatagtcaaa

SEQ ID NO: 2959 - DNA, 661 bp, Adiantum capillus-veneris
tcctcccttcttttcagcggccagccccttcgcaacctaaagttttggaggcaaacctgacgtcgaagtttcatcgccatgagcaagtcaggacaacctccggatctcaagaaatatatggacaagaagttaaacattaagttgaatgcaaatcgagtggttgttggcacattgcgtggctatgaccagttcatgaatctggtacttgatggaacagtggaaatgaatggcaatgaccgaaatgagataggcatggtggtgattaggggcaacagtgttgtgatgattgaagctttggaacctgtgaatagaccaggagcttaatttagaagttttcaagttttggaaactatgctgatgacatgtaacaggagatgccataggcagtgagtgcatgcatgcactcttttaagtttcgaaagcttagaacaggttctctttggacacaaaaatttaaatttcctgttcgatgcagtgtggaattagtctgctggtatcttctgattattgctaaaaacaatagtcgcgacttttaattgttgtaatgataaatcctaacaagaagcttttgtactggtaatacttacttacatctggtataaagtgagttgtactaaaaaatgcactgctattaaacaaaaataaggttttttacctttcg

SEQ ID NO: 2960 - DNA, 579 bp, Pteridium aquilinum
gttctaagtctgttaaaacgtactacctgtgaggaagcctagcagcggcatttgagagcggccagaacccaccaagccattgtcgccatgagcaagtcggggcaacctccagatctcaagaagtacatggacaagaaactgaacattaagttgaatgcaaatcgtgtggttgtcggcacattgcgaggctatgatcagtttatgaatttggtacttgacggtactgtggagatgaatggaaacgatcggaacgagattggcatggtggttattagaggcaacagtgtcgtgatgattgaggctctagaacctgtcagtaggccaggaccatagagtacattttggtatacctcttttgtataatgtgcgccgtacaagcatgcgagccttatcagaagaatcttatgaagtgtcttgactacgttgatatgtattgttcatactctggaggcccgtcaaatttcaaggatgtttggccccactggtcgaaagcactgcaatgttctaattttgatcatttttggggacatgacagtagaattggaacatgtttctgattttttaagtaactgtgggtaa

SEQ ID NO: 2961 - DNA, 507 bp, Cichorium intybus
tcgggggagcgcgattatttcaccgattttcgttaatttgtggcgactcatcggcttctgtttagggtttcgccatgagcagatcaggtcagcctccagatctcaagaaatacatggacaagcaactgcgatgaagctgaatgccaatcggacagtgattggaacacttcgtgggtttgaccagttcatgaacctggtgattgacaacacagtgaaagtgaatggcgaagagaaaaacgacataggcatggtggtcataagagggaatagagtagtcactgtcgaagcactcgagccagtcagcagagcccagtgattccagattcttccccttacatattctgtaattgctttcttcttttcccaaaacagttctagtagtaaccaagatgatatttaattaaaaattgatttgcacctagtagctatgtccaattgcatctattggtgcaaacaagcagtgtattttatcttccaaattttaacatcatttgcttggtacaactt

SEQ ID NO: 2962 - DNA, 273 bp, Cajanus cajan
cgtatttcgttgatcgctgttatctcatcaacatgagcaggtcagggcaaccaccggattttgaagaagtacatggacaagaagcttcagattaagctgaatgcaaatcgcatgattgttggtactctccgtggctttgacctagtttatgaattttggttgttgacaacactgtggaatgatggcatgaagaaaaatgacattgggatggtggtaatcagaggaaacagtgtggtcactgttgaaaagcgcttgaacctgtgaacaggactt

SEQ ID NO: 2963 - DNA, 291 bp, Senecio madagascariensis
agcgtggtcgcggccgaggtactctttttttctttttcattaaaatttcagggtttaacaatgagcagatcaggtcaacccccagatcttaagaagtatatggacaagcaactacagatcaagctgaatgcgaacaggacagtggtcgggacacttcgtggttttgatcagttcatgaacctcgttatcgacaacacagttgaagtcaacggtgaagagaagaacgagattggcatggtaggtcataagagggaatagtgtagtcactgttgaagcactggagccggtcag

SEQ ID NO: 2964 - DNA, 474 bp, Nicotiana tabacum
  misc_feature (177)..(177): n is a, c, g, or t
  misc_feature (230)..(230): n is a, c, g, or t
  misc_feature (233)..(233): n is a, c, g, or t
  misc_feature (280)..(280): n is a, c, g, or t
  misc_feature (290)..(290): n is a, c, g, or t
  misc_feature (311)..(312): n is a, c, g, or t
  misc_feature (314)..(314): n is a, c, g, or t
  misc_feature (317)..(317): n is a, c, g, or t
  misc_feature (325)..(325): n is a, c, g, or t
  misc_feature (353)..(353): n is a, c, g, or t
  misc_feature (417)..(417): n is a, c, g, or t
  misc_feature (455)..(455): n is a, c, g, or t
cggcggggattatccggactctgaaaaactccaaaatcttgcactctccatcttacagcagtgagcaaagagtagaagacaaagggttcaaaggatgagcaggtcgggtcacctccggatctcaaaagtatatggacaagcaacttcaaatcaagctgaatgccaaccgcttagtcntcggcactcttcgtgggtttgatcagttcatgaatttggtcattgacaacacngtngaagttaatggcaatgagaagaatgaaattggcatggtggtaattcncggtaatagngtggtgactattgaagcattnnanccngttgccanagcgcagtaactctaaggtatctttgtntatgctctagattctgctgctgctctttaaggaacatatatttgtaccaagttattcagtattngactagatgacagttaacatgacaatggatttcaagtntgtaaaaagatgctctctc

SEQ ID NO: 2965 - DNA, 746 bp, Cephalotaxus harringtonia
ttatttccagagtaagttttcggcttgcggggttctcggcaccatgagcaaatcagggcagcccccagatctaaaaaagtacatggacaagaagcttaacataaaactgaatgcaaatcgcatggtggtcggtacattgcgaggatttgaccagttcatgaatctggttctggatggtactgtggaaattaatggcaatgacaggaatgaaattggcatggtggttattagaggtaatagtgttgtaatgattgaagctttggaaccagtcaacaagggctaatggtttttgtgtcaacacctttgtaattgggagatttagttacatagaacttttgtaatcgaaatttcacttggttaaaatgctataatgaatttccaggaggtgttgtaatcctttttgggactttttatctggaattattgacatgggaagcatgcaaaagaggctacttcaagatatatttttctctctttaagaggtgaaaggtaagtgaaactatatgctcatccatttgcagatggcaactgtgaaagaagctattgaatttttgtatgtaatttattgatttcagatattaacaacacctggttctgttgtcaacattaccatgaatttagttactgttaaaaatgcaatgattgtaaaggattgcgtatgcacaatttcagaattttaatcacacccagttttgtttctcaataatagcataaatttagtgattgcttatgcaaaaatttcagaa

SEQ ID NO: 2966 - DNA, 635 bp, Cryptomeria japonica
  misc_feature (625)..(625): n is a, c, g, or t
gataaaacctactcgctgtcattctctctgagtctatattcttggatatctgacctagtatcagttgggcaaataattttaggttttctattctttcgtctgcaccatgagcaaatcagggcagcccccggatctaaagaagtacatggacaagaaacttaacataaagctgaatgcaaaccgcatggtggttggtactttgcgaggatttgaccagttcatgaacctggtcctggatggtactgttgaaattaacggcaatgaaaggaatgagattggcatggtggtaattagaggcaatagtgttgtaatgattgaagctttggaaccagtcaacaggggttaacgttattgtgatgatacctttgtaattgatcgatttagctacatagaacttctataatcaattttccacttggttaaaatgctatagtgaattgccaataagcatggtaatcttttttgggttttctatttggaattaatgacacgaatgctctatatgccctttaagagcttgaagatgagtgaattcatttgtacatttatttgcagatggcaagtgtgaaggaagctattgaattcttgtacttagttaattgattctagatattatccacaccanattatgtttc

SEQ ID NO: 2967 - DNA, 458 bp, Flaveria ramosissima
ttctcgtaataaagataaaccctcacagttttcaagcaattcgattcgattcgattcctccatcatctccatttctagggttttaacatgagcagatcaggccaacctccagatctcaaaaagtatatggacaagcaactgcagatcaagctaaatgcaaatcggacagttgttgggacgcttcgtggttttgatcagttcatgaacctcgtcatcgacaacatagtggaagtcaatggtcaagagaaaaacgatattggcatggtggttataagaggtaacagtgtagtcactgttgaagctttagagcccatcagcaaagcacagtaatcaacgttatgtcgctaatctgttagtgtatgattggttttatgctgatttataccctctaaacaaatctgttaccacctttgtacgtactagggagatatgcattcgtacttgtagaatttaagaat

SEQ ID NO: 2968 - DNA, 464 bp, Guizotia abyssinica
ggccgtgataaacctcaagcaatcggattccgccctcacatcacttcatcgtcttcgtttctagggtttcaacatgagcagatcaggtcaacctccagatctcaaaaagtacatggacaagcaaatacagatcaagctgaatgcgaatcgaacagtggtggggactcttcgtggttttgatcagttcatgaacctagtcattgacaacacagtggaaatgaacggtgaagaaaagaatgaaataggcatggtggttataagaggcaatagcgtagtaactgttgaagctctagagccagtcagcagagctcagtaattgatgttgtgttgctcttgcattgtattttccaaaaatagatctactagcaactgatgcttctgtcagacaaacatgatactatttttgcttcttcggtacaaacaagtgatgtattctgaccttatagctttctaagaagttgaat

SEQ ID NO: 2969 - DNA, 503 bp, Carthamus tinctorius
tctctatctctctgggtttcgatatgagcagatcatgtctacctccagatctcaagaagtacatggacaagcaactgcagatcaagctgaatgccaatcggacagtagttggaacacttcgtggtttcgaccagttcatgaacctcgtaatcgacaatacagtggaaatgaacggtgaagagaaaaacgatataggcatggtggtcataagagggaatagcgtagtcactgttgaagcgctcgagccggtcagcagaggacagtgagtcaagacccgtatcggtatggcctcccaacgtattgtgtaattgtttttttttcttccaaaaacagtatttgagaccatttttagcttaaaaagcttatttgcacctagttggcaatctttaattgcgtctcctgtgcaaacgagcagtgtatggttgcagtctaacttcgactttttaagtgactttgtaattgtttcaaccagggatgagatcaagaccgcgctggttggtacc

SEQ ID NO: 2970 - DNA, 533 bp, Sequoia sempervirens
ggcagcatgagcaaatcagggcagcccccagatctaaagaagtacatggacaagaaacttaacataaaactgaatgcaaaccgcatggtggttggtactttgcgaggatttgaccagttcatgaatctggtcctggatggcactgttgaaattaatggcaatgaaaggaatgagattggcatggtggtaattagaggcaatagtgttgtaatgattgaagctttggaaccagtcaacaggggctaacgttattgtgatgacacctttgtaatcaattggtttagctacatagaacttctataatcaattttccacttggttaaaacactagagtgaattgccagtaagcatggtaatcttttttgggtttctatttggatttagtgacatgaatgctcaatatgccctttaagagcttgaagatgagtgaatttttgtgtacatccatttgtggatggcaagtgtgaaggaagctattggattcttgtatgtcgttaattgattttagatactatccacaccatattctgttt

SEQ ID NO: 2971 - DNA, 528 bp, Artemisia annua
gacgccataaaccccacaaaaaactttcaccatatcatcctctgcaactttttttctttttagggtttcatcatgagcagatcaggccagcctccagatctcaaaaagtacatggacaaacagctacagattaagctgactcgcgtgtcgaatgctaaccggacagtggttggaacacttcgtggttttgaccagttcatgaatctcgtgatcgacaacacagtggaagttaatggtgatgcaaaaaatgagataggcatggtggtcataagagggaatagtgtggtcactgttgaagcactcgagccagtcgccagagctcaatgatttgagactcgtagcagtttaatatcagctgtattgtgtaattgctttcttttctgaaacagttttagtagtaacctagttgacattatctatcaagcttatgtgccacctatttgacaaatttcaattgcacatttggtgtaaacgagcagtatattgactttatcctgactttaatgtttctaagtaaatcttggtaat

SEQ ID NO: 2972 - DNA, 533 bp, Tropaeolum majus
tacaaaactaatcgctgtatgtatacagtaaattggcgaaattccatcttcaaaaactctctctaaaccctagaatctctaccattcgttcctctgtcaccaccaatctagatcggcataatgagcagatcgggtcagcctccggatctcaagaagtatatggacaagaaactccaaatcaagctgaacgcaaataggatgattgttggtactcttcgagggtttgaccagttcatgaatctggtggttgacaacactgtggaagttaatggagatgagagaactgagataggcatggtggttttgcgaggaaatagtgtcgtgactgttgaggctctggagccaattgcgaaaacatatggataactgttgacattttatgtttttcaaaatttatatggagatggtaaactgaagtaatctaaacttcctttgtaatgatgggttatggttatcgttatcgctatcgctatgcatttgtaattgatgtttattttttttgctcatcttcaagtgttgaaatccctgttcct

SEQ ID NO: 2973 - DNA, 525 bp, Tropaeolum majus
cggccggggaatcgctgtatgtatacagtaaattggcgaaattccatcttcaaaaactctctctaaaccctagaatctctaccattcgttcctctgtcaccaccaatctagatcggcataatgagcagatcgggtcagcctccggatctcaagaagtatatggacaagaaactccaaatcaagctgaacgcaaataggatgattgttggtactcttcgagggtttgaccagttcatgaatctggtggttgacaacactgtggaagttaatggagatgagagaactgagataggcatggtggttttgcgaggaaatagtgtcgtgactgttgaggctctggagccaattgcgaaaacatatggataactgttgacattttatgtttttcaaaattaatatggagatggtaaactgaagtaatctaaacttcctttgtaatgatgggttatggttatcgttatcgctatcgctatgcatttgtaattgatgtttattttttttgtcttcatcttcaagtgttgaaat

SEQ ID NO: 2974 - DNA, 373 bp, Selaginella moellendorffii
gcgagggaagcgagcgccaaagcaccatgagcaagtctgggcagccgccggatctcaagaagtacatggatttgaagcttatgatcaagctcaacgcaaaccgagttgtggtgggcgtgctgcgaggattcgatcagttcatgaatctcgtcctggacaacaccatggagatcagtggcaacgagagaacggagattggcatggtggtgatcaggggaaacagcgtcgccatgatcgaagctctggaacctgtggcgccgagagcgcagtagaggtttttagctctggaattttgttaaagcctctcgcaagcaaagaaccaagaattgttttcatctttgctgttgaaaaaaaaaaaccgtagattcttctt

SEQ ID NO: 2975 - DNA, 488 bp, Ambrosia trifida
ggatacacaaacaagtgatattaggttttggccgtgataataataataaacctccctctcatcatcttttgaacaatcgttgtctcaattttttaaggttccaacatgagcagatcaggtcaacccccagatcttaaaaagtatatggacaagcaactacagatcaagctgaatgcgaatcggacagtggtggggactcttcgtggttttgaccagtttatgaatctcgtcatcgacaacacagtggatgacggtgaagagaaaaatgaaattggcatggtggttatacgaggtaacagtgtagtgactgttgaagctctagagccagtcagcagagcccagtaactgccgttatgtttatcctgtaacgttttatcagtctttcctaaagtttagatctagcagtaactgatatgatactcaaaaccttgtagcgtataatcggtttcatgctatccgagatttggctctttggtacaaacaagttg

SEQ ID NO: 2976 - DNA, 411 bp, Flaveria ramosissima
atcaggtcaacctccagatcttaaaaagtatatggacaagcaactgcagatcaagctgaatgcaaatcggacagttattgggacgcttcgtggttttgatcagttcatgaacctcgtcatcgacaacacggtggaagtcaatggtcaagagaaaaatgatatcggcatggtggttataagaggtaacagtgttgtcactgttgaagctctagagcccatcagcaaagcacagtaatcaacgtcatgtcgcgaatctcttagtgtatgattggttttatgctgatttatacccactagacaaatctgttactatctttcgtacgtactagggagtgtgcattcagacttgtagaatttaagaacttgaattatggttctatttcagttatttccttctcaagaaacagtgtg

SEQ ID NO: 2977 - DNA, 329 bp, Lolium multiflorum
agcgtggtcgcggccgaggtacatggacaagaagctccaaatcaaaatgaacgcaaaccgtgttgtcattggcaccctccgaggatttgatcagttcatgaatctggtggtggacaacaccgtggaggtcaatggagatgagaggactgatattggaatggtggttgttagggggaacagcgttgtcatgatcgaggcactggaaccgattgccaaatcgcagcagtgaattccaaggctctgccataatttaagcttcttactggtagtgtgaaaactgatgtatatgctattagtgctcatgttgtacctgcccgggcggccgctcg

SEQ ID NO: 2978 - DNA, 583 bp, Podocarpus macrophillus
gaagttttcacctcgaaaggagacacgatttcagcgcgtgggcattcgggcgcgcattatcctccattttattttcagggagatttaggccaccatgagcaagtcagggcaacccccagatctcaagaagtacatggacaagaaacttaacataaaattgaatgccaatcgaatggtggtcggtactttaagaggatttgaccagttcatgaatttggtgatcgatggtacagttgaaatcaatggcaatgaaagaaatgagataggcatggtggttatcagaggaaatagtgttgtgatgattgaagctttggaaccagtcaacaaaacgtaaaatgttttattttcacagtaccttgtaatttagagaagatttatttagaacttctataaacattctgccgctcgggtggaatagtatagtccactgcggtaagtggtgttttgggccttttcatttgaacagatcacacggactagataacaaagatatctgaaatttcttttgttctggagttcttttagagctggagcataactaattttacatgtatacactgcatagatggtaagcatgaatggg

SEQ ID NO: 2979 - DNA, 661 bp, Sciadopitys verticillata
actgcgtaaacaatagttgtccagttgttctcggcgcatttgcaggttacacaggtcgtctactctattctttctttctctattaagcaccatgagcaagtcaggacagcctccagatctgaaaaagtacatggacaagaagcttaacataaaactaaatggcaaccgaatggtgattggtactctaagagggtttgatcaattcatgaatcttgtgcttgatggtactttggaagtcattggcaacgatagaaacgagataggcatggtggtcatcagaggtaatagtgttgtaatgattgaagctttggaaccagtcaacaaggcttaatgttcactatgacactatcatgtaattgagatattttattgatataaaacttttgtaaacattttgctacttcgttaaaatgctaagtatgaagagccatctaagtgttctaatattttttgggctgtttattttgaacagaggacatcaacaatatgcaataggtaatatttcaatagatctttttgttagggctcgaagataattaagactaccaaagttactccaattgaaagctaagatggggctgtttattttgtaacagaggacatcaacaatatgcaataggtaatatttcaatcgatctttttgtttagggctcgaagataa

SEQ ID NO: 2980 - DNA, 1686 bp, Zea mays
acccgtgagatcgcgggacccacactcagcctcagcgaacccctctgcgttccgccgcagcttccgaagacatcgatgtcctagcaagttggaaacccccctccctcccctcatattcgcctccgcctccctctccctccgtccctcgtcaaatccacgcgaccgcgagagctctcagaaggccctagcacgcaaaaaccccacgagagagacgaatcttccgaatctctcggtggcgatggcgctctccgaccgctcccgcgagtcgctcctcccgagcttcctctacggctcctcggcgcgctctttcgctgccacaggagccgccgcgcgcctccctgtctcctccccggcgcctgccgcggctggagcaggaggcggcgtgccgttctcgatccaggcgcccaaggagaagatcgagatgtactcgccggccttctatgccgcctgcactgccggaggaatcgccagctgcgggctcacccacatggccgtcacgcctctcgacctcgtcaagtgcaatatgcagattgacccagcgaaatacaagagtatctcatctggatttggtatcctgttaaaggagcaaggggccaggggtttcttcaggggatgggtgcctactttgcttggttacagtgctcagggggcttgcaagtttggcttctatgagttctttaagaagtattactcggacatcgcagggcctgagtatgcccaaaagtacaagactctaatctacctcgcaggatctgcatctgctgaggtaattgctgatgtggctctctgcccttttgaagctgtgaaggtacgtgtgcagacacaacctggatttgctcgtggattgagtgatgggctccccaaatttgtccgatctgagggtgttcttgggctctacaagggaattgttcctctctggggtcgtcagattccttataccatgatgaagtttgcttcctttgagaccatcgttgagcttatctacaagcatgctgtgcctgttccgaagtctgagtgcagcaagactacccagttgggtattagctttgctggtggttacgttgccggtgtcttctgtgctattgtttctcacccggctgacaaccttgtgtctttcctgaacaatgccaagggagctacagtgggagatgctgttaagaagcttggtctctggggtctcttcactagaggacttcctcttcgtatcgtcatgattggtacccttactggtgctcagtggggaatttacgatgcattcaaagtgatggttggactcccaacaacgggaggtgttacacctgccccagcagcagaggctgaattgaaagccagtgcttgattttttttttctgtgttccctgagatcatatttggtagagtggaattgtatcagccagtcgagagcttagttcccgaatctttttttaatcgtaacggaaaatttgtccgtcatccttctgatgagaggaactcattaaacaggcgaaataggtcttttttgcgctgggaaaagtttgcgcttgatgcataataatttttaggacggcaacgctcttagagcgcaggttttgttcacctcctgtaccgaggaatgcttactaagtcccatttcacattatggtctttatgaaatagtgcacctcggttaatgttctttttgccgttattggaactacgcgattgctg

SEQ ID NO: 2981 - DNA, 1571 bp, Zea mays
taccccccttcatattcgcctccgcctccgcggctgtctccctcgtcaaatccacgcgaccgccgcgaggggctctcagaaagcaccagtaccaaaagccacccgagggagacgaatcttccgaatctctcggcggcgatggcgctctccgaccgctcccgcgagtcgctcctcccgagcttcctctacgcctcctcggcgcgctccttcgccgccacaggcgccgccgcgcgcctccatgcctccgccccggcgcctgccgcggctggagcaggaggcgccgtgccgttctcgatccaggcgcccaacgagaagatcgagatgtactcgccggccttctatgccgcctgcaccgtcggaggaatcgccagctgcggcctcacccacatggccgtcacgccgctcgacctcgtcaaatgcaacatgcagattgatccagcgaaatacaagagtatttcatctggatttggtgtcctattaaaggagcaaggggctaggggctttttcagaggatgggttcctacattgcttggttacagtgctcagggggcttgcaagtttggcttctatgagttctttaaaaagtattactcagacattgcagggcctgagtatgctcagaagtacaagactctaatctacctcgcaggatccgcatctgctgaggtaattgctgatgtggctctctgtccttttgaagctgtgaaggtacgtgtgcagacacaacctggatttgctcgtggattgagtgacggtcttcccaaatttgtccgatctgagggtgctcttgggctttacaagggaattgttcctctctggggtcgtcagattccttataccatgatgaagtttgcttcctttgagaccatcgttgagcttatatacaagcacgctgtgcctgttccgaagtctgagtgcagcaagactacccagttgggtattagttttgctggtggttacattgctggtgtcttctgtgctattgtttctcacccggccgataaccttgtgtctttcctgaacaatgccaaggatgctactgttggcgatgctgttaagaagcttggtctctggggtcttttcactagagggctgcctcttcgtatcgtcatgattggtacccttactggtgctcagtggggaatttacgatgctttcaaagtgatggttggactcccaacaacgggaggtgttacacctgccccggcagcgaaggctgaactgaaagccagtgcttgatttttctgtattcacggagatcattacttggtggagggtggaagtgtatcagtcactcgagagtttagtttccgattttttttttcttaaaaggaaaatttgtccatcatccttttggtgagaggaactcattaaacaggtggagtagatcttttttgtcccgggaaaagtttatgctttgatgcataataatttgtaggacagcagtgctgttagagcgcaggttttgtttacctcctgtaccgaggaatgcttactaagtcacatttcacattatggtgtttattttgaaagcgtgcacctcgcttgatgtccttttttgcccttgctgt

SEQ ID NO: 2982 - DNA, 1668 bp, Sorghum bicolor
acccacgaggtcgtgggacccacactcagcgtcagcgaaccccgttccgccgcagtctccgaagagatcgatgccctagcgaactagaaatccccccttcatattcgcctccgcctccctcgtcaattccacgcgaccgccagagcgttcagaaagcaccagcccccaaagccccacgagagagacgaatcttccgaatctctcggcggcgatggcgctctccgaccgctcccgcgagtcgctcctcccgagcttcctctacagctcctcggcgcgctccttcgccgccacaggcgccgccgccgcgcgcctccctgtctcggccccggcgcctgccgcggctggagcaggaggccgcgtgccgttctcgatccaggcgcccagcgagaagatcgagatgtactcgccggccttctacgcagcctgcacagccggaggaatcgccagctgcgggctcacccacatggccgtcacgccgctcgacctcgtcaagtgcaacatgcagatcgatccagcgaaatacaagagtatctcatctggatttggtgtcctgttaaaggagcaaggggctaggggcttcttcaggggatgggtccctaccttgcttggttacagtgctcagggggcttgcaagtttggcttctatgagttctttaagaagtattactcggacattgcagggcctgagtatgcccagaagtacaagactctgatctaccttgcaggatccgcatctgctgaggtaattgctgatgtggctctctgcccttttgaagctgtgaaggtacgtgtgcagacacaacctggatttgctcgtgggttgagtgatgggctccccaaatttgtccgatctgagggtgctcttgggctctacaagggaattgttcctctctggggtcgtcagattccttatacaatgatgaagtttgcttcctttgagaccatcgttgagcttatctacaagcatgctgtgcctgttccgaagtctgagtgcagcaagactacccagttgggtattagctttgctggcggttacattgctggtgtcttctgtgctattgtgtctcacccggctgacaatcttgtgtctttcctgaacaatgccaagggtgctacagtgggcgatgctgttaagaagctgggtctctggggtcttttcactagaggacttcctcttcgtatcgtcatgattggtacccttactggtgctcagtggggaatttacgatgctttcaaagtgatggttggactcccaacaacgggaggacctgcaccagcagcggtggctgccccagcagcagaggctgaatcgaaagccagtgcttgatttttctgtattccctgagatcatatttggtggaggttggagttgtgtaattcactcgagagcttagttcccgaatcatttttttttcttaacggaaaatttgtccgtcatccttatgatgagaggaactcattaaacaagtgaaataggtcttttttgcccccgggaaaagtttatgctggatgcataataatttgtaggacagcaatgctgttagagcgcaggttttggttacctccttactaagtcacatttcacattacgatgtttatggaagcgtgcacctcgtttgatgttctttttgccattgctggaactatgaagttgctgtcaatttcctt

SEQ ID NO: 2983 - DNA, 1723 bp, Sorghum bicolor
acccacgaggtcgtgggacccacactcagcgtcagcgaaccccgttccgccgcagtctccgaagagatcgatgccctagcgaactagaaatccccccttcatattcgcctccgcctccctcgtcaattccacgcgaccgccagagcgttcagaaagcaccagcccccaaagccccacgagagagacgaatcttccgaatctctcggcggcgatggcgctctccgaccgctcccgcgagtcgctcctcccgagcttcctctacagctcctcggcgcgctccttcgccgccacaggcgccgccgccgcgcgcctccctgtctcggccccggcgcctgccgcggctggagcaggaggccgcgtgccgttctcgatccaggcgcccagcgagaagatcgagatgtactcgccggccttctacgcagcctgcacagccggaggaatcgccagctgcgggctcacccacatggccgtcacgccgctcgacctcgtcaagtgcaacatgcagatcgatccagcgaaatacaagagtatctcatctggatttggtgtcctgttaaaggagcaaggggctaggggcttcttcaggggatgggtccctaccttgcttggttacagtgctcagggggcttgcaagtttggcttctatgagttctttaagaagtattactcggacattgcagggcctgagtatgcccagaagtacaagactctgatctaccttgcaggatccgcatctgctgaggtaattgctgatgtggctctctgcccttttgaagctgtgaaggtacgtgtgcagacacaacctggatttgctcgtgggttgagtgatgggctccccaaatttgtccgatctgagggtgctcttgggctctacaagggaattgttcctctctggggtcgtcagattccttatacaatgatgaagtttgcttcctttgagaccatcgttgagcttatctacaagcatgctgtgcctgttccgaagtctgagtgcagcaagactacccagttgggtattagctttgctggcggttacattgctggtgtcttctgtgctattgtgtctcacccggctgacaatcttgtgtctttcctgaacaatgccaagggtgctacagtgggcgatgctgttaagaagctgggtctctggggtcttttcactagaggacttcctcttcgtatcgtcatgattggtacccttactggtgctcagtggggaatttacgatgctttcaaagtgatggttggactcccaacaacgggaggacctgcaccagcagcggtggctgccccagcagcagaggctgaatcgaaagccagtgcttgatttttctgtattccctgagatcatatttggtggaggttggagttgtgtaattcactcgagagcttagttcccgaatcatttttttttcttaacggaaaatttgtccgtcatccttatgatgagaggaactcattaaacaagtgaaataggtcttttttgcccccgggaaaagtttatgctggatgcataataatttgtaggacagcaatgctgttagagcgcaggttttggttacctccttactaagtcacatttcacattacgatgtttatggaagcgtgcacctcgtttgatgttctttttgccattgctggaactatgaagttgctgtcaatttccttacgatttttggagctcacgaatgacgcagtaggaggaaacacaacagaaatggtt

SEQ ID NO: 2984 - DNA, 1574 bp, Saccharum officinarum
gcctccgcctccctcgtcaaactcacgcgaccgcgagggctctcagaaagcaccagcacccaaagccccacgagagagacgaatcttccgaatctctcggcggcgatggcgctctccgaccgctcccgcgagtcgctcctcccgagcttcctctactcgtcctcggcgcgctccttcgccgccactggcgccgccgcgcgcctccctgtctcctccccggcgcctgccgcggctggagcaggaggcggcgtgccgttctcgatccaggcgcccaacgagaagatcgagatgtactcgccggccttctacgccgcctgcaccgccggaggaatcgccagctgcgggctcacccacacggccgtcacgccgctcgacctcgtcaagtgcaacatgcagattgatccagcgaaatacaagagtatctcatctggatttggtgtcctgttaaaggagcaaggggctaggggcctcttcaggggatgggtgcctaccttgcttggttacagcgctcagggggcttgcaagtttggcttctatgagttctttaagaagtattactcggacattgcagggcctgagtatgcccagaagtacaagactctaatctacctcgcaggatccgcatctgctgaggtaattgctgatgtggctctctgcccttttgaagctgtgaaggtacgtgtgcagacacaacctggatttgctcgtgggttgagtgatgggctccccaaatttgtccgatctgagggtgctcttgggctctacaagggaattgttcctctctggggtcgtcagattccttataccatgatgaagtttgcttcctttgagaccatcgttgagcttatctacaagcatgctgtgcctgttccaaaatctgagtgcagcaagactacccagttgggtattagctttgctggcggttacattgctggtgtcttctgtgctgttgtatctcacccggctgacaaccttgtgtctttcctgaacaatgccaagggtgctacagttggcgatgctgttaagaagcttggtctctggggtcttttcactagaggacttcctcttcgtatcgtcatgattggtacccttaccggtgctcagtggggaatttacgatgctttcaaagtgatggttggactcccaacaacgggaggtgttacccctgccccagcagtggaggctgtctcagcagcagaggctgaatcgaaagccattgcctgatttttctgtattctctgagatcatattttggtggaggatggaattgttatcagtcactcgagagcttagtccccgaatcttttttcttcttaacggaaaatttgtctgtcatccttttgatgagaggaactcattaaacaggtgaaatagatcttttttgccctgggaaaagtttatgcttgatgcataataatttgtaggacagcaatgctgttagagcgtaggttttggttacctcctgtaccgaggaatactcagtcacatttctcaatatggtgtttatgaaagcgtgcacctcctttgatgttctaagaaagggtaggaagccctaattatatcccccaagacga

SEQ ID NO: 2985 - DNA, 1758 bp, Setaria italica
cgaagatgtcgatgccctagcaagttggaaatccccccttcatattcgcctcctcgtcgaatccacgcgaccgcgagagctctcggaaagcaccaccagcccccgccccccctccaagccccacgagagggacgaatcttccgaatctctcggcggcgatggcgctctccgaccgctcccgcgagtcgctcctcccgagcttcctctacgcctcctcggcgcgctccttcgccgcctcctcccccgcgcgctccttcgccgcctccgccccggcgccggccgcggctgctggagctggcggcggcggcgcgccgttctcgatccaggcgcccaacgagaagatcgagctctactcgccggcgttctacgccgcctgcaccgccggagggatcgccagttgcgggctcacccacatggccgtcacgccgctcgacctcgtcaagtgcaacatgcagatcgatccagcgaaatacaagagcatctcatctggatttggtatcctgttaaaggagcaaggggctaggggctttttcaggggatgggtgcctaccttgcttggttacagtgctcagggggcttgcaagtttggcttctatgagttcttcaagaagtactactcagatattgcagggcctgagtatgcccacaagtacaagactctaatctacctcgcaggttctgcttctgctgaggtaattgctgatgtggctctctgccccttcgaagctgtgaaggtacgtgtgcagacgcagcctggatttgctcgtgggttgagtgatgggctccccaaatttgtccggtctgagggtgctctcgggctctacaagggaattgttcctctctggggtcgtcagattccttataccatgatgaagtttgcttcctttgagaccattgttgagcttatctacaagcatgctgtgcctgttcccaagtctgagtgcagcaagacgacccagttgggtatcagctttgctggtggctacattgctggtgtcttctgtgctattgtttctcacccggctgacaaccttgtgtctttcctaaacaatgccaagggtgctacagtgggtgatgctgttaagaagattggtctcttgggtcttttcaccagaggacttcctcttcgtattgtcatgatcggtacccttactggtgctcagtggggaatttatgatgctttcaaagtcatggttggactcccaacaactggtggtgttactcctgccccagcagaggctgaatcgaaagccagcgcttgatttttcagtactccctgagatcgtatttggtggatggaattgtatcagtcactcaagagctagtcccaaatcttttgtttttttcttaacggatgatttgtccgtcatccttttgatgagaggaactcattaaacaggtgaaataggtcttttttgccccgggaaaagtttatgctcgatgcataataatttgtaggacagcaaggctgttagagcgaagattttgtttacctcctgtaccgaggaatgctcacaagtcgcatcatggagttttctggaagcatgcacctaatttgatgctcattctgccatatcatggtagagtaatcggttacccttgttttcaactacaactcttcgtttgctcctcttttttcgactttgcatcattggttcaagatttacattttttcccgaattgaacattctgcctcgtctccttgtacgactttcatctctcaacattctatcaaacagatcactgcactttacatgc

SEQ ID NO: 2986 - DNA, 1540 bp, Panicum virgatum
ccacgcgtccggaagcccgcccccttcatattcgcctccgcctccgcggctccgcctcctcgtcaaacccacgcgaccgcgagagctctccgagagcaccaccacgagagagacgaatcttccgaatctctcggcggcgatggcgctctccgaccgctcccgcgagtcgctcctcccgagcttcctctacgcctcctcctcggcgcgctccttcgccgccaccccctcgcgcctctccgtccccgtccccgccccggccccggccgcggctggagctggtggcggtgcgcccatcacgatccaggcgcccaaggagaagatcgagctctactcgccggcgttctacgccgcctgcacggccggagggatcgccagctgcgggctcacccacatggccgtcaccccgctcgacctcgtcaagtgcaacatgcagatcgatccagcgaaatacaagagcatctcatctggatttggtgtcctgttaaaggagcaaggggctaggggcttcttcaggggatgggtgcctaccttgcttggttacagtgctcagggggcttgcaagtttggcttctatgagttcttcaagaagtactactcagatattgcagggcctgagtatgcccagaagtacaagactctaatctacctggcaggttctgcttctgctgaggtaattgccgatgtggctctctgcccctttgaagctgtgaaggtacgtgtgcagacgcagcctggatttgctcgtgggttgagcgatgggctccccaaatttgtccgatctgaaggtgctctcgggctctacaagggacttgttcctctctggggtcgtcagattccttataccatgatgaagtttgcttcctttgagaccattgttgagcttatctacaagcatgctgtgcctgttcccaagtctgagtgcagcaagttgacccagttgggtatcagctttgctggtggctatattgctggtgtcttctgtgctattgtttctcacccggctgacaaccttgtttctttcctgaacaatgccaagggtgctacagtgggtgatgctgttaagaagtttggtctctggggtcttttcaccagaggacttcctattcgtattgtcatgattggtacccttactggtgctcagtggggaatttatgatgctttcaaagtcatggttggactcccaacaactggtggtgttacacctgccccagcagaggctgaatcgaaagccagcgcttgatttttctgtaaccccttgatggtatttggtggatggaattgtatcaatcattcaagagcttagttcccaatcttttgttttttttcttaattgtccagtcacctttttgatgagaggaactcattaaacagttgaaataggtccgtttttgcccccaggaaaagtttatgctcgatgcataataatttgtaggacagcaagactgttagagcgaagattttgtttgccacctatactgaggaatactcacaagcaacatcatggagtttgtggaagcacgtacctaatttgacgctcttc

SEQ ID NO: 2987 - DNA, 1838 bp, Oryza sativa
cgagaaaattttggcaccgctaccattctctagccataaagtagtccctccacagcccagattccaggcaccaacaacaaccccaacagacgctgacacatcgggcccacatattaacgggccccacacgcagcgaccctccggttcatctccacctcccaaaagatcgatgccctaacaacttggaagcccatctcgcctcgccgccccccttcatattcaccctccgccgcctcgtcaattccacgcgaacgcgagagctctcggaaagcaccaccaccagcacagagccagcgcgagagagagagagagggagaccaaaccccatcccggatctctcgtcgtcggcggcgtctgcgatggcgctctccgaccgctcccgcgagtcgctcctcccgagcttcctctacacctcctccgccgcgaggtccttcgccaccggcgccacccgcttcccctccccggtgtccccagcttccccggctccgggtgccgtcgggggcggcgcgcccatctcgatccaggctcccagggagaagatcgagatgtactcgccggcgttctacgccgcctgcactgccggtgggatcgccagctgcgggctcacccacatggccgtcacgccgctcgacctcgtcaagtgcaacatgcagattgatccagcaaaatacaagagcataacatctgggtttggcgtcctcttaaaggagcaaggacctagaggcttcttcaggggatgggtgcctaccttgcttggttacagtgctcagggcgcatgcaagtttgggttttatgagttctttaagaagtactactcagatattgctgggcctgagtatgctcagaagtacaagaccctaatttacctcgctggatcagcttctgctgaggtgattgcagatgtggctctctgcccatttgaagctgtgaaggttcgtgtgcaaacccaacctggattcgctcgtggactgagtgatgggctccccaagttcgtcagatctgaaggcgctcttgggctttacaagggaattgttcctctgtggggtcgccaaatcccttatactatgatgaagtttgcctcctttgagaccattgttgaaatgatctacaagcacgctgttcctgttccgaagtctgagtgcagcaagtctttccaattgggtatcagtttcgctggtggttacattgctggagtcttctgtgccattgtctctcatccagctgacaacttggtctctttcttgaacaacgccaagggagctacagtgggtgatgctgttaaaaagcttggtctttggggccttttcactagaggactgccccttcgtattgttatgattggaactcttactggtgctcaatggggtatttatgatgcttttaaagtcatggttggacttccaacaaccggtggtgttacgcccgcgcccggtgcagcagagaaagcattgcaagccagtgcttgattcttatgcagagataatggcgatgtattcctgaagatccatctttgttgtggctggaattgtatcaattacttgagtttagcacctaaatcttaattttagtggatgattcttgtgtcatccttttgatgagaggaactcattaatcaggtgaagtaggtcttttttgcccccgggaaagtttgatgcttgatacataataaatttttggacagcaaggctgttagagctcaggttttggcatcacctgtactgaggaatactcacatctttgtgttccttaaaagcatacataccttgaatcaatgctaccctattttttttgttgcaagtcagatatatgtgtgtgaaactgtcaataccaggaatctc

SEQ ID NO: 2988 - DNA, 1635 bp, Oryza sativa
tggaagcccatctcgcctcgccgccccccttcatattcaccctccgccgcctcgtcaattccacgcgaacgcgagagctctcggaaagcaccaccaccagcacagagccagcgcgagagagagagagagggagaccaaaccccatcccggatctctcgtcgtcggcggcgtctgcgatggcgctctccgaccgctcccgcgagtcgctcctcccgagcttcctctacacctcctccgccgcgaggtccttcgccaccggcgccacccgcttcccctccccggtgtccccagcttccccggctccgggtgccgtcgggggcggcgcgcccatctcgatccaggctcccagggagaagatcgagatgtactcgccggcgttctacgccgcctgcactgccggtgggatcgccagctgcgggctcacccacatggccgtcacgccgctcgacctcgtcaagtgcaacatgcagattgatccagcaaaatacaagagcataacatctgggtttggcgtcctcttaaaggagcaaggacctagaggcttcttcaggggatgggtgcctaccttgcttggttacagtgctcagggcgcgtgcaagtttgggttttatgagttctttaagaagtactactcagatattgctgggcctgagtatgctcagaagtacaagaccctaatttacctcgctggatcagcttctgctgaggtgattgcagatgtggctctctgcccatttgaagctgtgaaggttcgtgtgcaaacccaacctggattcgctcgtggactgagtgatgggctccccaagttcgtcagatctgaaggcgctcttgggctttacaagggaattgttcctctgtggggtcgccaaatcccttatactatgatgaagtttgcctcctttgagaccattgttgaaatgatctacaagcacgctgttcctgttccgaagtctgagtgcagcaagtctttccaattgggtatcagtttcgctggtggttacattgctggagtcttctgtgccattgtctctcatccagctgacaacttggtctctttcttgaacaacgccaagggagctacagtgggtgatgctgttaaaaagcttggtctttggggccttttcactagaggactgccccttcgtattgttatgattggaactcttactggtgctcaatggggtatttatgatgcttttaaagtcatggttggacttccaacaaccggtggtgttacgcccgcgcccggtgcagcagagaaagcattgcaagccagtgcttgattcttatgcagagataatggcgatgtattcctgaagatccatctttgttgtggctggaattgtatcaattacttgagtttagcacctaaatcttaattttagtggatgattcttgtgtcatccttttgatgagaggaactcattaatcaggtgaagtaggtcttttttgcccccgggaaagtttgatgcttgatacataataaatttttggacagcaaggctgttagagctcaggttttggcatcacctgtactgaggaatactcacatctttgtgttccttaaaagcatacataccttgaatcaatgctaccctattttttttgttgcaagtcagatatatgtgtgtgaaa

SEQ ID NO: 2989 - DNA, 1694 bp, Setaria italica
atcggggacctggactccgccgccgctccctctcccattccccttcgccaaacccacgcgaccgggagagcgcagcgcagagagcaccgccaccgccgagaggattggcccagccgagcaaaccctccaaatctcggcggcaatggcgctctccgaccgctcccgcgagtcgctcctcccgagcttcctctacgccccgtcggcggcgcggtccttcgccggcgcctcccgctttccctcctcgcccgccgcggccccgggaagcggtggtgccccgtcgttcccgatccaggcgcccaaggagaagatcgagatgtactcgccggcgttctacgccgcctgcacggccggaggcatcgccagctgcgggctcacccacatggccgtcacgccgctcgacctcgtcaagtgcaacatgcagatcaatccagcgaaatacaagagcatcacatctgggtttggagttctagcccaggagcaaggagtgaggggcttcttcaggggatgggtgcccaccctgcttggttacagtgctcagggagcttgcaagtttggattctatgagttcttcaagaagtactactcagatattgcagggcctgagtatgctcagaaatacaagaccttgatataccttgctggatcggcttctgctgaggtgattgctgatgtggctctctgccccttcgaagctgtgaaggtccgtgtgcagacacagcctggtttcgctcgtgggctcagtgatgggcttcctaagttcattagatctgagggtgccctggggctttacaagggaattgtccctctctggggtcgtcagattccttatacaatgatgaagtttgcgtcatttgagaccattgttgaacttatctacaagcatgctgttcctgttccgaagtcagagtgtagcaaatctttccagttgggtatcagctttgctggtggctatgttgctggtgtcttctgcgccattgtttctcacccggcagataacttggtctctttcctgaacaatgctaagggtgctacagtgggtgatgctgttaagaagcttggcctctggggtctcttcactcgtggtctaccccttcgtattgtcatgatcggtactcttactggagctcagtggggaatttatgatgcattcaaagtcatggttggattgcctactactggtggtgttacgcctgcaccagcccctaccacagaggaggctgcgttgaaggccagtgcctgatccttcatattaagacaactagaatgcattgatcattctttaccgatgacaaattttccaattacatgagttcaaccttgtgttctaaatttttgagaggatggctgtcatccttcagacgagaggaactcgctaaactggtgatcatagttttttgcccaagtgtaaccctagtgcttgatgatatataataagttttaggttcgcatcactgttaggagcccaggttttgctatcacctgtgccatggtttattctcattacagtacctttcatatgctgctgattttgtggtatcactggtcatccatgtgaatgagttgatgacaaccgttcaagctcctgatttcagtagtgtgctgttttctcctgcaagattacattctgtgatgcctatagtttagacttgcattctattggtttggcccactggcggtgagatatgaattaaaac

SEQ ID NO: 2990 - DNA, 1531 bp, Panicum virgatum
cctttcgccgaatccacgcgaccgcgcgagcgcagagagcaccgccaccgccgaggggatcggcccagacgagcaaaccctccgagtctcggcggcaatggcgctctccgacctgtcccgcgagtcgctcctcccgagcttcctctacgcccctgcggcggcgaggtccttcgccggcgcctcccgcctccccgcctcgcccgccgcggcaccggggggtgcgggcgcgccgtcgttcccgatccaggcgcccaaggagaagatcgagatgtactcgccggcgttctacgccgcctgcacggccggaggcatcgccagctgcgggctcacccacatggccgtcacgccgctcgacctcgtcaagtgcaacatgcagatcgatccagcgaaatacaagagcatcacatccgggtttggaattctggccaaggagcaaggagtgaggggcttcttcaggggatgggtgcccaccctgcttggttacagtgctcagggagcttgcaagtttggattctatgagttcttcaagaagtactactcagatattgcagggcctgagtatgctcagaagtacaagaccttgatataccttgctgggtcggcttctgctgaggtgattgctgatgtggctctctgcccctttgaagctgtgaaggtccgtgtgcagacacagcctggttttgctcgtggactcagtgatgggctccctaagttcattaaatctgaaggtgctctggggctttacaagggaattgttcctctctggggtcgtcagattccttacacaatgatgaagtttgcttcatttgagaccattgttgaacttatctacaagcatgctgttcctgttccaaagtcagagtgtagcaaacctttccaattgggtatcagctttgctggtggctacattgctggtgtcttctgtgccattgtttctcacccggcagataacttggtctctttcttgaacaatgccaagggtgctacagttggtgatgctgttaagaagcttggcctctggggcctcttcactcgaggactaccccttcgtattgtcatgatcggtactcttactggagctcagtggggaatttatgatgcgttcaaagtcatggttggactgcctactactggtggtgttacacctgcaccagcccctaccgcagaggaggctgcgttgaaggctagtgcctgatccttcatattaagacaactggaatgcagtgatcattctttaccgatgacgaatgtaccaattacatgggttcaacctttatgttctaaattcttgagaggatggctgtcatccttcggatgagaggaactcgctaaaccggtgatcatagttctttttgcccaggagtgtaaccttagtgcttgatatataataaattttaggttcacatcactgttaggagccctggttttggtctcacctgtgccaaagtttattcacatcacagcacctttcatgtgctgacaattttttggcatcactggtcatccatatgaacgagttgatgataaagtc

SEQ ID NO: 2991 - DNA, 1560 bp, Panicum virgatum
gatccggggacctggactccgccgcctccccctctcccattccccctttcgccaaatccacgcgaccgcgcgagcgcagggagcaccgccaccgccgaggggattggcccagccgagcgaaccctccgagtctcggcggcaatggcgctctccgacctctcccgcgagtcgctcctcccgagcttcctctacgcccctgcggcggcgaggtccttcgccggcgcctcccgcctccccgcctcgcccgccgcggcgccggggggcgcgggcgcgccgtcgttcccgatccaggcgcccaaggagaagatcgagatgtactcgccggcgttctacgccgcctgcacggccggaggcatcgccagctgcgggctcacccacatggccgtcacgccgctcgacctcgtcaagtgcaacatgcagatcgatccagcaaaatacaagagcatcacatctgggtttggaattctggccaaggagcaaggagtgaggggtttcttcaggggatgggtgcccaccctgcttggttacagtgctcagggagcctgcaagtttggattctatgagttcttcaagaaatactactcagatattgcagggcctgagtatgctcagaagtacaagaccttgatataccttgctgggtcggcttctgctgaggtgattgctgatgtggctctctgcccctttgaagctgtgaaggtccgtgtgcagacgcagcctggttttgctcgtgggctcagtgatgggctccctaagttcattaaatctgaaggtgctctggggctttacaagggaattgttcctctctggggtcgtcagattccttacacaatgatgaagtttgcttcatttgagaccattgttgaacttatctacaagcatgctgttcctgttccaaagtcagagtgtagcaaatctttccaattgggtatcagctttgctggtggctacattgctggtgtcttctgtgccattgtttctcacccggcagataacttggtctctttcctgaacaatgccaagggtgctacagttggtgatgctgttaagaagcttggcctctggggcctcttcactcgaggactaccccttcgtattgtcatgatcggtactcttactggagctcagtggggaatttatgatgcgttcaaagtcatggttggattgcctactactggtggtgttacacctgcaccagcccctaccgcagaggaggctgcgttgaaggccagtgcctgatccttcatattaagacaactataatgcagcgatcattctttaccgatgacaaatgtaccaattacatgagttcaacctttatgttctaaattcttgagaggatggctgtcatccttttgtcgagaggaactcgctaagccggtccggtgatcatagttctttttgcccaggagtgtaaccttagtgcttgatatataataaattttaggttcacatcactgttaggagccctggttttggttggcatcactggtcatccatatgtacgagttgatgacaatgttcaagctctgagtttcagtaggattctgctctctgtaa

SEQ ID NO: 2992 - DNA, 1575 bp, Cenchrus ciliaris
  misc_feature (151)..(151): n is a, c, g, or t
  misc_feature (207)..(207): n is a, c, g, or t
  misc_feature (961)..(961): n is a, c, g, or t
  misc_feature (1435)..(1435): n is a, c, g, or t
  misc_feature (1450)..(1450): n is a, c, g, or t
  misc_feature (1482)..(1482): n is a, c, g, or t
  misc_feature (1485)..(1486): n is a, c, g, or t
  misc_feature (1494)..(1494): n is a, c, g, or t
tttcgccaaacccacgcgaccgcgagagcgcagcgccgagagcaccgccaccgccgagaggattggcccagccgagcaaaccctccaaatctcggcggcaatggcgctctccgaccgctcccgcggctcgctcctcccgagcttcctctangccccgtcggcggcgcggtccttcgccggcgcctcccgcttccccgcctcgcccgncgcggccccggcgggtggccgagccccgtcgttcccgatccaggcgcccaacgagaagatcgagatgtactcgccggcgttctacgccgcctgcactgccggaggcatcgccagctgcgggctcacccacatggccgtcacgccgctcgacctcgtcaagtgcaacatgcagatcgatccggcgaagtacaagagcatcacttccgggtttggaattctggccaaggagcaaggagtgaggggcttcttcaggggatgggtgcccaccctgcttggttacagtgctcagggagcttgcaagtttggattctatgagttcttcaagaaatactactcagatattgcagggcctgagtatgctcagaaatacaagaccttgatataccttgctgggtcggcttctgctgaggtgattgctgatgtggctctctgcccctttgaagctgtaaaggtccgtgtgcagacacagcctggttttgctcgtgggctcagtgatgggcttcctaagttcattagatctgagggtgccctggggctttacaagggaattgtccctctctggggtcgtcagattccctatacaatgatgaagtttgcgtcatttgagaccattgttgaacttatctacaagcatgctgttcctgttccaaagtcagagtgtagcaaacctttccaattgggtatcagctttgctggtggctacattgctggtgtcttctgtgccattgtttctcacccggcagataacttggtntctttcttgaacaacgccaagggtgctacagtgggtgatgctgtaaagaagcttggcctctggggcctcttcactcgtggtctaccccttcgtatcgtcatgatcggtactcttactggagctcagtggggaatttatgatgcattcaaagtcatggttggattgcctactaccggtggtgttacgcccgcaccagcccctatcgcagaagaggaggctgctttgaaggccagtgcttgatccttcatgtttaagacaactagaatgcctttgatcattctttaccgatgacaaatgtaccagttacatgagttcaaccttatgtctaaatttttgagaggatggctgtcatccttcggacgagatgaacttgctaagccggtgatcatagttttttgcccaagtgtaaccctagtgcttgatgatatatgataagttttaggttcgcatcactgttaggagcccaggttttgntaccacctgtgccgnggtttattcacattacagtacctttcatatgntgnngattttgnggtgtcactggtcatccaggtgaatgagttgatgacaacggttggagctatcaatttcagtattatgatgttttctctgca

SEQ ID NO: 2993 - DNA, 1848 bp, Sorghum bicolor
caacggttcagtggcaggtggtttgttcaatctttctccgaaatagatcggggaccagctggactccgccgcctcccccctcccattcccccagcgccaaatccacgtgaaggcgagagcgcagagagcaccaccaccgccgagaggattggtccagaggagcaaaccctccaaagttcggcggcaatggcgctctctgaccgctcccgcgagtcactcctaccgagcttcctctactccccggcggcgacgaggtccttcgcaggcgcctcccgctttcccgcctcgcccgccgcggcggcggcctcggccccgagcgtagcgggaggtggcgccctgccgttcacgatccaggcacccaatgagaagatcgagatgtactcgccagcgttctacgccgcctgcacggccggaggcatcgccagctgcgggctcactcacatggccgtcacgccgctcgacctcgtcaagtgcaacatgcagattgatccggcaaaatacaagagcatctcatctggttttggaatactggccaaggagcaaggagtgaggggcttcttcagggggtgggtgccaaccctgcttggctacagtgcccagggagcttgcaagtttggattctatgaattctttaagaaatactactcagatattgctgggcctgagtatgctcagaaatacaagaccctaatatacctggctgggtcggcttctgctgaggtgattgctgatgtggctctctgcccctttgaagccgtgaaggtccgtgtgcagacacaacctggatttgctcgtggtctcagtgatgggctccccaagttcatcaaatctgagggtgccttggggctttacaagggaattgtccctctctggggtcgtcagattccttatacaatgatgaagtttgcttcatttgagaccattgttgaacttatctacaagcatgctgttcctgttccaaagtcagagtgtagcaaacctttccaattgggtatcagctttgccggtggctacatcgctggtgttttctgtgccattgtttctcaccctgctgataacttggtctctttcctgaacaatgccaagggtgctacggtcggtgatgctgttaagaagcttggcctctggggcctcttcactcgtggtcttcctcttcgtattgtgatgattggtactcttactggagcccagtggggtatttatgatgcattcaaagtcatggttggactgccgacaactggaggtgtcacgccagcaccagctcctgctactgaggaggctgcattgaaggccagtgcatgatctcgatattaagatataactaaacaatcattcttcaccgagacaactgtatgcattcattacatgagttcaaccctacttatacgttgaatgttttagaggatggttatcttctgaacgagagcaactttctaagccgggaatcatagcgttctgctcaagtgtactgttagtgcttgtaataagttttaggtgggtaaattactgttaggagcccaggttttccacctgaggcaaggtttattcatggtacactgcctgaatgccattctgccattcatgttcccgaaggagttattctgtcaattttgatatacagtcatgcaagtgatgggaagattcaagcagtctgtttcagtaagatgcttttgtttttcctcaatcaagagttgcttgtgcattctcattaaatcagcattctgttgtgctagctacttgtggcaagcatgctctagttcatatcttcgataaattctctgtacacttattgaagctaaagatcccttgtgttatggttgttgctttgtgcattatcctgctttcagt

SEQ ID NO: 2994 - DNA, 1817 bp, Sorghum bicolor
atcggggaccagctggactccgccgcctcccccctcccattcccccagcgccaaatccacgtgaaggcgagagcgcagagagcaccaccaccgccgagaggattggtccagaggagcaaaccctccaaagttcggcggcaatggcgctctctgaccgctcccgcgagtcactcctaccgagcttcctctactccccggcggcgacgaggtccttcgcaggcgcctcccgctttcccgcctcgcccgccgcggcggcggcctcggccccgagcgtagcgggaggtggcgccctgccgttcacgatccaggcacccaatgagaagatcgagatgtactcgccagcgttctacgccgcctgcacggccggaggcatcgccagctgcgggctcactcacatggccgtcacgccgctcgacctcgtcaagtgcaacatgcagattgatccggcaaaatacaagagcatctcatctggttttggaatactggccaaggagcaaggagtgaggggcttcttcagggggtgggtgccaaccctgcttggctacagtgcccagggagcttgcaagtttggattctatgaattctttaagaaatactactcagatattgctgggcctgagtatgctcagaaatacaagaccctaatatacctggctgggtcggcttctgctgaggtgattgctgatgtggctctctgcccctttgaagccgtgaaggtccgtgtgcagacacaacctggatttgctcgtggtctcagtgatgggctccccaagttcatcaaatctgagggtgccttggggctttacaagggaattgtccctctctggggtcgtcagattccttatacaatgatgaagtttgcttcatttgagaccattgttgaacttatctacaagcatgctgttcctgttccaaagtcagagtgtagcaaacctttccaattgggtatcagctttgccggtggctacatcgctggtgttttctgtgccattgtttctcaccctgctgataacttggtctctttcctgaacaatgccaagggtgctacggtcggtgatgctgttaagaagcttggcctctggggcctcttcactcgtggtcttcctcttcgtattgtgatgattggtactcttactggagcccagtggggtatttatgatgcattcaaagtcatggttggactgccgacaactggaggtgtcacgccagcaccagctcctgctactgaggaggctgcattgaaggccagtgcatgatctcgatattaagatataactaaacaatcattcttcaccgagacaactgtatgcattcattacatgagttcaaccctacttatacgttgaatgttttagaggatggttatcttctgaacgagagcaactttctaagccgggaatcatagcgttctgctcaagtgtactgttagtgcttgtaataagttttaggtgggtaaattactgttaggagcccaggttttccacctgaggcaaggtttattcatggtacactgcctgaatgccattctgccattcatgttcccgaaggagttattctgtcaattttgatatacagtcatgcaagtgatgggaagattcaagcagtctgtttcagtaagatgcttttgtttttcctcaatcaagagttgcttgtgcattctcattaaatcagcattctgttgtgctagctacttgtggcaagcatgctctagttcatatcttcgataaattctctgtacacttattgaagctaaagatcccttgtgttatggttgttgctttgtgcattatcctgctttcagtggaagcgtcgtttcc

SEQ ID NO: 2995 - DNA, 1375 bp, Saccharum officinarum
ccgccgcctcccctcccgtctcccattccccatcgccaaatccacgtgaacgcgagagcgcagagagcaccgccgccgccgagaggattggcccggcccagcggagcagaccctccaaagtttggcggcaatggcgctctctgaccgctcccgcgagtcactcctaccgagcttcctctactccccggcggcggcgaggtcgttcgcaggcgcctcccgcttccccgcctcgcccgccgcggcggctccggccccgagtctagcaggaggtgcccccctgccgttcacgatccaggcacccaatgagaagatcgagatgtattcgccagcgttctacgccgcctgcacggccggaggcatcgccagctgcgggctcacccacatggccgtcacgccactcgacctcgtcaagtgcaacatgcagattgatccggcaaaatacaagagcatcacatctggttttgggatactggccaaggagcaaggagtgaggggcttcttcagggggtgggtgcccaccctgcttggctacagcgctcagggagcttgcaagtttggattctatgaattctttaagaaatactactcagatattgctgggcctgagtatgctcagaaatacaagaccctgatataccttgctgggtcggcttctgctgaggtgattgctgatgtggctctctgcccctttgaagccgtgaaggtccgtgtgcagacacaacctggattcgctcgtggtctcagtgatgggctccctaagttcatcaaatctgagggtgccctggggctttacaagggaattgtccctctctggggtcgtcagattccttatacgatgatgaagtttgcttcatttgagaccattgttgaacttatctacaagaacgctgttcctgttccaaagtcagagtgtagcaaacctttccaattgggtatcagctttgccggtggctacattgctggtgttttctgtgccattgtttctcaccctgctgataacttggtctctttcctgaacaatgccaagggtgctacggttggtgatgctgttaagaagcttggcctctggggcctcttcactcgtggtcttcctcttcgtattgtgatgatcggtactcttactggagcccagtggggtatttatgatgcattcaaagtcatggttggactgccgacaactggaggtgtcacgccagcaccagctcccactacagaggaagctacactgaaagccagtgcatgaactccatattaagatataactaagcagcattcttcaccgagacaattgtattcattacatgagttcaaccctacttatacattagaattttttagaggatggttgtcatcttctgaatgaaagcaacttgct

SEQ ID NO: 2996 - DNA, 1824 bp, Oryza sativa
ctcctttggctctggaagccgcagcagccatctattactgcgccgccgccgcctccaacttttcggtcgccttcgtcgtctccgtcaaagcgacgcgagcgcgagagcgaggaggagagcccgagatctcggcggcggcggcggcggcgatggcgctctccgaccgctcccgcgagtcgctcctgccgagcttcctctactcgacggcgggggcgcggccgtacaccgcgggcggcggcggcgccgccttccgcctccccgccgcggcggccccgggaggtgtaggagggggcgcgccgatcgagatccaggcgcccagggagaagatcgagatgtactcgccggcgttctacgccgcctgcacggccgggggcatcgccagctgcggcctcacccacatggcggtcaccccgctcgacctcgtcaagtgcaacatgcagattgatccagcaaagtacaagagcatcacatctgggtttggaatattggctaaggagcaaggagtcaggggcttcttcaggggctgggttcccactcttcttggctacagtgctcagggcgcctgcaagtttgggttttatgaattctttaagaagtactactcagacattgcaggacctgagtacgctcagaaatataagacgctcatataccttgctggctcagcttctgcggaggtcattgctgatgtggcattgtgccctttcgaagctgtgaaagtccgtgtgcagacacagcctggatttgctcgtgggcttggcgatgggctccccaagttcattaaatccgagggtgccttgggtctttacaaagggattgttcctctttgggggcgtcaaattccttatacaatgatgaagtttgcatcctttgagaccattgttgaacaaatctacaagcatgctgttcctgtcccgaagtcagagtgtagcaaatcattccagttgggtatcagctttgctggtggttacattgccggtgtcttctgtgctattgtttctcacccggcagataatctagtctctttcctgaacaatgccaagggtgctacagtgggtgatgctgttaagaagcttggtctctggggtctattcactcgtggactgcccctacgtattgtcatgatcggtacccttactggagctcaatggggaatttatgatgcattcaaagtcatggttggattgccaactaccggtggtgttacgccagcaccatccacttcagatgctggattgaaagctgtcagtgcctgattttctcattaggacaacttggttatttttggaacttatcgttcttcatggatggaaaatatattggtcacatgagttcaattatatttttgtttaaaatttttgtagaggatgactatgtcatctttggaatgagaggaactcgttaaaacagacaatgatatattttttttgtccaagtgtaagttctaatatttggtataaaataagatttaggaacttggtattccctccgcccctaaatataaagaattttggttgaatgtgacacatcctaatacaacgaatttggacagacttcatgtccacattcgttgtaataggatatgccatatccaagcaaaatctataagggacggagggagtataaaataagatttaggaacccagatggttagcgcacaggttgtgttccatttcctttaccaccatattcataaatttaattattttatactactctacatgtatctttggggcattccccattttacgatgtaaattactccttgttcagttattcatcttctgttcccctcatatttctggaggcaatccctgattcccc

SEQ ID NO: 2997 - DNA, 1745 bp, Oryza sativa
acttttcggtcgccttcgtcgtctccgtcaaagcgacgcgagcgcgagagcgaggaggagagcccgagatctcggcggcggcggcggcggcgatggcgctctccgaccgctcccgcgagtcgctcctgccgagcttcctctactcgacggcgggggcgcggccgtacaccgcgggcggcggcggcgccgccttccgcctccccgccgcggcggccccgggaggtgtaggagggggcgcgccgatcgagatccaggcgcccagggagaagatcgagatgtactcgccggcgttctacgccgcctgcacggccgggggcatcgccagctgcggcctcacccacatggcggtcaccccgctcgacctcgtcaagtgcaacatgcagattgatccagcaaagtacaagagcatcacatctgggtttggaatattggctaaggagcaaggagtcaggggcttcttcaggggctgggttcccactcttcttggctacagtgctcagggcgcctgcaagtttgggttttatgaattctttaagaagtactactcagacattgcaggacctgagtacgctcagaaatataagacgctcatataccttgctggctcagcttctgcggaggtcattgctgatgtggcattgtgccctttcgaagctgtgaaagtccgtgtgcagacacagcctggatttgctcgtgggcttggcgatgggctccccaagttcattaaatccgagggtgccttgggtctttacaaagggattgttcctctttgggggcgtcaaattccttatacaatgatgaagtttgcatcctttgagaccattgttgaacaaatctacaagcatgctgttcctgtcccgaagtcagagtgtagcaaatcattccagttgggtatcagctttgctggtggttacattgccggtgtcttctgtgctattgtttctcacccggcagataatctagtctctttcctgaacaatgccaagggtgctacagtgggtgatgctgttaagaagcttggtctctggggtctattcactcgtggactgcccctacgtattgtcatgatcggtacccttactggagctcaatggggaatttatgatgcattcaaagtcatggttggattgccaactaccggtggtgttacgccagcaccatccacttcagatgctggattgaaagctgtcagtgcctgattttctcattaggacaacttggttatttttggaacttatcgttcttcatggatggaaaatatattggtcacatgagttcaattatatttttgtttaaaatttttgtagaggatgactatgtcatctttggaatgagaggaactcgttaaaacagacaatgatatattttttttgtccaagtgtaagttctaatatttggtataaaataagatttaggaacttggtattccctccgcccctaaatataaagaattttggttgaatgtgacacatcctaatacaacgaatttggacagacttcatgtccacattcgttgtaataggatatgccatatccaagcaaaatctataagggacggagggagtataaaataagatttaggaacccagatggttagcgcacaggttgtgttccatttcctttaccaccatattcataaatttaattattttatactactctacatgtatctttggggcattccccattttacgatgtaaattactccttgttcagttattcatcttctgttcccctcatatttc

SEQ ID NO: 2998 - DNA, 1518 bp, Brachypodium distachyon
cttcctcgtcaaatccacgcgagagctctcccaggaagcgccgtcatcacaagtcaagagaggggaagggaaatccaccggatctctcggcggcgatggcgctctccgacctctcccgcgagtcgctcctcccgagcttcctctacacctccacggccgcgcgctccttcgccggcgcctcccgcttcccctcctcctcctccccccaggccccgtccttcggcggcggcagcgctggcggccgcaagccgttctcactccaggcccccaacgagaagatcgagatgtactccccggccttctacgccgcctgcacggccggcggtatcgccagctgcgggctcacccacatggccgtcacgccgctcgacctcgtcaagtgcaacatgcagattgacccagcgaaatacaagagcatctcgtctggatttggtgtcctgttaaaggagcaaggagccaggggattcttccggggatgggtgcctaccttgcttggttacagtgcccagggggcttgcaagtttgggttctacgagttctttaaaaagacctactcagacatggcagggcctgagaatgccttgaagtacaagaccctaatttacctcgcagggtcagcttctgctgaggtgattgctgatatcgctctgtgcccctttgaagctgtgaaggtccgtgtgcagacacagcctggatttgctcgtgggttgagtgatgggctccccaagttcatcaaagctgagggtgctggtgggctctacaagggaattgttccactctggggtcgccagattccttataccatgatgaagttcgcttccttcgagaccattgttgaacttatctacaagcatgctgttcctgttccaaagtctgagtgcagcaagcctttccagttgggtatcagctttgctggtggttacattgctggagtgttctgtgctattgtttctcacccggctgacaacctggtctctttcctgaacaatgccaagggtgctacaatgggtgatgctgttaaaaagattggtgttctgggccttttcaccagaggtcttccccttcgtattgtcatgatcggtactcttactggtgctcagtggggaatttacgacgctttcaaagtgatggttggacttccaacaactggtggtgtggcaccagctcctccggtagaggcggcaccggttgcttgatttttcatgccaagacaatgacgacgatgtgttccctgatgtcgtaggggtggatgggattgtatcaattacttgagtttagtacccccaaatctcttatttttgtagcagatgattaccgtgtcatcattttgatgagaggaactcattaagcaggtgaaatagttcttttttggccccccggaaagtttggtgcttgacacataataagttttattaggacagcaaggctgttagagagcaggtattgctatcacctgtaccgaggaatactcacatattgttctttacctcccaatttatgttgtcgatgccatgccaa

SEQ ID NO: 2999 - DNA, 1732 bp, Brachypodium distachyon
gagaaaaagttccgataccctaattaacaagttgggaaaccacgccttcatattcctcctcccatctcggcgttctccttcccttcctcgtcaaatccacgcgagagctctcccaggaagcgccgtcatcacaagtcaagagaggggaagggaaatccaccggatctctcggcggcgatggcgctctccgacctctcccgcgagtcgctcctcccgagcttcctctacacctccacggccgcgcgctccttcgccggcgcctcccgcttcccctcctcctcctccccccaggccccgtccttcggcggcggcagcgctggcggccgcaagccgttctcactccaggcccccaacgagaagatcgagatgtactccccggccttctacgccgcctgcacggccggcggtatcgccagctgcgggctcacccacatggccgtcacgccgctcgacctcgtcaagtgcaacatgcagattgacccagcgaaatacaagagcatctcgtctggatttggtgtcctgttaaaggagcaaggagccaggggattcttccggggatgggtgcctaccttgcttggttacagtgcccagggggcttgcaagtttgggttctacgagttctttaaaaagacctactcagacatggcagggcctgagaatgccttgaagtacaagaccctaatttacctcgcagggtcagcttctgctgaggtgattgctgatatcgctctgtgcccctttgaagctgtgaaggtccgtgtgcagacacagcctggatttgctcgtgggttgagtgatgggctccccaagttcatcaaagctgagggtgctggtgggctctacaagggaattgttccactctggggtcgccagattccttataccatgatgaagttcgcttccttcgagaccattgttgaacttatctacaagcatgctgttcctgttccaaagtctgagtgcagcaagcctttccagttgggtatcagctttgctggtggttacattgctggagtgttctgtgctattgtttctcacccggctgacaacctggtctctttcctgaacaatgccaagggtgctacaatgggtgatgctgttaaaaagattggtgttctgggccttttcaccagaggtcttccccttcgtattgtcatgatcggtactcttactggtgctcagtggggaatttacgacgctttcaaagtgatggttggacttccaacaactggtggtgtggcaccagctcctccggtagaggcggcaccggttgcttgatttttcatgccaagacaatgacgacgatgtgttccctgatgtcgtaggggtggatgggattgtatcaattacttgagtttagtacccccaaatctcttatttttgtagcagatgattaccgtgtcatcattttgatgagaggaactcattaagcaggtgaaatagttcttttttggccccccggaaagtttggtgcttgacacataataagttttattaggacagcaaggctgttagagagcaggtattgctatcacctgtaccgaggaatactcacatattgttctttacctcccaatttatgttgtcgatgccatgccaacgttgtcttgtttgcaaaaccactagctcttccttgttttggccgccactgatcgacgtaagcttttatcctttatccagatgcacttggctttcaggcttttctcgttttctccctcgaaaaaaggttagt

SEQ ID NO: 3000 - DNA, 1447 bp, Avena sativa
gtcgaatcccacgcgaacgccagcgcgagctctcggaaagcaccgccaacgaccgcccgcgaatccccacccggatctcccggcccggcggcgatggcgctctccgacctcacccgcgagtcgctcctcccgagcttcctctactccgcctcccccttcggcgccgccgcctcccgcctcgcctcctcctccgcggccccggctcctcctgccttcggccttggcggaggcgtcggcgtgggcggcggcaagcccttctcgatccgcgcccccagcgagaagatcgagatgtattcaccggccttctacgccgcctgcaccgccggagggatcgccagctgcgggctcacccacatggccgtcaccccactcgaccttgtaaagtgtaatatgcagatcaatccagagaaatacaagagtatttcatccggctttggtgtgctgttaaaggagcaaggagcaaggggattcttcaggggatgggttcccaccttgctgggttacagcgcccagggggcttgcaagtttgggttctacgaattctttaagaagacctactcagatatggctgggcctgagaatgccattaagtacaagaccctaatataccttgcaggctcagcttctgctgagctgattgctgatgttgctctctgccccatggaagccgtgaaggttcgtgtgcagacacaacctggatttgctcgtgggttgagtgatgggctccccaagttcgtcaaagctgagggtgttgctgggctttacaagggacttgttcctctctggggtcgccagattccttataccatgatgaagtttgcttcctttgagacaattgttgaacttatctacaagcacgctgttcctgttccaaagtcggagtgcagcaagcctttccagttgggtatcagctttgctggtggctacatcgctggtgtcttctgtgctattgtttctcacccagctgacaaccttgtctctttcctgaacaatgccaagggtgctaccatgggtgatgctgtcaagcagataggtgttctgggccttttcactagaggactgcctcttcgtattgtcatgatcggtactcttaccggtgctcagtggggaatttatgatgcattcaaggtcatggttggacttccaacaactggtggtgttgcacctgtccctgcagcagcagaggaagcgaaggccaatgcttgattgtgtttctgccaaggcaacgttgatgtattcttgggtgtcatattggtggatggggactatcaatttcctgtgtttagtaccctaaatgttttattcttgtagaagatgattattgtgtcatcgttttaatgagaggaactcattaagcaactgaaatagctccatttttgtcctgggagtccgaaatttgaatcaataaatattaggatagcatacggaggaatatgatggactattt

SEQ ID NO: 3001 - DNA, 1525 bp, Pseudoroegneria spicata
  misc_feature (34)..(35): n is a, c, g, or t
ccgccagcgccagcgccgcagcccccgcgaatcnncacccggatctcccggcccggcggcgatggcgctctccgacctctcccgcgactcgctcctccccagcttcctctactcctcgcccgccgcgcgctccttcgccgccgcctccccgcgcttcccctcctccccgtcgccctaccaggcgcccgccgcggccccggccgtcggcatcgtcggcgctggccgggtcgggggcggcaggccgttctcgatccgcgcgcccaacgagaagatagagatgtattctcccgccttctacgccgcctgcaccgccggggggatcgccagctgcggcctcacccacatggccgtcaccccgctcgacctagtcaagtgcaacatgcagattgacccggcgaaatacaagagcatcacatctggatttggtgttctgttaaaggagcaaggagctaggggattcttcaggggatgggtgcctaccttgcttggttacagtgctcagggggcttgcaagtttgggttctatgagttctttaagaagacctactcagatatggctgggcctgagaatgccgtgaagtacaagaccctgatttaccttgcagggtcagcttctgctgaggtaattgctgatattgctctgtgcccctttgaagctgtcaaggtccgtgtgcagacacaacctggatttgctcgtgggttgagtgatgggcttcccaagttcatcaaagctgagggtgctgctgggctctacaagggcattgttcctctctggggtcgccagattccttataccatgatgaagtttgcttccttcgagaccatcgttgaactcatctacaagcacgctgttcctgttcctaaggccgagtgcagcaagtcttcccagttgggtatcagctttgctggtggctacattgctggtgtcttctgtgctattgtttctcacccggctgacaacctggtctctttcctcaacaatgccaagggtgctacagtgggtgatgctgttaagaagattggcatgttgggccttttcaccagaggacttcccttgcgtattgtcatgatcggtactcttactggtgctcagtggggaatctatgacgccttcaaggtcatggtgggactcccaaccactggcggtgctccaccagttgctccggtagaggaagcagcgaaagccatcgcttgattgatttttcctgctacgacgatgatgacgatgtatttcccggatgtggtattggtggatgggactgtatcaattacttgagtttagcacccgaaatcttttgttattgtagcggatggttattgtgtcatcattttgatgagaggaactcattaagcaggcgaaataggccttttttgcccctgggaagtttgatgcatgacctaataagttttagtacagcaaggctgttaagagcgcaggttttgccatcacctgtactgagggagtcccatataatcttgtttacctccaaatttatgctgttgatatcgtggcatgcttgtttca

SEQ ID NO: 3002 - DNA, 1645 bp, Triticum aestivum
cgccacgccaagggagaggagagctcggaaagcaccgccagcgccgcagccccccgcgaatccgcgcccggatctcccggcccggcggcgatggcgctctccgatctctcccgcgactcgctcctccccagcttcctctactccccgcgctccttcgccgccgccgcctccccgcgcttcccctcctccccgtcgccctaccaggcgcccgccgcggccccggctgctcgtctcgtcggcgctggcggggtcgggggcggcaggcccttctcgatccgcgcgcccaacgagaagatagagatgtactctcccgccttctacgccgcctgcaccgccggggggatcgccagctgcgggctcacccacatggccgtcaccccgctcgacctcgtcaagtgcaacatgcagattgaccccgcgaaatacaagagcatcacatctggatttggtgttctgttaaaggagcaaggagctaggggattcttcaggggatgggtgcctaccttgcttggttacagtgctcagggggcttgcaagtttgggttctatgagttctttaagaagacctactcagatatggctgggcctgagaatgccgtgaagtacaagaccctgatctaccttgcagggtcagcttctgctgaggtaattgctgatatcgctctgtgcccctttgaagctgtcaaggtccgtgtgcagacacagcctggatttgctcgtgggttgagtgatgggcttcccaagttcatcaaagctgagggagctgctgggctctacaagggcattgttcctctctggggtcgccagattccttacaccatgatgaagtttgcttcctttgagaccattgttgagcttatctacaaacatgctgttcccgttcccaaggccgagtgcagcaagtcttcccagttgggtatcagctttgctggtggctacattgccggtgtcttctgtgctattgtttctcacccggctgacaacctggtctctttcctcaacaatgccaagggtgctacagtgggtgatgctgttaagaagattggcatgctgggccttttcaccagaggacttccccttcgcatcgtcatgatcggtactcttaccggtgctcagtggggaatctatgacgccttcaaggtcatggtcggactcccgaccaccggcggtgctccaccagttgctccggtagaggaagcagcgaaagccatcgcttgattgatttttcctgctacgacgatgacgatgtattcccggatgatggggtattggtggatggggactctatcaattacttgagtttagcaaccgaaatcttttgttattgtagcagatggttattgtgtcatcattttgatgagaggaactcattaagcaggcgaaataggccttttttgtccccgggaagtttgatgcttgacataataagttttaggacagcaaggctgttagagcgcaggttttgccatcacctgtactgaggaattcccatatactactgtttaaaaacccgtgccgaactcggcacgagcgatcgattcggttcgattgcggtttccgtacccgcccgccgaccaagcaacaacatcgttttgctgcaatctgacaaagtggagggcacgctcaactccttaattctgaacac

SEQ ID NO: 3003 - DNA, 1623 bp, Secale cereale
gccaagagagagagagagctcagaaagcgccgccagcgcccccgcgaatccacacccggatctctcggcccggcggcgatggcgctctccgacctctcccgcgactcgctcctccccagcttcctctactccccgcgctccttcgccgccgccgcctccccgcgcttcccctcctccccgtcgccctaccaggcgcccgccgcggccccggccccggctgttggtctcgtcggcgctggcggggtcgggggcggcaggcccttctcgatccgcgcgcccaacgagaagatcgagatgtactctcccgccttctacgccgcctgcaccgccggggggatcgccagctgcggcctcactcacatggccgtcaccccgctcgacctcgtcaagtgcaacatgcagattgacccggcgaaatacaagagcatctcatctggatttggtgttctgttaaaggagcaaggagctaggggattcttcaggggatgggtgcctaccttgcttggttacagtgctcagggggcttgcaagtttgggttctatgagttctttaagaagacctactcagacatggctgggcctgagaatgccgtcaagtacaagaccctgatttaccttgcagggtcagcttctgctgaggtaattgctgatattgctctgtgcccctttgaagctgtcaaggtccgtgtgcagacacaacctggatttgctcgtgggttgagcgatgggcttcccaagttcatcaaagctgagggagctgctgggttgtataagggaatcgttcctctctggggtcgccagattccttacaccatgatgaagtttgcttcctttgagaccattgttgagctcatctacaaacacgctgttcccgttcccaaggccgagtgcagcaagtcttcccagttgggtatcagctttgctggtggctacattgccggtgtcttctgtgctattgtttctcacccggctgacaacctggtctctttcctcaacaatgccaagggtgctaccgtgcgtgatgctgttaataagattggcatgctgggccttttcaccagaggacttccccttcgtatcgtcatgatcggtactctcaccggcgctcagtggggaatctatgacgccttcaaggtcatggttggactcccgaccaccggcggtgctccaccagttgctccggtagaggaagcagcgaaagccagcgcttgattgatttttcctgctacgacgatgacgatgtattccaggatgatgtggtattggtggatgggactgtatcaattacttgagtttagcacccaaaaatcttttgttattgtagcagatggttattgtgtcatcattttgatgagaggaactcattaagcaggcgaaataggcctttttttgtccctgggaagtttgatgcttgacataataagttttaggacagcaaggctgttagagcgcaggttttgccatcacctgtactgagggaatcccatataatcttgtttacctccaattctatgctgttgatatcgtcccatgttagtttctgaatgaatgggtagaaagtttcttgttatatggtgcagaggtttacttataaacaactacattagtagttaccttcatgct

SEQ ID NO: 3004 - DNA, 1545 bp, Triticum aestivum
cccccgtcaaatccacgcgaacatcgccacgccaagggagaggagagctcggaaagcaccgccagcgccgcagccccccgcgaatccgcgcccggatctcccggcccggcggcgatggcgctctccgacctctcccgcgactcgctcctccccagcttcctctactccccgcgctccttcgccgccgccgcctccccgcgcttcccctcctccccgtcgccctaccaggcgcccgcctcgcccgccgcggccccggctgctggcctcgtcggcgctggcggggtcgggggcggcaggcccttctcgatccgcgcgcccaacgagaagatagagatgtactctcccgccttctacgccgcctgcaccgccggggggatcgccagctgcggcctcacccacatggccgtcaccccgctcgacctcgtcaagtgcaacatgcagattgacccggcgaaatacaagagcatctcatctggatttggtgttctgtttaaggagcaaggagctaggggatttttcaggggatgggtgcctaccttgcttggttacagtgctcagggggcttgcaagtttgggttctacgagttctttaagaagacctactcagatatggctgggcctgagaatgccgtgaagtacaagaccctgatttaccttgcaggttcagcttctgctgaggtaattgctgatattgctctgtgcccctttgaagctgtcaaggtccgtgtgcagacacagcctggatttgctcgtgggttgagtgacgggcttcccaagttcatcaaagctgagggtgctgctgggctctataagggcatcgttccactctggggtcgccagattccttacaccatgatgaagtttgcctcctttgagaccattgttgagcttatctacaagcacgctgttcctgttcccaaggccgagtgcagcaagtcttcccagttgggtatcagctttgctggtggctacattgccggtgtcttctgtgctattgtttctcaccctgctgacaacctggtctctttcctcaacaatgccaagggtgctacagtgggtgatgctgttaacaagattggcatgttgggccttttcacaagagggctaccccttcgtatagtcatgattggtactcttaccggtgctcagtggggaatctatgacgcgttcaaggtcatggttggactcccgaccaccggcggtgctccaccagttgctccggtagaggaagcagcgaaagccagcgcttgattgatttttcctactacgacgatgacgatgtattccgggatgatgtggtattggtggatggggactgtatcaattacttgagtttagcaaccgaaatcttttgttattgtagcagatggttattgtgtcatcattttgatgagaggaactcattaagcaggcgaaataggccttttttgtccccgggaagtttgatgcttgacataataagtcttaggacagcaaggctgttagagcgcaggttttgccatcacctgtactgaggaactcccatatactcctgtttacctccaa

SEQ ID NO: 3005 - DNA, 1714 bp, Triticum aestivum
ccacgcgtccgcgccacgccaagggagaggagagctcggaaagcatcgccagcgccgcagccccccgcgaatccgcgcccggatctcccggcccggcggcgatggcgctctccgacctctcccgcgactcgctcctccccagcttcctctactccccgcgctccttcgccgccgccgcctccccgcgcttcccctcctccccgtcgccctaccaggcgcccgcctcgcccgccgcggccccggctgctggcctcgtcggcgctggcggggtcgggggcggcaggcccttctcgatccgcgcgcccaacgagaagatagagatgtactctcccgccttctacgccgcctgcaccgccggggggatcgccagctgcgggctcacccacatggccgtcaccccgctcgacctcgtcaagtgcaacatgcagattgacccggcgaaatacaagagcatcacatctggatttggtgttctgttaaaggagcaaggagctaggggattcttcaggggatgggtgcctaccttgcttggttacagtgctcagggggcttgcaagtttgggttctatgagttctttaagaagacctactcagatatggctgggcctgagaatgccgtgaagtacaagaccctgatttaccttgcagggtcagcttctgctgaggtaattgctgatatcgctctgtgcccctttgaagctgtcaaggtccgtgtgcagacacagcctggatttgctcgtgggttgagtgatgggcttcccaagttcatcaaagctgagggagctgctgggctctacaagggcattgttcctctctggggtcgccagattccttacaccatgatgaagtttgcttcctttgagaccattgttgagcttatctacaaacatgctgttcccgttcccaaggccgagtgcagcaagtcttcccagttgggtatcagctttgctggtggctacattgccggtgtcttctgtgctattgtttctcacccggctgacaacctggtctctttcctcaacaatgccaagggtgctacagtgggtgatgctgttaagaagattggcatgctgggccttttcaccagaggacttccccttcgcatcgtcatgatcggtactcttaccggtgctcagtggggaatctatgacgccttcaaggtcatggtcggactcccgaccaccggcggtgctccaccagttgctccggtagaggaagcagcgaaagccatcgcttgattgatttttcctgctacgacgatgacgatgtattcccggatgatggggtattggtggatggggactgtatcaattacttgagtttagcaaccgaaatcttttgttattgtagcagatggttattgtgtcatcattttgatgagaggaactcattaagcaggcgaaataggccttttttgtccccgggaagtttgatgcttgacataataagttttaggacagcaaggctgttagagcgcaggttttgccatcacctgtactgaggaattcccatatactactgtttacctccaattctctatgctgttggtatcgtggcatgttgtgtgttagtttctgaatgggtgtgtagtagttttcttttcttcgtgcttgcaaaatcattccttggccttctgagataagtcatgcagtgctcttgttttgttcgggcacacaggtcagctagagtattagcgacaggttgtacacgtcaa

SEQ ID NO: 3006 - DNA, 1831 bp, Secale cereale
tcgccaagagagagagctcagaaagcgccgccacgcgcccccgccgaatccacacccggatctctcggcccggcggcgatggcgctctccgacctctcccgcgactcgctcctccccagcttcctctactccccgcgctccttcgccgccgccgccgccccgcgcttcccctcctccccgtcgccctaccaggcgcccgcctcgcccgccgcggccgcggccccggccgttggtctcgtcggcgctggcggggtcgggggcggcaggcccttctcgatccgcgcgcccaacgagaagatcgagatgtactctcccgccttctacgccgcctgcaccgccggggggatcgccagctgcggcctcacccacatggccgtcaccccgctcgacctcgtcaagtgcaacatgcagattgacccggcgaaatacaagagcatctcatctggatttggtgttctgttaaaggagcaaggagctaggggattcttcaggggatgggtgcctaccttgcttggttacagtgctcagggggcttgcaagtttgggttctatgagttctttaagaagacctactcagacatggctgggcctgagaatgccgtcaagtacaagaccctgatttaccttgcagggtcagcttctgctgaggtaattgctgatattgctctgtgcccctttgaagctgtcaaggtccgtgtgcagacacaacctggatttgctcgtgggttgagcgatgggcttcccaagttcatcaaagctgagggagctgctgggttgtataagggaatcgttcctctctggggtcgccagattccttacaccatgatgaagtttgcttcctttgagaccattgttgagctcatctacaaacacgctgttcccgttcccaaggccgagtgcagcaagtcttcccagttgggtatcagctttgctggtggctacattgccggtgtcttctgtgctattgtttctcacccggctgacaacctggtctctttcctcaacaatgccaagggtgctaccgtgcgtgatgctgttaataagattggcatgctgggtcttttcaccagaggacttccccttcgtatcgtcatgatcggtactctcaccggtgctcagtggggaatctatgacgccttcaaggtcatggttggactcccgaccaccggcggtgctccaccagttgctccggtagaggaagcagtgaaagccagcgcttgattgatttttcctgctacgacgatgacgatctatacctggatgatgtggtattggtggatgggactgtatcaattacttgagtttagcacccgaaatgttttgttattgtagcagatggttattgtgtcatcattttgatgagaggaactcattaagcaggcgaaataggccttttttgtccccgggaagtttgatgcttgacataataagttttaggacagcaaggctgttagagcgcaggttttgccatcacctgtactgagggaatcccatataatcttgtttacctccaattctatgctgtttatatcgtcgcacgttagtttctgaatgaatggttagaaagtttcttgttatatggcgcagaggtttacttataaacaactacatgctgtttggttggttctgtttagttaccttcatgctggcaaatagtcttctaaatgaagtacctttcttgtttggttggtgctgtttaagatccagtggatatttcattttcatagattaggtgtatgtttggggaactactacaagtgggatatacaattgttctttgtgtcatgcctatagagaacccgcatggctaacttccaacaaaaaaaaagtc

SEQ ID NO: 3007 - DNA, 1481 bp, Avena sativa
cacgcgaacgccagcgcgagctctcggaaagcaccgccaacgcccgcccgcgaatccccacccggatctcccggcccggcggcgatggcgctctccgacctcacccgcgagtcgctcctcccgagcttcctctactccgcgtcccccttcggcgctgccgccacccgcctcgcctcctcctcgtcctaccaggcccccgccgcggccccggctcctcctgccttcggccttggcggcggcgtcggcgtgggcggcggcaagcccttctcgatccgcgcccccagcgagaagatcgagatgtattcaccggccttctacgccgcctgcaccgccggagggatcgccagctgcgggctcacccacatggccgtcaccccccttgaccttgtaaaatgtaacatgcagataaacccagagaaatacaagagcatctcatctggcttcggtgtcctgttaaaggagcaaggagctcggggattcttcaggggatgggtccctaccttgcttggttacagtgcccagggggcctgcaagtttggtttctatgagttcttcaagaagacctactcagatatggctggccctgagaatgccatcaagtacaagaccctgatttaccttgcagggtcagcttctgctgagctgattgctgatgttgctctctgccccatggaagccgtgaaggttcgtgtgcagacacaacctggatttgctcgtgggttgagtgatgggctccccaagttcgtcaaagctgagggtgttgctgggctttacaaggggcttgttcctctctggggtcgccagattccttataccatgatgaagtttgcttcctttgagacaattgttgagcttatctacaagcacgctgttcctgttccaaagtcggagtgcagcaagcctttccagttgggtatcagctttgctggtggctacatagccggtgttttctgtgccattgtttcccaccctgcagacaatttggtctctttcctcaacaatgccaagggtgctaccatgggtgacgccgtgaagcagattggtgttctgggccttttcaccagaggattgcccctacgtatcgtcatgattggtacactcaccggtgctcagtggggaatctatgatgcatttaaggtcatggttgggctcccaaccactggtggtgttgcacctgtaccagcgtccgaggaagtgaaagccgttgcttgatgtcctctgctgagacgatgacgatgtatttgttggtgtaatatttgtggatgggactatgaattacctgagtttattcttgtagcagatgattttgtgtcatctttttgatgagtggaactcattaagcagggaaagtaggtcttttttgccccggaaagcttggtgcttgacaaaataagtattattaggacagcaaggctgttaagagggcatgttttgccatcatctcctgttctgaggaatactctacttacatactgttgttt

SEQ ID NO: 3008 - DNA, 1619 bp, Triticum aestivum
ccacgcgtccgatcgccacgccaagggagaggagagctcggaaagcaccgccagcgccgcagccccccgcgaatccgcgcccggatctcccggcccggcggcgatggcgctctccgacctctcccgcgactcgctcctccccagcttcctctactcctcgcgctccttcgccgccgccgccccgcgcttcccctcctccccgtcgccctaccaggcgcccgcctcgcccgccgcggccccggctgctggcctcgtcggcgctggcggggtcgggggcggcaggcccttctcgatccgcgcgcccaacgagaagatcgtcatgtactcgccggccttctacgccgcctgcaccgccggggggatcgccagctgcggcctcacccacatggccgtcaccccgctcgacctcgtcaagtgcaacatgcagattgacccggccaaatacaagagcatcacatctggatttggtgttctgtttaaggagcaaggagctaggggattcttcaggggatgggtgcctacgttgcttggttacagtgctcagggggcttgcaagtttgggttctacgagttctttaagaagacctactcagatatggctgggcctgagaatgccgtgaagtacaagaccctgatttaccttgcaggttcagcttctgctgaggtaattgctgatattgctctgtgcccctttgaagctgtcaaggtccgtgtgcagacacagcctggatttgctcgtgggttgagtgacgggcttcccaagttcatcaaagctgagggtgctgctgggctctacaagggcatcgttccactctggggtcgccagattccttacaccatgatgaagtttgcctcctttgagaccattgttgagcttatctacaagcacgctgttcctgttcccaaggccgagtgcagcaagtcttcccagttgggtatcagctttgctggtggctacattgccggtgtcttctgtgctattgtttctcaccctgctgacaacctggtctctttcctcaacaatgccaagggtgctacagtgggtgatgctgttaacaagattggcatgttgggccttttcacaagagggctaccccttcgtatcgtcatgattggtactcttaccggtgctcagtggggaatctatgacgcgttcaaggtcatggttggactcccgaccaccggcggtgctccaccagttgctccggtagaggaagcagcgaaagccagcgcttgattgatttttcctactacgacgatgacgatgtattccgggatgatgtggtattggtggatggggactgtatcaattacttgagtttagcaaccgaaatcttttgttattgtagcagatggttattgtgtcatcattttgatgagaggaactcattaagcaggcgaaataggccttttttgtccccgggaagtttgatgcttgacataataagtcttaggacagcaaggctgttagagcgcaggttttgccatcacctgtactgaggaactcccatatactcctgtttacctccaattctctatgctgttggtatcgtggcatgttgtgtgttagtttctgaatgggtgtgtagtagttttcttttcttcgtgctgcaaaatca

SEQ ID NO: 3009 - DNA, 1783 bp, Triticum aestivum
gccacgccaagggagaggagagctcggaaagcaccgccagcgccgcagccccccgcgaatccgcgcccggatctcccggcccggcggcgatggcgctctccgacctctcccgcgactcgctcctccccagcttcctctactcctcgcgctccttcgccgccgccgccccgcgcttcccctcctccccgtcgccctaccaggcgcccgcctcgcccgccgcggccccggctgctggcctcgtcggcgctggcggggtcgggggcggcaggcccttctcgatccgcgcgcccaacgagaagatcgtcatgtactcgccggccttctacgccgcctgcaccgccggggggatcgccagctgcggcctcacccacatggccgtcaccccgctcgacctcgtcaagtgcaacatgcagattgacccggccaaatacaagagcatcacatctggatttggtgttctgtttaaggagcaaggagctaggggattcttcaggggatgggtgcctacgttgcttggttacagtgctcagggggcttgcaagtttgggttctacgagttctttaagaagacctactcagatatggctgggcctgagaatgccgtgaagtacaagaccctgatttaccttgcaggttcagcttctgctgaggtaattgctgatattgctctgtgcccctttgaagctgtcaaggtccgtgtgcagacacagcctggatttgctcgtgggttgagtgacgggcttcccaagttcatcaaagctgagggtgctgctgggctctataagggcatcgttccactctggggtcgccagattccttacaccatgatgaagtttgcctcctttgagaccattgttgagcttatctacaagcacgctgttcctgttcccaaggccgagtgcagcaagtcttcccagttgggtatcagctttgctggtggctacattgccggtgtcttctgtgctattgtttctcaccctgctgacaacctggtctctttcctcaacaatgccaagggtgctacagtgggtgatgctgttaacaagattggcatgttgggccttttcacaagagggctaccccttcgtatcgtcatgattggtactcttaccggtgctcagtggggaatctatgacgcgttcaaggtcatggttggactcccgaccaccggcggtgctccaccagttgctccggtagaggaagcagcgaaagccagcgcttgattgatttttcctactacgacgatgacgatgtattccgggatgatgtggtattggtggatggggactgtatcaattacttgagtttagcaaccgaaatcttttgttattgtagcagatggttattgtgtcatcattttgatgagaggaactcattaagcaggcgaaataggccttttttgtccccgggaagtttgatgcttgacataataagttttaggacagcaaggctgttagagcgcaggttttgccatcacctgtactgaggaactcccatatactcctgtttacctccaattccatgctgttgatatcgtggcatgttgtgtgttagtttctgaatgggtgtgtagtagttttcttttcttcgtgcttgcaaaatcattccttggccttctgagataagtcatgcagtgctcttgttttgttcgggcacacaggtcagctagagtattagcgacaggttgtacacgtcaacagttattgctgtttgtgtaatgccttaaggaagaaaccagctgattttttaattcatatctcggcagtctcggaccaaactaggt

SEQ ID NO: 3010 - DNA, 5927 bp, Pennisetum glaucum
cctcatcttgccttgctgccatttttctttcaatcaagcaaaacaaagaggtcgctgcaattggacgggatgctttgacaccaatggtctcactttcaaattcttcagttattgaagtagcagaacaagcgaccagagctttagctaatctttttcttgatcaggagttatctctccaggtgtcttttgaagaaattctcttccgtgtaacacgtgtgctaaaagagggaactattgatggaagaactcatgcagctgcagcaatagctcgtcttttacaatgtcgaactattaatcaactgctttcagataccattaaccgttctgggtgtgttctcgctctagctgggctcttggaagctgctaatggtgaagctgctgcaacatcagaagttcttgatgcactggtcctactatcacgatcaaaggcatcaagtgggcacaccaaggctccctgggcagtccttgcagaaaatccccacacgatacttccccttgtttcatgtatagctgatgctgctccctccttacaagataaagccatagaagttgtgtcaaggctctgttcggaccaacatgatgttgtgggtggtttggtttctgaaactccaggttgcatagcatccatcacacgtcgagtcattggctctaacatgcttagggttaaagttggtggatgtgctcttcttgtttgtgcagcaaaagagcattgtcagaagcagatagagattctgaatgattcaagtctctatattcaactaattcattctctgattggaatgatccatatgacaaacactcatgctgagagtgacatcagtgatagcatagcagatattagaatttccagatactgcaaagaaaacaacagcgatggtgaaactgtgtgccgtactgctgtaatctcaggcaacatgattccactatggctacttgctgtcttttctcgtcatgacagcaaaacaagagccgaaatcctagaagctggggcagttgaaatgctcaccgagaagatttcacaaaatgcattccaatatgtgggtgaagaggatagcacctcatgggtctgttcgttgcttcttgctttgctattccaagaaagagagataaatcgatcaaactcagcgttgcactccattcctgtgctctcaaatttgttaagatcagatgagccagcatacaggtactttgctgcgcaagctttgtcaagtctggtctgcaatggtagcagaggaactcttctggctgttgctaattctggggcagccattggacttatatctttgcttggatgcgctgatgttgacatagctgatcttttggagttatcagaggaattcatgttggtgcctaatcctgatcaaattgcattagagaggatgttcagagttgatgatatcagggttggttcaacttccagaaaatctattcctcttcttgtggatctacttaaacccattcctgaaagacctggtgctcctttcttggccttgtgtcttctgactcaactggctgttgattgccctccaaacatgctgctaatggctgaagctggaatcctagaagcacttaccaaatatctatctcttagcccacaagatgcaactgaagaagctacaactgaattgctgggcattctcttcagcagtgcagaaataaggcaccatgagtcagcacttggtgttgttaatcaacttgtggcagtcctccgtctaggagcaagaaattcacgttacagtgctgcaaaggcattagagagcttgttttctgccgaccatgtgaggaacagtgaatcagctaggcaggctattcaaccacttgtggagattctgagtactggcatggagagggagcagcatgcagctatatcagcccttgttaggcttctctgtgacaatccctcaagagcacttgcggttgcagatgttgagatgaatgctgttgatgttctgtgccgtattctttcttccgactgttcagcagagttgaaaggagatgctgcagaattatgctgtgttctatttgcaaatacaaggatccgttcaacaatggcggcagcacgttgtgtggaacccctggttggtttactagttagtgaagctaaccctgcccagctttctgtggttcgtgcattggatagactcttggatgatgagcagctcgcagaattagtggcagcacatggagctgttgttcctcttgtcggtcttttgtatggcagaaactacatgcttcatgaggcagttgctagagctttggtgaaacttggaaaggatagaccagcttgcaaattggaaatggtgaaagctggtgtaattgagagtattcttgagattctccatgatgctccagattttctgtgcattgcattggcggaaatgcttcggattttaacaaacaatgctagcatagcaaaaggtccatctgcagccaaagtagtacagcctcttttctctttgctatctaaggcagacatgggtcccgaagggcagtatagcgctttgcaggttcttgtgaatattttggagcatcctgaatgccgcgctgattataacttgacacctcgccaaactattgagccagtcattaccttattgaattcatccccaccagctgtgcaacaattagctgccgaactcctatcccatcttcttttagaagaccacctccagaaggatacaataacagagcaggccattactcctcttattcaagttctttcttcaggtttgccaaacctacagcagagagctataaaagctcttgccaacctggcaatagcttggccaaatacaattgcaaaggagggtggtgttttcgagttgtccaaggttcttttgcaatctgacccacctttgcctcatgttgtgtgggaatctgcagcatctgtcctgtctagcattttgcagtacagtactgagtttttccttgaggttcctgttgcagtactagtgcagttgctcaggtcaggaactgaaaacactgttgttggtgctttgaatgccctgcttgttttggagagtgatgattcaacaagcgcagaagcaatggctgaaagtggtgctgtggaagcattgctagatctcctaaggagtcatcagtgtgaggaaactgctgcgagactcatcgaggcattgcttaacaatgtaagaataagggaggcaaaggctgctaaaaatgctattgcacctttgtccatgtaccttctggatccacagacacagtctcaacaaggaagattgcttgctgcccttgctcttggagatcttttccaaaatgaaggtcttgctcgttctactgatgccgttgcagcatgccgcgccttggttaatcttctcgaagatcaaccaactgaagagatgaaagtggtagcaatttgtgccttgcagaatctagtcatgtacagtcgcgcaaacaagagagcagttgcagaatctggtggtgtccaggtcctgctggaccttatcagttcaagcaatcctgacacttctgttcaagcagcaatgtttgtcaaacttctgttcaataatcacaccatacaagagtatgcaaccagtgaaacagtcagagttattactgcttctattgagaaggatatatgggcatctggaagtgctaatgaggagtatctaaaagcacttaatgctttacttagcaacttccctcgtctaagggtcactgaacctgctacattatgcattcctcatcttgtaacatcccttaaaactggttctgaggcaactcaagaagcagcactggattctctatatcttctcaggcaagcttggtcagcttgcccagctgaagtattcaaagctcagtcagtggctgcctctgaggctattcctctacttcagtacttgatacagtctggcccaccccggtttcaagaaaaagcagaactgcttcttcagtgcttgcccgggacacttacagttactataaagcgtggcaacaatctaaagcaatcagttggaaatcctagtgcattctgcaagcttactcttggaaataatacaccaagactgacaaagattgtatccactggcacaacaccagaatgggatgaagcctttgcatgggcctttgacagccctcccaaaggccagaaactccatatctcctgcaaaaacaacagcaaatttggaaagaaatcattcgggaaagttacaatccaaatcgaccgggttgtcatgctaggctcagtcgcgggcgagtacaccctgctgcctgagagcaaaagtgggcccaataggaacctggaaatcgagttccagtggtcaaacaaataactgtatacctacataaattaggctgtctgtgtaagttaaaagatctacaagagaggtccagagtggtttcttgtttttgtcctctgctaaaggttactaagtttgtgcatcagtgtaaatagcgagcagagaaagttgtcatttgccgtaccttttctcgttcagtgagatatataaacagatgagttctcagatgttttgtactgattgtaacaggattcattcgtttatttttccccccttcttacccccgggattttgtctttgtaaagggtatactgtaaacagaataaatatatgctgtggttaggttctgtcatacggaaacaaaggcaaccgattactatatcataatatagcagaatgaagagcatcaatatacttccagaaaactccatgtgacttgggagtattcctcggtacaggaggtaaacaaaatcttcgctctaacagccttgctgtcctacaaattattatgcattgagcataaactttcccgggggcaaaaaagacctatttcacctgttttaatgagttcctctcatcaaaaggacggctgacaaatcatccgttaccaaaaaacaaaagatttgggaactaagctcttgaagtgattgatacaattccatccaccaaatacgatctcggagagcacttaaaagatcaagcgatggctttcggttcagcctctgctgggggaggtgtaacaccaccagttgttgggagtccaaccatgactttgaaagcatcataaattccccactgagcaccagtaagggtaccgatcatgacaatacgaagaggaagtcctctggtgaaaagaccccagagaccaagcttcttaacagcatcacccactgtagcacccttggcattgttcaggaaagacacaaggttgtcagccgggtgagaaacaatagcacagaagacaccagcaatgtagccaccagcaaagctgatacccagttgggtgttcttgctgcactcagacttgggaacaggcatagcatgcttgtagataagctcaacaatggtctcaaaggaagcaaacttcatcatggtataaggaatctgacgaccccagagaggaacaagtcccttgtagagcccgagagcaccctcagaccggacaaatttggggagcccatcgctcaacccacgagcaaatccaggctgtgtctgcacacgtaccttcacagcttcgaaggggcagagagccacatcagcaattacctcagcagaagcagaaccagcgaggtagattagagtcttgtacttgtgggcatactcaggccctgcaatatctgagtagtacttcttgaagaactcatagaagccaaacttgcaagccccctgagcactgtaaccaagcaaggtaggcacccatcccctgaaaaagcccctagccccttgctccttcaacaggacaccaaatccagatgtgatgctcttgtattttgctggatcaatctgcatgttgcacttgacgaggtcgagcggcgtgacggccatgtgggtgaggccgcagctggcgatccctccggcggtgcaggcggcgtagaacgccggcgagtagagctcgatcttctccttgggcgcctggatcgagaacggcgcgccgccgccgccagctcc

SEQ ID NO: 3011 - DNA, 1541 bp, Secale cereale
cgaacttcgccaagagagagagctcagaaagcgccgccagcgcccccgcgaatccacacccggatctctcggcccggcggcgatggcgctctccgacctctcccgcgactcgctcctccccagcttcctctactccccgcgctccttcgccgccgccgcctccccgcgcttcccctcttccccgtcgccctaccaggcgcccgcctcgcccgccgcggccgcggccccggccgttggtctcgtcggcgctggcggggtcgggggcggcaggcccttctcgatccgcgcgcccaacgagaagatcgagatgtactctcccgccttctacgccgcctgcaccgccggggggatcgccagctgcggcctcacccacatggccgtcaccccgctcgacctcgtcaagtgcaacatgcagattgacccggcgaaatacaagagcatctcatctggatttggtgttctgttaaaggagcaaggagctaggggattcttcaggggatgggtgcctaccttgcttggttacagtgctcagggggcttgcaagtttgggttctatgagttctttaagaagacctactcagacatggctgggcctgagaatgccgtcaagtacaagaccctgatttaccttgcagggtcagcttctgctgaggtaattgctgatattgctctgtgcccctttgaagctgtcaaggtccgtgtgcagacacaacctggatttgctcgtgggttgagcgatgggcttcccaagttcatcaaagctgagggagctgctgggttgtataagggaatcgttcctctctggggtcgccagattccttacaccatgatgaagtttgcttcctttgagaccattgttgagctcatctacaaacacgctgttcccgttcccaaggccgagtgcagcaagtcttcccagttgggtatcagctttgctggtggctacattgccggtgtcttctgtgctattgtttctcacccggctgacaacctggtctctttcctcaacaatgccaagggtgctaccgtgcgtgatgctgttaataagattggcatgctgggtcttttcaccagaggacttccccttcgtatcgtcatgatcggtactctcaccggtgctcagtggggaatctatgacgccttcaaggtcatggttggactcccgaccaccggcggtgctccaccagttgctccggtagaggaagcagtgaaagccagcgcttgattgatttttcctgctacgacgatgacgatctatacctggatgatgtggtattggtggatgggactgtatcaattacttgagtttagcacccgaaatgttttgttattgtagcagatggttattgtgtcatcattttgatgagaggaactcattaagcaggcgaaataggccttttttgtccccgggaagtttgatgcttgacataataagttttaggacagcaaggctgttagagcgcaggttttgccatcacctgtactgagggaatcccatataatcttgtttacctccaattctatgctgtttatatcgtcgc

SEQ ID NO: 3012 - DNA, 1538 bp, Secale cereale
gagagctcagaaagcgccgccagcgcccccgcgaatccacacccggatctcccggcccggcggcgatggcgctctccgacctctcccgcgactcgctcctccccagcttcctctactccccgcgctccttcgccgccgccgcctccccgcgcttcccctcctccccgtcgccctaccaggcgccctcacacgcctcgcccgccgcggccccggccgttggtctcgtcggcgctggcggggtcgggggcggcaggcccttctcgatccgcgcgcccaacgagaagatcgagatgtactctcccgccttctacgccgcctgcaccgccggggggatcgccagctgcggcctcacccacatggccgtcaccccgctcgacctcgtcaagtgcaacatgcagattgacccggcgaaatacaagagcatctcatctggatttggtgttctgttaaaggagcaaggagctaggggattcttcaggggatgggtgcctaccttgcttggttacagtgctcagggggcttgcaagtttgggttctatgagttctttaagaagacctactcagacatggctgggcctgagaatgccgtcaagtacaagaccctgatttaccttgcagggtcagcttctgctgaggtaattgctgatattgctctgtgcccctttgaagctgtcaaggtccgtgtgcagacacaacctggatttgctcgtgggttgagcgatgggcttcccaagttcatcaaagctgagggagctgctgggttgtataagggaatcgttcctctctggggtcgccagattccttacaccatgatgaagtttgcttcctttgagaccattgttgagctcatctacaaacacgctgttcccgttcccaaggccgagtgcagcaagtcttcccaattgggtatcagctttgctggtggctacattgccggtgtcttctgtgctattgtttctcacccggctgacaacctggtctctttcctcaacaatgccaagggtgctaccgtgcgtgatgctgttaataagattggcatgctgggccttttcaccagaggacttccccttcgtatcgtcatgatcggtactctcaccggcgctcagtggggaatctatgacgccttcaaggtcatggttggactcccgaccaccggcggtgctccaccagttgctccggtagaggaagcagcgaaagccagcgcttgattgatttttcctgctacgacgatgacgatgtattccgggatgatgtggtattggtggatgggactgtatcaattacttgagtttagcacccaaaaatcttttgttattgtagcagatggttattgtgtcatcattttgatgagaggaactcattaagcaggcgaaataggcctttttttgtccctgggaagtttgatgcttgacataataagttttaggacagcaaggctgttagagcgcaggttttgccatcacctgtactgagggaatcccatataatcttgtttacctccaattctatgctgttgatatcgtcccatgttagtttct

SEQ ID NO: 3013 - DNA, 1659 bp, Secale cereale
gcccaccgactccaacttcgccaagagagagagagagctcacgaaagcgccgccagcgcccccgcgaatccacacccggatctctcggcccggcggcgatggcgctctccgacctctcccgcgactcgctcctccccagcttcctctactccccgcgctccttcgccgccgccgcctccccgcgcttcccctcttccccgtcgccctaccaggcgcccgcctcgcccgccgcggccgcggccccggccgttggtctcgtcggcgctggcggggtcgggggcggcaggcccttctcgatccgcgcgcccaacgagaagatcgagatgtactctcccgccttctacgccgcctgcaccgccggggggatcgccagctgcggcctcacccacatggccgtcaccccgctcgacctcgtcaagtgcaacatgcagattgacccggcgaaatacaagagcatctcatctggatttggtgttctgttaaaggagcaaggagctaggggattcttcaggggatgggtgcctaccttgcttggttacagtgctcagggggcttgcaagtttgggttctatgagttctttaagaagacctactcagacatggctgggcctgagaatgccgtcaagtacaagactctgatttaccttgcagggtcagcttctgctgaggtaattgctgatattgctctgtgcccctttgaagctgtcaaggtccgtgtgcagacacaacctggatttgctcgtgggttgagcgatgggcttcccaagttcatcaaagctgagggagctgctgggttgtataagggaatcgttcctctctggggtcgccagattccttacaccatgatgaagtttgcttcctttgagaccattgttgagctcatctacaaacacgctgttcccgttcccaaggccgagtgcagcaagtcttcccagttgggtatcagctttgctggtggctacattgccggtgtcttctgtgctattgtttctcacccggctgacaacctggtctctttcctcaacaatgccaagggtgctaccgtgcgtgatgctgttaataagattggcatgctgggccttttcaccagaggacttccccttcgtatcgtcatgatcggtactctcaccggcgctcagtggggaatctatgacgccttcaaggtcatggttggactcccgaccaccggcggtgctccaccagttgctccggtagaggaagcagcgaaagccagcgcttgattgatttttcctgctacgacgatgacgatgtattccgggatgatgtggtattggtggatgggactgtatcaattacttgagtttagcacccaaaaatcttttgttattgtagcagatggttattgtgtcatcattttgatgagaggaactcattaagcaggcgaaataggcctttttttgtccctgggaagtttgatgcctgacataataagttttaggacagcaaggctgttagagcgcaggttttgccatcacctgtactgagggaatcccatataatcttgtttacctccaattctatgctgttgatatcgtcccatgttagtttctgaatgaatgggtagaaagtttcttgttatatggtgcagaggtttacttataaacaactacattagtagttaccttcatgctggcagtc

SEQ ID NO: 3014 - DNA, 1744 bp, Triticum aestivum
agggagaggagagctcggaaagcaccgccagcgccgcagccccccgcgaatccgcgcccggatctcccggcccggcggcgatggcgctctccgacctctcccgcgactcgctcctccccagcttcctctactcctcgcgctccttcgccgccgccgccccgcgcttcccctcctccccgtcgccctaccaggcgcccgcctcgcccgccgcggccccggctgctggcctcgtcggcgctggcggggtcgggggcagcaggcccttctcgatccgcgcgcccaacgagaagatcgtcatgtactcgccggccttctacgccgcctgcaccgccggggggatcgccagctgcgggctcacccacatggccgtcaccccgctcgacctcgtcaagtgcaacatgcagattgacccggccaaatacaagagcatcacatctggatttggtgttctgtttaaggagcaaggagctaggggattcttcaggggatgggtgcctaccttgcttggttacagtgctcagggggcttgcaagtttgggttctacgagttctttaagaagacctactcagatatggctgggcctgagaatgccgtgaagtacaagaccctgatctaccttgcagggtcagcttctgctgaggtaattgctgatatcgctctgtgcccctttgaagctgtcaaggtccgtgtgcagacacagcctggatttgctcgtgggttgagtgatgggcttcccaagttcatcaaagctgagggtgctgctgggctctacaagggcattgttccgctctggggtcgccagattccttacaccatgatgaagtttgcttcctttgagaccattgttgagcttatctacaaacacgctgttcctgttcccaaggccgagtgcagcaagtcttcccagttgggtatcagctttgctggtggctacattgccggtgtcttctgtgctattgtttctcacccggctgacaacctggtctctttcctcaacaatgccaagggtgctacagtgggtgatgctgttaagaagattggcatgctgggccttttcaccagaggacttccccttcgcatcgtcatgatcggtactcttaccggtgctcagtggggaatctatgacgccttcaaggtcatggtcggactcccgaccaccggcggtgctccaccagttgctccggtagaggaagcagcgaaagccatcgcttgattgatttttcctgctacgacgatgacgatgtattcccggatgatggggtattggtggatggggactctatcaattacttgagtttagcaaccgaaatcttttgttattgtagcagatggttattgtgtcatcattttgatgagaggaactcattaagcaggcgaaataggccttttttgtccccgggaagtttgatgcttgacataataagttttaggacagcaaggctgttagagcgcaggttttgccatcacctgtactgaggaattcccatatactactgtttacctccaattctctatgctgttggtatcgtggcatgttgtgtgttagtttctgaatgggtgtgtagtagttttcttttcttcgtgcttgcaaaatcattccttggccttctgagataagtcatgcagtgctcttgttttgttcgggcacacaggtcagctagagtattagcgacaggttgtacacgtcaacagttattgctgtttgtgtaatgccttaaggaagaaaccagctgatttttaatt

SEQ ID NO: 3015 - DNA, 1921 bp, Musa acuminata
cgacaatttagcgaacaccaccgcgccctaaaaattggggagtgcaccaaaactccagtcatttcgcgtccgtcacattcacgagtgagaagaagagaggcaagagagccatcacattggctctcgcctccaactcaggctcctctttgatccgaaccctaacacgtaatcgaggggagctgcaatggatctgacagagagatctcaccaatccctcctcccgaccttcctgtactcgcccaccccggcctccggaacccgagccctggaccggatcctggggaggaccactgcctcaccggtgacggcgggcattgccgcctcgccagccccagtcgttgcccaggcgcccaacgagcccggaaaaatcgagatgtactcgcccatgttctacgccgcctgtaccgccggcggcatcgccagctgcggcctcacccacatggccgtcactccgcttgacctcgtcaagtgtaatatgcagatcgacccagctaagtacaaaagcatctcttcaggatttggagtcttgcttaaagaacaagggatcaggggtttctttaggggctgggtacctactctgcttggatacagcgcccagggggcatgcaagtttgggttttatgagtacttcaagaagtactattcagatatagctgggccagagtatgccgccaagtataagactttgatctatcttgctgggtctgcttctgctgaagtgattgctgatgtagctctctgcccctttgaggctgtgaaggttcgggtccagacacagcctggttttgcaaggggattgagtgatgggttgcctaaatttgtcaaatctgaaggtgttatgggactatataaaggaatagttccactttgggggcgtcagattccttataccatgatgaaatttgcatcctttgagactgtggttgagatgatctacaaatatgcaattccaacacccaaagaccagtgtagcaaaacacgtcagctgggcataagctttgctggtggttatattgctggaattttctgtgctatagtttctcatccagctgacaaccttgtctctttcctaaacaacgctaagggtgctacagttggtgatgctgtgaaaaagcttggtctgtggggtcttttcacacgtgggctccctcttcgtattgtgatgattggcactctaactggcgcacagtgggggatttacgatgctttcaaagtcatggttggcctgccaacgactggtggagtctctcctgcaccagaactggctaagctgaaagcagcttaatgattattatagatatcaataatataagattgtcagatgccaaaatacattttgtttgggagtgttatatccttccagagcacctcagtgtctgttttcaatatgttttaggcgacggttttgttctcataatttaggcctgagaaactcatcaaacaggtaaatgcagcttttaacatcataacagcaggagggtttccatggatttatcgggaaggcataacccttgtaagtccgatcatcatatgttgagttagtgatgattcgtgtcaaatttcatgccctttgtttcttaatgtttgttggtaaatataatgcaacttttgatccaagaagactgattatgagccgatttagaagcttgtctctttttcagataatgaaattctcaaaccttgatgcctagcggaaacaagggtccagttgtgctaacatgcctcttgcttacttgaaagttaactttccatttgctttgttacgtcttctccgatgcttgtatattttcttaagagcaattagcgattgctattcggtttaaaggtggtatacttgttagaattgtttggactgtcatacataagcccgcccagttgctgctggttaaacaataatgactttgtgattaatgtatgtatg

SEQ ID NO: 3016 - DNA, 1547 bp, Hordeum vulgare
cggcacgagggcgcctccatatattccagccaccgccgccactccccgtcaaacccacgcgaacgcgagagagaggagagagagctcagaaagcaccgcccccgcgaatccgcgcccggatctctcggcccggcggcgatggcgctctccgacctctcccgcgactcgctcctccccagcttcctctactcctcccccgccgcgcgctccttcaccgccccgcgcttcccctcctccccgtcgccctaccaggcgcccgccgcggccccggccgccggcatcgtcggcgccggcggggccgggggcggcaggcccttctcgatccgcgcgcccaacgagaaaatcgtcatgtactcgccggccttctacgccgcctgcaccgccggggggatcgccagctgcggcctcacccacatggccgtcaccccgctcgacctggtcaagtgcaacatgcagattgacccggcgaaatacaagagcatcacatctggatttggtgttctgttaaaggagcaaggagctaggggattctttaggggatgggtgcctaccttgcttggttacagtgctcagggggcttgcaagtttgggttctacgagttctttaagaagacctactcagatatggctgggcctgagaatgccgtgaagtacaagaccctaatttaccttgcagggtcagcttctgccgaggtaattgctgacatcgctctgtgcccctttgaagctgtcaaggtccgtgtgcagacacagcctggatttgcccgtggcttgagtgatgggcttcccaagttcatcaaagccgagggtgctgctgggctttacaagggcatcgttccgctctggggtcgccagattccttataccatgatgaagtttgcgtccttcgaaactattgttgagcttatctacaaacacgctgttcctgttccgaaggccgagtgcagcaagtcttcccagttgggtatcagctttgctggtggctacattgccggtgttttctgtgctattgtttctcatccggctgacaaccttgtctcgttcctcaacaatgccaagggtgctacagtgggcgatgctgttaagaagattggcatgttgggccttttcaccagagggctcccccttcgtatcgtcatgattggtactcttactggtgctcagtggggaatctatgatgcgtttaaagttatggtgggactcccgaccaccggcggtgctccaccagttgctccggtagaggaatcagcttgattgatttttgctgctatgacgatgtattcctggttgtggttattggtggatgggactgtatcagttacttgtttagcacccaaaatcttttgttattgtagcagatggttattgtctctatcagatgagaggaactcattaagcaggcgaaataggcctttttttgccccccgggaaagtttgatgcttgacataataagttttaggacagcaaggctgttagagcgcaggttctgccatcacctgtactgagggattcccatataatcttgtttacctccaatattacgctg

SEQ ID NO: 3017 - DNA, 1575 bp, Leymus cinereus x Leymus triticoides
  misc_feature (33)..(33): n is a, c, g, or t
  misc_feature (46)..(46): n is a, c, g, or t
  misc_feature (123)..(123): n is a, c, g, or t
  misc_feature (125)..(125): n is a, c, g, or t
  misc_feature (155)..(155): n is a, c, g, or t
  misc_feature (189)..(189): n is a, c, g, or t
  misc_feature (198)..(198): n is a, c, g, or t
  misc_feature (475)..(475): n is a, c, g, or t
  misc_feature (502)..(502): n is a, c, g, or t
  misc_feature (556)..(556): n is a, c, g, or t
  misc_feature (577)..(577): n is a, c, g, or t
  misc_feature (620)..(620): n is a, c, g, or t
  misc_feature (622)..(622): n is a, c, g, or t
  misc_feature (664)..(664): n is a, c, g, or t
  misc_feature (709)..(709): n is a, c, g, or t
  misc_feature (859)..(859): n is a, c, g, or t
  misc_feature (922)..(922): n is a, c, g, or t
  misc_feature (976)..(976): n is a, c, g, or t
  misc_feature (1433)..(1433): n is a, c, g, or t
  misc_feature (1441)..(1441): n is a, c, g, or t
  misc_feature (1452)..(1452): n is a, c, g, or t
  misc_feature (1461)..(1461): n is a, c, g, or t
  misc_feature (1473)..(1473): n is a, c, g, or t
gctcagaaagcaccgccagcccccgcgaatccncacccggatctcncggcccggcggcgatggcgctctccgacctctcccgcgactcgctcctccccagcttcctctactcctcccccgccncncgctccttcgccgccgcctcccgcttcccntcctccccgtcgccctaccaggcgcccgccgcgnccccggccncggcctcggcctcggcgctggcggagtcggaggcggcaggccgttctcgatccgcgcgcccaacgagaagatcgagatgtattcgccggccttctacgccgcctgcaccgccggggggatcgccagctgcgggctcacccacatggccgtcaccccgctcgacctcgtcaagtgtaacatgcagatcgacccggcgaaatacaagagcatcacatctggatttggtgttctgttgaaggagcaaggagctagggggttcttcaagggatgggtgccnaccttgcttggttacagtgctcagggngcttgcaagtttgggttctacgagttctttaagaagacctactcagatatggcngggcctgagaatgccgtgaantacaagaccctaatttaccttgcagggtcagcttctgctgagntnattgctgatatcgctctgtgcccctttgaagctgtcaaggtncgtgtgcagacacaacctggatttgctcgtgggttgagtgatggncttcccaagttcatcaaagctgagggtgctgctgggctttacaagggaattgttcctctctggggtcgccagattccttacaccatgatgaagtttgcatcctttgagaccattgttgagcttatctacaagcatgctgttcccgttccnaaggccgagtgcagcaagtcttcccagttgggtatcagctttgctggtggctacattgccggngtcttctgtgctattgtttctcacccagctgacaacctggtctctttcctcaanaatgccaagggtgctacagtgggtgatgctgttaagaagattggcatgttgggccttttcaccagaggacttcctcttcgtattgtcatgatcggtactcttaccggtgctcagtggggaatttatgacgccttcaaggtcatggttggactcccgacgactggcggtgctccaccagttgctccggtagaggaagcagcgaaagccagcgcttgattgatttttcctgctacgacgatgacgatgtattcctggatgatgtggtattggtggatgggactgtatcaattacttgagtttagcacccgaaatcttttgttattgtagcagatggttattgtgtcatcattttgatgagaggaactcattaagcaggcgaaataggccttttttgccccccgggaagtttgatgcttgacataataagttttaggacagcaaggctgttagagcgcangttttgcnatcacctgtantgaggaatncccatataatcntgtttacctccaattttatgctgttgatatcgtggcatggtagtttctgaatggggaagtttcttgttttacggtgcagaagtatttacttcaataccacta

SEQ ID NO: 3018 - DNA, 1659 bp, Musa acuminata
gtgcctgtcattgttgctccgtcacattcacgcgaggccggaagggagaagagagagaaccgttgcttcggttctctcctctccatctccgtctcctgttcgatccaagccgaacccagactctaacggcgatggatctggccgagagatctcgccaatccttccttccgagcttcctctactcgccttccccggccgccagaaccctggccgtggaccggatcctagggaggagcctcgtctcgccggcggcggaggtgggtagcacctcgcctaccccgatcgtcgcccaggcacccaacgagcccggaaagatcgagatgtactcgcccatgttctacgccgcctgcaccgccggcggcatcgccagctgtggcctcacccacatggccgtcaccccactcgacctcgtcaagtgtaacatgcagatcgatccagctaagtacaaaagcatctcatcaggatttggagtcttgctaaaagaacaaggggtcagagggttcttcaggggctgggtaccaaccctgcttggatacagcgcacagggggcgtgcaagtttgggttttatgagttcttcaagaaatactattcagatatagcagggcctgagtatgctgccaagtataagacgttgatatatcttgctgggtctgcttctgctgaggtgattgctgatgtagctctctgcccctttgaggctgtgaaggtgcgggtccagacacagcctgggtttgctaggggattgagcgatgggttgcctaagtttgtcagatctgagggtgtttcgggattgtacaaaggcatagttccgctttggggacgtcagattccttatactatgatgaagtttgcctcattcgagactgtggttgagatggtctacaaatatgctattccgacacctaaggaacagtgtaccaaaacactccagctgggagtgagctttgctggtggttatattgctggaattttctgtgctatagtttctcatccagctgacaaccttgtctctttccttaacaatgccaaaggtgccacagttggtgatgctgtgaaaaagcttggtatgtggggtcttttcacacgtggccttcctcttcgcattgttatgattggtactctgactggtgcacaatgggggatctatgatgcattcaaagtcatggttggcctgcctaccactggtggagttgctcctgctgcagctcctgcttcagaggttgggaagttgaaggctgcagcataattatttatggatatcaatgacacaatttttgacgtttcagtccattttgcatggaagtgtaacatcattccaaggcaaaacattgattgcttttgacatgttttctgggatggttttattctcatcccttctgcctgtaaaactcaattaaacaggtaattgcagcatttagcatgataacaacagagggcttccgaggattattcagtaatggcctttgtaatttagattatcatttgtttagtcacttatttttggttctctaatattcgtgacaatgtgattctagcaggctgtattagaaagctcgtttcccaattcttgcatgtattacctaagcgaggggaacaaccttactgtgatgataagtacaataaatggctacctgtttttagtggttatggagccagag

SEQ ID NO: 3019 - DNA, 1795 bp, Ricinus communis
aaaaatcataatttctccaatggtaaaactgtaattgagttctaagagcatggccataaggtaagagacacatctcgtataaagaacgccaggggcatgagtacaagcaggagcaagtagggccggttactgaggcaataaaactaagaattggccagctcttcacagctattggcaacacaagcgagcgagagactagtctgtctcatttctctctctctctctctctctctctctctctctcgcttcctttagcctcagaaaaccctcatttctccagctttcccaaattttgaattccaatggctttctccgattcttcaaaacaatccctaatccctagcttcctctactcttcttcttcctcttctaaaaccctcactctctcaaaactcctccactctaaccaacagtcgccgtcgccatctctcatgaggaagagcagcggaaatttcgtgatccctgctccaagtgagccagggaagatcgagatgtactctcctgctttctacgctgcttgtacagctggtggtattcttagctgtggtcttactcacatgactgttactcctcttgatcttgtcaagtgcaatatgcagattgatcctgcaaagtacaaaagcatctcatctggttttggaatcctgctcaaggagcaaggagtgagaggcttcttcaggggctgggtgcctaccctccttggttacagtgctcagggtgcctgcaaatttggattctatgagtttttcaaaaagtactactccgacattgctgggcctgagcatgcagccaagtacaagaccttgatttaccttgctggttcagcatctgctgaggttattgcagatgttgctctttgcccctttgaggcagtaaaggttcgagttcaaactcagcctggttttgctaggggcttgtcagatggacttcccaaatttgtcaaatctgaaggcgctcttgggttgtacaaaggtattgttcctctctggggacggcagattccatatacaatgatgaagtttgcatcttttgagactattgttgagatgatctacaagcatgccatccctacaccaaaggaccaatgcagcaaaagtctacagctcggtgttagttttgctggtggttatgttgctggtgttttctgtgctattgtatcccatcctgctgataatcttgtctctttcctcaacaatgccaaaggcgcaactgtcggtgatgctgtgaagaagctaggtctgtggggcctgtttacccgtgggcttcccctccgtattgtcatgattggaactcttactggagcacagtggggtatctatgatgcattcaaagtttttgtggggctgccaactaccggtggtgttgctcctgctgcccctgctgctgagcttgcaaaagcataataattccagaggagaagagatttattgtgctgttcaatgttgaagctgggaaaactatagtgataataagcaagcataggattgatgactcccaaggcaaaggagataattctttttaaattcagaactttaaatcaatttttgtcattttggctaatatgactccggagggatggttttgttttcatcctccctatcatgaataccttttgttagttagatcaagatatgaaatttcactccgatgttaggatcaagatgtcccctgtcaagacaaccaaaaataacgggcagatgggggtagattagcactctttatttacaacattattttaaattttattgaatttatgcttgggtcttattaatatttcaaacatttaatgttgaat

SEQ ID NO: 3020 - DNA, 1509 bp, Elaeis guineensis
cgttggtcgtcggtccgtcggcgtctctcgcgcgacgaggagggtggggggaagaacgccatcgctccgagccctaaccccaacttgcgagccttgttcccctcttccaaaaactcgccagtgatggatctctccgagaaatctcgccaatcgcttcttccgaatttcctctactcctcgtcggccaccaggagcctcgccctcgagagggtcgtgagccggaaccctgggtcgccagcgcctccgccgtcgaatggcggcgcatcgcagggatcgttcctcatccaggccccgagcgagcccaggaagatcgcgctgtactcgccggcgtactacgccgcctgcactgccggcgggatcgccagctgtgggctcacccacacggccgtcacgccgctcgatctcgtcaagtgcaacatgcagattgacccatctaagtacaaaagcatcacatcaggatttggtgtgttgcttagagagcaggggttgagaggtttcttcaagggctgggtgccaaccttgcttggttacagtgcccagggggcatgtaaattcgggttctatgagttcttcaagaagtactactcggacattgctggacctgagtttgctgccaagtacaagaccttgatctaccttgctgggtctgcttcggcagaagtgattgctgatgttgctctctgccccatggaggcagttaaggtgagagtccagacacagccagggtttgctaggggtttgagtgatggatttccaaagtttgtcaaatctgaaggttatctgggattgtataaaggattggttccactttgggggcgtcagattccttataccatgatgaaatttgcttcttttgaaactattgttgagcttctttacaaatattcaattcccactccaaaggacgagtgtagcaagacactacagctaggagtgagctttgctggagggtacatcgctggggtcttctgtgctgttgtctcacacccagcggacaatcttgtctcgtttcttaacaatgccaagggtgccaccgttggtgatgctgtgaagaagcttgggctgtggggtcttttcacccgtgggcttcctcttcgtattgttatgattggtacgctgactggagcacaatggggaatttatgatgcattcaaagtcatggttggcctgccaaccacaggtggagtcgctcctgctgcagcccccgccccagagccggcacagctgaaagctagtgcatgattttctatagatataaataatgacagatttgtgacattaatttgcccattttggacggcagtgtaatatttgtcttgaagcaactacatcgcttgttttgacatttttggggatggttttgtttgcatccctttgccctgcgaggctcatcggacaggtgaagatagaatttggcatcatagcagtttaaaggctattgagaaataaatttctttgtactttgactaagcttttatcctccgaatttcaggaaggatttcatgataa

SEQ ID NO: 3021 - DNA, 1413 bp, Ocimum basilicum
ttttgattagaccaccaccaccatctcgggaggagccgccgtagaatcaccgctcatggctctctcctccgaccgccagtctctcatcccctccttcctctatacctcctctttcacctccaaatccctaaatctacataagaatgtcgcgccttccagttcgccggcggcggcttcctctcctaatggcggattcatgattcaggcaccgagtgagcctggaaagatcgagatgtactctcctcagttctatgctgcctgtaccgttggtggaattctcagctgcggtcttactcatatggccgtcactcctctcgatctcgtcaaatgtaatatgcagattgatcctgcgaagtacaagagcatctcatcaggtttcggagttctactgaaggagcagggagctagaggtttcttcaggggctgggtacctactctgctaggttacagtgctcagggcgcctgcaaatttggattctacgaatttttcaagaagtactattctgacctcgctggagcagaaaatgctgctaaatacaagactctcatttatcttgctgggtctgcatctgctgaggtgattgccgatattgctctttgcccttttgaagccgtgaaggttcgagttcagactcagcctggtttcgctagaggtttgggtgatggacttcccaagtttgtgaaatctgaaggagctcttggactgtacaaggggcttgttccactctgggggcgtcagattccatatacaatgatgaagtttgcatccttcgagactattgtggagctcctttacaagcatgctatccccacgcctaaaaatgaatgcagcaagtctctccagcttggcgtgagttttgctggtggatatatcgctggtgtgttctgcgctatcgtatcacatccggccgataatctcgtctctttcctcaacaacgccaagggtgctaccgttggtgacgctgtgaagaagctcgggctgtggggtctattcactcgtggacttcctcttcgtattgtcatgatcggaactctcacaggagcccagtggggtatctatgatgcattcaaagttttcgtcggcctgccaacaactggtggtcctgcacctgttgcccctgaagccgcaaaggcctagagtaaattgcagtaatcttcttcaaaatcaatgctaaggagaataaatttagcagcggccattttgctagtcattagctgatggacattattctttccggttttgctgatttaatttttgagacttaagtttcttataattttatatcattctgaacttctagagataggctttgcattagggttacgaaatataataacggcagatttatggagaggcttgaactttagccaatgtaacgtagatttccaaagattcaaaaagctgctgtatgg

SEQ ID NO: 3022 - DNA, 1446 bp, Citrus sinensis
agaaagagaaaattagaagaattctctctctctcgctctttttctctataattcaatcaagcttttactctcaaaatcaaatttcaaaaattccgaaatggccctcacagaatcttataggaaaaactctctgataccaagctacctctactcctcccaaacatccttcccgtccacggcggctttcaatggagcggcagcagccgccacgtcgccggctactccatccacggcgaggaggagcttcgttgttgcggcaccgagcgagccagggaagatagagatgtactcccctgcattctacgccgcttgtaccgtcggcgggatcctcagctgcggcctcactcacacggccgtcactcctcttgacctcgtcaagtgcaatatgcagattgatcctgttaagtataaaagcatatcatctggttttggagttttgctcaaggaacagggaatcaggggcttcttcaggggatgggtacctaccttgcttggttacagcgcccaaggtgcttgcaagtttggattctacgagttcttcaagaagtactactctgacattgctggtccagagtatgctgctaagtacaagactttaatctaccttgctggctctgcttctgctgagttcattgctgatgttgctctttgcccctttgaggccgtgaaggtccgtgttcagactcagcctggttttgccagaggtttgggtgatggacttcccaagtttgttaaatctgagggcgctcttggtttgtacaagggtattgttcctctttgggggcgtcagattccatatactatgatgaagtttgcttcttttgaaaccattgttgagatgatctacaagcatgcagttcccacaccaaaggaccagtgcagcaaacctctgcagcttggaattagttttgctggtggttatgtggctggtgttttctgtgctattgtgtcgcatcctgctgacaatcttgtctctttccttaacaatgccaaaggagcaactgttggtgatgctgtgaagaagctaggtttgtggggtctatttacccgtgggcttcctctccgtattgtcatgattggaacactcactggagctcaatggggaatctatgatgcattcaaagtttttgtgggactgccaaccactggtggtgttgctcctgcccctgctgctgctgagcttgcaaaggtgtaggtcaaccaaatagaattgttttattttgggttttgtggattccaggagaacttcttgatagggattaataaacataggtgacaaaattgaagtcgcttgagtgtctcaagtcagagtattctttataattgagaactattttttcgagcttaagatttgcttttgctgaggatggttttgttttcatccaaatatcagaaaacttttgtagttagattatacatgaaatatcactctgatatccagctcgc

SEQ ID NO: 3023 - DNA, 1913 bp, Musa acuminata
cttaatacgtgtagtttgatttgacgattgagggtattttcgtacttgacgaggctataaaggccgaagcgaagtggcctagtaaacgggaaccgcctgccgttgcgctccgctgcaggatcacgcaagcgaaggaccttctctgcttgtcgtctccgatccgttccttctccttctcgatcgaaacctcgatcttcgatggatctctcagatagatctcgccagtccctcatccccagcttcctttactccaccgcggcctcccgaaccatcggcctggagcggaatatcttggggaggagccccgtctccaaggcggctcctgccgcgacggcgaatgatggcgctttgatgggatctgtggttgcccaagcgccgaacgagccagggaagatcaagctgtactcccctatgttctacgccgcctgcaccgccggtgggatcgccagttgcggcctcacccacacggccgtcaccccgctagatctcgtcaagtgtaacatgcagattgacccatcgaagtacaagagcatctcctcaggatttggtgtcctccttaaagaacaaggcgtcaggggattcttcagaggctgggtgccaaccctgctcggatacagcgcccagggggcgtgcaagtttggattctacgagttcttcaagaagtactactctgatatcgctggacctgagtacgctgccaagtacaagactctgatctacctcgctggctctgcttctgctgaagtgattgctgatgtcgctctctgccccttcgaggcagttaaggtgcgggtccagacacagccagggtttgctaggggtttgagtgatgggttgcccaagtttgtaaggtctgagggcgctttgggattgtataaaggattggtcccactttgggggcgtcagattccttatactatgatgaaatttgcctcatttgagactattgttgaaatgatctacaaatactcgattccaagaccaaaggaccagtgtagcaaagaacttcagctgggagtgagctttgctggtggttacattgctggtgtcttctgtgcaattgtttctcacccagctgacaatcttgtctctttcctgaacaacgccaagggtgccactgttggtgatgccgtgaagaaacttgggttgtggggtcttttcacacgtggactgccccttcgtatagtcatgattggtactctaactggtgcgcagtggggaatctatgatgctttcaaagttatggttggcctgccaacgactggtggagttactcctgctgttcctgctacagggcttgacaaactgaaagctgcttgattgtttagcattcatcgaaacaaatgtcttctgtcaatgaagaccaattttttgggagtaaattctttttgaaacaatgcattgcttgttctctgttcgtgggatggttttgatctcatcccttttgcctcagccatttcatcatacagtgaagattgcatctggcatcatattagacagataagtctggaaaataattggaaggacactgtagtcatgactgttgttcacgcagttaatatatgaaatttaatgcgctttattctattgtgccttgtgtaggctacaagtattatcagtgtcacgatgaagggttgatttaggagccatttttggtttagaatgaaagcctgtttacagtatgcacaaagaagattgtccatgcatagtagaaagttttgtttgattgcattatatactcgcatagttcaaatggctcttcatgttgtactaactgttttgcgctatagcaatcaatatttgaaacgaccatggaactgtaatgagttacttttgtgatcgtgccaagcaacgactcatgcaccttgtcgtcattataatttgaaacaggatgaaaattattagcaattgat

SEQ ID NO: 3024 - DNA, 1693 bp, Citrullus lanatus
ttcccatttctcaatcagagagaaatcaaagcaatttggcgttgagagattgggagaggtttctctttctagggttgcttcttcttcttcttcttcttcttcctctccattgttgtaaattttgcttccttctgctctaaatctgatctcccatggcactctctgataaaccctctcgccagtctctgatccccagcttcctctactcctccccttcttccactcgaaccctccctctcaagaagatgcttcaatcttcacccactctcgatggcgtttcctctcctactaagagctttgttattcccgcccccaccgagccgtctaagaagatcgagttgtactcgccagccttctacgctgcttgtacttttggtggaattctcagctgtggtcttacgcatatggctgttactcctcttgatttggttaaatgcaatatgcagattgatcctgcgaaatacaaaagtatttcgtctggttttggagttctgcttaaggagcagggtgcgaggggtttcttcaggggttgggtgcctactctccttggatacagtgcacagggtgcttgcaagtttggcttttacgagttctttaagaagtattactctgatattgctggacctgagtacgcagctaagtacaagaccttgatctaccttgcgggttctgcatctgctgaggttattgctgatgttgcactttgccctttcgaagcagtgaaggttcgggttcaaactcagcctggttttgctagaggtctatcagatggacttcccaagtttgtcagatctgaaggagctcttgggttgtacaagggtatagttccactctggggacgccagattccatacacgatgatgaagtttgcatcctttgagacaatagttgagatgctatataagtatgccattcccacaccaaaggaccagtgcagcaaatctctccagcttggtgttagttttgctggtggatatgtggctggtgttttctgtgctattgtatctcatcctgctgataatctcgtgtcgttcctcaacaatgccaaaggagcaactgttggtgatgctgtcaagaagctcgggttatggggtctcttcacccgtgggctacccctccgtattgtgatgattggaactcttactggtgctcagtggggtatctatgatgcgttcaaagtatttgttggactgcctactactggtggccctgcacctgctgcccctgcacctgctgctgctgagctcgcaaaggcgtgaggttgatgcttgattgaccaaccggagttttgttgtttttacgagttgaggagaaacctcctgataggaaattgaataaacataaccctttagccatgatgcttatagtcctcaaagccagaaggatatcttcatagaatggatgaacccttttccattcggttttcgtttccctttttttaatcggcattcattgaatttgttcagccaaggatggttttgatctcatccttgctagttgggatactcatttgttttgtagtagttcagaattcagatagagaattgcagtttaatggttttaaaaccatgagcatgatgtattttgttgtacccatgtcaggaagaaactttcgccaaataaactgacagacaatgggcaaaggaagatttggctgagttttcatctcttgttactgcctgtttcagtaagc

SEQ ID NO: 3025 - DNA, 1430 bp, Elaeis guineensis
aggagtcctccttctgctcctccttcctcattcaaactctaaccctaggtgtagagactgttccctttccaagtaaatggatctctccgagaaatctcgtcaatcgcggctcccgagtttcctctattccccgtcggctaccaggaccctcggcctccagagggtcttgagcaggaaccctagctcgccttcacctccgccgtcgaatggcgcctcatcgcccggatctttcctcatccaggctccaagagagccggggaagattgaaatgtactcgccgatgttctacgccgcctgcaccgcaggcgggatcgccagctgtggcctcacccacatggccgttacgccactcgatctcgtcaagtgcaacatgcagattgacccatctaagtacaagagcatcacatcaggatttggtgtcttgcttagagagcagggaccgagaggtttcttcaggggctgggtgccaaccctgcttgggtacagcgcccagggggcatgcaaattcgggttctatgaattcttcaagaagtactactcagatattgctggacctgagtatgctgccaagtacaagaccttgatctaccttgctggttctgcttctgctgaagtgattgctgatgttgctctctgccccatggaggctgtgaaggtgcgagtccagacacagccagggtttgccaggggtttaagtgatggatttccaaagtttgtcaaatctgaaggctatctgggattgtataaaggtttagttccactttgggggcgtcagattccttatactatgatgaaatttgcatcttttgaaactattgtcgagttaatctacaaatattcaattcccactccaaaggaccagtgcagcaagcccctccagctgacagtgagctttgctggaggttacatcgctggagtcttttgtgctgttgtgtctcaccctgcggataaccttgtctcattccttaacaatgctaagggtgcaactgttggtgatgctgtgaagaagcttgggctgtggggccttttcacccgtgggcttcctcttcgtattgttatgattggtaccctgactggggcacaatggggaatttatgatgctttcaaagtctttgttggcctgccaaccacaggtggagttgctcctgctgcagccacgccagagcttgcacagttgaaagctagtgcataattttctagagataaatcataacagatttctgacattaattttctcattttggacggcagtgtgatatttgccctgaagcaatgcattgtttgttttcatatttttggggatggttttgactgcatccctttggcttgctagacttgttaaacaggtcaagatagaatttggcatcatagcaaatgaaagcttattgttaaataaaacctttggtctcagttcttatcctccagacatt

SEQ ID NO: 3026 - DNA, 1677 bp, Citrus sinensis
ggtcggattccgggtcgacccacgcgtccgttgctttgcccgggttctaacaaattggcagcgagagacaggaggaggagaagagaaagagaaaattagaagaattctctctgtctcgctctttttctctataattcaatcaagctttttactctcaaaatcaaatttcaaaaattccgaaatggccctcacagaatcttataggaaaaactctctgataccaagctacctctactcctcccaaacatccttcccgtccacggcggctttcaatggagcggcagcagccgccacgtcgccggctactccatccacggcgaggaggagcttcgttgttgcggcaccgagcgagccagggaagatagagatgtactcccctgcattctacgccgcttgtaccgtcggcgggatcctcagctgcggtctcactcacacggccgtcactcctcttgacctcgtcaagtgcaatatgcagattgatcctgttaagtacaaaagcatatcatctggttttggagttttgctcaaggaacagggaatcaggggcttcttcaggggatgggtacctaccttgcttggttacagcgcccaaggtgcttgcaagtttggattctacgagttcttcaagaagtactactctgacattgctggtccagagtatgctgctaagtacaagactttaatctaccttgctggctctgcttctgctgagttcattgctgatgttgctctttgcccctttgaggccgtgaaggtccgtgttcagactcagcctggttttgccagaggtttgggtgatggacttcccaagtttgttaaatctgagggcgctcttggtttgtacaagggtattgttcctctttgggggcgtcagattccatatactatgatgaagtttgcttcttttgaaaccattgttgagatgatctacaagcatgcagttcccacaccaaaggaccagtgcagcaaacctctgcagcttggaattagttttgctggtggttatgtggctggtgttttctgtgctattgtgtcgcatcctgctgacaatcttgtctctttccttaacaatgccaaaggagcaactgttggtgatgctgtgaagaagctaggtttgtggggtctgtttacccgtgggcttcctctccgtattgtcatgattggaacactcactggagctcaatggggaatctatgatgcattcaaagtttttgtgggactgccaaccactggtggtgttgctcctgttgctcctgcccctgctgctgctgagcttgcaaaggtgtaggtcaaccaaatagaattgttttattttgggttttgtggattccaggagaacttcttgatagggattaataaacataggtgacaaaattgaaggcgcttgagtgtctcaagtcagagtattctttataattgagaactatttgttcgagcttaagatttgcttttgctgaggatggttttgttttcatccaaatatcagaaaacttttgtagttagattatacatgaaatttcactctgatatccagctcgcaatcctccccatgaataggtgacaaaataatgtgcaaggggagagtacctaatttctcttcgcaaatgcgtggagtgtacgattattagatcatcattactgctgttttttttgttgcgagtacctttgaaacttttc

SEQ ID NO: 3027 - DNA, 1522 bp, Citrus clementina
aataaaagcggaattgctttgcccgggttctaacaaattggcagcgagagacaggaggaggagaagagaaagagaaaattagaagaattctctctgtctcgctctttttctctataattcaatcaagctttttactctcaaaatcaaatttcaaaaattccgaaatggccctcacagaatcttataggaaaaactctctgataccaagctacctctactcctcccaaacatccttcccgtccacggcggctttcaatggagcggcagcagccgccacgtcgccggctactccatccacggcgaggaggagcttcgttgttgcggcaccgagcgagccagggaagatagagatgtactcccctgcattctacgccgcttgtaccgtcggcgggatcctcagctgcggtctcactcacacggccgtcactcctcttgacctcgtcaagtgcaatatgcagattgatcctgttaagtacaaaagcatatcatctggttttggagttttgctcaaggaacagggaatcaggggcttcttcaggggatgggtacctaccttgcttggttacagcgcccaaggtgcttgcaagtttggattctacgagttcttcaagaagtactactctgacattgctggtccagagtatgctgctaagtacaagactttaatctaccttgctggctctgcttctgctgagttcattgctgatgttgctctttgcccctttgaggccgtgaaggtccgtgttcagactcagcctggttttgccagaggtttgggtgatggacttcccaagtttgttaaatctgagggcgctcttggtttgtacaagggtattgttcctctttgggggcgtcagattccatatactatgatgaagtttgcttcttttgaaaccattgttgagatgatctacaagcatgcagttcccacaccaaaggaccagtgcagcaaacctctgcagcttggaattagttttgctggtggttatgtggctggtgttttctgtgctattgtgtcgcatcctgctgacaatcttgtctctttccttaacaatgccaaaggagcaactgttggtgatgctgtgaagaagctaggtttgtggggtctgtttacccgtgggcttcctctccgtattgtcatgattggaacactcactggagctcaatggggaatctatgatgcattcaaagtttttgtgggactgccaaccactggtggtgttgctcctgttgctcctgcccctgctgctgctgagcttgcaaaggtgtaggtcaaccaaatagaattgttttattttgggttttgtggattccaggagaacttcttgatagggattaataaacataggtgacaaaattgaaggcgcttgagtgtctcaagtcagagtattctttataattgagaactatttgttcgagcttaagatttgcttttgctgaggatggttttgttttcatccaaatatcagaaaacttttgtagttagattatacatgaaatttcactctgatatccagctcgc

SEQ ID NO: 3028 - DNA, 1608 bp, Setaria italica
gtacaaacgcagcgcggccgcgctcgcgtggctcgccgctgcacacgcacaagcacgcccgcctcgccgagcctcagacggagcccacggaggcgcacgaaccgagggaatcagcccgcgcgctgtgccatggccctctccgagagctcgcggaatgcgctgctccccggcttcctctacgcggccccggctgccgcctcaccgtttgccgccgccggtggcgtgggcggactcgcggtcgccgcgccgtctgccgcttcggcggcggggcccgcggtttgggcgcgggcgccgagtgagccggggcggaggatcgagatgtactccccggctttctatgcagcgtgtacggccggcggcgtcgccagctgcgggctcacgcacatgaccgtcacgccgctcgacctcgtcaagtgcaacatgcagattgatccagctaagtacaagagcatctcttctggttttggtgttttgttgaaagagcaaggtgccaagggtttcttcaggggctgggtacccaccttgcttggatacagtgctcagggagcatgcaagttcggtttctatgaattcttcaagaagtattactcagacattgctggtcctgagtatgccgccaagtacaagaccttgatttacctcgcgggatctgcttcggctgaagtcattgcagatgttgctctctgtccaatggaggctgtgaaggtccgtgtgcaaacacagcctggctttgcaagaggtttgtctgatggtctccccaagtttgtaaaatctgaaggctattctgggctgtataaaggaattgttccgctctggggccgacaaattccttacactatgatgaaatttgcctctttcgagactgttgttgagatgatatacaaatacgccatcccttcccccaagagtgagtgcagcaagaatctccagcttggagtgagctttgcagggggttacattgctggggtgttctgcgccattgtttctcacccagctgacaaccttgtttccttcctcaacaatgctaagggggcaactgttggcgatgctgtgaagaagattggcctagtggggctatttacgcgtggcctgccattgcggatagtgatgattggcaccctaactggagctcagtggggtatctatgacgctttcaaagtcatggttggactaccaactactggtggtgttgctccaacacctgctcccgctaaggcctgattctacactaccgaacatctaacagcaattttggcgccaacaaggatgatgaccatccagctcctttttccctgtcgttctataattcttttaggaaggcatacctgcgtgcctgctaaaatttcagatgagacacaagctcaatacttcatgctaactcgaagaagagacatttaggaacatgttagtagatggtcctcaggtgcatagtgatcgctgtggaaaccatggcgtccttttcttttcaacatgatatgattctggaagtacaaatttgtagactctttcgactagagctgtcttgctggctcgatttgctgtcactgtgcccagtacatttaccatttgatacttttgtgaatgaacacaatatagctcttggtgtct

SEQ ID NO: 3029 - DNA, 1598 bp, Arachis hypogaea
tttctttctttctttctttctgtttctgtgtttcattgacctaactcttttcctcacaaatctcaatggctttctcagcagactcttctcgccgcaactccctcatcccttccttcctctactcttcctcttcctccgccaaaaccctatccttccagaagattctcacctccccctcctcctcccctcgccgcagcaccttccggcagcaacggtggcgccttcatgattccctctcccagcgagcccggcaagatcgagatgtactctccggccttctacgccgcctgtaccgccggcggaatcctcagctgtggtctcactcacatggccgtcactcctcttgacctcgtcaagtgtaatatgcagattgaccctgccaagtacaagagtatctcctctggttttggagttctgctgaaggagcagggactcagaggcttcttcaggggatgggtgccaactttgcttggttatagtgctcaaggtgcctgcaagtttggattttatgaattcttcaaaaagtactactctgatctggctggcccggaatatgcaaccaagtacaagaccttgatctaccttgctggttctgcatctgctgaggttattgctgatattgcactttgcccatttgaggccgtgaaggtccgtgttcaaactcagcccggctttgctaggggtctggctgatgggttaccgaagtttgtcagatctgaaggaaccttgggattgtacaagggattggtgcctctgtggggacgacaaattccatacacaatgatgaagtttgcttcttttgagaccattgtggagatgatctacaagcatgccatccccacaccaaagaatgagtgcagcaagagtctgcaactcggtgtgagttttgctggtggatatgttgcaggtgtgttctgtgccattgtgtcacatcctgctgataaccttgtctctttcctcaacaatgccaagggagcaaccgttggtgatgctgtgcagaagcttggtttgtggggtctcttcacccgaggcctccctctgcgtattgttatgattggaacacttacaggagctcaatggggaatatatgatgccttcaaggtcttcgtgggactgccaaccaccggtggtcctgctccttctgctgttcctacccccaccagtgctgagcttgcaaaggcttagattgccaagatgacacagttaatagtttgtttagagagccagcgaatagggaccataaataaacagaggattgctgaagttgcttgagtggaactcaagtatggttggatgatattctttgaagttcagacattgtttccatttttcttgagtattttgaatttttgggtggatggttttgctcgcatccttcctgttgccgaacactttgtaggtagttgatataattttgcatgttaggatatcacatgctcctttcaaatcggaatacatatctgttttcttgtccatgcaaaagcatggaaccatatgcaatgccaaaatcgagattattttacatatagttaacttcaatttttgtgatctgataaataattgttctcaattcgaatcatgatttttgtattgatgtc

SEQ ID NO: 3030 - DNA, 1662 bp, Cucurbita pepo
catttcagagaaaatcagagccattgggcgtttcagggatccgtttctgagcgagaaaaagcgaggttcctcttctagggttgcttcattttcttctccattgttggaattttgctttgatttgttctgctccaagttccatctcccatggcgctctctgatagaccctctcgtcaatctctgatccccagcttcctttattcttcaccttcttccactcgcactctgcctattaagaagatgcttcagtcttcatccacttttgatgcggtttcctcttctcctaagacctttgttattcctgccccgagtgagccgtctaagaagattgagttgtactcgccggcgttctacgctgcttgtacttttggtgggattctcagctgtggtctcacgcatatgactgttactcctctcgatttggttaaatgcaatatgcagatcgaccctgcgaaatacaaaagcatttcgtctggttttggaattttgcttaaggagcagggtgtgaggggtttctttaggggttgggtgcctacccttcttggctacagtgctcagggtgcttgcaagtttggtttctacgatttctttaagaagtattacactgatattgctggacctgagtacgctgctaagtacaagaccttgatctaccttgctggctctgcatcggctgaggtgattgctgatgttgcactttgccctttcgaagcagtcaaggttcgggttcaaactcagcctggattcgctagagggctagcggatggacttcccaagtttgtcaaatctgaaggaactctagggttgtacaagggtattgttccactctggggtcgccagattccatacacaatgatgaagtttgcttccttcgagacaattgtcgagatgatatacaagtatgccgttcccgcaccaaaggaccagtgcagcaaatctctccagcttggtattagttttgctggtggatatgtggctggtgttttctgtgctattgtgtctcatcctgctgataatctcgtgtctttcctcaacaatgccaaaggagcaactgttggagacgctgtcaagaagctcggattatggggtctcttcactcgtggtctacccctccgtatcgtcatgattggaactcttactggtgctcaatggggcatttacgatgcattcaaagtgttcgttggactgcctactactggtggtgttgctcctgctgcccccacaccttctgcttctgagcttgcaaatgcgtgagattgatgctcgatccatcgatcatccggagttttgttgtttttacgagttggggagaaacctctccatagaattgaataaacataaccttagaatgatgatatgcttatagtcgtcgaagccagaagaatttcttcatagaatggatgatggacgcttttccattcggtatcggtttcctttttttcctcggaattcattgaatttgttggggatggttttgatctcatccttagcttggaatacttgtttgtagtagttcataattcagatagagatttgcagtttgatggtttaagaaccatgagcatatgatatgaggatgtattttgtacccatgtcaggaacaaactttctgccaaataaactgacagatgaagggtaatcaaagatttggcccagttttca

SEQ ID NO: 3031 - DNA, 1438 bp, Pennisetum glaucum
ggcgagtgggtccgccccgtcgttcccgatccaggcgcccaacgagaagatcgagatgtactcgccggcgttctacgccgcctgcacggccggaggcatcgccagctgcgggctcacccacatggccgtcacgcccctcgacctcgtcaagtgcaacatgcagatcgatccagcaaagtacaagagcatcacttccgggtttggaattctggccaaggagcaaggagtgaggggcttcttcaggggatgggtgcccacccttcttggctacagtgctcagggagcttgcaagtttggattctacgagttcttcaagaagtactactcagatattgcagggcctgagtatgctcagaaatacaagaccttgatataccttgctgggtctgcttctgctgaggtgattgccgatgtggctctctgtccctttgaagccgtgaaggtccgtgtgcagacacagcctggttttgctcgtgggctcagtgatggactccctaagttcattagatctgagggtgccctgggcctttacaagggcattgtccctctctggggtcgtcagattccttatacaatgatgaagtttgcgtcatttgagaccattgttgaacttatctacaagcatgctgttcctgttccaaagtcagaatgtagcaaatcttcccaactgggtatcagctttgctggtggctacgttgctggtgtcttctgtgccattgtttctcacccggcagataacttggtctccttcctgaacaatgccaagggtgctacagtgggtgatgctgttaagaagcttggtgtctggggcctgttcactcgtggtctaccccttcgtatcgtcatgattggtactcttactggagctcagtggggaatttatgatgcattcaaagtcatggttggattgcctacaactggtggtgttacgcctgcaccagcccctaccgcagaggaggaggctgctttgaaggccagtgcctgatccttcatattaagacaaactagaatgcctttgatcattctttaccgatgacaaatgtaccaattgcatgagttcaaccttatgtctaaatttttgagaggatggctttcatcctgtcggacgagatgaactcgctaagccggtgatcgtagtttttttgcccgagtgtaaccctagtgcttgatgatgtataataagtattaggttcgcatcactgttaggagcccaggttttgctaccacctgtgctattgcttatgctgcccattttgtggcatcactggtcatccatgtgaatgagttgatggcagcggttcatgttctcaactattgcttatgctgctgattttgtggcatcactggtcatccatgtgaatgagttgatggcagcggttcatgttctcaatttcagtattatgctgttcttttctcctcaaggtcacattctatatgc

SEQ ID NO: 3032 - DNA, 1564 bp, Cajanus cajan
aaaacctcggaaccaaagcaaaggcagtgagaagtgagaagtagagagagaaagagcccttccctttctctctcgctttcttttgacgcttcgttgaccaaatggctcttcccgactcctcctctcgccgcaactccctcatcccctccttcatctactcctcttcctccaaaaccctacctctccaccaaatgctcaactccgccgccgcctcctccctcgcgccgccgcccgcgtccgccgccggatcccgcggcctcatcattccctctcccagcgagtcccgcaagatcgagctctactcgccggctttctacgctgcctgtaccgccggtggaatcctcagctgtggcctcactcacatggctgtcactcctcttgaccttgtcaagtgtaatatgcagattgaccctgctaagtacaagagcatctcttctgggtttggagttttgctcaaggagcagggagttaagggctttttccgtggttgggtacctaccttgcttggttacagtgcacagggtgcttgcaaatttggattctatgagttctttaagaagtattactctgatattgctggaccggagtatgcaagcaagtacaagactttgatctaccttgctggttcagcatctgctgaggttattgctgatattgctctttgccccttcgaggctgtgaaggtccgtgtccaaactcagcctggttttgcaaggggtctgtctgatgggctcccaaaatttgtcagatctgaaggaacattagggctgtacaagggattagtgcctctgtggggacggcagattccatacacaatgatgaagtttgcttcttttgagaccattgttgagctgatctataagcatgccatccccacaccgaagaacgagtgcagcaaaggtctgcaacttggagtcagttttgctggtggatatattgctggtgtactttgtgcaattgtgtctcatcctgctgataatctcgtctcttttctgaacaacgccaaaggagcaacagttggtgatgctgtgaataagcttggtttatggggtctcttcacacgtggtcttcccctccgtattgttatgattggaactcttaccggagcccaatggggaatatatgatgcattcaaagtctctgttggacttccaaccactggtggtcctgctcctgcggctgctccagctcctggttctgagcttgcaaaggcatagaatgtccaatgatgacacactcaatagtttgtttaagaaactttagaaagccggtgaatagggaccataaataaacagaagactgctgaagttagcttgagtggaactcaagcttggttggataatattcttttcaagttcagacattgtttccatttttcttatatttgagtattttaaatttttgggaggatggttttgcttgcatccttcccgctgttgaaaactctagctaggaatgatataattttgcatgttaggttcactacatgcctttgtcaaacgggaatacacatttgttttcttgtctgtgcataagcatagacgcatatgcaatgtctagattg

SEQ ID NO: 3033 - DNA, 1955 bp, Cajanus cajan
ggggcatagcgttagcgtccgttacggaaatgggaagagcaatataaagcaggaggcgagacacatccaatggtgccaaaacctcggaaccaaagcaaaggcagtgagaagtgagaagtagagagagagaaagagcccttccctttctctctcgctttcttttgacgcttcgttgaccaaatggctcttcccgactcctcctctcgccgcaactccctcatcccctccttcatctactcctcttcctccaaaaccctacctctccaccaaatgctcaactccgccgccgcctcctccctcgcgccgccgcccgcgtccgccgccggatcccgcggcctcatcattccctctcccagcgagtcccgcaagatcgagctctactcgccggctttctacgctgcctgtaccgccggtggaatcctcagctgtggcctcactcacatggctgtcactcctcttgaccttgtcaagtgtaatatgcagattgaccctgctaagtacaagagcatctcttctgggtttggagttttgctcaaggagcagggagttaagggctttttccgtggttgggtacctaccttgcttggttacagtgcacagggtgcttgcaaatttggattctatgagttctttaagaagtattactctgatattgctggaccggagtatgcaagcaagtacaagactttgatctaccttgctggttcagcatctgctgaggttattgctgatattgctctttgccccttcgaggctgtgaaggtccgtgtccaaactcagcctggttttgcaaggggtctgtctgatgggctcccaaaatttgtcagatctgaaggaacattagggctgtacaagggattagtgcctctgtggggacggcagattccatacacaatgatgaagtttgcttcttttgagaccattgttgagctgatctataagcatgccatccccacaccgaagaacgagtgcagcaaaggtctgcaacttggagtcagttttgctggtggatatattgctggtgtactttgtgcaattgtgtctcatcctgctgataatctcgtctcttttctgaacaacgccaaaggagcaacagttggtgatgctgtgaataagcttggtttatggggtctcttcacacgtggtcttcccctccgtattgttatgattggaactcttaccggagcccaatggggaatatatgatgcattcaaagtctctgttggacttccaaccactggtggtcctgctcctgcggctgctccagctcctggttctgagcttgcaaaggcatagaatgtccaatgatgacacactcaatagtttgtttaagaaactttagaaagccggtgaatagggaccataaataaacagaagactgctgaagttagcttgagtggaactcaagcttggttggataatattcttttcaagttcagacattgtttccatttttcttatatttgagtattttaaatttttgggaggatggttttgcttgcatccttcccgctgttgaaaactctagctaggaatgatataattttgcatgttaggttcactacatgcctttgtcaaacgggaatacacatttgttttcttgtctgtgcataagcatagacgcatatgcaatgtctagattgagagcttttttactcggctttttgacccatctaaaaaaaaaaaaaatacaaaaaaaaaataaaaaaaaaaataaataacaaaaagaggaagttttggccacgtaggagccaacgtggcattgaaaacgcctggggggtgggcgtcttttagaagacgcctccaccccaggtgccatgtatgctgatgtggcacggtgaagagaaaatgctggagggaggcgtgttgtacacgtggtagaatttcgttgaaggcgccccacccccaggcgccaagtgtgctgatgtggcacacactgaaggcgcctcctccca

SEQ ID NO: 3034 - DNA, 1990 bp, Oryza sativa
ctggaattcttactgggcggcccattaaggcccacgatgaggtaacccacacccacctgtgcggactccgctataaaagcccagcccattcggaagcggatgccctagcaaatcgcggagccaccggtctctcccacctctccctcccccgcgagcgaatggcggcgagccgctcgcgggagcggagctcgcgcacgccgctgctcaagctcaacaaagcgcgcccccgcgcccctcctcgagatgaggcctcaaaccctaagccgcgagagcaccaccaccgccaacgcccacgcccgccgccatggccgtcgtctccgagagctcgcgcaaggcgctgctgcccagcttcctgtacgcggcccctgccgcctcctcgtcgccgtcgttcgcggccgccgcagccgtgggtgtacgtggggtccccgcgccgtcgctggcggggccggcggtgtgggctcgctcgccgagagagccggcggggaagattgagatgtactcgccggccttctacgccgcgtgcacggccggcggcatcgccagctgcgggctcacgcacatgaccgtcacgccgctcgatctcgtcaagtgcaacatgcagattgatccagccaagtacaagagtatctcatctgggttcggtgttctcttgaaagagcaaggagcaagaggtttcttcagaggatgggtgcccacactgcttggttacagtgctcagggcgcgtgcaagtttggtttctatgaattttttaagaagtactattcggacattgctgggcctgagtatgcagctaagtacaagacattaatttatttggctggatctgcttctgctgaagtaattgcagatattgcactctgccccatggaggctgtgaaggttcgtgtgcagacacaacctggctttgcgagaggtttatctgatggtcttccaaagtttgtcaaggcagaaggctatgctggattgtataaagggattgttccactctgggggcgacaaattccttatactatgatgaagtttgcgtcttttgaaaccgttgttgagatgatatacaaatatgcaatccctgcccccaagagtgagtgcagcaaaccactgcagctcggtgtgagctttgcaggtggttacattgcaggggtgttctgtgcaatagtttcacaccctgcggacaatcttgtgtctttcctcaacaatgccaagggcgcaacagttggcgatgctgtgaataagcttggtatgtggggtctatttacgcgtggactccctttgcgtatcgtgatgatcggtactctcactggagcgcagtggggactctatgacgctttcaaagtgatggttggactgccaactactggtggagttgctccaacaccagccaagtgatggttggactgccaactactggtggagttgctccaacaccagccattggtgaagagcagctgaaggcctgatgcttgattctatacttccgaacttctaacaattccgtgccaacttggatgatggcgaaataggttcttagtttagaaacaaaaaggattttgttgacgaatgcttatagttcattaattcaatcgctgctaaaaaaaactgagataagcatgctcagggcttacaaattataagggtattgcggtacagagtttaggatagtagtatagatggccattcgatgaatgatgcttgcgtgaatgaccgtggcatccttcaatttttgtaggtctattttttttattgcagtagaaatgttgattacgccttgggccttggctctatcttttgctggccggttgttatcgttgtaactctccgcggtattcgttcttttcttcagatgtcaataatgcaatctgtgtagtgttccattcaatataccactgtatcatatctctctattgtgctagtattaatgaagctgtcgataagtatttgacaaccgaaacaaataaactttggacatatgaatatgagaatttatcctcc

SEQ ID NO: 3035 - DNA, 1770 bp, Oryza sativa
tagcaaatcgcggagccaccggtctctcccacctctccctcccccgcgagcgaatggcggcgagccgctcgcgggagcggagctcgcgcacgccgctgctcaagctcaacaaagcgcgcccccgcgcccctcctcgagatgaggcctcaaaccctaagccgcgagagcaccaccaccgccaacgcccacgcccgccgccatggccgtcgtctccgagagctcgcgcaaggcgctgctgcccagcttcctgtacgcggcccctgccgcctcctcgtcgccgtcgttcgcggccgccgcagccgtgggtgtacgtggggtccccgcgccgtcgctggcggggccggcggtgtgggctcgctcgccgagagagccggcggggaagattgagatgtactcgccggccttctacgccgcgtgcacggccggcggcatcgccagctgcgggctcacgcacatgaccgtcacgccgctcgatctcgtcaagtgcaacatgcagattgatccagccaagtacaagagtatctcatctgggttcggtgttctcttgaaagagcaaggagcaagaggtttcttcagaggatgggtgcccacactgcttggttacagtgctcagggcgcgtgcaagtttggtttctatgaattttttaagaagtactattcggacattgctgggcctgagtatgcagctaagtacaagacattaatttatttggctggatctgcttctgctgaagtaattgcagatattgcactctgccccatggaggctgtgaaggttcgtgtgcagacacaacctggctttgcgagaggtttatctgatggtcttccaaagtttgtcaaggcagaaggctatgctggattgtataaagggattgttccactctgggggcgacaaattccttatactatgatgaagtttgcgtcttttgaaaccgttgttgagatgatatacaaatatgcaatccctgcccccaagagtgagtgcagcaaaccactgcagctcggtgtgagctttgcaggtggttacattgcaggggtgttctgtgcaatagtttcacaccctgcggacaatcttgtgtctttcctcaacaatgccaagggcgcaacagttggcgatgctgtgaataagcttggtatgtggggtctatttacgcgtggactccctttgcgtatcgtgatgatcggtactctcactggagcgcagtggggactctatgacgctttcaaagtgatggttggactgccaactactggtggagttgctccaacaccagccaagtgatggttggactgccaactactggtggagttgctccaacaccagccattggtgaagagcagctgaaggcctgatgcttgattctatacttccgaacttctaacaattccgtgccaacttggatgatggcgaaataggttcttagtttagaaacaaaaaggattttgttgacgaatgcttatagttcattaattcaatcgctgctaaaaaaaactgagataagcatgctcagggcttacaaattataagggtattgcggtacagagtttaggatagtagtatagatggccattcgatgaatgatgcttgcgtgaatgaccgtggcatccttcaatttttgtaggtctattttttttattgcagtagaaatgttgattacgccttgggccttggctctatcttttgctggccggttgttatcgttgtaactctccgcggtattcgttcttttcttcagatgtcaataatgcaatctgtgtagtgttccattc

SEQ ID NO: 3036 - DNA, 1606 bp, Hordeum vulgare
agccaccggtctccctccccgcgagcaaatggcggcgagcctcacgctcgcctccctccccccccgcaacccacaagacaacccagccccgccccgcccccaggggaagaagaagcagagcactcgcggcgaccgcgtagaagcccaacctcagccatggccctctccgatagctcgcgccacgcgctgctccccagcttcctgtacgcggccccctccgccgccgccaccaccacccccttctccgccgccgctggcattggtggccgcgggctcgtcgcaccggccgatgcggcggcgacgaggccggcggtgtggacgcgggcgcctagcgagccgtcccggaagatcgagatgtactcgcccgcgttctacgcggcgtgcacggccggtggcatcgccagctgcgggctcacgcacatgaccgtcacgccgctcgacctcgtcaagtgtaacatgcagattaatccagccaagtacaagagcatctcttctggatttggtgttctattgaaagagcaaggggcaaagggtttcttcagaggatgggtgcctactttgattggttacagtggtcaaggcgcctgcaaatttggtttctatgagttcttcaagaagtattactcggatattgctggacctgagtatgcagccaagtacaagactttgatctatcttgctggctctgcttcggctgaggttattgcagatgttaccctctgccctatggaggctgtgaaggtccgcgtgcagacacagcctggttttgccaaaggtttatctgatggactgcctaagtttgtgaaggctgaaggatatgctggattgtacaagggaattgttccgctctggggccgtcaaattccatatactatgatgaaatttgcctcctttgagactattgttgagatgatctacaagtacacaattcctgttcccaagagcgagtgcagcaagtctctccagctcggagtgagctttgcaggcggttacgttgctggagtgttctgtgcaatagtttcgcacccagctgacaaccttgtttcattcctcaacaatgctcagggagcaactgttggcgatgctgtgaagaaacttggtctgtggggtttgttcacgcgtggactccctctgcgtattgtgatgattggtactctaaccggagctcagtggggtatctatgatgcttttaaagtcatggttggactgccaacaactggtggagttgctcctacgcctgcagccgctggagagcagctgaagggctgaggcttttgattctatactacatatctaacaacattttttggcgccgaattggatgacgacgaaatagctcatctttcatccttttaagagcaaacgatttttttttcaggactgcctagtcgcaaccctggtaattagtagatgccaagacagtttaggaacaattttcggcacatgatcgtctggtttaggacggttgcctggaacagcatacttgtctatctttaactgttattatatgtcccagctctggcaataaaagctgtaattaagcgcttgcttgtgtttaatattttgctggtcttatttcaccagtgtgcaacattgttgtgttttg

SEQ ID NO: 3037 - DNA, 2091 bp, Vitis vinifera
agataaaggggttgaaatagaatattccactaccacgccggcctcttgtgcaagtgaaattacccttgcactaaaattaccaatcgtacccgcacgagagattctgtctgtgtcagacgacgccgtttagagcgttggagaggaaagtccagggacagagcatcgtaatttcagttgaagtttagggtttttatttgtacgtcgtataagtaacgcgaacgagggctagccggtggccaataagtggaacgacactcccctcatttcttacaggagcatcgctgttgttgagtgcgagatattgggagaacatctgcttccctttttttttccattcatttcttccgttttctctcaatctctttcagctctcatggcgacttctgaaaactctcgacattctctgatcccttgcttcctatactcctcctcctcgaagaagagccttattcttgagaaaatggcggcttctccatcacctgcaaatggaggagtacccaagagcttcttcgttcctgctccaagcgagccgggaaagatcgagatgtactctccggcgttctatgctgcttgtaccgccggtggaatcctaagttgcggcctgactcacatggccgtcactcctcttgacctcgtcaaatgtaatatgcagattgaccctgcaaagtacaagagcatttcgtctggatttggagttttgctgaaggagcagggagttaggggatttttcaggggttgggtgcctaccctgcttggttatagtgcacagggtgcttgcaagtttggattctatgaattcttcaagaagtattactctgacattgctgggccagagtatgctgccaagtacaagaccttgatctaccttgctggttctgcatctgctgaggtaattgcagatgttgctctttgccccatggaggcagtgaaggtccgggttcaaactcagcctggttttgctagaggtctgtcagatggatttcccaagtttgttaaatccgaaggtgccttgggattgtacaagggcattgttcctctctggggacgtcagattccatatacaatgatgaaatttgcttcttttgagactattgttgagatgctttacaagtatgccattcctactccgaaggaccagtgcagtaaaactctgcagcttggtgtgagctttgctggtggatatgtggctggtgttttctgtgctattgtttctcatccagctgacaatcttgtctccttcctcaacaatgctaagggcgcaacagttggtgatgctgtgaagaaccttggattgtggggtctcttcacccgggggcttcccctgcgtattgtcatgattggaactctcaccggagcacagtgggggctatatgatgctttcaaagttttcgtaggactgccaaccactggtggtattgctcctgctcctcctgcttccacgacttctgagcttgcaaaggcctagaatgttgaatgatcgatatacagagtttagatgaatgataaaactgggaaaacgtcttaataagggatcaataagggtaggattcctgaagctgcgatggcagcctaggacgtgggaaatattcttttgcgtttgaaacttgcgtcgattttccttgttcaccctttttttggggttaggggttgtttgatggtgggggtaaagattggtatcggtcttgtccatccaattcttgaaaactttagtgtgttagacgaaaaatctcactttgatattaggattatggatgtcatccatcacaaatggacagcaaagaataatgagcatctgcttacatcgaacagtaggcatgtgcagagatggcaatgcaaaggcgtggaaaattatgcctgttttcatggttcataatcactatcatgtcagatgccttcgcaaaccatttttttttttctgctgggtatgttaatgcattttttacctatttgaaaagggcttggcatgaattttatatgttgtaatctgttttacctgagtccggttgtgccctagcccagtaacgtatgtcaccaaataatttactctaccgttcatttcaaatttcatactttatagcatttatagatttt

SEQ ID NO: 3038 - DNA, 1774 bp, Cucumis melo
ctccgttaccattacagagaaaatcaaagaaatttggcgttgagagattgggagagaggtttctctttctagggttgcttcttcttcttcatcctccattgttgcaaatttcacttccttctcctcttgttctcatctcccatggcgctctctgataaaccctctcgccaatctctgatccccagcttcctttactcttccccttcttccactcgaactcttcctctcatgaagatgcttcagtcttcacccactctcgattcggtttcctctccttctcctaagacctttgttattccctcccccactgagccctctaagaagatcgagatgtactctccagccttttacactgcttgtacttttggtggaattctcagctgtggtcttactcatatggctgttactcctcttgatttggttaaatgtaatatgcagattgatcctgcgaaatacaaaagtatttcatctggttttggagttttgctcaaggagcagggtgtgaggggtttcttcaggggctgggtgcctacccttcttgggtacagtgcacagggtgcttgcaagtttggattctacgagttctttaagaagtattactctgatattgctggacctgagtacgctgctaagtacaagaccttgatctaccttgccggttctgcatctgctgaggtgattgctgatattgcactttgcccttttgaagcagtgaaggttcgtgttcaaactcagcctggttttgctagaggtctagctgatggacttcccaagttcgtcagatctgaaggaactcttgggttgtacaagggtattgttccactctggggacgacagattccatacacgatgatgaagtttgcatcctttgagacaatagttgagatgctatacaagtatgccattcccacaccaaaggaccagtgcagcaaatctctccagcttggtgttagttttgctggtggatatgtggctggtgttttctgtgctatcgtgtctcatcctgccgataatcttgtgtcgttcctcaacaacgccaaaggagccactgttggtgatgctgtcaagaagctcggattatggggtctcttcacccgtgggctacctctccgtattgtgatgattggaactcttactggtgctcaatggggtatctatgatgccttcaaagtatttgttggactgcctaccaccggtggcccggcgcctgctgctgcccctgcacctgctgcagctgagcttgcaaaggcgtgaggttgatgcatgatagaccaacaggagttttgttgtttttcgcgagttgaggagaaacctcttcataggaaattgaataaacataaccatttagcgatgctgcttacagtcctcaaagcctgaagaatatctttatagaatggatggacccttttccattcggttttttgtttcccgtttattactcggcattcattgaatttgttaagccaaggatggttttgatctcatccttgtgctagcttttggatactcggcattcatccttgctagcttttgtagtagttaagaattcagatagagaattgcagtttaatggttttaaaaaccatgtcaggaacaaacttgttgtaccacccatgtcagcaacaaactttcgccaaataaactgacggataatgggcaaaggaacaaaatttggctgagttttcatttctcttcttacattctacttttcttggtaagcctatgctaaagactaaagacctactacaattacttaagactactagaaatttta

SEQ ID NO: 3039 - DNA, 2269 bp, Glycine max
ggggcacaaaagagagagacccttttccttctctctggctttcctttgacgcttctgacactgctccttttctttctctccgtgtcctaatggctctccccgactcttcttcccgccgcaactccctgatcccctccttcatctactcctcttcctccaaaacgctccctctacaccacatgctcaactccgcctccgccgccgccccctcccagccgccggaaaacctccacgccggatcgcgcggcctcatgattccctctcccagcgagtcacgcaagatcgagatgtactcccctgccttctacgccgcctgcaccgccggtggaatcctcagctgtggcctcactcacatggccgtcactcctcttgacctagtcaagtgtaatatgcagattgatcctgctaagtacaagagcatctcttctgggtttggagttttgcttaaggagcagggattcaggggctttttccgtggctgggtgcctaccttgcttggttacagtgcccagggtgcttgcaaatttggcttctatgagttctttaagaagtactattctgatattgctggcccagagtatgcaagcaagtacaagaccttgatctaccttgctggttcagcatctgctgaggttattgctgatattgctctttgcccatttgaggctgtgaaggtccgtgtccaaactcagccaggttttgcaaggggtttgtctgatgggctcccaaaatttgtcagatccgaaggaaccttagggctgtacaagggattagtgcctctatggggacgacagattccatacacaatgatgaagtttgcttcgtttgagaccattgtagagctgatctataagcacgccatcccaacaccaaagaatgagtgcaccaaaggcctgcaacttggtgtcagttttgctggtggatatattgctggtgtactttgtgcaattgtgtctcatcctgctgataatcttgtctcttttctgaacaatgcaaaaggagcaacagttggtgatgcggtgaagaagcttggcctgtggggtctctttacccgtggtcttcccctccgtattgttatgattggaactcttactggagcccaatggggaatatatgatgcattcaaagtgtctgtcggattgccaaccactggtggtcctgctcctgcagctgctctagcttctgatgctgagcttgcaaaggcatagaatgtccaatgatgacacattcaacagtttgtttacgaaacttagaaagccagtgaatagggacaccataaataaacaggaggattgcagaagttgcttgagtggaactcgagcttggttggataatatattcttttaaagttcagacatcgtgtttccatttttcttaaatttgagtattttgaatttttaggaggatggttttgctcgcatcctcctcttgctgaaaactttgtaggtaggaatgatataattttgcatgctaggttctctacatgccattgtcaaacgggaatactcatttgttttcttgtctgtgcataagcacagacgcatttgcaaatgtctagattgagataatttttactccctttatttgattatttcttttggaaaatgttccttttttgttgtattgcaatcatcagctctcttaaacgactgttatcatgagtcaactactagctatttaatcccttttttgttgtgattagttccggggaaaatgcaaaattgatgggaatccagtcacctatcgcgatcgatatgttggacttctcgttatgggtcttaatgactcaggcttcaccaaatcaagataaaaaatttgtgttcaattcaagctcccaaattatagtccaaaatccttaaattatatcgagcatggtcaggttagccttgtctgttgaattggttttgccatgacctttgtatgcaaaccagcacatgatggtagggaaaatgaaagtgactattacatcggagtagaggaagaagataggtttgtgagtaaagagtaagagtgaaatgtgacaagtctcatgaacttttaaatattttgttaaggatcaataattgatgggtcagaaatacattttatttttgggtataatttgtgtgattcttctcccatcgggttggttcattttttaggtaaggtgatattttgagttgtcactctatgctcaagtcggggatcgaacaccaaaccttgaataaggaatccaaatatcaaattacttgtgttaacaacttttggttatggacatacattctaattg

SEQ ID NO: 3040 - DNA, 1662 bp, Cucumis sativus
ctccgttaccattacagaagaaagtcttacaaatttggcgttgagagattgggagagaggtttctctttctagggttgcttcttcttcttcttcttcctccattcttgccactttcacttccttcttctcttaatctcatctcccatggcgctctctgataaaccctctcgccaatctctgatccccagcttcctttactcttccccttcttccactcgaacccttcctctcatgaagatgcttcagtcttcacccactctcgattccgtttcctcttcttctcctaagagctttgttattccttcccccactgagccttccaagaagatcgagatgtactctccggccttctacactgcgtgtacttttggtggaattctcagctgtggtcttacgcatatgactgttactcctcttgatttggttaaatgtaatatgcagattgatcctgcgaaatacaaaagtatttcatctggttttggaattttgctcaaggagcagggtgtgaggggtttcttcaggggttgggtgcctacccttcttggatacagtgcacagggtgcttgcaagtttggattctacgagttctttaagaagtattactctgatattgctggacctgagtacgctgctaagtacaagaccttgatctaccttgccggttctgcatctgctgaggtgattgctgatattgctctttgcccttttgaagcagtgaaggttcgtgttcaaacgcagcctggttttgctagaggtctagctgatggacttcccaagttcgtcagatctgaaggaactcttgggttgtacaagggtattgttccactctggggacgacagattccatacacgatgatgaagtttgcatcctttgagacaatagttgagatgctatacaagtatgcgattcccacaccaaaggaccagtgcagcaaatctctccagcttggtgttagttttgctggtggatatgtggctggtgttttctgtgctatcgtgtctcatcctgctgataatcttgtgtcgttcctcaacaacgccaaaggagcaactgttggtgatgctgtcaagaagctcggattatggggtctcttcacccgtgggctacctctccgtattgtgatgattggaactcttactggtgctcaatggggtatctatgatgccttcaaagtatttgttggactacctactactggtggcccagcacccgctgctgcccctgcacccgctgcagctgagcttgcaaaggcgtgaggttgacttgatgcatgatagaccaaccggagttttgttgttttttacgagttgaggagaaacctcttcataggaaattgaataaacataaccttttagaatgatgctgcttacagtcctcaaagcctgaagaatatctttatagaatggatggacccttttccattcggtttttgtttcctgttttttactcgtcattcattgaatttgttcagccaaggatggttttgatctcatccttgtgctagcttttggatactcggcattcatcatccttgctagcttttgtagtagttaagaattcagatagagaattgcagtttaatggttttaaaaccatttcagggaacagactttgttgtattcccccatgtcagcaacaaactttcgccaaataaactgac

SEQ ID NO: 3041 - DNA, 1396 bp, Curcuma longa
gcaccagtcttccttctccttcctcttgatccggttcggtatcctagtcttcgatcaatggatctctccgaaaggtctcgccaatcgctcctccctagcttcctatactcgtccgggacgcttggcgtggatcggatgatcctcggccggagcgccgccgccgtccctaacgtggcacccagtggccctgcttcgattggatccgtcgttgtccaagccccgaacgagcctgggaagatcaagctctactcgcccatgttctacgccgcctgcactgccggaggtatcgccagttgcggcctgacccatacggccgtcacccctctcgatctcgtcaagtgtaacatgcagatcgatccggcgaagtacaagagcatctcctccggatttggggttttactcaaggaacaaggggtcaaggggttcttccgaggttgggtgccaactcttcttgggtacagcgcccagggagcttgcaagtttggattttacgaattcttcaagaagtattattctgatattgctggaccggagtatgctaccaagtataaaactctaatctacctggctggctctgcgtctgctgaggtgattgccgacgttgctctctgtccctttgaggccgtcaaggtgcgagtccagacgcagcctggttttgctagaggtttgagtgacgggttgcccaagtttgttaaatccgagggggcattaggattgtacaagggattggttccactttggggtcgtcaaattccttataccatgatgaaatttgcatcatttgagacgatagttgagatggtctacaaatacgcaattccaaaacccaaggaccagtgtagcaaagagcttcaacttggagtgagttttgctgggggttacattgccggtgtgttctgtgccattgtttctcaccctgccgacaatctcgtctctttcctaaacaacgctaagggtgccactgttggggatgctgtgaacaagcttggagtatggggtcttttcactcgtgggctcccgcttcgtatcgtcatgattggaaccctaacgggtgcgcaatggggaatttatgatgcattcaaagtcatggttggcctgcccacaaccggtggagttactcctcctgccacggtgaccgataagctgaaagctattgcttgattttttaaagattcccatttcttctcagatcttttgacaaagaaccagtttaggttaaaaggtatacatatatttttttgaattcacattatcatcaaatatcgagatccctcgatgtattattttgatccatttccatttccatttcttttggcatcctagaaattatagaggtgcagaataataatagaatgtgtaaacttgattgccgtttgcacactatttaacttataaa

SEQ ID NO: 3042 - DNA, 1857 bp, Musa acuminata
ggagagaaaagaggggaagacgctcttctctcatcctccccttctgcgtccaatctcgtcgatacaaaccctaagcccgtcgcgggaggagcgattgaagaagaccctaagcgtcgatgatggatctctctgagcagtctcgccgatccgtcctccccagcttcctctactcccccacctcaccgacctccagaaccctcggcctggagcagatccttgggagggccacccccgcctcgccagcccctcccgcctcggcgcccggcgggggcgctccgacaggctcgtttgtcatccaggcgccgagcgagcccgggaagatcgagatgtactcgcccatgttctacgccgcctgcaccgccggtgggattgccagctgcggcctcactcacacggccgtcactccgctcgacctcgttaagtgcaacatgcagatcgacccagcaaagtacaagagcatctcttctggttttggtgttttgcttaaagaacaagggttcagaggtttcttcaggggctgggtgcctacactgcttggatacagtgcccagggggcatgcaagtttgggttctacgagtacttcaagaagtactattcagatattgctgggcctgaatttgctgcaaagtataagactcttatctatcttgcggggtcagcatctgctgaagtgattgctgatgtagctctctgcccctttgaggcagtgaaggtgcgagtacagacacaaccagggtttgctagggggttgagcgatgggttacctaggttcgtcaaatctgaaggtgctctgggattgtacaagggaattgttcctctctgggggcgtcagattccttatactatgatgaaatttgcttcatttgagactgttgttgagatggtttacaaatatgcaattccaacaccaaaggaccaatgtagcaaacaactccagttgggagtgagttttgctggtggttatattgctggagtattctgtgctattgtttcccacccggctgacaaccttgtctcttttcttaacaatgctaagggtgccactgttggtgatgctgtgaagaaacttggggtgtggggtctgtttacacgtgggcttccactgcgtatcgtcatgattggcacacttactggagcacagtggggaatttatgatgctttcaaagtgatggttggccttcctacaactggtggagttgcccctgccgctgcttcctctccagagcttgctgagctgaaatctgctgcttgatatatgtttctgaaattaatccacttcatacggaagtgtaattctttaaaagaacaaccctttgcttgcttttgattttccatctcttagcctgagaaatttaaacatgttaaggtggcttttcaaatcatagccaaagcaaggattagtgagaaataagatggagcacgaggtctttgtaaccttgacctgcgaagagttgctagaacaggtgatgtttacttccatttcccaacctttgtaatctgttttcgttataaggtttgctaagcaaatatgtttctcatgtatttagcaacttatggttcccatgcagtagtgtttctttagccgaaaagatggatttccgtaggaacacaaatatttttatagtcatataaaaaatcctggtaaagcaattctgatcttcttcttaaacttgaaagttagcttaaagattgagggtggaaagtagtatgttatattgtttgatgtaactttctttctattaacgacagtgtattaggctataatacattgcaattttaccttacaatatgagacattgtatctatgatttggactctaatcattcacttcgtgacagggaaatgttatcatcggc

SEQ ID NO: 3043 - DNA, 1622 bp, Aristolochia fimbriata
atcgttaaagagtcataaaactcgttggacatcaagaagtgtggaagaaaaccatttcctcggttctctcgactaaaccctaatcaaattctctccttttgtccctcaaataccagcgtcgcacctgcgcgccttctctttggatcgttccttctgcgtcgatcgtcgcgagatggatttgatggaagggtctcgccgatcgctcctcccgggccacctctacaccagctcctccgcccattcgttgagcttggacgggctcttgagcaaggcgcagacctcgttcgcgcctcccttatctaatggaaccccaaagccttcttctttcgtcattcccgcccccagcgagcccgggaagatccagatgtattccccggctttctacgccgcctgcacggcgggtgggatcttgagctgcggcctcacccatatggctgttacgccgcttgatctcgtcaagtgtaatatgcagatagatccggcaaagtacaagagtatttcctctggttttggtgtccttctgaaggaacagggtgtccgaggtttcttcaggggctgggtgccaactcttataggctacagtgcacaaggagcctgcaaatttggattttatgaatttttcaagaagtactactcggacctcgctggacccgagtttgctgttaaatacaagaccttgatctacttggccgggtctgcatctgctgaagttatagctgatgttgctctgtgcccaatggaggctgtgaaagttcgggttcaaactcaacctggatttgctagaggattgtccgatgggttaccgaagttcgtgagatctgagggagctcttggattgtacaaggggctggttcctctgtggggtcgtcaaattccatatacaatgatgaagtttgccacttttgaaacaattgtggagatgatttacaagtacagtattcctagaccgaagagcgaatgcagcaatagtttgcaattgggtgtgagttttggtggtggttatattgctggtgttttctgcgctattgtctctcatccagcagataatctcgtttctttccttaacaatgctaagggagccactgttggagacgctgtgaagaagctcgggctatggggtctcttcaccaggggtctcccacttcgtattgttatgattggtacactgacaggagctcagtggggaatctatgatgccttcaaggttttcgttggactgccaacaacaggtggagttgcaccggctgccccagctactgaactggcagggaaagctgctgcttgaatttggaacatgttgtccggtagagctccttaattgattgtttgattccaggatgtgcttaatccatccttcaagtaccgccaatgagttaggattaataatgagataattgttttcttgttttctttaattttttttttgttatctttttcttcacagttagaaataacggccagatgttgtaatgtctgttaaattttttggcgttgtaccttctatattaaaaatttgatcattcggcttattgacagcaattattaatttgagttgatctgcagtaccaagtactggcaagtattcttgtgtattaaagtgtataaaaaagaagggttgtttc

SEQ ID NO: 3044 - DNA, 1499 bp, Manihot esculenta
tctagctcccttgcaaattccctcgttttcctcaatggctctcaccgattcttctcgccagtccctaatccctagcttcctctatgcctcttcctctcccaaaaccctcacactttccaaactcctccactctaactccaccctgccttccccttcgccgtcgccgtcactcatgaggaacaccagcagcttcgtgatccccgctcccagcgagcctgggaagatccagatgtactctccagctttctatgctgcttgtactgcaggaggtattctcagctgtggacttactcatatggccgtcactcctcttgaccttgtcaagtgtaatatgcagattgatcctgcaaagtacaaaggcatctcatctggttttggagttctgctcaaggagcagggattgagaggcttcttccggggttgggtgccaaccctccttggttatagtgcccagggtgcctgcaaatttggattctacgagttcttcaagaaatactactctgacattgccggaccagagaatgcagctaagtacaagaccttgatttaccttgctggttctgcatctgctgaggtgattgcagatgttgcgctttgtccttttgaggcagtaaaagttcgagttcaaactcagcctggttttgctagaggcatggcagatggacttcccaaatttatcaaatctgaaggcgctttagggttgtacaaaggcatcgttcctctctggggtcgtcagattccatatactatgatgaagtttgcatcttttgagaccatcgttgagctgatctacaagcatgccatccccacacctaaggaccagtgtagcaaacccttacagcttggcattagttttgccggtggatacgtcgctggtgttttctgtgccattgtatctcatcctgctgataatctcgtgtctttcctcaacaatgccaaaggcgcaactgttggtgatgctgtgaagaagctaggtttatggggtctgtttacccgagggctacctctccgtattgtcatgattgggactcttactggagcacagtggggtatctatgatgcattcaaagtttttgtgggattgccaaccactggaggtgctgctcctgctgctgcccctgctgttgctgcaactgagcttgcaaaggtgtaatttcggaaatcagcagttttattttgtgtcgctctgtggaagctgagaaaacaatagggataataaaagtaggattgacaactccctctcaagcctgtggagttcttttacattcaagagttactttgactaatttttttctctggagggatggttttggtttcatctttctataatgaatacattcaatagttagatcgtatatgaaatttcattttaatgttaggatcacaatatcctctgtcaggacaaccaaaaataatgggcagatgaggggatataatttgtcttgtccatttcccttgctatgaatttggtgaatgatatacatatatgtttttccatg

SEQ ID NO: 3045 - DNA, 1633 bp, Platanus occidentalis
gagaaccggtgattttttctcgcttctgctatttcagcgttctctttcttatatcgttcaaagccgcaaaccaatctcacgtatacaagccgcaaaacctttaccttaccgaagccttttgtatttcccctgaagagaagaaaccctaaccctaaccctaatggcgttctctgataactctcgccaatctctcgtcccaagctttctgtactcgacgtctttgtcgaagaagacactagatttagatggattgctgcacaaaaaccgtagcttgccttcgtctccatcaaatggtacttcaaaaagtttcgtcattcctgctccgagcgagcccggaaagatcgagatgtattcgccggctttctacgccgcttgtaccgccggtggaattttgagctgtggtcttacacatatgactgtcactcccctagatctggtcaaatgtaatatgcagattgaccctgcaaagtacaagagcatcagttctggttttggggttttgcttaaagagcagggagctagaggtttctttaggggttgggtgccaaccttgcttgggtacagtgctcagggtgcctgcaagtttggattctatgagttcttcaagaagtactactctgacattgctgggcctgagtatgctgccaagtacaagaccttgatttaccttgctggctctgcatctgctgaagtgattgctgatattgctttgtgtcccatggaggcagtgaaggtccgggtccaaactcaaccagggtttgccagagggttgtcggatgggttaccaaagtttgtcagatctgaaggatatcttgggttgtacaagggacttgttccgctctggggacgtcagattccatataccatgatgaagtttgcttcttttgagaccattgtagagatgctgtacaagtatgccatccccagcccaaaggaccagtgcagcaaatctctgcagctgggtgtgagctttgctggaggatatgttgctggtgttttctgtgccattgtttctcaccctgctgacaatcttgtgtctttcctcaataatgccaaaggggctactgttggtgatgctgtaaagaagctaggggtgtggggtctttttacacgtggtcttcctcttcgtattgtcatgattggcacccttactggagcccaatggggcatctacgacgcattcaaagtttttgttgggctgccaaccactggtggtgttgctccggccgctgcccctgctgcaactgaactagcaaaggtgtaacttggcctgattgtctgttaacattgaatgcttgcctttccatggggctagagactaaggaagtttttttttatacggttcaataactatagttcagctgctttgatgatcaatggcagttgggagtgtattctttccttgtttagaagttagtatattcttttttggatattttaaattgtgggaggatcgttttgatgtgaatctctgtttgaagaaattcaggcatgaagagaacttggtctttaggtgaagattctatacggtccccaacttacaaagagaggggacccataataatgaacagattttggggatctttagtgtatctgcccatctgtactttgtattgagataaatttgtggatc

SEQ ID NO: 3046 - DNA, 1751 bp, Glycine max
gttagcgggggcatattgtccgcaaaacaattggcaccaccaaaccaatataaagtagcacgaacgtgcagccaatggcgcacaaatctcggaagcaaacgcagcattgggagatagaaagagagagagaaagagagagagagaaagacccttacccttctctatcgctcgctttcctttgacgcttctgacccttgctttgtctgcgtcttccttctttctttctttctttctctgtgtgtcgtaatggctctcccagactcttcttcccgtcgcaactccctgatcccctccttcatctactcctcttcctccaaaacgctccctctccaccacatgctcaacaccgcctccgctgccgccgccgccgctccctccccgccgccggccaatctcgacgccggatcgcgtggcctcatgattccctctcccagcgagtcacgcaagatcgagttgtactcccccgccttctacgccgcctgcaccgccggtggaatcctcagctgtggcctcactcacatgaccgtcactcctcttgacctagtcaagtgtaatatgcagattgaccctgctaagtacaagagcatctcgtctggttttggagttttgcttaaggagcagggattcaggggcttttttcgtggctgggtgcctaccttgcttggttatagtgctcagggtgcttgcaaatttggattttacgagttctttaagaagtactattctgatattgctggcccagagtatgcaagcaagtacaagaccttgatctaccttgctggttcagcatctgctgaggttattgctgatattgctctttgcccatttgaggctgtgaaggtccgtgtccaaactcagcctggttttgcaaggggtttgtctgatgggctcccaaaatttgtcagatctgaaggaaccttagggctgtacaaggggttagtgcctctctggggacgacaaattccatacacaatgatgaagtttgcttcttttgagaccattgttgagctgatctataagcatgccatcccaacaccaaagaatgagtgcaccaaaagcctgcaacttggtgtcagttttgctggtggatatgttgctggtgtactttgtgcaattgtgtctcatcctgctgataatcttgtctcttttctgaacaatgcaaaaggagcaacagttggtgatgcggtgaagaagcttggtttgtggggtctctttacgcgtggtctccccctccgaattgttatgattggaactcttactggagcccaatggggaatatatgatgcattcaaagtcttcgtcggattgccaaccactggtggtcctgctcctgcagctgctccagctcctggttctgagctagcaaaggcatagaatgtccaatgatgacaagcaacaatgttgtacgaaacttagaaagccagtgaatagggaccataaataaatagaggactgctgaatgaagttgcttgagtggaactcaagcttggttggataatattcttttaaagttcagacattgtttccatttttcttatatttaagtattttgaatttttgggaggatggttttgctctcatccttccacttgctgaaaactttgtaggtaggaatgatataattttgcatgttaggttctctacatgccaattgtcaaacgggaacacatttgttttcttgtctgtgcataagcaccgacacatatgcaatgcctagattgagatcatttatactcgctagttttacttga

SEQ ID NO: 3047 - DNA, 1440 bp, Brachypodium distachyon
cgcgaaccaacccacagcagccatggccgtctccgagagctcgcgcaacgcgctgctacccagcttcctttacgcggtccccgccgcagccacctcccctttctcctccgccgctggcgtggcagggagcgggctcgtcgtgccgtcttcagcggcggtggcgacgaggccggcggtctgggcgcgggcgccgagcgaaccgtccggcaagatcgagatgtactcgccggcgttctacgcggcgtgcacggccggaggcatcgccagctgtggcctcacgcacatgactgtcacgccgctcgacctcgtgaagtgcaacatgcagattgatccagccaagtataagagcatctcttctggttttggtgttctcttgaaagagcaaggagcaagaggattctttagaggctgggtgcctaccttgattggttacagtggtcaaggcgcgtgcaaattcggtttctatgagttcttcaagaagtactactcggatattgctggacctgagtatgcagccaagtacaagactttgatctatcttgccggttctgcttcggctgaagtaattgcagatattgccctctgccctatggaggctgtgaaggtccgtgtgcagacacagcctggctttgccagaggtttatctgatgggctccctaagtttgtgaaggctgaaggctatgctggattgtataagggaattgttccgctctggggtcgacaaatcccatacactatgatgaagtttgcctcctttgagactattgttgagatgatctacaagtatgccattcctgcccccaagagtgaatgtagcaagtctctccagcttggagtgagctttgcaggaggttacgttgctggagtgttctgcgcaatagtttcgcacccagctgacaaccttgtttcatttctcaacaatgctcagggcggaaccgtcggagatgcagtgaagaagcttggtttgtgggggctctttacacgtggactccctttgcgtatcgtgatgattggtactctcaccggagcccagtggggtatctacgatgcttttaaagtcatggttggactgccaactactggtggagctgctccaccacctgctgctgctggagagcagctgaaggcctgagacttgattatatatatactatatatatctaacaccattttttggcgccaagttggacgatggcgaaataactcctattcttccttctaaaagctattgaataccttcaggaatgcttaattgcaactctggtagcaatctcagacgagcctgaagctcctgagtctgtgttaattagaagttgagacagtttaggaacaattttcggtagatgatcgcctggaaaccttggtagcatcctccctgtttctttttggtttatatccccggtctggcagtaaaaattgcaataaagtcaagttatactt

SEQ ID NO: 3048 - DNA, 1669 bp, Brachypodium distachyon
ccctccatgcgaggaagtggcggcgagcctcacgctcggaccgtctgacgcagctcgccccgctcacacaaggcaggagccacccccggccctctcccagaggagaagcactcgtggcgagcgcgaaccaacccacagcagccatggccgtctccgagagctcgcgcaacgcgctgctacccagcttcctttacgcggtccccgccgcagccacctcccctttctcctccgccgctggcgtggcagggagcgggctcgtcgtgccgtcttcagcggcggtggcgacgaggccggcggtctgggcgcgggcgccgagcgaaccgtccggcaagatcgagatgtactcgccggcgttctacgcggcgtgcacggccggaggcatcgccagctgtggcctcacgcacatgactgtcacgccgctcgacctcgtgaagtgcaacatgcagattgatccagccaagtataagagcatctcttctggttttggtgttctcttgaaagagcaaggagcaagaggattctttagaggctgggtgcctaccttgattggttacagtggtcaaggcgcgtgcaaattcggtttctatgagttcttcaagaagtactactcggatattgctggacctgagtatgcagccaagtacaagactttgatctatcttgccggttctgcttcggctgaagtaattgcagatattgccctctgccctatggaggctgtgaaggtccgtgtgcagacacagcctggctttgccagaggtttatctgatgggctccctaagtttgtgaaggctgaaggctatgctggattgtataagggaattgttccgctctggggtcgacaaatcccatacactatgatgaagtttgcctcctttgagactattgttgagatgatctacaagtatgccattcctgcccccaagagtgaatgtagcaagtctctccagcttggagtgagctttgcaggaggttacgttgctggagtgttctgcgcaatagtttcgcacccagctgacaaccttgtttcatttctcaacaatgctcagggcggaaccgtcggagatgcagtgaagaagcttggtttgtgggggctctttacacgtggactccctttgcgtatcgtgatgattggtactctcaccggagcccagtggggtatctacgatgcttttaaagtcatggttggactgccaactactggtggagctgctccaccacctgctgctgctggagagcagctgaaggcctgagacttgattatatatatactatatatatctaacaccattttttggcgccaagttggacgatggcgaaataactcctattcttccttctaaaagctattgaataccttcaggaatgcttaattgcaactctggtagcaatctcagacgagcctgaagctcctgagtctgtgttaattagaagttgagacagtttaggaacaattttcggtagatgatcgcctggaaaccttggtagcatcctccctgtttctttttggtttatatccccggtctggcagtaaaaattgcaataaagtcaagttatacttcgttgcgttgttgtgctttggcttgtgaagagtgttcttgaggtgttcacataaattgaacatttatttggttgcggctctatacttcgacgaattggcagcagtgca

SEQ ID NO: 3049 - DNA, 1607 bp, Vigna unguiculata
aacgcagaagaggcattggaaaaattatagagagagatcctttccttctctctcgctttcctttgacgcttctgacccttttccctttgtctgcgtctttctcatctattctctgacctaatggctatctccgactcttcttctggccgcaactctctcatcccctccttcctctactcctcttcctccaagacgcttccactccaccgtatgctccactccaccgccgccgcagccgccgccgcaccttcggcaccgccggcaaacctcgatgccggatcgcgtggcatcatgattccctctcctagcgagtcacgcaagatcgagctgtactctcccgccttctacgccgcctgtactgccggtggaatcctcagctgtggccttactcacatggccgtcactcctcttgaccttgtcaagtgtaatatgcagatcgacccttctaagtacaagaacatcacgtctggatttggggttttgcttaaggagcagggcttcaggggatttttccgtggttgggtgcctaccttgcttggttacagtgcccagggtgcttgcaaattcggattctacgagttctttaagaagtattattctgatattgctggcccagagtatgctagcaagtacaagaccttgatttaccttgctggttccgcttctgctgaggttattgctgatgttgctctttgcccctttgaggctgtgaaggtccgtgtccaaacacagcctggctttgctaggggtttggcagatgggctcccaaaatttgtgagatctgaaggaaccttggggctgtacaagggaatagtgcctttgtggggacgacagattccatacacaatgatgaagtttgcttcatttgagaccatagtggagcttatctataagcatgccattcctacaccaaagaatgagtgcagcaaaaacctgcaactcggtgtcagttttgctggtggatatattgctggtgtgctttgtgcaatcgtgtctcatcctgctgataatcttgtctctttcctgaacaatgctaaaggagcaacagttggtgatgcggtgagtaagcttggtttgtggggtctcttcacccgtggtcttcccctccgtattgtgatgattggaactcttactggtgcccaatggggaatatatgatgctttcaaagtctttgttgggctgccaacaactggtggtcctgctcctgctgctgctccagctgcagctcctgattctgggctagcaaaggcgtaaaatgtccagtgatgagacactcaatagtttgtttacgaaagttagaaggcagtgaataggaaccataaataatcagaggactgaagttgcttgggtggaactcaagcttcgttggataatattcttttcaagttcagacattgtttccatttttattgtatgagtatgtcacatttttgggaggatggttttgctcgcatccttcccgttttctgagaactttgtagttaggaatgatataattttgcatgttaggttcgccacatgccattgccaaccgggaatacacatttctttcttttattgtccgtgcaataagcacagacgcatatgcaatgccgagtttgagatca

SEQ ID NO: 3050 - DNA, 1615 bp, Vigna unguiculata
cagaagaggcattggaaaaattatagagagagatcctttccttctctctcgctttcctttgacgcttctgacccttttccctttgtctgcgtctttctcatctattctctgacctaatggctatctccgactcttcttctggccgcaactctctcatcccctccttcctctactcctcttcctccaagacgcttccactccaccgtatgctccactccaccgccgccgcagccgccgccgcaccttcggcaccgccggcaaacctcgatgccggatcgcgtggcatcatgattccctctcctagcgagtcacgcaagatcgagctgtactctcccgccttctacgccgcctgtactgccggtggaatcctcagctgtggccttactcacatggccgtcactcctcttgaccttgtcaagtgtaatatgcagatcgacccttctaagtacaagaacatcacgtctggatttggggttttgcttaaggagcagggcttcaggggatttttccgtggttgggtgcctaccttgcttggttacagtgcccagggtgcttgcaaattcggattctacgagttctttaagaagtattattctgatattgctggcccagagtatgctagcaagtacaagaccttgatttaccttgctggttccgcttctgctgaggttattgctgatgttgctctttgcccctttgaggctgtgaaggtccgtgtccaaacacagcctggctttgctaggggtttggcagatgggctcccaaaatttgtgagatctgaaggaaccttggggctgtacaagggaatagtgcctttgtggggacgacagattccatacacaatgatgaagtttgcttcatttgagaccatagtggagcttatctataagcatgccattcctacaccaaagaatgagtgcagcaaaaacctgcaactcggtgtcagttttgctggtggatatattgctggtgtgctttgtgcaatcgtgtctcatcctgctgataatcttgtctctttcctgaacaatgctaaaggagcaacagttggtgatgcggtgagtaagcttggtttgtggggtctcttcacccgtggtcttcccctccgtattgtgatgattggaactcttactggtgcccaatggggaatatatgatgctttcaaagtctttgttgggctgccaacaactggtggtcctgctcctgctgctgctccagctgcagctcctgattctgggctagcaaaggcgtaaaatgtccagtgatgagacactcaatagtttgtttacgaaagttagaaggcagtgaataggaaccataaataatcagaggactgaagttgcttgggtggaactcaagcttcgttggataatattcttttcaagttcagacattgtttccatttttattgtatgagtatgtcacatttttgggaggatggttttgctcgcatccttcccgttttctgagaactttgtagttaggaatgatataattttgcatgttaggttcgccacatgccattgccaaccgggaatacacatttctttcttttattgtccgtgcaataagcacagacgcatatgcaatgccgagtttgagatcatttttaaaaaaa

SEQ ID NO: 3051 - DNA, 1512 bp, Olea europaea
aaaagaccttctggctgagaaatcggtacgcctgattttctccgccgccgatctctccgccgttgaattttcctccgccttctcactcaatcccccatggctttcttatccgaaaacactcgccgtcaatctcttattccaagtttcctatactcttcctctttgacttctaataaactagcacttgacaaaatggctagcaactcaaaccctagcttctcgccgtcgccgtcatcgccatctgcttcggctccgaacaagagctttttgattccggcgccgagcgagccaggtaaaatcgagatgtactctcctcagttctatgctgcttgtactgctggtggaatactcagctgcggtctcactcatatggccgtcactcctcttgatctcgtcaaatgtaatatgcagattgatccagcaaagtacaagggcatctcatctggttttggagtgctacttaaggaacagggagtcaaaggtttcttcagaggatgggtgcctaccttgcttggttacagtgctcagggtgcctgcaagtttggattctatgaatacttcaagaagtactatagtgaccttgcaggaccagaaaacgcagtcaaatacaagactctgatctatcttgctggttctgcatctgctgaggtcattgcagatattgcgctctgcccctttgaagctgtgaaggttcgtgttcagacacagcctggttttgctagggggttgtctgatgggcttcctaagtttgtgaaatctgaaggtgctcttgggttgtacaagggcctggttcctctttggggacgtcaaattccatatacaatgatgaagttcgcatctttcgagactattgtggagatgatttacaagcatgcaatccctacacctaaaagtgaatgcagcaagcccttgcagcttggtgtgagcttcgctggtggatatgttgctggtgttttctgtgctatcgtatcacatcctgctgacaaccttgtctctttcctcaacaatgccaagggtgctaccgttggcgatgctgtaaagaatcttggtttatggggtctctttactcggggacttcctctccgtattgtcatgattggaactctcaccggggctcagtggggtatctatgatgctttcaaagtttttgttgggctgccaacaactggtggtgttactcctgctgctgcacctgttgccgccgaacttgcaaaggtgtagaatccagacttgcaaattttttcacacagtacgttttcttcggggtggtcaataataaacatattatgcctggtgctgctcgggtattttcttttcagatatctagtttaatgtttggtcaagtgccaaattctagacatatattgaactttcgattttgttttaagagtagataagagtttccatgtgagaaccatgaaagtagcttcccgacaaggaaaataattggcatatttaaagggctaatgttagctcttgcaagcaaattttccagagacctgctgtatgaga

SEQ ID NO: 3052 - DNA, 1565 bp, Nicotiana tabacum
gagtataaaaaggtggaaatttttattgtttgtgaattaggtccaaagagctattcggagagcgagaggagaaggttttcagtcctctgcaatactttgccctcgcccatttctcctcgcttccgatctctctctctgcgccgtcacacactcatttcgccatggaaaactcacgccgtcagtctcttcttccaagcttcctctacactccatcttcgttttcttctttcactcccaaaacctttgctgttcccgagaacaccgccagcgtgttgcccgctgcacagccgtcgtccaccaacaagagcttcgtgattcctgcacctagcgaacctggaaagattgagatgtactcgccgcagttctatgctgcctgtaccttcggtggtatcctcagctgtggtctcactcacatggctgtcactcctcttgatctcgtcaaatgtaacatgcagattgaccccgcgaaatacaagagcatatcatctggatttggagtgctgcttaaggagcaaggtgctaagggcttcttcaggggatgggttcctactcttttgggttacagtgctcagggtgcatgcaagttcggattctatgaattcttcaagaagtactactctgaccttgctggagcagaaaatgctgcaaagtacaaaactctgatataccttgctggttctgcatctgcagaagtgattgcagacattgctctttgcccatttgaagctgtaaaagtccgtgttcagacacagcctggttttgctaggggattgtcagatggattaccgaaatttgtaagatctgaaggaaccatgggcctgtacaaaggtttggttcctctttggggacgtcagattccatatacaatgatgaagtttgcgtcctttgagactattgtggagttgatctacaagcatgcagtcccaaagcctaaaaatgagtgcagcaaatctatgcaacttggtattagctttgctggtggatatatagccggtgtcttctgtgctattgtatcccatcctgctgacaatcttgtctcattcctcaacaatgccaagggtgcaactgttggtgatgccgtgaagaagataggagtagtgggtctctttacccgtgggcttcctctacgtattgtcatgattggaactcttactggtgctcaatggggaatctatgatgctttcaaggtttttgttgggctgcctacaactggaggagttgctccttctgcacctgctgcctctgaggttgcaaaggtgtaaggttgagtataaactaattcttcgccaagcctagtagtaagagaagacttctccagatgaaacaataaacacagattgccaatgtttctctagtgctctttcgtagtaagctggagagtattcttacacaacaatcttgacaattttatatttctctaattttgagattttggagagggggagtccccctaaaacttaagcgttgcggatgtttttttgttagaatagatacaaaatcaatttgatgctagaaacgctgttccctctcgaggatgggaataacaagcatatttggggctatat

SEQ ID NO: 3053 - DNA, 2654 bp, Eucalyptus grandis
catggccagccactagcctaggttgaaaaggaagagaaaaaaattaaaatttaaaaaaaaatgaaaaatgagtgtatgcaagaaaagataatattttctagttcattttcaaatttctgccaaacattaaaaaaattggttattttcctgaaaaatggtttcttggagaaccatttctagaaatagtatatttttcgggaaacgaaaggaacctgaaatttttttgcaaattctttagtccggttccatataaggaatcggagatctggcctcaaactagtccgtttggtccggtccggctcgcttgctggattgaaccgggacggacgcagccgcccctagtctgtaaatactctttccaatttttcctttttcatttttattcttcccagcttccgttgaccgacgggagggggcaggcctctggggaaagtggcaacatcgcaaataacgcgagaacggagggccgatgcccaaggggggggcccctcctcgtggtagacatcacgcgagggtttcgcccaataaaatcgccagcacagaaaaggcctccctcctcgcgagagattgttggaaacgaagaaccttcatttccctcaatctctctctctctagcttctctctctagctccttctctctctagcgcagagcattccgcagatctcatccatggcgttcgccgacggctccagctcgcggcagtcgctgatccccagcttcctctacgcctcctccgcctcctccaggtccctctacctcgagaagatgctcgcctcctccggcccccgctcggccgcccccaccgcggcggcggcggcgtccccggcggccgcggatcggagcggcttcctgatcccggcgccccaggagccgtcgaagaagatcgcgatgtactccccggagttctacgccgcctgcaccttcggcggcatcctcagctgcggcctcactcacatgaccgtcaccccgctcgacctcgtcaagtgtaatatgcagatcgaccctgcaaagtacaagagcatttcatctggttttggaattctgctaaaagagcagggcgtcaggggatttttcaggggctgggtgcccactctgcttggttacagtgcccaaggtgcctgcaagtttggcttctacgagttcttcaagaaatattactctgacattgctggacctgagttttccgccaagtacaagacattgatctacctagccggctctgcatctgctgaggtcatagccgatgttgccctttgccccttcgaagcagtgaaggtcagagtgcaaactcagcctggatttgcaagaggtctgtcagatggattgcccaagtttgtaaaatctgagggcgctcttgggttatacaagggcattgttcctctctggggtcgtcaaataccatataccatgatgaagtttgcatcttttgagaccattgttgagatgatctacaaatatgccatgccccaaccaaaagatcagtgcagtaaaggtttgcagcttggtgtcagtttcgctggtggttatgtggcaggtgttttctgtgccatcgtgtctcatcctgccgacaatcttgtctctttcctcaacaacgctaagggagcaaccgtcggtgatgctgtgaagaaactaggtctgtggggtctcttcacccgtggtcttcctctccgtatagtcatgatcggtactcttactggagcccaatggggtatctacgacgcattcaaagtctttgtgggactgccaacaacgggtggtgtcactccggctcctgcccccactactgagcttgccaaggtttagaacgtcttagtgaccaagggaccggcatttgtctcagacatcaagactcatctgcattgggaagtaataatagtagatttgctggagctggttcaatggctctcgaagtgatttgactattctttcgtattcggaactcaagtgttcaatttttactcaactgatttttgttttggggaggatggctaggtcctgtccttggatctctattaaatctttttgtagctaggtcgcatgttttaaagttcggttgaaactaagattttgaatcccccccattaagggtgacagaggcatggaaactaaataaacagacagtttgggggccatagcatgaggtatacttttggagactcgagatctttccatcttatattaaccatcctctgtcattttttttcttgctatctctttgccttattcatctaaaaccgtgctgttatttctgtttcaatgccactaactatccttcactccctaagctctgctgagctaaaaaaattatggaagtctcgatcgttgttgcatatgacctattgcttgaatgaatccgccctgtccaggtgcagcgtggcgaggactataattccccgatgccttttactttttggctatattgcttacatgctctttgagggtacctccggttttcatccccggagcattgcgaaattggttatagtgcggtgagccttattcagtgacgaattttttgtccacaaaccatgggttccggttcatagcttggagtatttttcagtgtttcatgatgcgttgccagcgatgatatcgtgaattggtctagcggaatatgcaataagctttcctcatatgaggaccagcaaaattt

SEQ ID NO: 3054 - DNA, 1431 bp, Triticum aestivum
cgtagcagcccaaccgcagccatggccgtctccgatagatcgcgcaacgcgctgctccccagcttcctatacgcggccccctccgccgccgccagccacacccctttctctgcggccgctggcattggtggccgcgggctcgtcgcaccgtcccatgcggcggcgaccaggccggcggcgtgggcgcgggcgcctagcgagccgtcgcggaagatcgagatgtactcggccgccttctacgcggcgtgcacggacggtggcatcaccagctgcgggctcacgcacatgaccgtcacgcccctcgacctcgtcaagtgcaacatgcagattgatccagccaagtacaagagcatctcttctggatttggtgttctcttgaaagagcaaggggcaaagggtttcttcagaggctgggtgcctactttgattggttacagtggtcaaggcgcctgcaaatttggtttctacgagttcttcaagaagtattactcagatattgctggacctgagaatgcagtcaagtacaagactttgatctatcttgctggctctgcttcggctgaggttattgcagatgttgccctctgccctatggaggctgtgaaggttcgtgtgcagacacagcctggttttgcaaaaggtttatctgatgggctacctaagtttgtgaaggctgaaggatatgctggattgtacaagggaattgttcctctctggggccgtcaaattccatacactatgatgaaattttcctccttcgagacgattgttgagatgatctacaagtacacaattcctgcccccaagagcgagtgcagcaagtctctccagctcggagtgagctttgcagggggttacgttgctggagtgttgtgcgcaatagtttcgcacccagctgacaaccttgtttcattcctcaacaatgccaagggagcaactgtgggcgacgctgtgaagaaacttggtctgtggggtctgtttactcgtggtctccctctgcgtatcgtgatgattggtaccctcactggagctcagtggggcatctatgatgctttcaaagtcatggttggactgccaactactggtggagttgctccgactcctgctgccgctggagagcagctcaagggctgaagctttgattctatactgcatataatatctgacaagactttttggcgccgaattggatgagatgacgaaatagctcatctttcatccttttaagagcaaaatttgatatttttttttcaggactgcctagccgcggccctggtaattagaagtccaagacagtttaggaacaattttcggcacatgatcgtctggtttaggacgattgcctggaaccatagcatacgttgcccatttttttgaattgttattatatgtctcagctaatcctggcaataaaagctgtaattaagcgct

SEQ ID NO: 3055 - DNA, 1767 bp, Phaseolus coccineus
gttagtgggggcattttccctgcgacaaagttgacacacacaatataaagtagtcgcaaagtgaagccaaaaactcggaaccaaacgcagcaaaggcattgggaaaatagagagagagagagagaggcttttccttctgtctcgctttcgtttgacgcttctgacccttttcccttccaaaacgccctttgtctgcgtcttcccttctcttctctgacctaatggatttctccgactcttcttctggccgcaactctctcatcccctccttcctctactcctcttcctccaagacgcttcctcttcaccgcatgctccactccaccgctgtctccgccgcggcaccctcgccaccgccggctaacctcgatgcgggatcgcgcggccttatgattccctctcccagcgagtcacgcaagatcgagctctactcgcccgccttctatgctgcctgtactgctggtggaatcctcagctgtggcctcactcacatgaccgtcactcctcttgaccttgtcaagtgtaatatgcagatcgaccctgctaagtataagaacatctcgtctgggtttggtgttttgctcaaggagcagggcttcaagggctttttccgtggttgggtgcctaccttgcttggttacagtgcccagggtgcttgcaaattcggattctacgagttctttaagaagtattactctgatattgctggcccagagtatgcgagcaagtacaagaccttgatctaccttgctggttccgcttctgcggaggttattgctgatgttgctctttgccctttcgaggctgtgaaggtccgtgtccaaacacagcctggttttgctaggggtttggctgatgggctcccaaaatttgtgaaatctgaaggaaccttggggctgtacaagggaatagtgcctctgtggggacgacagattccatacacaatgatgaagtttgcttcatttgagaccatagttgagctgatctataagcatgccattcctactccaaagaatgagtgcagcaaaaacctgcaactcggtgtcagttttgctggtggatatattgctggtgtgctttgtgcaatcgtgtctcatcctgctgataatcttgtctcttttctgaacaatgctaaaggagcaacagttggtgatgcggtgaagaagtttggtgtctggggtctcttcacccgcggtcttcccctccgtattgtgatgattggaactcttactggtgcccaatggggaatatatgatgctttcaaagtctttgttgggctgccaacaactggtggtcctgctcctgccgctgctccagctcctggttctgagctagtaaaggcgtagaatgtccattgacgagactcaatagtttgtttacgaaagttagaagccagtgaatagaccataaataatcagaggagtgaagttgcttgggtggaactcaagcttggttggataatattcttttcaagttcagacattatttccattttattgtacgagtatttcaaatttttgggaggatggttttgctcgcatccttcctgttttacgagaactttgtagctaggaatgatataattttgcatgttgggttcgccacatgccattacggccgggaatacacaattgttttcttgtcagtgcaataagcacagactctatgcaatgcctagattgagttatttttttgcctggaaatattgtcaaattacgttttatattaattccattccacaccattaactcttgcaatcaccattaa

SEQ ID NO: 3056 - DNA, 1881 bp, Phaseolus coccineus
tcctatttattggccggggggaaccaaacgcagcaaaggcattgggaaaatagagagagagagagagaggcttttccttctgtctcgctttcgtttgacgcttctgacccttttcccttccaaaacgccctttgtctgcgtcttcccttctcttctctgacctaatggatttctccgactcttcttctggccgcaactctctcatcccctccttcctctactcctcttcctccaagacgcttcctcttcaccgcatgctccactccaccgctgtctccgccgcggcaccctcgccaccgccggctaacctcgatgcgggatcgcgcggccttatgattccctctcccagcgagtcacgcaagatcgagctctactcgcccgccttctatgctgcctgtactgccggtggaatcctcagctgtggccttactcacatgaccgtcactcctcttgaccttgtcaagtgtaatatgcagatcgaccctgctaagtataagaacatctcgtctgggtttggtgttttgctcaaggagcagggcttcaagggctttttccgtggttgggtgcctaccttgcttggttacagtgcccagggtgcttgcaaattcggattctacgagttctttaagaagtattactctgatattgctggcccagagtatgcgagcaagtacaagaccttgatctaccttgctggttccgcttctgcggaggttattgctgatgttgctctttgccctttcgaggctgtgaaggtccgtgtccaaacacagcctggttttgctaggggtttggctgatgggctcccaaaatttgtgaaatctgaaggaaccttggggctgtacaagggaatagtgcctctgtggggacgacagattccatacacaatgatgaagtttgcttcatttgagaccatagttgagctgatttataagcatgccattcctactccaaagaatgagtgcagcaaaaacctgcaactcggtgtcagttttgctggtggatatattgctggtgtgctttgtgcaatcgtgtctcatcctgctgataatcttgtctcttttctgaacaatgctaaaggagcaacagttggtgatgcggtgaagaagtttggtgtctggggtctcttcacccgcggtcttcccctccgtattgtgatgattggaactcttactggtgcccaatggggaatatatgatgctttcaaagtctttgttgggctgccaacaactggtggtcctgctcctgctgctgctccagctcctggttctgagctagtaaaggcgtagaatgtccattatgagactcaatagtttgtttacgaaagttagaagccagtgaatagaccataaataatcagaggagtgaagttgcttgggtggaactcaagcttggttggataatattcttttcaagttcagacattatttccattttattgtatgagtatttcaaatttttgggaggatggttttgctcgcatccttcctgttttacgagaactttgtagctaggaatgatataattttgcatgttgggttcgccacatgccattgccaaccgggaatacacaattgttttcttgtcagtgcaataagcacagactctatgcaatgcctagattgagttatttttttgcctggaaaaaaacctcgtgccgaattcggcacgagggaaaggcaaggcgaaatacctcttttgcatattatttatttgggtgttccactctacttcatttccagtatggaaagctttcattttcgggaaatcctgtcgggataatttccctaatgccataatatcagtggaggaagccaacatctcagaggcaatatcaacagaatttgcacaccccaactttgatccttcatctgctataag

SEQ ID NO: 3057 - DNA, 1587 bp, Castanea mollissima
ctctctctctctctccatcaaaaccttactctctctcacacacgttctctctctctctctctctctttctccgatggctctctcagacaaatcttcgcgtcagtctctgatcccaagcttcctctactcctcttcctccaccgtctacacctcgcacaaatccttggctcttgacaagaccatgctcggtgctgctgctgctccagcaaggtccaacagcggcgtctcgtctccggccaggaacttcgtcgttccggcgccgagcgagcccggcaagatcgagatgtactcgccggccttctacgccgcctgtaccgccggcggtattctcagctgtggtctcactcacatggccgtcactcctctcgatctcgtcaagtgcaatatgcagattgaccctgcaaagtacaaaagcatttcatctggttttggagtgttgtataaggagcagggtttcagaggcttcttcaggggttgggtgccaaccttgcttggttacagtgctcagggtgcctgcaagtttggattctatgagttctttaagaagtactactctgaccttgctggacctgagaatgcagccaagtacaagaccttgatctatcttgctggttctgcatccgccgaggtcattgctgatattgctctttgcccattcgaggcagtgaaggtccgggttcaaacacagcctggttttgctagaggtttgtcagatgggcttcccaaatttgttaaatctgaaggctatggagggttgtacaagggactggttcctctctggggacgtcagattccatatacaatgatgaagtttgcatcttttgagacaattgtggagaatatctataagcatgccatccccacaccgaagaacgagtgtagcaaaactctgcagcttggtgtgagttttgctggtggatatgtggctggtgtattctgtgccattgtgtctcatcctgctgacaatcttgtctccttcctcaacaatgccaagggggcaactgttggtgatgctgtgaagaagctaggtgtcttgggtctctttacccgtgggcttcctctccgtattgtcatgattggaactcttactggagctcagtggggaatctatgatgcgttcaaagttttcgtgggattgccaacaactggtggtgttgctcctgctgctgcctctgctgctactgagcttgcaaaggcatagaatttcagatgatcatcacaagtttttgtcgttttgttgaacgtaggaaagacaattatagggtttcaataaacaataggattgttgaagttacttggtggatggctctgaagccggtggggagtattcttttgcatttggaactgtccaattttcctaattttccttgtggaaggatggttttgctcttatccttctgattacttttaaaactttgtagttagatctataatgaatttgcaatatgatgttaggatcatggttcccccataagcttgggtcaaagaataattggcagatggggtgatatactgagttctcttattttaaatctctttgaatgcaattgatatgagcggaaacatgttcctaacatcatattgcaa

SEQ ID NO: 3058 - DNA, 1487 bp, Nicotiana tabacum
  misc_feature (1392)..(1392): n is a, c, g, or t
ttaggtccaaagagctattgggagagcgagaggagaaggttttcagtcctctgcaaccctcgcccatttctcctcgcttccgatctctctctgcgccgtcacaaactcatttcgccatggagaactcacgccgtcagtctcttcttccaagcttcctctacactccatcttcgttttcttctttcactcccaaaacctttgctgttaccgagaacaccaccagtgtgttgcctgctgcacagccgtcgtccaccaacaagagctttgtgattcctgcacctagcgaacctggaaagatcgagatgtactcaccgcaattctacgctgcctgtaccttcggtggtatcctcagctgtggtctcactcacatggctgtcactccgcttgatctcgtcaaatgtaacatgcagattgaccccgcgaaatacaagagcatttcatctggatttggagtgctgcttaaggaacaaggtgctaagggcttcttcaggggatgggttcctactcttctgggttacagtgctcagggtgcatgcaagtttggattctatgaattcttcaagaagtactactctgaccttgctggagcagaaaatgctgcaaagtacaagactctgatataccttgctggttctgcatctgcggaagtgattgcagacattgctctttgcccatttgaagctgtaaaagttcgtgttcagacacagcctggttttgctaggggattgtcagatggattaccaaaattcgtaagatctgaaggaaccatgggcctgtacaaaggtttggttcctctttggggacgtcagattccatatacaatgatgaagtttgcgtcctttgagactattgtggagatgatctacaagcatgcagtcccaaagcctaaaaatgagtgcagcaaatctatgcaacttggtattagctttgctggtggatatattgccggtgtcttctgtgctattgtatcccatcctgctgacaatcttgtttcattcctcaacaatgccaagggtgcaactgttggtgatgccgtgaagaagataggagtagtgggtctctttacccgtgggctacctctgcgtattgtcatgattggaactcttactggtgcacaatggggaatctatgatgctttcaaggtttttgttgggctgccaacaactggaggagttgctcctgctgcacctgctgcctctgaggttgcaaaggtgtagggtcgagtacaaactaattcttcgccaagcctagaagtagtaagagaagacttctccagatgaaacaataaacacagattgccgatgtttctctagtgatctttcctagtaagctggagagtatattcttacacaacaatcttgacaattttatatttctctaattttgagattntggagagggggagtccccctaaaacttaagcattgcggatgtttttttgttagaatagatacaaaatcaatttgatgctagaaacgctgttccct

SEQ ID NO: 3059 - DNA, 1457 bp, Tripterygium wilfordii
cagatctaccacaaaccttccatcttcctcgttctctgtcctctcgaagagggactacagaacaaagccacaactgaaccgtgactccccgggatctcttattctctctgatggcttttcccgataacgctcgccaatcgctcatcccgagcttcctctattcgtccacgtcgggatcgaagagaatctccggtttggaatcctttgcgaactcgactcatggatcacatcaatcgccgtcgagggccggtagcgttggtgccgccagtaacttcgttattcccgcaccaaatgagaaaatcgagatgtactctcctagtttttatgccgcgtgtactgccggagggatcttgagctgtggcctcactcacatggccgtcactcctctcgatctcgtcaagtgtaatatgcagattgacccagcaaagtacaagagcatcacttcaggatttggagttctgctcaaggagcagggagttaaaggtttctttaggggttgggtgcccacattgcttggttacagtgctcagggtgcctgcaaatttggattttatgagttcttcaagaagtactactctgacattgctgggcctgagaatgctgccaagtacaagacactgatttatcttgctggttcggcatctgctgaactgattgccgatgttgccctttgcccaatggaggcagtaaaggttcgtgtccaaactcagcctggttttgcccgcggtttgagcgatggcttgccaaagtttatcaagtctgaaggtgctctagggttgtataaggggattgttcctctttggggccgtcaaattccatacacaatgatgaagtttgcatcttttgagactattgtggagatgatttacaagcatgctatccctaccccaaaagatcagtgcactaagagtctgcagcttggtgtgagttttgccggtggatatgttgctggagttctgtgtgctattgtctcacaccctgctgataatcttgtgtccttcctcaacaatgccaagggggcaactgttggcgatgctgtgaagaagcttggattgtggggtctttttacgcgtggcctccctctgcgtattgttatgattggaacccttactggagcccaatggggtatctatgatgccttcaaagtgtttgttgggctgccaaccaccggtggtgtcactccggctcctgctgttgcaaaggcataagcttggagatgggcggatatgagcagaatattgtctctctgcatactctcaacttttgatagattaataacagcaggctagttgatgcttgctctaggggcatgcattgtactgttttgagctcttttttttaaatatttccgtcgttcttctcgttgttctacatgattttttggaggatggttttgatttcatcctatttcagacatttgcagagctacctttgtttaatgatttgattgacagaaa

SEQ ID NO: 3060 - DNA, 1536 bp, Flaveria ramosissima
gaaagcatggaggcatgttattgtccggatatctagggctgtagaaactgaccgcatcggtagacaaaaagcattgagatttgagatactcgaaacagagaagatttgggagagatttacgtcgtcgattccgtcgtatctccaccatcttctccgatcacatctccgacactcactcatggcgttttccgatgactctcgtcaatctctcatccctaacttcctttacacttcttccgtttcttccagcagtctactcatggccaacacatcaaacccctacactgttgccttcaacctcatctgctaaacaccacaacagtttcgtgattcctgctcctaacgagcctcttggcaagatcgacatgtattcccctcggttctacgctgcttgtactgttggaggtattctcagctgtggtctcacgcacatggccgtcactccgcttgatcttgtcaaatgtaacatgcagattgaccctgtgaaatataagagcatctcgtctggttttggagtattgttgaaagagcagggtttaaggggcttcttcaggggatgggttccaaccctgcttggttacagtgctcagggtgcctgcaaatttggcttctatgaattcttcaagaaatattactccgacattgctggcccagagtatgcagccaagtacaagactttgatctaccttgctggttcagcatctgcggaggtaattgctgatgtggctctttgtcctatggaggccgtgaaagtacgtgtccaaacgcaacctggtttcgccaggggattgggagatgggcttccaaagtttgtcagatctgaaggagcacttgggttgtacaagggcttggtaccactatggggccgccagataccatatacaatgatgaaatttgcttcattcgagaccattgtggagatgctgtacaagtatgccatccctacaccaaagaatgagtgcagcaaatcactacaacttggagtcagttttgctggtggatatgtggctggtgtcttctgtgctgttgtttctcatcctgctgacaatcttgtttctttccttaacaatgccaaaggtgctagcgttggagatgcagtaaagaagtttggactttggggtctcttcacacgagggcttcccctacgtatcgtcatgattggaacgctcaccggagctcaatggggaatatatgatgctttcaaagtgtttgttggcctaccaacaacaggcggtgctgcacctgctccggttgctgaggttgcagaagcttaggtgcatgacaacggagcctttgatgctttcacaccctcaaatcgagtcaataaacatagaccccttgatagcacaagagtaattttggcgagtcaactcttttttaacttttagaaagggtgagggtttgtcttgattgtttgtggtgcattgctgattatttaaagaggatggtgcttcatcaattgagaagttttgttaaccatggaagttaatttgggacaaacgatatggtaatacttttggctcaaatccttggtga

SEQ ID NO: 3061 - DNA, 1525 bp, Euonymus alatus
cggccgggggccctccaaacactatcgatccagttgcctcgttctctctcctctcgagaggggactaaaggacaaaaggattacataaagccgcaactaaactgtaccccgggaatctcatatactctctgatggcttttcccgagaacgctcgccagtcgctcatcccgagcttcctgtactcgtccacgtcggggtcgaagagaatcgccggtttggaatcctttgcgaatgcgagtcatggatcacatcaatcgccgtttttttcatcgccgtcaagggccggtagtgttggtgcggacagtaacttcgttattccgtcaccaaatgagaaaatcgagatgtactctcctagtttctacgccgcgtgtaccgccggagggatcttgagctgtggcctcactcacatgaccgtcactcctctcgatctcgtcaagtgtaatatgcagattgacccagcaaagtacaagagcatcacatcaggatttggagttttgctcaaggagcagggagctagaggtttctttaggggttgggtgcccacattgcttggttacagtgctcagggtgcctgcaaatttggattctatgagttcttcaagaagtactactcggacattgttgggcccgagtatgctgccaagtacaagacattgatttatcttgcaggttcagcatctgctgaactgattgccgatgttgccctttgccccatggaggcagtcaaggttcgtgtccaaactcagcctggttttgcccgcggtttgagcgatggcttgcctaagtttgtcaagtctgaaggtgctctagggttgtataaggggattgttcctctttggggccgtcaaattccatacacaatgatgaagtttgcatcttttgagactattgtggagatgatttacaagcatgctatcccaaccccaaaagatcaatgctctaagagtctgcagcttggagtgagttttgctggtggatatgttgctggagtactgtgtgcaattgtctcacaccctgctgataatcttgtgtctttcctcaacaatgccaagggggcaactgttggtgatgctgtgaagaagcttgggttgtggggtctttttacccgtggccttcctcttcgtattgttatgattggaacccttactggagcccaatggggtatctatgatgccttcaaagtgtttgttgggctgccaaccactggtggtgtcactccggctcctgctgttactctggctcctgctgttgcgaaggcagaagcatagagatgggcagatatgagcagaatgttatttctatgcaaacaccagctcttttgatagattaataacagcaggctatcgatgcttgctactggggcatgcattgtacttttttgagcttctttttttctcccgtcattcttctcttattgttctacatgattttttggaggaaggttttgatttcaatccgcacctatttcagactattcagtgaggaagttatccttgatataattagttgcctctgtttaatgatt

SEQ ID NO: 3062 - DNA, 1424 bp, Euonymus alatus
ccgtcggttagaaaaacctccagattcacgctagggtttatactctcttcatttctctctcgcgagagagaaaggcgcgacggagaaattgatagacagattctctccctccatttctctctcgcgacctaacactagtcttactcacaatggctctctctgattcctctcgacaatctatgatcccaagctttctttactcttcttcctcatcaaagtctttctctcttgaaaaatggcttcacgcaaaccataactccaacatcgaggttccctcacctgccccatcagtgacgaccacgaagagccacttcacaatccccgcaccgagtgagcctggcaagatcgagatgtactctcccgctttctatgcggcttgtactgtcggcgggattcttagttgtgggctcactcacatggctgttactcctcttgatctcgtcaagtgtaatatgcagattgaccctgcaaagtacaagagcatttcatccggttttggagtattgctcaaggagcagggagtaagaggcttctttaggggttgggtgcctaccctccttggctacagtgctcaaggagcctgcaagtttgggttttatgagtttttcaagaagtactactctgatattgctggacctgcgtatgctgccaagtacaagaccttgatttaccttgctggatcggcatctgctgaggtgattgctgacattgctctttgcccctttgaggctgtaaaggttcgtgttcaaactcagcctggttttgctagaggtatttcggatgggcttcccaagtttgtcaaatctgaaggggctctagggttgtacaaaggccttgttccgctttgggggcgccagattccatatacaatgatgaagtttgcatcatttgagacaattgtagagctgatctacaagcacgccatccccatgccaaaggaccaatgtagtaaaccccttcaacttggtgtcagttttgctggtggttatgttgccggagttttctgtgcaattgtgtcgcatccagctgacaatcttgtctctttccttaacaacgccaaaggagcaaccgttggtgatgctgttaagaagctaggtttgtggggtctctttactcgtgggcttcctatccgcatagtcatgattggtactctcactggagctcagtggggcctctatgatgcattcaaagtttttgtgggactgccaactactggtggtgtggctcctgctgcagctcctctggcaaaggtgtaacacaaaacagaatcagtcttctccctttatgcctttatggcaccttttaaattttcataggactaagaaaggaatgaatattgaaagcttcttcaatgacctcaagctagtgaagcaatcggtggttaggtgctccatcttattttcccactgaggcagagcttttga

SEQ ID NO: 3063 - DNA, 1443 bp, Phalaenopsis aphrodite
gcgaaaggttcgcacgcgtgatggctttctccgatagctcccgccgcgaagctttcttgccctccttcctttactcgccggtgctgaaatcctccggtctcgaacggatcctcttacgaaactctagctctcaggtcgggcaaacggccccttcgaccggatcgcccccgccgacctctttcctcgtcgaagctccgagcgagcccgcaaggaaaattgagatgtactcccccgctttctacgccgcctgcaccgccggaggcatacttagctgcggtctcacccacatggccgtcacacctcttgatctcgttaagtgcaatatgcagattgatccggcgaaatataagagcatctcatcaggatttggagttctgcttagggagcaaggcgccaggggattcttcagggttgggtaccgaccttgctcggctacagcgctcagggagcttgcaagttcggcttttacgaattttttaagaaatattattcggacattgctgggccggagtatgcaaccaagtataagacgttaatttatcttgctgggtctgcatctgccgaattcattgccgatatagctctttgcccatttgaggctgttaaagtgcgtgtccagacgcaaccgggatttgcccgtggcatgagtgatgggttccccaagtttgtcaaatctgaaggagccttgggactctacaaagggcttgttccgctttggggtcgtcagattccatacacaatgatgaagtttgcttcatttgagaccatagtggagttgctgtacaagaatgttattcccactcctaaggatcaatgcagcaagccctttcagcttggtgtaagctttgcaggcggctacattgccggtgtcttatgtgccattgtatctcaccctgctgacaaccttgtctctttccttaacaatgcgaagggagctacagtcggtgatgcggtgaaaaagcttggcttgtggggccttttcacccgtggacttccacttaggattgttatgattggtaccttaactggtgcacagtggggaatctacgacgccttcaaagtttttgtcggcctgccaacaaccggaggagttacgcctgctcctgcttctgcttctgctcctgctgctcctacccaggaacttgctaagctgagcagcagctgagctggttttcattcttttgcggtatttcagtatcagacatttatggatgagatgagcccttgatgatattcgggtgtataatatgttgaacattacctcttcgatcttgcttttttactttagtatttgttttgaagggtgtttttgctctcatccttctgataaatcggagataacaattcctagtttcctgccaaaaaccagtaggaaggaaaaagtaataatttgttgctcttatattattttttatcaaggagacttttctctaaactagccgg

SEQ ID NO: 3064 - DNA, 1491 bp, Euonymus alatus
acttttttctcgcgctccagatccaccacaacccttccgttttcctcgatctctctcctctcgaggagggactaaagaacgggaattgcacggacaaagccgtaactgaactgtaattcttcagaatctcatattctctctgatggcttttccggagaacgctcgccaatcgctcatcccgagcttcctctattcgtccacgtcgggatcgaagagaatctccggtttggaatcctttgcgaacgtgactcatggatcgcatcaatcgccgtcaagggccggtagtgttggtgcggccagtaacttcgttattccgtcaccaaatgagaaaatcgagatgtattctcctactttctatgccgcgtgtactgccggagggatcttgagctgtggcctcactcacatgtccgttactcctctcgatctcgtcaagtgtaatatgcagattgacccagcaaagtacaagagcatcacttcaggatttggagttttgctcaaggagcagggagttaaaggtttctttaggggttgggtgcccacattgcttggttacagtgctcagggtgcctgcaaattcggattctatgagttcttcaagaagtattactccgacattgctgggcccgaatatgctgccaagtacaagacactgatttatcttgctggttcggcatctgctgaagtgattgccgatgttgccctttgcccaatggaggcagtaaaggttcgtgtccaaactcagcctggttttgcccgtggattgagcgatggctttccaaagtttgtaaagtctgaaggtgctctagggttgtataaggggcttgttcctctttggggccgtcaaattccatacacaatgatgaagtttgcatcttttgagactattgtggagatgatttacaagcatgccatccctaccccaaaagatcagtgcagtaagaatctgcagcttggtgtgagttttgccggtggatatgttgctggagttctgtgcgctattgtctcacaccctgctgataatcttgtgtctttcctcaacaatgccaagggagcaactgttggtgatgctgtgaagaagtttggattggtgggtctttttacccgtggcctccctcttcgtattgttatgattggaacccttaccggagcccaatggggtatctatgatgccttcaaagtgtttgttgggctgccaaccactggaggtgtcactccggctcctgctcctgctcctgctcttgcaaaggcataagcttagagacgggtggatatgagcagaaatagtttctcggcaaacttcaacttgtttgatagattaataacagcaggctaccttgctctaggggcatgcattgcactgttttgagctctatttttttttaatttccatcaattttctcggcattcgacgctattttttggaggatggttttgatttcatcctcccctatttcagactccgcagtgagtgagttatcatgatagtttcct

SEQ ID NO: 3065 - DNA, 1567 bp, Pennisetum glaucum
cgcggggctcgccgctgcccgcccgcctcgtcgaccctgagaccaaccccagggaggcacgtgaaccgagggaaccagcccacgcgccgtgccatggccctctccgagagctcgcggaacgcgctgctccccggcttcctttacgcggccccggctgccgcctccccgtttggcgccgccggtggcgtgggaggactcgcggtagccgcgccgcctgccgcttcggcaacggggcccgcggtgtgggcgcgggcgccgagtgagccggggcggaggatcgagatgtactcgccggctttctacgcggcgtgtacggccggaggcgtcgccagctgcgggctcacgcacatgactgtcacgccgctcgacctcgtcaagtgcaacatgcagattgatcctgctaagtacaagagcatctcttcaggttttggtgttttgttgaaagagcaaggtgccaagggtttcttcaggggctgggtacccaccttgcttggatacagtgctcagggagcatgcaagttcggtttctatgaattcttcaagaagtattactcagacattgctggtcctgagtatgccgccaagtacaagaccttgatttacctcgtgggatctgcttcggctgaagtcattgcagatattgccctctgtccaatggaggctgtgaaggtccgtgtgcaaacacagcctggctttgcaagaggtttgtctgatggtctcccaaaatttgtaaaatctgacggctattctgggctgtataaaggaattgttccgctctggggccgacaaattccctacaccatgatgaaatttgcctcttttgagactgttgttgagatgatatacaaatatgccatccctgcccccaagagtgagtgcagcaagaatctccagcttggagtgagctttgcagggggttacgttgctggggtgttctgtgccattgtttctcacccagctgacaaccttgtttccttcctcaacaatgctaagggggcaactgttggcgacgctgtgaagaagattggcctagtggggctatttacgcgcgggctgccattgcggatagtgatgattggcaccctaactggagctcagtggggtatctatgatgctttcaaagtcatggttggactaccaacctctggtggcgttgctccaactcgtgctgctgctgccaaggcctgattctacactaccgaacttataacagcaattttggcaccaaggataatgaccacccagctccttttttcctgtcgttctatggttattttgggaaggcatacctgcgtgcctgctaaaatttcagatgagccacaagctcaatacttcatgctaactcgaagaagagacatttaggaacatagtagaagatggtcctcgggtgcatggtgattggcatggaaacaaaccatggtgtcctttttctttttaacttgatatgattctggaggtacaaatttgtatatactcttctgactagagctgcccattacatttgatacttctgtgaatgtggctcttggtttatatgctgctcgtttcaggctaccctttgtaagcc

SEQ ID NO: 3066 - DNA, 1596 bp, Capsicum annuum
gcacgagggtcattgtggtttaggtccaaagagagacgagtaattgtttttcatttggccctcccatcacctctcgatctctgtctcgcgcgccgtcagtcatggagaacttcccccgtcagtctcttcttccaagctttctctactccccatcttcttcttcttcttttttcactaatagcaaaaccctttctgctgccgctcccgaaaccaccaatgttttgccctcttccaataagagcttcctcgttccagcacctaacgaacctggaaagatcgagatgtactcccctcagttctatgctgcctgtacctttggtggtatcctcagctgtggtctcactcacatggccgtcactcctctcgatctcgtcaaatgtaacatgcagatcgaccctgcaaaatacaagagcatatcatctggatttggggtgcttcttaaggagcaaggtgccaggggattcttcaggggatgggttcctacccttttaggttacagtgctcagggtgcatgcaagtttggattctatgaattcttcaagaagtactactctgaccttgcgggagcagaaaatgctgcaaagtacaagactctgatataccttgctggttctgcatctgctgaagtgattgcagatgttgctctttgcccatttgaagctgtaaaggttcgtgttcagacacagcctggttttgctaggggattgtcagatggattgccgaaatttgttagatccgagggccccttgggcctatacaaaggtttggttccactctgggggcgccagattccatatacaatgatgaagtttgcatcctttgagactattgtggagttgatctacaagcatgcagtcccaaagcctaaaaatgagtgcagcaaacccatgcaacttggtattagctttgctggtggttatattgctggtgttttctgtgctatcgtatcacatcctgctgacaatcttgtctcattcctcaacaatgccaagggtgcaactgttggtgatgctgtgcagaagatgggagtagtgggtctctttacccgtgggctacctctacgtattgttatgattggaacccttactggtgctcaatggggaatctacgatgctttcaaggtttttgttgggctgccaacaactggtggtgttgctcctgctgcacctgccgactctgaggttgcaaaggtgtaggattgagtatttcttcgccaaacgtagaagtagtaagagaagacttctccagattaaaacaataaacatagattgccttgtttctttagtgctctttcgtagtagctggagagtattctcacgctcaacaatctttacaattttattatttctcagattttgagattttggagaagggggagtcccccgaaaacttaagcattgcggatgtcttttttgctagaatagatgatgctaagcatttccctttctagatgggaataacaaagaatatttggggctatatttttgctcgttcgttttaacttccccagtgtaccaaaaatgttcttttttcaaacttgcccaagctacagctgctgaatgatgattcttctatcgctggttttgttctggttaa

SEQ ID NO: 3067 - DNA, 1540 bp, Capsicum annuum
gagacgagtaattgtttttcatttggccctcccatcacctctcgatctctgtctcgcgcgccgtcagtcatggagaacttcccccgtcagtctcttcttccaagctttctctactccccatcttcttcttcttcttttttcactaatagcaaaaccctttctgctgccgctcccgaaaccaccaatgttttgccctcttccaataagagcttcctcgttccagcacctaacgaacctggaaagatcgagatgtactcccctcagttctatgctgcctgtacctttggtggtatcctcagctgtggtctcactcacatggccgtcactcctctcgatctcgtcaaatgtaacatgcagatcgaccctgcaaaatacaagagcatatcatctggatttggggtgcttcttaaggagcaaggtgccaggggattcttcaggggatgggttcctacccttttaggttacagtgctcagggtgcatgcaagtttggattctatgaattcttcaagaagtactactctgaccttgcgggagcagaaaatgctgcaaagtacaagactctgatataccttgctggttctgcatctgctgaagtgattgcagatgttgctctttgcccatttgaagctgtaaaggttcgtgttcagacacagcctggttttgctaggggattgtcagatggattgccgaaatttgttagatccgagggccccttgggcctatacaaaggtttggttccactctgggggcgccagattccatatacaatgatgaagtttgcatcctttgagactattgtggagttgatctacaagcatgcagtcccaaagcctaaaaatgagtgcagcaaacccatgcaacttggtattagctttgctggtggttatattgctggtgttttctgtgctatcgtatcacatcctgctgacaatcttgtctcattcctcaacaatgccaagggtgcaactgttggtgatgctgtgcagaagatgggagtagtgggtctctttacccgtgggctacctctacgtattgttatgattggaacccttactggtgctcaatggggaatctacgatgctttcaaggtttttgttgggctgccaacaactggtggtgttgctcctgctgcacctgccgactctgaggttgcaaaggtgtaggattgagtatttcttcgccaaacgtagaagtagtaagagaagacttctccagattaaaacaataaacatagattgccttgtttctttagtgctctttcgtagtagctggagagtattctcacgctcaacaatctttacaattttattatttctcagattttgagattttggagaagggggagtcccccgaaaacttaagcattgcggatgtcttttttgctagaatagatgatgctaagcatttccctttctagatgggaataacaaagaatatttggggctatatttttgctcgttcgttttaacttccccagtgtaccaaaaatgttcttttttcaaacttgcccaagctacagctgctgaatgatgattcttc

SEQ ID NO: 3068 - DNA, 1552 bp, Helianthus annuus
gctgtccgaatcatcgcattggttatcccccaagccgccccaatatatataaagtaaacatttcaagactcccatcatttctcttcatttgcagaggaaatcggagccctaatcttccccccaaaaccctccgatctccctctgcaaaactccacatttcctcatggccttttcagacaaatctcgacattctctcatccccaatttcctatattcaccgtcttcatcaaccaacttactcatctccagagctaccaaccattcatcgttttctgctccttcaccagttacggacggaagcaacttcgtggttccggctccgagcgagccgttcggcaagatcgagatgtattctcccagattctacgctgcgtgtacagccggtggtattctcagctgtggtcttacgcatatggctgtcactcctcttgatcttgttaaatgtaacatgcagatcgaccctgtaaagtataagagtatctcgtctggtttcggggttttgctgaaggagcagggtgtcaggggcttcttcaggggctgggtacctacgctgcttggttatagtgctcagggtgcctgcaagtttgggttctacgagttcttcaagaaatattactctgacattgccggcccggagtatgctactaagtacaagactttgatctaccttgcgggttctgcatctgcggaggtaattgcagacgtggctctttgtcccatggaggcggtgaaggttcgtgtccaaacacaaccaggttttgctaggggtctcggtgatggacttcccaagttcgttagatctgaaggcgcactagggttatacaaaggattggtgccactatggggacgccaaataccatatacaatgatgaagttcgcttcgtttgagactattgtggagatgttttacaaatacgccatccctacacctaaaaacgagtgcagcaaatcgtttcagcttggtgttagttttgctggaggatatgtggctggtgttttgtgtgctattgtatctcatccagctgataatcttgtctcatttctaaataatgctaagggagcaagtgttggagatgctgtgaagaaacttggagtttggggtcttttcacccgagggcttccattacgtatcgtgatgattgggacactcacgggagctcaatggggaatttatgatgctttcaaagtgtttgttgggctgccaaccactggtggtgctgcaccacctgccgccattgaagttgcaaaatcttagaactcgtgaagttttgtttgcggtttacggtcgtggtgaaacattgtttttttttttgtgtgtgtttttggacatctaaaataggtaacgggctttattatatttttgggatttgaatagattgttcgtcacgttcatgtgaaacgtttctcataggattcggtatgaaatatgtatcatgaaaatagaattacgtcaattccgccttattagaaataatgggcatgtaggatgtgattgtacctgggcaaaactctttaaaaatttctaagtttgtgaatgcaagttgatatttac

SEQ ID NO: 3069 - DNA, 1528 bp, Gossypium hirsutum
taacacagagtttggcaagcgagagaaacaaaatccgaagggaatcccaatttcttcgctctccatttctcccgcttccatttctccttttttttaacctccggcaatggctaccaattctgattcttttaaacaatcccttctccctagcttcctttactcttcttcccccaactcattctctctggatcgactcctcaacgccaacagccctgctttctctgcttcgcgctccactatacccgatgctcctgcggcctcttcctcgccatcgatcaaggcgagaactttcatgatcccctcccccaatgagcccgggaagaagatcgagatgtattcgcctcagttctacgctgcttgtacctttggcggtatccttagctgtggtctcactcacatggccgttactcctcttgacctcgtcaagtgtaatatgcagattgaccctgcaaagtacaaaagtatttcatctggttttggagttctactaaaggagcaaggagtgagaggcttcttccgtggttgggttcctacccttcttggttacagcgcacagggtgcttgcaagtttggattctatgagttcttcaagaagtactattctgaccttgctggacctgaatattttgccaagtacaagactctcatctatcttgccggctctgcatctgctgaggtgattgctgatgttgcactttgcccctttgaggcagtcaaggtcagggttcaaacccagcctggttttgctaggggtctgtctgatggtcttcccaagtttgtcagatctgaaggtgctctcggattgtacaagggtattgttcctctttggggccgacagattccatataccatgatgaaatttgcttcttttgaaactattgttgagatgatctacaagtatggtattcccactcccaaggagcagtgcagcaaaagtctgcagcttggtgttagttttgctggtggttatgtcgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgctcctgctgctgtggagcttgccaaggcatagaatgttggaaaacctgttgtcatgggggacaagtaaacataggattgctggaatggtttgtcaagctggtggaaggatattcttttttgcgttgagaacatttttatcaagtcgctctgttttgaaaaaaactgttggttttaggagaggatggttttgatctcatcctccaaactacggagactaattatttttgtaatagttagatcataaatgaaatttcatttgaagatcaatcccccccttctgtagcagttaaaaataaggagcagatgcagatggggg

SEQ ID NO: 3070 - DNA, 1538 bp, Nicotiana benthamiana
  misc_feature (598)..(598): n is a, c, g, or t
  misc_feature (601)..(601): n is a, c, g, or t
  misc_feature (649)..(649): n is a, c, g, or t
  misc_feature (880)..(880): n is a, c, g, or t
  misc_feature (973)..(973): n is a, c, g, or t
  misc_feature (988)..(988): n is a, c, g, or t
  misc_feature (1042)..(1042): n is a, c, g, or t
  misc_feature (1075)..(1075): n is a, c, g, or t
  misc_feature (1172)..(1172): n is a, c, g, or t
gagctattgggagagcgagaggagaaggttttcagtcctctgcaatactttgccctcgcccatttctcctcgcttccgatctctctctgcgccgtcacagactcatttagccatggagaactcccgccgtcagtctcttcttccaaacttcctctacactccatcttcattttcttctttcactcccaaaacctttgctgttcccgagaacaccaccagtttgttgcctgctgcactgccgtcgcccaccaacaagagctttgtgattcctgcacctagcgaacctggaaagatcgagatgtactcgccgcaattctacgctgcctgtactttcggtggtatcctcagctgtggtctcactcacatggctgtcactccccttgatcttgtcaaatgtaacatgcagattgaccctgcgaaatacaagagcatatcatctggatttggagtgctgctaaaggagcaaggtgctaagggcttcttcaggggatgggttcctactcttttgggttacagtgctcagggtgcatgcaagtttggattctatgaattcttcaagaagtactactctgaccttgctggagcagaaaatgctgcnaantacaagactctgatataccttgctggttctgcatctgcggaagtgatngcagacattgctctttgcccatttgaagctgtaaaagttcgtgttcagacacagcctggttttgctaggggattgtcagatggattaccgaaatttgtaagatctgaaggaaccatgggcctgtacaaaggtttggttcctctttggggacgtcagattccatatacaatgatgaagtttgcgtcctttgagactatcgtggagatgatctacaagcatgcagtccccaancctaaaaatgagtgcagcaaatctatgcaacttggtattagctttgctggtggatatatagccggtgtcttctgtgctattgtatcccatccngctgacaatcttgtntcattcctcaacaatgccaagggtgcaactgttggtgatgccgtgaagaagatnggagtagtgggtctctttacccgtgggctaccnctacgtattgtcatgattggaactcttactggtgctcaatggggaatctatgatgctttcaaggtttttgttgggctgccaacaactggaggagttnctcctgctgcacctgctgccactgaggttgcaaaggtgtagggtcgagtacaaactaattcttcgccaagcctagaagtagtaaggaaatttctccagacaaaacaataaacacagattgccgatatttctctagtgctctttcgtagtaagctggagagaattcttacacaacaatcttgacaattttatatttctctaattttgagattttggagagggggggtccccctaaaacttaagcattgcggatgtttttttgttagaatagatacaaaatcaatttgatgctagagacgctgttccctctcgaggatgggaatatcaagcatatttggggctatatatttgccttttatttgggaat

SEQ ID NO: 3071 - DNA, 1563 bp, Euphorbia esula
  misc_feature (9)..(10): n is a, c, g, or t
ggagaatcnntaggcagagaaacgcttacgcctctctttctcttcatttgcaattttctttgctctgcatttgcaatggcgtcttccgattcctccaggcaatctctgatccctagctttctctattcttcatcggcctcctccaaatctctctcgctttccaaggtccttcactctaaccctgcgtcccaaaactcatccatgatgaaggcctcctcccacttcgcgatcccctctccctccgagcctggcaagatcgagatgtactctcctgctttttacgctgcttgtactgctggaggtatcctcagctgtggtcttactcacatggctgtcactcctcttgaccttgtcaagtgcaatatgcagattgaccctgctaagtataaaagcatctcgtctggttttggagttctgctaaaggagcagggagccagaggcttcttcaggggttgggtgcctacccttcttggttacagtgctcaaggcgcctgcaaatttggattttacgagtttttcaaaaagtactactctgaccttgcgggaccagagtatgctaccaagtataagaccttgatttaccttgctggttcggcatctgcagaagtgattgcagatattgctctttgccctatggaagcagtgaaggtccgagttcaaactcagcctggttttgccagaggcttgtcagatgggtttcccaaatttgtcaaagctgaaggggcacttgggttgtacaaaggtcttgttcctctctggggacgccagattccttatactatgatgaagtttgcatcatttgaggccattgttgagcagctctacaagaacgttatccccacgccaaagagtgaatgcagcaaacctctacagcttggtgttagttttgctggtggttatattgctggtgttttatgtgctattgtgtctcaccctgccgataatctcgtctccttcctcaacaatgctaaaggcgcaactgttggtgatgctgtgaagaagctaggtgtgttgggcctgtttacccgtggactccctcttcgaattgtcatgattgggacactaacaggtgcccaatggggtatctatgatgcattcaaagttttcgtgggactgccaacaactggtggtgttgctcctgttgcttccccggaagccggacttgccaaggcgtaatgttttgggggatatcattattccttttgttgaagggagaagaagtatagaagaaaaataaacctaggattagtgactcaaggcagtgaagattattctttttttgcattcggaactcgctacaaattcttttcaatttttgctaattaagcttaagctccacagagagacggttttggtttcttcctgccatgaaaaagtcgcttaatgtatgagattttactttgatgttatgttaggaatacaagattaattcccctgtcatagacaacctaaaataagggccagacttgggggatattatttgtttctgtccatcttctgatgatcagcgttttgattgtatgttgagaaatgcattagtaaaagttttgttacttattttgg

SEQ ID NO: 3072 - DNA, 1416 bp, Malus domestica
atcactctctctaccatggctctctcagataagcagtcgcgtcaggctctgatcccgagcttcctctacagatcctcatcctccatcgcgctggagaagatgctctacgccaggcctaacggcggcttcacgccgaatgccaccgtcgaaggagtctccgccaggaagggcctcgtcattccgtcgcccagcgagcccttggggaagatcgagatgtactcgccttccttctacgctgcctgtacttttggaggaattcttagctgtggtctcactcacatggccgtcactccccttgacctcgtcaagtgcaatatgcagattgatcctgcaaagtacaaaagcatcacatctggttttggaattctgctcaaggagcagggagttaagggctttttcaggggatgggtgcctaccctccttggttacagtgctcagggtgcctgcaagtttggattctatgagtttttcaagaagtactactctgaccttgctggaccagagtttgctgccaagtacaagaccttgatctaccttgctggttctgcatctgctgaggtcattgccgatgttgctctttgcccctttgaggcagtcaaggtccgtgtgcaaactcagcctggatttgctagaggtttgtcagatggacttcctaagtttgtcagatctgaaggtgctcttgggttgtacaagggtcttgttccactatggggacgtcaaattccatacaccatgatgaagtttgcctcatttgaaacaattgtggagatgatctataaatatgccatccctaggcctaagagcgagtgctccaaatctttgcagcttggtgtgagttttgctggtggatacgtggccggtgtattctgtgctattgtatctcatcctgctgacaatcttgtctctttcctcaacaatgccaaaggagcaacagttggtgatgctgtgaagaagattggagtggttggtctctttacccgtgggcttcctcttcggattgtcatgattggaactcttactggagctcagtggggtatctatgatgcattcaaagtttttgtcgggctgccaacaactggtggtgctccccctccagttgctgctgcttctgagctttctaaggtgtaaactgctgggtgattaaccgcatcaacttcgttgtttttggaactgaaaatttgtcatacgaaataagcgtaggattgctgaagttgtttaaatggcttcaaagaggagtattgtttcttttacatttggaaaccggatccattttcccccatatttgactagtctggttttgtggggatggttttgctctcatcctattttaaaagacgtatttgtagttagatgagatatgaatttgaaatttgattgttaaagagtaggcaataaaaaatcatgttagatggggta

SEQ ID NO: 3073 - DNA, 1769 bp, Humulus lupulus
aacaacgagaaaaaggacggattctcacataatagtgttccagagctctctgagagtaagcatttggcagcgagagattgggagagaaacaaacctcacaaccctctctctctctctatcactttgctttcttctcccaaaaatcaaccctctccaaacctccgatctctctcccatggcgttctccgataaatcctcgcgtcaatctctaattcctagcttcctttactcttctacctccaccaaggccatggccgtcgagaaaatgctccaatctcgacctaccaccgccgtctcaccacccgacgtcgaagccgtagctccaaggaaagccttcgttgttccttctccggccgagtctggtttgaagatcgagatgtactcccccgctttctacgccgcctgtaccgccgggggaatccttagctgtggactcactcacatgtccgtcactcctcttgaccttgtcaagtgtaatatgcagattgaccctgccaagtacaaaagtatttcatccggttttggaattcttctcaaggagcagggtgtcaggggattcttcaggggatgggtgcctactctacttggttacagtgcacagggtgcttgcaagtttggattctatgaatttttcaagaagtactactctgacattgctgggccagagtatgctgccaagtacaagactttgatctaccttgctggttctgcatctgctgaggtgatagcagatattgctctctgccccttcgaggctgtgaaggtccgtgttcaaactcaacctggatttgctcgtggtttgtcagatgggcttcccaagtttgtgaaatctgaaggcgcactagggttgtacaagggtattgttccactctggggtcgtcaaattccatacactatgatgaagtttgcatcctttgagaccattgtcgagatgatctacaaatatggtattcctacaccaaaggatcaatgcagcaaagaacttcagctcggtgtgagtttcgctggtggatacgttgctggtgttttctgtgctattgtgtctcatcctgctgacaatctcgtctctttcttgaacaacgccaaaggagcaactgttggtgatgctgtgaagaagatgggtatgttgggtctctttacccgaggacttcctcttcgtattgtcatgatcggaactctaaccggagcccaatggggtatctatgatgcattcaaagttttcgtgggactgccaacaaccggtggcgtttctcctgctgcccctgctccaacagagcttgccaaggcttaataaaataagatgttcgaatggtcacaaaatcatatagtggtttttatttgtttcatggaactgagaaaaaacatcgtttcaaggaattaaaaataaacgtaggggggttttgggttgggttgctgaagctgctgcttgaaatggtggctcagaaggcttctctagggagaatcatcttttgaagtgggaggttctctccaattttttccattttgactctattttttgtctttttctttcagaaggtagttttgttcttacccttctgagaaaaactctctagttgtagatgatcaaaaatatgaatttggagttttatgtcaggattattattttggacccccttagatagtaggcaagcaaaaaataagaggagattttgggggtgatttattttctatttaaagaagtttggttgggcatgggatctatgccttaattctctatgttcctcgcaattcttttttacagttattaa

SEQ ID NO: 3074 - DNA, 1507 bp, Cicer arietinum
aaagaaagacacggcacaggtagcgaagaattgggagagactagctaaccatttctctctcatttctctgtagttgttcatctcaatggctcaacaatcagaatcttattctggccgtaaaaacatgatcccttcatttctctacggttcttccaccaaaaccctacctattcaccagatcctcagtaacggtcccgctccttcattgcctggaactggatccgccggcttcatgattccatctcctaaggaatctggtaagatcgagatgtattctccagctttctatgctgcttgtactgccggtggaattttcagttgtggtcttactcacatgaccgtcactcctcttgacctagtcaagtgtaatatgcagattgacccagccaagtacaagagcatctcatcagggtttggagttttgctcaaggagcagggagtcaagggctttttccgtggttgggtgcctaccttgcttggttacagtgcacagggtgcttgcaaatttgggttctatgagttctttaagaagtactattctgatattgctggcccagagtatgcaagcaagtacaagactttgatctaccttgctggttctgcatctgctgaggttattgccgatattgcactttgcccatttgaggctgtgaaagttcgtgttcaaactcagcctggttttgcaagaggtctcggtgatgggcttccaaaatttatcaaatctgaaggaactttggggctgtacaagggattggtgcctctatggggacgacaaattccatacacgatgatgaaatttgcctcttttgagaccattgttgagcagatctataagcatgccatccccagaccaaagaatgagtgcagcaaatctctgcaactcggtgtcagttttgctggtggatacattgctggtgttctttgtgcaattgtgtctcatcctgctgataatcttgtctctttcctgaacaatgccaaaggtgcaacagttggtgatgctgttaagaagtttggtgtggtggggcttttcacccgaggtctccctctacgtattgttatgattggaacacttaccggtgcccaatggggaatatatgatgctttcaaagtctttgtggggctgccaaccactggtggtgctgctcctgctcctgttgctgctcctgctgagaacgcaacggcataaagtaaccaatggtgacaatttatagtttgtttaagaaacttaggaaaccagctaataggggccataataaacagaggactgctgaggttgcttgagttctcaagcatggttcgatattctttcgaagttaaaacactgtttccatttttcctgcatttggttattttaatttttggtaggatggttttgctcgcatccttccagttgctgaaaactttgtagctaggaaagttataattttcctctgtcaaacggaaatacacatttgttttattgtttttgcataagcatggactgatatgcaatgcctaggttgagatc

SEQ ID NO: 3075 - DNA, 1970 bp, Sesamum indicum
cattcttgctttgcgttcctctgtccgtataaataacgcacatgtcctttccccaataacatcgctccatttctctttcttccattgcgaacacagcttcgaacatttctgggaggagccgccttctctcagcctcaccaccaccaccacaaccatccacctctcttctctctgatatataagagatggctctctcctccgaccggcaatctctcatccccaacttcctttactcaacctctttcacctccaaaaccctacctctccataatatggccggacattccaatcctcgcgttactccttcaccttcgccttccgctcccaagagcaacttcctcattccggctcccggcgagcctggcaagatcgagatgttctctcctcagtactacgccgcctgtacggttggtggaatactcagctgtggtcttactcacatggctgtcactcctctcgatctcgtcaaatgtaatatgcagattgatcctgcaaaatacaagagcatctcatcaggttttggagtgctactcaaggagcaaggtgttaaaggtttcttcaggggctgggtacctactctgcttggttacagcgcccagggtgcctgcaaatttggattttatgagttttttaagaagtattattctgatcttgctggacccgagaatgcatctaagtacaagaccctgatctatcttgctggttctgcatctgctgaggtgattgctgatattgctctttgcccctttgaagctgtgaaggtgcgtgttcagacccagcctggttttgctagaggcttggctgatggacttcctaaatttgtgagatctgaaggtgcacttggattgtacaagggcctggttcctctttggggacgtcaaattccatatacaatgatgaagtttgcatcctttgagactattgtggaactcatttacaagcatgcaattcccacacctaaaaatgagtgcagcaagaacctccagcttggagtcagttttgctggtggatatgtagctggtgttttctgtgctgttgtatctcacccggctgacaaccttgtctcgttcctcaacaacgcgaagggtgctactgttggtgatgctgttaagaagcttggactatggggtctctttactcggggacttcctcttcgtatcgtcatgattggaactctcacaggagcgcagtggggtatctatgacgctttcaaagtttttgttggcctgccaacaactggtggcgtcactcctgcaccgacggctgaagttgcaaaagcgtagagtcaattctaatggaatacaaacttttttagttggtaccttctacaaaggggggcaataaatgttgacgaagatgttttgctagcaccctagcagatggaggggattcctttcctttttagaactgtgtcaattgtcatgctcaattaatttggttgtggatgtctgagttacccacatattctgaaccattgcggattttttgttagaatagacagtgtgttaggatcggtgacaggtaccttaccccaccaaacaattaaaataacgggcagatatggaggataaaacttagcatcgcccagctaccttttcctgagatatatagctggtgtaagaagatcaattttttcttgacattaagaatacaagttttgcttgtttctgtcggcatccttaacatttccctttttccccacggttgatgtttttaactttcttgtgttctctttctttcatatttgattggccagtacgggaagcagctaatgccacttgaacccagtaccacttgttgttagagccctcttggtttctggctctgggtcatggaaaattgaatgacgagatgtttcttattttttgataattgaatgagaatagatgttacttgttacggcaagagccgtactgaatctcatatcccccagcctacggggaaattaggaaatggtttggatctctaat

SEQ ID NO: 3076 - DNA, 1481 bp, Flaveria ramosissima
cttgtagcatcggtaaataaaaagcatcccctttcattgatattcacaaaacggagaaaaaaccctcagagattcaagtcgccggagcaattcatcactgaaatcgtattctccgatcaacgatggcggtttccggcgactctcgtcaatctctgatccccaatttcatctacacttcgtctgtttctcctagcagcttactgatgaacaacacatcgagtttcacatcgttttcgtctgcatcgaacgctaaacagcagaataagttcgtgattcctgctcctagcgagcctgctggaaagatcgagatgtattcgcctcggttctatgctgcgtgcactgctggagggattctcagctgtggtctcacgcatatggctgttacgcctcttgatcttgtgaaatgtaacatgcagattgaccctgctaaatataagagcatctcgtctggtttcggagtgctgctgaaggaacagggtttaaggggattctttaggggatgggtccctactctgcttggttacagtgctcagggtgcctgcaaatttggcttctatgagttcttcaagaaatactactctgacattgctggcccagagtatgcagccaagtacaagaccttgatctaccttgctggttcagcgtctgctgaggtaattgctgacgtggctctttgtcctatggaggcagtgaaggtccgtgtccaaacacaacctggatttgccaggggtttgggagacggacttccgaagtttgtcagatctgaaggtgtacttgggttgtacaagggtttggtaccgctttggggacgccagataccatatacaatgatgaaattcgcttcattcgagacaattgtggagttgatgtacaaatatgctattcctacaccaaagaacgagtgcagcaaatccctgcagcttggagttagttttgctggtggatatgtggctggtgtactctgtgctgtcgtttctcatcctgctgacaaccttgtttccttccttaacaatgccaagggagcaagtgttggagatgctgtgaataagcttggactttggggtctcttcacccgagggcttccccttcggattgtcatgattggaactctcaccggagctcaatggggaatctacgatgcttttaaagtgtttgttggcctgccaacaacaggtggtgctgcacctgctccagttgccgagactgcaaaggcataagtttgtgtgtggctatggagcctgagatgtctttttttaccccttcaaagtgagtcaataaacataggattccttaatgtcaccacagtaattttggagagttaactcttttgttttggaacatgagactagaaaggccttttaacttgtatttgtttcttttgtattttttggtatttaaagtagcgtagtaagtttttgtctatcatgaagagacaaatgtcaatttcctacccttggaaattaagttgggacgatattata

SEQ ID NO: 3077 - DNA, 1622 bp, Lotus japonicus
gggtggaaaaaaaccggaaaagccagagatttttggcagcgaagtattgggagcgagcgagagaaagcgaagcacccactctttgttgtttctacttcttctctcgctttctcttcaaatcaattcaacgaaatcacttcctgtcattgacctaatggcttttcctgattcctcttctcgccgcaacaacaacctcatcccttccttcctctatggctcctcctcccccaaaaccctacctctcaaccagatcctctcctcctcctccaccgccgctgctgctccctcgaagctcatgatcccggctcctaatgagaagatcgagatgtactcccctgctttctacgccgcctgcaccgtcggcggtatcctcagttgtggactcactcacatgaccgtcactcctcttgaccttgtcaagtgtaacatgcagattgaccctaccaagtacaagagcatttcgtctgggtttggagttttgctcaaggagcagggagtcaagggctttttccgcggctgggttcctaccttgctcggttacagtgcacagggtgcttgcaagtttggattctatgagttcttcaagaagtactactctgatattgctggccctgagtatgctaccaagtacaagaccttgatctaccttgctggttcagcatctgctgaggttattgctgatgttgcactttgcccctttgaggctgtgaaggtccgcgtccaaactcagcctggtttcgcaagaggtctgtctgatgggctgccaaagtttgtcaaggctgaaggaaccttggggttgtacaagggattggtgcctttgtggggacgacagattccatacacaatgatgaagtttgcttcctttgagaccattgttgagatgatctataagcatgccgttcccgttccaaagagcgagtgcagcaaaaatctgcaactcggtatcagtttcgctggtggatatgttgctggtgtattttgtgcaattgtgtctcatcctgctgataatcttgtctcttttctcaacaatgctcaaggcgcaacagttggtgatgcggtgaagaagctcggcatgtggggtctctttacccgtggtcttcctctccgtattgtcatgatcggaacacttactggagcccaatggggaatctacgatgcattcaaagtctttgtggggctaccaactactggtggtgctgctcctgctgctcctgcaaaggcatagaatgtccatggtgacactttttagtttgttttaagaaacttagaaaagccagcgaatagggagcccataaataaactgaggattgctgaagttgcttgaataatcaagcttggctggataatattctttgcaagtttagacatactgtttccaattttcttgtattcgccgagtattttaatcttttggtaggatggttttgctcgcatccttcctgttgctgaaaactttgtagctaggaatgatataattttgcatgttagggtcacactacatgcctctctgtcaaacgggattacacatttgttttcttgtctatgcaacaagcatggacgcatctgcaatgcttatgttgagatcaattttttatcaagtttgcttgaatatttttatctcg

SEQ ID NO: 3078 - DNA, 1351 bp, Amorphophallus konjac
ctcccgccgatccctcatccccgacttcctctacgccctacctccgcggctgccgtggccggatcacccggcctcgagaagctcatcctcgccgggggcggcggcgcgcagaggctgctggcgccgaccccttcgccgtcgccatttcccgccgatggcggatcgccgaagccgttcctcatccccgcgcccaaggagaagatccagctgtactcggggcagtactacgcggcctgcacggccggcgggatcgccagctgcgggctcacccacatggccgtcacgccgctggatctcgtcaagtgcaatatgcagattgaccctgcaaaatacaagagcatctcgtctggattcggggtcctgctgaaggagcaaggtgtcagaggcttctttaggggttgggtgccgaccctcctgggatacagcgcccagggtgcttgcaagtttggattctacgagttcttcaagaaatattattccgacattgctggcccagagtttgcagcaaaatacaagactcttatctacctagctggctctgcttctgctgaagtcattgccgatgttgctctttgcccaatggaggctgtgaaggtgcgagtgcagacgcaacctggctttgccagagggttgtcagatggcttccccaagtttatcaaatcggaaggggtgttagggttgtacaagggaattgttccgctctggggacgtcagattccctatacgatgatgaagttttcgtcttttgagaacatcgtggagatgctatacaagtacgccattccttcacccaaggaccaatgcagcaagtcacttcagctcggcgttagtttcgctggtggctatatcgcaggagtcttctgcgctatcgtttcccacccagctgacaaccttgtttcattcctcaacaatgcaaagggcgccactgtcggtgatgctgtcaagaagctcgggctgtggggcctgttcactcgtggtcttcccctgcgtattgtgatgatcggcaccctcactggtgcgcagtgggggatttacgatgccttcaaagtgttcgtaggcctgccaaccaccggtggagttactcctgctcctgctgccgtaaaagctcctgccccggcagcttaagtttgggttcttctttgttgcgggtgtaatagttctttttcactttgaagcatataatatagtttttgcttttcactgtcatgttttggagcgtagttttgagctcatccctcgaacgggaaaatttttgacgaagcatagttgggatcggtccttcctttctttcttttttcccctcaaatatccggcatttggaaagagccgtgaaataagttgtatgaccagg

SEQ ID NO: 3079 - DNA, 1600 bp, Fagus grandifolia
aaagtctcacacaccctagtaagcatttccaacacagaggaagcatttttggcagcgagagtctgggagagattctctcgctttcatttctcgcttcctaactcaactctctctcgattacgaaaaccctctcaatctctctgtctctctccgatggctctctcagacaaatcttcgcgtcaatctctgattccaagctttctctactcatcatcttcctccacaatcttacacaaaaccttttctctcgagaaaccgatgctcggcgcaacctcaaacaacggcctctcgtcgccgtctagaaacgtcgtcgttccggcaccgaacgagcctggcaggaagatcgagatgtattctccggccttctacgccgcctgtactgccggaggtattctcagctgtggtctcactcacacggccgtcactcctctcgaccttgtcaagtgcaatatgcagattgacccttcaaagtacaaaagcatctcatctggtttcggagtgttgttgaaggagcagggtgtcagaggcttctttaggggttgggtgccaaccttgcttggttacagtgctcagggtgcctgcaagtttggattctatgaattctttaagaagtactactctgacattgctggacctgagtttgcaaccaagtacaagaccttgatctatcttgctggttctgcatctgctgaggtcattgcggatattgcactttgcccttttgaggctgtgaaggtccgggtgcaaacacagcctgggtttgctagaggtctttcagatgggtttcctaagtttgttaaatctgaaggcgctcttgggttgtacaagggaatagttcctctctggggacgtcagattccatatacaatgatgaagtttgcatcttttgagacaattgtggagaatatctataagcatgccatccccagaccgaaggacgagtgtagcaaaactctgcagctcggtgtgagttttgctggtggatatgtggctggtgtattctgtgccattgtgtctcatcctgctgacaatcttgtctctttcctcaacaatgccaagggggcaactgttggtgatgctgtgaagaagatgggtgtgttgggtctctttacccgtgggcttcctctccgtattgtcatgattggaactcttactggagctcagtggggaatctatgatgccttcaaagttttcgtgggattgccaacaactggtggtgttgctcctgctgctgccactgagcttgcaaaggtgtagaatacagtgatcagcacaagtttttgtcgttttgttgaacctaggaaagacatttatagggtttaaataagcatagaattgttgaagctgcttgggtggctgtcaagccaatggggagtattcttttgcatttggaactgtccaattttcctaatttggcttatgaaaggatggttttgttctcatccttcggattactttaaaactctttagttagatctataatgaatttgcaatgtgatgttaggatcctcggtcccccccacttgggtcaaagaataataggcagatggggtgatatactgagttatcttcttttacattctttttgaatgcaattgat

SEQ ID NO: 3080 - DNA, 1574 bp, Triticum aestivum
cccggctgctggcctcgtcggcgctggcggggtcgggggcggcaggcccttctcgatccgcgcgcccaacgagaagatagagatgtactctcccgccttctacgccgcctgcaccgccggggggatcgccagctgcgggctcacccacatggccgtcaccccgctcgacctcgtcaagtgcaacatgcagattgacccggcgaaatacaagagcatctcatctggatttggtgttctgttaaaggagcaaggagctaggggattcttcaggggatgggtgcctaccttgcttggttacagtgctcagggggcttgcaagtttgggttctacgagttctttaagaagacctactcagatatggctgggcctgagaatgctgtgaagtacaagaccctgatttaccttgcagggtcagcttctgctgaggtaattgctgatatcgctctgtgcccctttgaagctgtcaaggtccgtgtgcagacacagcctggatttgctcgtgggttgagtgatgggcttcccaagttcatcaaagctgagggtgctgctgggctctacaagggcattgttccgctctggggtcgccagattccttacaccatgatgaagtttgcttcctttgagaccattgttgagcttatctacaaacacgctgttcctgttcccaaggccgagtgcagcaagtcttcccagttgggtatcagctttgctggtggctacattgctggtgtcttctgtgctattgtttctcacccggctgacaacctggtctctttcctcaacaatgccaagggtgctacagtgggtgatgctgttaagaagattggcatgttgggccttttcaccagaggacttccccttcgcatcgtcatgatcggtactcttaccggtgctcagtggggaatctatgacgccttcaaggtcatggtgggactcccgaccaccggcggtgctccaccagttgctccggtagaggaagcagcgaaagccatcgcttgattgatttttcctactatgacgatgacgatgtattccgggatgatggggtattggtggatggggactgtatcaattacttgagtttagcacccgaaatcttttgttattgtagcagatggttattgtgtcatcattttgatgagaggaactcattaagcaggcgaaataggcctttttttgtccccgggaagtttgatgcttgacataataagttttaggacagcaaggctgttagagcgcaggttttgccatcacctgtactgaggaattcccatattatactcctgtttacctccaattctatgctgttgatatcgtggcatgttcgtttctgaacgggtagaacgtttattgttttactagtagtagtagttatcttctcttcgtgcttgcaaaatcattccttggtcttctgagataagtcatgcagtactattgttttgttcgggcaaacaggtagacagagtattaggctggttgtaatgggcagtatcatcatatactacttcctctgttcctaaatattggtctttctagacattttaaacggactaccatatatggatgcatgtag

SEQ ID NO: 3081 - DNA, 1748 bp, Gossypium hirsutum
tatggtgcgtataaagcacgcagggtttctttcccattcatcgcagtgccaaataataaaagccggacacatctgagtcctaacacagcgtttggcacgcgagagaaacaaaatccgaagggaatcccaatttcttcgctctccatttctcccgcttccatttctccttttttttaacctccggcaatggctaccaattctgattcttttaaacaatcccttctccctagcttcctttactcttcttcccccaactcattctctctggatcgactcctcaacgccaacagccctgctttctctgcttcgcgctccactatacccgatgctcctgcggcctcttcctcgccatcgatcaaggcgagaactttcatgatcccctcccccaatgagcccgggaagaagatcgagatgtattcgcctcagttctacgctgcttgtacctttggcggtatccttagctgtggtctcactcacatggccgttactcctcttgacctcgtcaagtgtaatatgcagattgaccctgcaaagtacaaaagtatttcatctggttttggagttctactaaaggagcaaggagtgagaggcttcttccgtggttgggttcctacccttcttggttacagcgcacagggtgcttgcaagtttggattctatgagttcttcaagaagtactattctgaccttgctggacctgaatattttgccaagtacaagactctcatctatcttgccggctctgcatctgctgaggtaattgctgatgttgcactttgtccctttgaggcagtcaaggtcagggttcaaacccagcctgggtttgctaggggtctgtctgatggtcttcccaagtttgtcagatcagaaggtgctgttggattgtacaagggtattgttcctctttggggccgacagattccatataccatgatgaaatttgcttcttttgaaactattgttgagatgatctacaagtatggtattcccactcccaaggagcagtgcagcaaaagtctgcagcttggtgttagttttgctggtggttatgtcgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgctcctgcggctgtggagcttgccaaggcatagaatgttggaaatcctgttgtcatgggggacaagtaaacataggattgctggaatggtttgtcaagctggtggaaggatattcttttttgcgttgagaacatttttatcaagtcgctctgttttgaaaaaaactgttggttctaggagaggatggttttgatctcatcctccaaactacggagactaattatttttgtaatagttagatcataaatgaaatttcatttgaagatcaatccccccttctgtagcagttaaaaataaggagcagatgcagatggggacgatactgcttactttaccttgttaagcaagctttttaatgtaatattgagaacttttgttcggctttctttaaggcatctcactctctctctgtgccaaaaaaatatttattacatttttagataaatttcatggaagtt

SEQ ID NO: 3082 - DNA, 2484 bp, Theobroma cacao
taaaagagataaatatttaaaaataaaaagagtaattaataatattactgtgttatagttatccaatttcattcttctaagttttcacagacaaaaaaaatgaaaagcataatatgtttctctcaatttgttggaggtgccgtcagggtggcccaatgaagggcaaggttgatgcctgccccagctaaagccagccatacccagccaccggggaagaaaaaactataggaggttgacgaagtgtcgttttcgtaattaacagcaaccctcatggtcaattcggtatggtatgtacaaatcacgcgagggttttcctctctcatttcctttacccaataaaagcggaaatgccaggtttttaacgcagcatttggcagcgagagattgggaagaaaaagagaagggaagagaagggaatccgagaaaatttctctcgcttccatttctcaaatatttctccgttttatccttcggcgatggcttcggtttccgattcttccaaacagtccctaatcccgagcttcctgtacgcttcttctgccaagtcattctctctcgatcgactcctcagcgccaacaaccctgccttcggtgcttcgcacgccgctacactcgatgctcccgcggtatcatcctctccgtcgatcaagacgaggacgttcatgatcgcctcgccgaatgagcctggcaagaagatcgagatgtactcgccgcagttctacgctgcttgtaccttcggcggtatccttagctgtggtctcactcacatggctgttactcctcttgacctggtcaagtgtaatatgcagattgaccctgcaaagtacaaaagtattacatctggtttcggagttctgctgaaggagcaaggagtcagaggcttcttccgtggttgggttcctacccttctgggttacagtgcacagggtgccggcaagtttggattctacgagtttttcaagaagtactactctgaccttgctggacctgaatatttttcaaagtacaagaccttgatctatcttgctggctctgcatctgctgaggtgattgctgatgttgcactttgcccctttgaggcagtcaaggtcagggttcaaacccagcccggttttgctaggggtttatcagatggtcttcccaagtttgtcaaatctgaaggagttcttggattgtacaagggcattgttcctctttggggccgtcagattccatataccatgatgaagtttgcttcatttgagaccattgttgagatgatctacaagtatggtatccccactccaaaggaccaatgcagcaaatctctgcaacttggtattagttttgctggtggttacattgctggtgtgttctgtgctattgtttctcatcctgctgacaacctcgtctctttcctcaacaatgccaaaggagcaactgttggtgatgctgtgaagaagcttggtttatggggtctgtttacccgtgggcttccccttcgtattgtcatgattggaacactaactggagctcagtggggtatctatgatgcattcaaagtgtttgtgggactgccaaccactggtggtgttgctcctgctgttgaggttgtaaaggcatagaacctcggaaaaatcaactgaaatagttttgttgttctaataggcctttcaaaacctttttcgtagggataaaataaacataggattgcttgaatggctgtcaagctggtggaaaaaattctttttgcattcagaactttctatcaactcttttttgtgttgactactgttggttcttgtcagaggatgattttggtctcatcctctaaaaactccagagaccattttttgtagttagaatcatcatatgtgaatttcatttgaagatcaaactctaccctctgcagcagcagcaaaataatgagcagatggggggtatacaactgagtttctgtctttgaactttttaagcaaccatttgatttatgcggagagaatttattttgctgtatcaaggcatgcaatttatgctttcttatttcccttaaatcacattgctgtaagtttctgtcttttcgattcctttggaatttctaatttgggccttatatctcatagtaaatttcatttatatttctgattttaattttttttcacctgatgttttggtgatctttttacttcacattttgtagaattttttcatcggttggtgatttgtgaattttttacaaatgattagattgttaattttattaagtagaattataaaaaaatataagtgtgaataagcagaataattttatggttctcagtcatatttttatatttttattatgagtcatagatcattttataattttattagttaaaatgttttatgttaatatgacatgttcatgtgaaaactaaaaattgtgaaatatgatcaaattgtagaacattaatatgtcatgttattatcatattatatgtgaaaatataaaaaattaattgaata

SEQ ID NO: 3083 - DNA, 1694 bp, Linum usitatissimum
gggcggaaaaaaagaagaaatcgctttgaaaagcagctggctgggagagatccggacctctctcattcatctctctcgctgcctttctaagcataactcatcgtcttcctcccgccaccattagcaatggcgttctccgattcctccaagaactcgctcatcccgagcttcctctactcttccaccatttcccccaagtcggtcaccttgtctaagctcctcctccactctaaccctaccgaatcggtcctccctcagtccccgaggaagccctccctcggcagccgaggatttgctatccctgctcctagcgagccgttcggcaagatcgagctgtactctcctgctttctacgctgcctgtaccgccggaggaattctcagctgtggtctcactcacatggctgtcactcctcttgaccttgtcaagtgcaatatgcagattgatcctgtgaagtacaagggcatctcgtctggttttggagtgttgtttaaggagcaggggtttagaggtttcttcaggggatgggtgcctacccttcttgggtacagtgcgcagggtgcctgcaagtttggcttctatgaattcttcaagaaatactactcagatattgctggccccgaatatgctgccaagtataagaccttgatctacctggctggttctgcatccgctgaggtgattgctgacattgccctttgcccatttgaggctgtgaaagttcgagtgcaaactcagcctgggttcgctagaggtctctctgatggccttcccaagtttgtcagatctgaaggagctttgggattgtacaagggtattgttccactctggggacgtcaaattccttataccatgatgaagtttgcttcatttgaaatggttgtggagatgatctataagtatgcagtaccccgaccaaagagcgaatgcagcaaaggacagcagcttggtatcagttttgccggtggttacattgctggtgttttgtgtgccattgtctcacatccagctgataatcttgtatctttcctcaacaatgccaagggagcaactgttggtgatgccgtgaagaagattggaatggtgggtctctttactcgtggtctccccctacgtattgtcatgattgggactcttactggagcccaatggggtatctatgatgcattcaaagttttcgttgggctgccaaccactggtggggctcctcctccagctgctattgctgattctggggtagccaaggcctaagaatgcagacagatggagctgatcatctatattcttgttgcattttgtgaagtttggtaaagagctataggagaataagcgggatgaacatggaggtcgggttttatcgccttttgattgaacaattttggatactcaagaagcttagccgatttttttttttttgaagttgacactagtttgaaggtaggggatggtgttgcatcccattcgataatttggttttaaagagaccggaatgtctatcatcgccgatgttgtgatgttcaccttctttacatttggaaatgtcatatgctttacacatcttgcggaaggccacaagcaagactaacacttgtgcggaactgtatcttgtgtctcttggtttatgccaagcatagcttttgataaatgtgccgatataaatggtgatgctctatggaatgtatgacattgtcgtc

SEQ ID NO: 3084 - DNA, 1460 bp, Plantago ovata
ggtagcagcagcgtttccgtattggtcattcaaagaaggagagatagagagagaatttagagagaagaagaaaaatctatctccatctccgatccatcaaaaatggcctccgaccgtcgtcaatcactaatccccaatttcctatactccacctcaaaattctccacctactcaccttcctccgccgccaccgggaactcctccgcccctccgatgaaggccactgccgccggaaatggtaacttcatgattccctctcccagcgagccacctctcggtaagatcgagatgtactctcctcagttctacgctgcctgtactgctggtggtatcctcagctgcggtctcactcacatggctgtcactcctctcgatctcgtcaagtgcaatatgcagattgaccctgcgaagtacaagagcatatcatcaggtttcggagtgttgctgaaggagcaaggagtcaggggtttcttcaggggatgggtcccgaccttgcttggttacagtgctcagggagcttgcaagtttggattctatgagttcttcaagaagtactactctgaccttgctggaccggagaacgcagctaaatataagactttgatctatcttgctggttctgcatctgctgaggtgattgctgatgttgcgctgtgccccatggaagctgtgaaggttcgtgtacagactcaacctggttttgctagaggcttgtctgatgggcttcccaagtttgtgagatctgaaggtgcacttgggctgtacaagggtattgtgccactttgggggcgtcagattccatacaccatgatgaagtttgcttcattcgagactattgtggagcttttatacaagcatgccattcccacacctaaaaatgaatgtagtaagcctttccagcttggtgttagttttgctggtggatatgttgctggtgttctatgtgctgtggtatcacatccagctgataaccttgtctctttcctcaacaatgcaaagggatctactgttggcgatgctgttaaaaagcttggagtgtggggtctcttcacccgtggactaccacttcgtattgttatgattggaactctcactggagctcaatggggtatctatgatgctttcaaagtctttgtaggattgccgacaactggtggtgctgctcctgctgaggttccagccaaggcttaaattcatcgacatatgtttttgataaacgtcctccacatactttcgaattctccacatgctcgaattattgagtaattttttccattagaatgttaaaaggtttgagtggcctatcaacaatgaataataggttggatatggaggacggaggtagaacttagtttttttgttactattttgttactaattgctctggaatagggtatggttttataccttattctgtcaaaattgataacagtatactccgtcgtatatgacgtcgaaat

SEQ ID NO: 3085 - DNA, 1524 bp, Solanum tuberosum
tgagaaaaaggaggtatcggagagcgagacgagattttcaggtttcttcatttgccttctccgatctcgatctcgatctctgtcaatggagaactcccgccgtcagtcccttcttccaagctttctctactccccaacgtcttctttttcttctttaactcccaaaacccttgctgttccagaaaccaccaatgttttgcctcctgccaacaacaacctccttattccggcacctaccgaacctggtaagatcgagatgtactccccgcagttctacgctgcctgtaccttcggtggcatcctcagttgtggtctaactcacatggctgtcactccactcgatctcgtcaaatgtaacatgcagattgaccctgcgaaatacaagagtatatcatctggatttggcatccttcttaaggagcaaggtcccaggggattcttcaggggatgggttcctaccctgttaggttacagtgctcagggtgcatgcaagtttggattctatgaattcttcaagaagtactactctgaccttgcgggagcagaaaatgctgcaaaatacaaaacactgatataccttgctggttctgcatctgctgaagtgattgcagatattgctctttgcccatttgaagctgtaaaggttcgtgttcagacacagcctggtttcgctaggggattgtcagatggattgccgaaatttgttagatctgaaggtcccatgggcctgtacaaaggtttggtacctctttggggacgtcagattccatatacaatgatgaagtttgcgtcctttgagactattgtggagatgatctacaagcatgcagtcccaaagcctaaaaatgagtgcagcaaatctatgcaacttggtattagttttgctggtggatatatagctggtgtcttctgtgctattgtatcccatcctgctgacaatcttgtctcattcctcaacaatgcgaagggtgcaactgttggtgatgccgtaaagaagataggagtattgggtctctttacccgtggtctacctctacgtattgtcatgattggaactcttactggtgctcaatggggaatctatgatgctttcaaggtttttgttgggctgccaacaactggtggtgttgctcctgctgtacctgctgactctgaggttgcgaaggtgtaggattgagaacaaattaattcttcaccaagtttaaaagtagtaaagagaagacttcctccagattaaacaataaacatagattgcagatgtttctttagtgctctttcgtagtaagctggagagtgttctttcgctcaacaatctttacaattttatatttctctgattttgagattttggagagggggagttcccctaaaacttaagcattgcggatgtcttttttgttagaatagatacaaaatcaatttgatgctaagcttttcccattcgagatgggaataacaagtatatttgaggctatatgtttgctctgaacattttaactgcccaatgtaccaaaatatgttttt

SEQ ID NO: 3086 - DNA, 1607 bp, Gossypium hirsutum
agagtttggcaagcgagagtaacaaaatccgaagggaatcccaatttcttcgcttttcatcttctctcgcttccatttctccgtttttccccctccggcaatggctatcgattctgattctttcaaacaatcacttctccctagcttcctttactcttctgctcccaactcattctctctggatcgactcctcaacgccaacagccctgctttctctgcttcacgctccactatacccggtgcccccgcggcctcttcctcgccgtcgatcaaggcgagaactttcatgatcccctcccccaatgagcccgggaagaagattgagatgtattcgcctcagttctacgctgcttgtacctttggcggtatccttagctgtggtctcactcacatggccgttactcctcttgacctcgtcaagtgtaatatgcagattgaccctgcaaagtacaaaagtatctcatctggtttcggagttctactaaaggagcaaggagtgaggggcttcttccgtggttgggttcctacccttcttggttacagcgcacagggtgcttgcaagtttggattctatgagttcttcaagaagtactattctgaccttgctggacctgaatattttgccaagtacaagactctcatctatcttgccggctctgcatctgctgaggtgattgctgatgttgcactttgcccctttgaggcagtcaaggtcagggttcaaacccagcctggtttcgctaggggtctgtctgatggtcttcccaagtttgtcagatctgaaggtgctctcggattgtacaagggtattgttcctctttggggccgacagattccatataccatgatgaaatttgcttcttttgaaactattgttgagatgatctacaagtatggtattcccactcccaaggagcagtgcagcaaaaatctgcagcttggtgttagttttgctggtggttatgttgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgctcctgctgctgtggagcctgccaaggcatagaatgttggaaaacctgttgtcatgggggacaagtaaacgtaggattgctggaatggtttgtcaagctggtggaaggatattcttttttgcgttgagaacatttttatcaagtcgctctgttttgaaaaaaactgttggttttaggagaggatggttttgatctcatcctccaaactacggagactaattatttttgtagtagttagatcataaatgaaatttcatttgaagatcaatcccccccttctgtaacagtgaaaaataaggagcagatgcagatggggttatactgcttactttaaccttctgcaagctttctaatgcaatgttgagagcttttgttcggctttctttgagtaaaaaaaaaaaa

SEQ ID NO: 3087 - DNA, 1528 bp, Eschscholzia californica
agcgccgggcagtgagatatcgagggagagaggctcctccttggttatctcgcgtctttgaaaccctaattcctggatctgcaaaaatgactatgtctgataacaatcgtcaatctcttatccctagtttcctttactcttcaccaaggagatcagatttggtgaacggaaaccgtagttgtttcccttctccttcatcatcatcatcatcagagggtggtgtatcgagaaagagtttcgttgtggccgctccaaacgagccaggcaagatcgagatgtattctcctacattttatgctgcttgtactgttggtggaattcttagttgtggtcttactcacatgactgtcactcctctagatctcgtcaagtgtaatatgcagattgatcctgccaagtacaagagcatttcttctggatttggtgtgttgctgaaagaacagggagctagaggtttctttaggggatgggtgcccaccctcctcggttacagtgcacagggtgcatgcaagttcgggttctacgagttcttcaagaaatactactctgaccttgctgggcctgaaaatgcagccaaatataagaccttgatctaccttgctggttctgcatctgctgaagtcattgctgatattgccttgtgtcccatggaggctgttaaggtccgagtccaaacacaacctggatttgctagaggtttgtctgatggatttcccaagtttgtcaaggctgagggttatggagggttgtacaagggtctcgttcctctctggggtcgacaaattccctacactatgatgaaatttgcatcattcgagaccattgtggaaaatatttacaagcacgcgatccccgtaccgaaggatcaatgcagcaaatcacttcaacttggtgtcagctttgctggtggatatgttgctggtgttttctgtgccattgtttctcatccagctgacaatcttgtgtcattcctcaacaacgccaagggtgccactgttggtgatgctgtgaaaaaccttggtttgtggggtttgttcactcgcggtcttcctctgcgtattgtgatgattggaacacttactggagcacaatggggtatctacgatgcatttaaggtctttgtgggcctgcccaccacaggaggtgccgcgcctgctgctgctgctgctattgcagcttctgaggtcgtgacggcataaatcatactggaaaccatttatgaaggtggtaggtttattgaaaaagggaatcagactgattaataatttttgtttggttgttgagattgattgcttgcctcaactactccagttaggaggtgctaagtttactcttttactgttacagacataggatttgctttaacttttggttagttattttgtattactatgtcattagtaggatgtttgtttcctatctctaacctaaggtagtattattaatatgtagtcgttaacctaatagaggacggaaacttaagttggaggatataatgtcttctatagaaggaaagaagggaaaggta

SEQ ID NO: 3088 - DNA, 1590 bp, Amorphophallus konjac
ccccatttgtcccggaaattgaatcctagcgccgccgggagctcgcggacatggctctccccgatcgctctcaccgccaatccctcgtccccagcttcctctactccccttcctctgccatcgccgccggcgccagatccacggccttagagaagctcgtcccgggcagaaacggcgccgctcccgctccgatgccgttatcgcctatgcctgatggcggatcggcggcgaacttcctcatcccggcgcccaaggagaagattcagctctactcgcctcagttctacgcggcgtgcaccgccggggggatcgccagctgcgggctcacccacatggcggtcacgcccctggatctggtcaaatgcaatatgcagattgaccctgtaaaatacaagagcatctcgtctggatttggtgtcctgctgaaggagcaggggcttagaggcttcttcaggggttgggtgccgaccttgctaggatacagtgctcagggcgcctgcaagtttggattttatgagtacttcaagaaatattattcggatcttgctggacccgagaacgcagtgaaatacaagactctgatttatcttgcgggatctgcctctgctgaagttattgctgatgttgccctttgcccgatggaagctgtgaaggtccgagtccagacacagcctggcttcgccagaggtttaatggatggactcccgaagttcgtcaaatcagaaggcacattggggttgtataaggggattgttccactctggggacgccaaattccttatacaatgatgaagttcgcatcttttgagaccatcgtggagatggtatacaagtatgccattcccacacccaaggaccaatgtagcaagtcactccagcttggtgttagttttgcgggtggttacatcgctggtgtcttctgcgctattgtctcccacccggccgacaaccttgtgtcgttcctcaacaatgctaaaggggcctccgttggtgatgctgtcaagaaactcggactgtggggtctgttcacccgaggacttcctctgcgtatcgtgatgataggcactctcactggcgcgcagtgggggatctatgatgccttcaaagtctttgttggcctgccgacaacaggtggagttgctcctgctcccaccactcctcctgctcctgccccagccacttgattctgcgtgttggggatatatatatatatttttctgtgttgtggaacattgtctttgttttaccttgaaaattttggaggctagttttgatctcagccttctgactcggaagagatgtttgccacaaagcgttggtgggtgaggtatttttgtgacatggcaattgctaggtgccatgaaataatggcattaccaggcagctgatagctgttgaacaaaccacatttgatctgtgcttctttactatcatttatagcagtccctctacgactgtggaatgtagtctagaatgatgtagtccatcaaaatttctccacttttgagatttcatgagctgtcttttgccactttgtgattcattgtttgaatgggtaagtcagtatttttagtatgagtattattccac

SEQ ID NO: 3089 - DNA, 1177 bp, Eucalyptus grandis
gtcccgttgcttgccatggcgctcgtggagaacccaagccgatcactgatccccagcttcctctacgcttctccttcctcgtccaggggcctcgccgccgaggtgagccccgccgctgcgccctccttccccgcgtccgtggcggagaagcggaggagttttgtggtcccgtcgccgagcgagcccgggaggaagattgagatgcactcgccggcgtattacgccgcttgtactgccgggggcatcctcagctgcggcctcacccacacggccgtcaccccgcttgacctcgtcaagtgcaatatgcagattgaccctttaaagtacaagagcgtcacatctggtttcggagtgttactgaaggagcaaggagtgagaggctttttcaggggttgggcgcctactctccttggttatagtgctcaaggtgcctgcaagatgggattctacgaatttttcaagaaatactactctgatattgctggaccagagtatgcatcgaagtacaagaccttgatctacctcgctggctctgcctctgctgaggtgattgcagatgtcgctctctgcccatttgaggctgtaaaggtccgggtgcaaactcagcctggttttgcaaggggtttatcagatggatttcccaagtttgttaaatctgagggtgctcttgggttatacaagggcattgttcctctctggggtcgtcagataccatacacaatgatgaaattcgcttcttttgagaccattgtggagctaatgtataaacacgccattcccagacctaaagatgagtgtagtaaaagtctgcagcttggcgtgagttttgctggcggatatgtcgccggagttttctgtgcccttgtgtctcatcctgctgacaacctagtctccttcctcaacaatgccaaaggggcaaccgttggtgatgcagtgcaaaagctaggattatggggtctcttcactcgtggacttcctcttcgtattgccatgattggaactcttactggggcccagtgggggatctatgacgcctttaaagttttcgtgggactgccgaccactggtggtgttgctcctgctgctgcccctgctgtgcttgcaaaggcttagactgtggaaagatcgaagatcgacatttatcattttttcacacatcctcgttgaaaggaataat

SEQ ID NO: 3090 - DNA, 1524 bp, Flaveria ramosissima
catcggtacacaaaaagcatcgagatactcgaaacggagaagatttgagagacatttgcgtcgtcgactccgtcgtatctccaccatcttctccgatcacacaccgacgctcactcatggcgatttccgacgactctcgtcaatctctcatccctaagttcctttacacttcttccgtttctcccagcagcctactcatgacctacacatcaaaccctacactgttgccttcaacatcacctgctaaacagcacaatagtctcgtgattcctgctcctaatgagcctctaggcaaaatcgagatgtattcccctcgattttatgctgcttgtactgttggaggtattctcagctgtggtctcacgcacatggccgttactcctcttgatctcgtcaaatgtaacatgcagattgatcctgtgaaatataagagcatctcgtctggttttggagtattgctcaaagagcagggtttgaggggcttcttcaggggatgggttccaaccctgcttggttacagtgctcagggtgcctgcaaatttggcttctatgaattcttcaagaaatattactccgacattgctggcccagagtacgcagccaagtacaagactttgatctaccttgctggttcagcatctgcggaggtaattgctgatgtggctctttgtcctatggaggctgtgaaagtacgtgtccaaacgcaacctggtttcgccagaggattgggagatggacttccaaagtttgtcagatctgaaggcgcacttgggttgtacaagggcttggtaccactatggggccgccagataccatatacaatgatgaaatttgcttcatttgagaccattgtggagatgctgtacaagtatgccatccctacaccgaagaatgagtgcagcaaatcactacaacttggcgtcagttttgctggtggatatgtggctggtgtcttctgtgccgttgtttctcatcctgctgacaatcttgtttcgttccttaataatgccaaaggtgctagcgttggagatgcagtaaagaagcttggactttggggtctcttcacaagagggcttcccctacgtattgtcatgattggaactctcactggagctcaatggggaatatatgatgctttcaaagtgtttgtcggcctaccaacaacaggcggtgctgcacctgctccagttgctgaggttgcagaagcttaggtgcatgactatggagcctcagatgctttcacaccctcaaatcgagtcaataaacatagaccccttgatagcacaagagtaattttggcgagtcaactcttttttaactatttagaaaggggtgagggtttgtcttgattcgtttgtggtgcattgctgattactttttgatatgaagaggatggtgcttcatcaattgagaagttttgttaaccatggaagttaatttgggacaaacgatatggtaatacttttggctctgatccttggtgaatacaggctttcttttgttgttgttaatttcatctcaatt

SEQ ID NO: 3091 - DNA, 1626 bp, Cichorium intybus
gcataggcggggggacggagaagaatcggagaggtctgggtcgactcaagtcatccctcaatcatcttctccgatcttttctctaatactcggccatggcgttttccgacaactcccgtcaatctctcatccctaatttcctgtacacttcttccgtttcgaccagcagcctactcatgggcaacacttcaaaccctaccttgtttccttctacatcaccggccaagcagcagaataacttcgtaattcctgctcccaacgagcctctaggcaagatcgagatgtactctcctcgattttacgctgcttgtactgctggaggtattctcagctgtggtctcactcacatgaccgtcactcctcttgatcttgtgaaatgtaacatgcagatcgaccctgtcaaatacaagagcatctcctctggtttcggaatattgttgaaggaacagggtgtaaggggcttcttcaggggatgggtccctaccctacttggttacagtgctcagggtgcctgcaaattcggcttctatgaattcttcaagaaatactactctgacatcgctggcccagaatacgcaaccaaatacaagaccttaatctaccttgctggttcagcctctgctgaagtaattgctgacgtggccctctgccccatggaagctgtcaaggtccgtgtccaaacacaacccggttttgccagaggtttgggtgacggactccccaagtttgtcagatctgacggtgtacttgggctgtacaagggattagtaccactttggggacgccagattccatatacaatgatgaagtttgcttcctttgagactattgtggagatgatgtacaagtatgcaattcctacaccaaagaacgaatgcagcaaatccctacaacttggagttagttttgctggtggatacgtggctggtgttttgtgtgctattgtatctcatcctgctgacaatcttgtctccttccttaacaatgccaagggagcaagtgttggagatgctgtgaagaagcttggagtttggggtctattcaccagaggacttcccctacgtattgtcatgattggaactctcactggtgctcaatggggaatctatgatgcatttaaagtgtttgttgggctaccaacaacaggtggtgccgcaccagttgctgaggttgcaaaaagaagagctcgtttttccattgaatgagtcaataaatataggatatattgcgcgtccttgaaggaaggcactgaaatagtcctggggagaaacctcctcttctttttgtcctgggacactggaaatttttaacttgtattgttttgatactatttctgacgattttttagtactgaggaggattgtgtttgtcctctgcttcatgaattgagaagttttggttattatgaaaagacctattttatccccctgggaaaacaatggggaaatacgatgtgacgcagaacaaaaaaaaaaaaagctgcctcggccaaaccaactctagaccttcctcaacttaagcatgaggccccaattcttgtacactgaatcggcggaaaatttaccaggtctttttggaacctcacccaggggtacagacccccatttgtgggtaatacaaaaaagc

SEQ ID NO: 3092 - DNA, 1608 bp, Gossypium hirsutum
ttttttttttggggtagtgcctaataatacagccggaaaaatctctgtcttaacacagagtttggcaagcgagagaaacaaaatccgaagggaatcccaatttcttcgcttttcatcttctctcgcttccatttctccgtttttcccctccggcaatggctatcgattctgattctttcaaacaatcacttctccctagcttcctttactcttctgctcccaactctttctctctggatcgactcctcaacgccaacagccctgctttctctgcttcgcgctccactatacccgatgctcctgcggcctcttcctcgccatcgatcaaggcgagaactttcatgatcccctcccccaatgagcccgggaagaagatcgagatgtattcgcctcagttctacgctgcttgtacctttggcggtatccttagctgtggtctcactcacatggccgttactcctcttgacctcgtcaagtgtaatatgcagattgaccctgcaaagtacaaaagtatctcatctggtttcggagttctattaaaggagcaaggagtgaggggcttcttccgtggttgggttcctacccttcttggttacagcgcacagggtgcttgcaagtttggattctatgagttcttcaagaagtactattctgaccttgctggacctgaatattttgccaagtacaagactctcatctatcttgccggctctgcatctgctgaggtaattgctgatgttgcactttgtccctttgaggcagtcaaggtcagggttcaaacccagcctggttttgctaggggtctgtctgatggtcttcccaagtttgtcagatcagaaggtgctgttggattgtataagggtattgttcctctttggggccgacagattccatataccatgatgaaatttgcttcttttgaaactattgttgagatgatctacaagtatggtattcccactcccaaggagcagtgcagcaaaagtctgcagcttggtgttagttttgctggtggttatgtcgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtgggactgccaactactggtggtgttgctcctgcacctgctgccgtggagcctgccaaggcatagaatgttggaaaacaagtaaacataggattgctggaatggtttgtcaagctggtggaaggatattcttttttgcgttgagaacatttttatcaagtcgctctgttttgaaaaaaactattggttttaggagaggatggttttgatctcatcctccaaactacggagactaattatttttgtagtagttagatcataaatggaatttcatttgaagatcaatcccccccttctgtaacagttaaaaataaggagcagatgcagatggggttatactgcttactttaaccttctgcaagctttctaatgcaatgttgag

SEQ ID NO: 3093 - DNA, 1596 bp, Gossypium hirsutum
acagcgtttggcaagcgagagaaacaaaatccgaagggaatcccaatttcttcgctcttcatttctcccgattccatttctccgtttttttcacctccggcaatggctaccaaatctgattctttcaaacaatcccttctccctagcttcctttactcttcttcccccaactcattctctctggatcggctcctcaacgccaacagccctgctttctctgcttcgcgctccactatacccgatgctcctgcggcctcttcctcgccatcgatcaaggcgagaactttcatgatcccctcccccaatgagcccgggaagaagatcgagatgtattcgcctcagttctacgctgcttgtacctttggcggtatccttagctgtggtctcactcacatggccgttactcctcttgacctcgtcaagtgtaatatgcagattgaccctgcaaagtacaagagtatttcatctggttttggagttctactaaaggagcaaggagtgagaggcttcttccgtggttgggttcctacccttcttggttacagcgcacagggtgcttgcaagtttggattctatgagttcttcaagaagtactattctgaccttgctggacctgaatactttgccaagtacaagactctcatctatcttgccggctctgcatctgctgaggtgattgctgatgttgcactttgcccctttgaggcagtcaaggtcagggttcaaacccagcctggttttgctaggggtctgtctgatggtcttcccaagtttgtcagatctgaaggtgctctcggattgtacaagggtattgttcctctttggggccgacagattccatataccatgatgaaatttgcttcttttgaaactattgttgagatgatctacaagtatggtattcccactcccaaggagcagtgcagcaaaaatctgcagcttggtgttagttttgctggtggttatgttgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgtgcctgctgctgtggagcttgccaaggtatagaatgttggaaaacctgttgtcatgggggacaagtaaacataggattgctggaatggtttgtcaagctggtggaaggatattcttttttgcgttgagaacatttttatcaagtcgctctgttttggaaaaaactgttggttttaggagaggatggttttgatctcatcctccaaattacggagactaattatttttgtaatagttagatcataaatgaaatttcatttgaagatcaatcccccccttctgtagcagttaaaaataaggagcagatgcagatggggacgatactgcctactttaccttcttaagcaagctttttaatgtaatattgagaacttttgttcggctttcttt

SEQ ID NO: 3094 - DNA, 1966 bp, Gossypium raimondii
tatggtgcgtataaatcacgcgagggttttctctcccatttccttcgcagtgccaaataataaagccggacacatctgagtcctaacacagcgtttggcaagcgagagaaacaaaatccgaagggaatcccaatttcttcgctctccatttctcccgcttccatttctccttttttttcacctccggcaatggctaccaattctgattcttttaaacaatcccttctccctagcttcctttactcttcttcccccaactcattctctctggatcgactcctcaacgccaacagccctgctttctctgcttcgcgctccactatacccgatgctcctgcggcctcttcctcgccatcgatcaaggcgagaactttcatgatcccctcccccaatgagcccgggaagaagatcgagatgtattcgcctcagttctacgctgcttgtacctttggcggtatccttagctgtggtctcactcacatggccgttactcctcttgacctcgtcaagtgtaatatgcagattgaccctgcaaagtacaagagtatttcatctggttttggagttctactaaaggagcaaggagtgagaggcttcttccgtggttgggttcctacccttcttggttacagcgcacagggtgcttgcaagtttggattctatgagttcttcaagaagtactattctgaccttgctggacctgaatactttgccaagtacaagactctcatctatcttgccggctctgcatctgctgaggtgattgctgatgttgcactttgcccctttgaggcagtcaaggtcagggttcaaacccagcctggttttgctaggggtctgtctgatggtcttcccaagtttgtcagatctgaaggtgctctcggattgtacaagggtattgttcctctttggggccgacagattccatataccatgatgaaatttgcttcttttgaaactattgttgagatgatctacaagtatggtattcccactcccaaggagcagtgcagcaaaaatctgcagcttggtgttagttttgctggtggttatgttgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgtgcctgctgctgtggagcttgccaaggtatagaatgttggaaaacctgttgtcatgggggacaagtaaacataggattgctggaatggtttgtcaagctggtggaaggatattcttttttgcgttgagaacatttttatcaagtcgctctgttttgaaaaaaactgttggttctaggagaggatggttttgatctcatcctccaaactacggagactaattatttttgtaatagttagatcataaatgaaatttcatttgaagatcaatcccccccttctgtagcagttaaaaataaggagcagatgcagatggggacgatactgcttactttaccttgttaagcaagctttttaatgtaatattgagaacttttgttcggctttcttttagtaaggcatctcactctctctctctgcaaaaaaatatttattacatttttagatatatttcatggaggttacaagtaggggtgagcattcgatcgaatcgaatcgaaaattttcgagttaatcgagtttttgaatctcattttatcatcttaattttatttgaagttttttcgaatcgagtcgagtgaaatgaaattcgaatcgaatatatttgttcgagttgaatttaaaaaaataattttgggtccttgtaaccattgtcatccatcgtaataaaattt

SEQ ID NO: 3095 - DNA, 1722 bp, Gossypium raimondii
tttcctttgtagtgcccaataataaagccggaaaaatctctgtcttaacacagagtttggcaagcgagagaaacaaaatccgaagggaatcccaatttcttcgcttttcatcttctctcgcttccatttctccgtttttcccctccggcaatggctatcgattctgattctttcaaacaatcacttctccctagcttcctttactcttctgctcccaactctttctctctggatcgactcctcaacgccaacagccctgctttctctgcttcacgctccactatacccggtgcccccgcggcctcttcctcgccgtcgatcaaggcgagaactttcatgatcccctcccccaatgagcccgggaagaagattgagatgtattcgcctcagttctacgctgcttgtacctttggcggtatccttagctgtggtctcactcacatggccgttactcctcttgacctcgtcaagtgtaatatgcagattgaccctgcaaagtacaaaagtatctcatctggtttcggagttctactaaaggagcaaggagtgaggggcttcttccgtggttgggttcctacccttcttggttacagcgcacagggtgcttgcaagtttggattctatgagttcttcaagaagtactattctgaccttgctggacctgaatattttgccaagtacaagactctcatctatcttgccggctctgcatctgctgaggtgattgctgatgttgcactttgtccctttgaggcagtcaaggtcagggttcaaacccagcctggttttgctaggggtctgtctgatggtcttcccaagtttgtcagatcagaaggtgctgttggattgtacaagggtattgttcctctttggggccgacagattccatataccatgatgaaatttgcttcttttgaaactattgttgagatgatctacaagtatggtattcccactcccaaggagcagtgcagcaaaagtctgcagcttggtgttagttttgctggtggttatgtcgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgctcctgctgctgtggagcctgccaaggcatagaatgttggaaaacctgttgtcatgggggacaagtaaacataggattgctggaatggtttgtcaagctggtggaaggatattcttttttgcgttgagaacatttttatcaagtcgctctgttttgaaaaaaactgttggttttaggagaggatggttttgatctcatcctccaaactacggagactaattatttttgtagtagttagatcataaatgaaatttcatttgaagatcaatcccccccttctgtaacagttaaaaataaggagcagatgcagatggggttatactgcttactttaaccttctgcaagctttctaatgcaatgttgagagcttttgttcggctttctttgagtaaggcatctctctctctctctacaaaaaaatatttattacatttttagaacatggaagttaaaactagttattcaca

SEQ ID NO: 3096 - DNA, 1537 bp, Gossypium hirsutum
aaatctctgtcttaacacagagtttggcaagcgagagaaacaaaatccgaagggaatcccaatttcttcgcttttcatcttctctcgcttccatttctccgttttcccctccggcaatggctatcgattctgattctttcaaacaatcacttctccctagcttcctttactcttctgctcccaactctttctctctggatcgactcctcaacgccaacagccctgctttctctgcttcacgctccactatacccggtgcccccgcggcctcttcctcgccgtcgatcaaggcgagaactttcatgatcccctcccccaatgagcccgggaagaagattgagatgtattcgcctcagttctacgctgcttgtacctttggcggtatccttagctgtggtctcactcacatggccgttactcctcttgacctcgtcaagtgtaatatgcagattgaccctgcaaagtacaaaagtatctcatctggtttcggagttctactaaaggagcaaggagtgaggggcttcttccgtggttgggttcctacccttcttggttacagcgcacagggtgcttgcaagtttggattctatgagttcttcaagaagtactattctgaccttgctggacctgaatattttgccaagtacaagactctcatctatcttgccggctctgcatctgctgaggtgattgctgatgttgcactttgcccctttgaggcagtcaaggtcagggttcaaacccagcctggttttgctaggggtctgtctgatggtcttcccaagtttgtcagatcagaaggtgctgtcggattgtacaagggtattgttcctctttggggccgacagattccatataccatgatgaaatttgcttcttttgaaactattgttgagatgatctacaagtatggtattcccactcccaaggagcagtgcagcaaaaatctgcagcttggtgttagttttgctggtggttatgtcgctggtgtcttctgtgctattgtttcgcatcctgctgacaaccttgtctccttccttaacaatgccaaaggagcaactgttggggatgctgtgaagaagcttggattatggggtctgtttacccgtggtcttcccctccgtattgtgatgattggaactctaactggagctcagtggggtatctatgatgctttcaaagtgtttgtggggctgccaactactggtggtgttgctcctgctcctgctgctgtggagcctgccaaggcatagaatgttggaaaacctgttgtcatgggggacaagtaaacataggattgctggaatggtttgtcaagctggtggaaggatattcttttttgcgttgagaacatttttatcaagtcgctctgttttgaaaaaaactgttggttttaggagaggatggttttgatctcatcctccaaactacggagactaattatttttgtagtagttagatcataaatgaaatttcatttgaagatcaatcccccccttctgtaacagttaaaaataaggagcagatgcagatgggg

SEQ ID NO: 3097 - DNA, 1445 bp, Triticum aestivum
cccgccccgcccccaggggaagaagcaaagcacccgcgtagcagcccaaccgcagccatggccgtctccgatagatcgcgcaacgcgctgctccccagcttcctgtacgcggccccctccgccgccgccacctccacccctttctctgccgtcgctggcattggtgcccgcgggctcgtcgcaccgtcccatgcgtcggcgacgaggccggcggcgtgggcgcgggcgcctagcgagccgtcccggaagatcgagatgtactcgcccgcgttctacgcggcgtgcacggccggtggcatcaccagctgtgggctcacgcacatgaccgtcacgcccctcgacctcgtcaagtgcaacatgcagattgatccagccaagtacaagagcatctcctctggatttggtgttctcttgaaagagcaaggggcaaagggtttcttcagaggctgggtgcctactttgattggttacagtggtcaaggcgcttgcaaatttggtttctacgagttcttcaagaagtattactcggatattgctggacctgagaatgcagccaagtacaagactttgatctatcttgctggctctgcttcggctgaggttattgcagatgttgccctctgccccatggaggctgtgaaggtccgtgtgcagacacaacctggttttgcaaaaggtttatctgatgggttccctaagtttgtgaaggctcaaggatatgctggattgtacaagggaattgttccgctctggggccgtcaaattccatacactatgatgaaatttgcctcctttgagactattgtcgagaatatctacaagtatgcaattcctgcccccaagagcgagtgcagcaagtctctccagctcggggtgagctttgcaggcggttacgtcgctggagtgttctgcgcaatagtttcgcacccagctgacaaccttgtttcattcctcaacaatgctcagggagcaactgtgggcgatgctgtgaagaaacttggcctgtggggtctgtttacgcgtggactccctctgcgtatcgtgatgattggtaccctcactggagctcagtggggcatctatgatgctttcaaagtcatggttggactgccaactagtggtggagttgctccgcctgctccgctggagagcagctgaagggctgaggcttgattctactatactcaatatatctaacaacattttttggcgccgaattggatgatgacgaaataactcatgtttcatccttttaagagcaagcgattatttttcaggaatgcctagttgcaaccctggtaattagatgtcaagacagattaggaacaattttcggcacatgatcgtctggcttaggacgattgcctgaagcatagcatacttgcccatttttttgaattgttattatatgtctcagctaatccggcaataaaagctgtaattaa

SEQ ID NO: 3098 - DNA, 1831 bp, Quercus alba
aagtgtcagaatggtaaattggccccggatgggaaggtcaaatttgtcccacagacgcattacacatctcgtataacaaacacgagtggggggttggcgattttggccaataaaaaccgaaaatgtcacacccaccgcattgtaaattgttaacacatcacaggaagcacttttgcatttggcaagcgagagtctgggagagattctctcgctttcatttctagcttccgacctcgcctctctctttctctccccattaccacaaaaccctttgtctctctcacacactctctctctttctccgatggctctctctgacaaatcttcgcgtcagtctctgatcccaagcttcctctactcctcttcctccaccgtctccacctcgcacaaatccttcgctcttgacaagaccatgctcggtgctgctgctccagcaagctccaacagcggcgtctcgtctccggccaggaacttcgtcgttccggcgccaaacgagcccggcaagatcgagatgtactcgccggccttctacgccgcctgtaccgccggcggtattctcagctgtggtctcactcacacggccgtcactcctctcgatctcgtcaagtgcaatatgcagattgaccctgcaaagtacaaaagcatctcatctggttttggagtgttgtataaggaccagggtgtcagaggcttcttcaggggttgggtgccaaccttgcttggttacagtgctcagggtgcctgcaagtttggattctatgaattctttaagaagtactactctgaccttgctggacctgagaatgcagccaagtacaagaccttgatctatcttgctggttctgcatctgccgagttcattgctgacattgctctttgcccatttgaggcagtgaaggtccgggttcaaacacagcctggttttgctagaggtctgtcagatgggcttcccaaatttgttagatctgaaggatatggagggttgtacaagggactggttcctctctggggacgtcagattccatatacaatgatgaagtttgcatcttttgagacaattgtggagaatatctataagcatgccatccccacaccgaagaacgagtgtagcaaaactctgcagcttggtgtgagttttgctggtggatatgtggctggtgtattctgtgccattgtgtctcatcctgctgacaatcttgtctccttcctcaacaatgccaagggggcaactgttagtgatgctgtgaacaagctaggtgttatgggtctctttacccgtgggcttcctctccgtattgtcatgattggaactcttactggagctcagtggggaatctatgatgccttcaaagttttcgtgggattgccaacaactggtggtgttgctcctgctgctactgagcttgcaaaggcatagaatttcagatgatcatcacaagtttttgtcgttttgttgaacgtaggaaagacaattatagggtttcaataaacaataggattgttgaagttacttggtggatggctctgaagccagtggggagtattcttttgcatttggaactggccaattttcctaatttggcttgtggaaggatggttttgctcttatccttctgattacttttaaaactatgtagttagatctataatgaatttgcaatatgatgttaggatcatggttcccccataagctctggtcaaagaataattggcagatggggtgatatactgagttctcttattttacatctctttgaatgcacttgatatgagcggaaacatgttttcttgtctttactcatttattcagttcattctggttgattttctc

SEQ ID NO: 3099 - DNA, 1603 bp, Solanum phureja
gtgaatggttgacagggcagtataaaagagtggaaattgttttaggtcgaaagagaaaaaggaggtattcggagagcgagacgagattttcaggtttcttcatttgccttctccgatctcgatctcgatctcgatctctgtcaatggagaactcccgccgtcagtcccttcttccaagctttctctattccccaacgtcttctttttcttctttaactcccaaaacccttgctgttccagaaaccaccaatgttttgcctcctgccaacaacaacctccttattccggcacctaccgaacctggtaagatcgagatgtactccccgcagttctacgctgcctgtaccttcggtggcatcctcagttgtggtctaactcacatggctgtcactccactcgatctcgtcaaatgtaacatgcagattgaccctgcgaaatacaagagtatatcatctggatttggcatccttcttaaggagcaaggtcccaggggattcttcaggggatgggttcctaccctgttaggttacagtgctcagggtgcatgcaagtttggattctatgaattcttcaagaagtactactctgaccttgcgggagcagaaaatgctgcaaaatacaaaacactgatataccttgctggttctgcatctgccgaagtgattgcagatattgctctttgcccatttgaagctgtaaaggttcgtgttcagacacagcctggtttcgctaggggattgtcagatggattgccgaaatttgttagatctgaaggtcccatgggcctgtacaaaggtttggtacctctttggggacgtcagattccatatacaatgatgaagtttgcgtcctttgagactattgtggagatgatctacaagcatgcagtcccaaagcctaaaaatgagtgcagcaaatctatgcaacttggtattagttttgctggtggatatatagctggtgtcttctgtgctattgtatcccatcctgctgacaatcttgtctcattcctcaacaatgcgaagggtgcaactgttggtgatgccgtaaagaagataggagtattgggtctctttacccgtggtctacctctacgtattgtcatgattggaactcttactggtgctcaatggggaatctatgatgctttcaaggtttttgttgggctgccaacaactggtggtgttgctcctgttgtacctgctgactctgaggttgcgaaggtgtaggattgagaacaaattaattcttcactaagtttaaaagtagtaaagagaagacttcctccagattaaacaataaacatagattgcagatgtttctttagtgctctttcgtagtaagctggagagtgttctttcgctcaacaatctttacaattttatatttctctgattttgagattttggagagggggagttcccctaaaacttaagcattgcggatgtcttttttgttagaatagatacaaaatcaatttgatgctaagcttttcccattcgagatgggaataacaagtatatttgaggctatatgtttgctctgtccattttaactgtccaatgtaccaaaatatgttttttaaaaaaaactttccggagcc

SEQ ID NO: 3100 - DNA, 1558 bp, Solanum lycopersicum
gattttcctattggatgccctaaaatgagggatggctcattttttgggagggatattatttattggtgaacggttgattgggcagtacaaaagagtggaaattgttttaggtcgaaatagaaaaaggaggtattcggagagcgagacgagattcttcatttgccttctctgatctccgatctccgatctccgatctccgatctccgatctcaatctgaatctgtgtcaatggagaactcccgccgtcagtctcttcttccaagctttctctactccccaacatcttctttttcttctttaactcccaaaacccttgctgttccagaaaccaccagtgttcccaacaacaacctcattattccggcacctaatgaacctggcaagatcgagatgtactccccgcagttttacgctgcctgtaccttcggtggtatcctcagttgtggtctcactcacatggctgtcactccactcgatctcgtcaaatgtaacatgcagattgaccctgcgaaatacaagagcatatcgtctggattcggcgtccttcttaaggagcaaggtcccaggggattcttcaggggatgggttcctaccctgttaggttacagtgctcagggtgcatgcaagtttggattctatgaattcttcaagaagtactactcggacctcgccggagcagaaaatgctgcaaaatacaaaactctgatataccttgctggttctgcatctgctgaagtgattgcagatattgctctttgcccatttgaagctgtaaaggttcgtgttcagacacagcctggtttcgctaggggattgtctgatggattgccgaaatttgttagatctgaaggtcccatgggcttgtacaaaggcttggtacctctttggggacgtcagattccatatacaatgatgaagtttgcgtcctttgagactattgtggagatgatctacaagcatgcagtcccaaagcctaaaaacgagtgcagcaaatctatgcaacttggtattagttttgctggtggatatatagctggtgtcttctgtgccattgtatcccatcctgctgacaatcttgtctcgttcctcaacaatgcgaagggtgcaactgttggtgatgccgtaaagaagataggagtattgggcctctttacccgtggtctacctctacgtattgtcatgattggaactcttactggtgctcaatggggaatctatgatgctttcaaggtttttgttgggctgccaacaactggtggtgttgctcctgctgtacctgctgactctgaggttgcgaaggtgtaggattgagaacaaattaattcttcaccaagtttaaaagtagacttctccagattaaacaataaacatagattgcagatgttccttaagtgctctttcgtagtaagcaagctggagagtgttctttcgctcaacaatctttacaattttatatttctctgattttcaaatttttggagagggggagttcccctaaaacttaagcattgcggatgtctttttttgttagaacagataaaaaaatcaatttgatgct

SEQ ID NO: 3101 - DNA, 1313 bp, Ambrosia trifida
gcttgctacattggtaaataaaaaccccatccaacccaactcatttccatcagcattaacggaacggagaacaacatctgagcgattgtcgtctccgaccatccctcaaatattattctccgatccaaaacagcaatggccatcaccgacaacacctctcgtcaatcactaatccctaacttcatttacacatcttcggtttctccgagcagttttcttatgcctaaaacatcaaaccataacatgtttaattctactgcaccggttaaacaggataataagtttgttattcctgctcctaacgagcctttaggcaagatcgagatgtattctccacggttctatgctgcgtgtactgctggaggtattctcagctgtggacttactcatatggctgttactcctcttgatcttgttaaatgtaacatgcagattgaccccgctaaatacaagagcatctcgtctgggttcgggatactgctgaaggagcaaggtgtaaggggattctttagaggatgggtccctaccctgcttggttatagtgctcagggtgcctgcaaattcggcttctatgaattctttaagaagtattactctgacattgctggccctgagtatgctgccaggtacaagactttgatctaccttgccggttcagcatccgctgaggtaattgctgatgtggctctttgtcctatggaggcagtgaaggtccgtgtccaaacacaacctggttttgccaggggtttgggggacggacttccaaagtttgtcagatctgaaggcgtacttgggttatacaagggattggtaccactttggggacgacaaataccatataccatgatgagatttgcttcatttgagacgattgtggagatgatgtacaagtacgctatccctacaccaaagaatgagtgcagcaaatccctgcaacttggagttagttttgctggtggatatgtggctggtgttctttgtgctgttgtttcccatcctgctgacaatcttgtttccttccttaacaatgccaagggtgcaagtgttggagatgctgtgaagaagcttggagtttggggtctcttcacccgagggcttcccctaaggattgtcatgattggaaccctcactggagctcaatggggaatttatgatgcttttaaagtgtttgtcgggctgccaacaacaggtggcgctgcacctgctccagttgccgagactgcggaagcataggtgttttatggagcctgatattcctttttactatcgtcaaactgagtcaataaacataggtgattttggtagagttaacg

SEQ ID NO: 3102 - DNA, 1427 bp, Elaeis guineensis
cgaagcgaggacgttcgagcgcgccatcacgcactctcgcggctatcgccaccccacccccaccccgccccctctctcaaaaccctcgccctcaccccagccctagaaggatcgatctcttcctctttcctgtaccttcttttctctttttggctatggcgaataccgagaactcttctctccattccctcctccctggcttcctctactcctcttcttccacccgatctctcgccttggagcgcctcctgcgtcgaagctctcgctcgcctgtgccttcttctccttctcctgcggttccgtcgatcgggcggttgccgtcgggccctttcctcgcgcaggcgccgagggagcccggcaagatcgagctctactcaccgctctactacgctgcctgcaccgccggtgggatcgccagctgtgggcttactcacatggccgtcacccccctggacctagtcaaatgcaacatgcagatcgacccagcaaagtataagagcatcacatcgggatttggtgtcttgctgagagagcaggggctcagaggcttcttcaagggttgggtgccaaccctgcttgggtatagcgctcagggtgcatgcaagtttgggttctatgagttcttcaagaagtattattcagacattgcagggccagagtatgcagccaagtataagaccctgatctatcttgcggggtctgcatctgctgaggtgattgctgatgtagctctttgccccatggaagctgtgaaggtgcgtgtccagactcagccagggtttgctaggggtttggctgatggatttccaaaatttgtcaaatctgaaggtgctctgggattgtacaaaggactggttccactctggggtcgtcagattccttatacaatgatgaaatttgcttcatttgagacaattgtcgaattgatgtacaagcatctcattcccacaccaaaagatcaatgtagcaaaccgatccagctgggagtaagctttgcaggtggatatattgctggggtcttctgtgctgttgtgtctcatccggctgacaatcttgtctctttccttaacaatgccaaggacgccactgtgggtgacgctgtgaagaagcttgggttgtggggtctttttacacgtggccttcctcttcggattgttatgattggtactttgactggagcacaatggggaatctatgatgctttcaaagtattcgttggcctgccaacgactggtggagttgcccctcctcctactccctctgagcattcaaaagaaagctgaacaaattgggctgatgaactagcagatagggtagagatcctggtgaataagatgatgagagcgatgcactccattttgaaggggaactgcaatattctttgaaatcaaagcatccccccatctccacacccacccccccccccc

SEQ ID NO: 3103 - DNA, 1526 bp, Hordeum vulgare
ggccccggccgccggcatcgtcggcgccggcggggccgggggcggcaggcccttctcgatccgcgcgcccaacgagaaaatcgtcatgtactcgccggccttctacgccgcctgcaccgccggggggatcgccagctgcggcctcacccacatggccgtcaccccgctcgacctggtcaagtgcaacatgcagattgacccggcgaaatacaagagcatcacatctggatttggtgttctgttaaaggagcaaggagctaggggattctttaggggatgggtgcctaccttgcttggttacagtgctcagggggcttgcaagtttgggttctacgagttctttaagaagacctactcagatatggctgggcctgagaatgccgtgaagtacaagaccctaatttaccttgcagggtcagcttctgccgaggtaattgctgacatcgctctgtgcccctttgaagctgtcaaggtccgtgtgcagacacagcctggatttgcccgtggcttgagtgatgggcttcccaagttcatcaaagccgagggtgctgctgggctttacaagggcatcgttccgctctggggtcgccagattccttataccatgatgaagtttgcgtccttcgaaactattgttgagcttatctacaaacacgctgttcctgttccgaaggccgagtgcagcaagtcttcccagttgggtatcagctttgctggtggctacattgccggtgttttctgtgctattgtttctcatccggctgacaaccttgtctcgttcctcaacaatgccaagggtgctacagtgggcgatgctgttaagaagattggcatgttgggccttttcaccagagggctcccccttcgtatcgtcatgattggtactcttactggtgctcagtggggaatctatgatgcgtttaaagttatggtgggactcccgaccaccggcggtgctccaccagttgctccggtagaggaatcagcttgattgatttttgctgctatgacgatgtattcctggttgtggttattggtggatgggactgtatcagttacttgtttagcacccaaaatcttttgttattgtagcagatggttattgtctctatcagatgagaggaactcattaagcaggcgaaataggcctttttttgccccccgggaaagtttgatgcttgacataataagttttaggacagcaaggctgttagagcgcaggttctgccatcacctgtactgagggattcccatataatcttgtttacctccaatattacgctgtttatatcgtggatgctggtttctgaatggttggaaagtttacttgtacactactactccctccgttcctaaatataagaccttttagagattgtaccataaactacatacggatgtacatgagggagtagtagttatcttcatgctggcaaaagtttaatcttctagatgaagtcacgcacttccaaatcaaagtcacttgcctttcttattggctggtactgtttaacgaagaaagatgc

SEQ ID NO: 3104 - DNA, 1437 bp, Helianthus annuus
ggacggagacacaatctcagcgatttgagtcgtcgtcgtctccgtcatcactcaaatcgcattctccgatccacaacaatggcggtttccgacacctctcgtcaatctctcatccctaatttcatctacacttcttccagttctcctagcagcctgttaatgacgaaaacatcaaaccctagcttgtttccttcaacttcaccggctaaacagcaaaatagcttcgtgattcctgctccgaacgagcctctcggcaagatcgagatgtattctcctcggttttatgctgcttgtactgttggaggtattctcagctgtggactcactcatatgacggttactcctcttgatcttgtgaaatgtaacatgcagattgacccagctaaatataagagcatctcatctggtttcggagttctattgaaggagcaaggtgtaaggggattctttaggggatgggtccctaccctgcttggttacagtgctcagggtgcctgcaaatttggcttctacgaattcttcaagaaatattactccgacattgctggcccagagtatgctgccaagtacaagactttgatctaccttgctggttcagcatccgctgaggtcattgctgatgtggctctttgtcctatggaggcagtgaaggttcgtgtccaaacacaacctggttttgccaggggtttgggagatggacttccaaagtttgtcagatctgaaggcgcacttgggttgtacaagggattggtaccgctttggggacgtcaaataccatacacgatgatgaaatttgcttcatttgagacaattgtggagatgatgtacaagtacgcgatccctacaccaaagaacgagtgcagcaaatccttgcaacttggagttagttttgccggtggatacgtggccggtgtcctttgtgctgttgtttctcatcctgctgacaatcttgtttccttccttaacaatgccaagggtgcaagtgttggagatgctgtaaagaagcttggagtttggggtctcttcacccgagggcttcccctcaggattgtcatgattggaactctcactggagctcaatggggaatttatgatgcatttaaagtgtttgttgggctaccaacaacaggtggtgcggcacctgctccagttgccgagactgcggaagcataggtctttgtttggatatggagcctgagatgcttttttaccccttcaaactgagtcaataaacataggtgattttggagagttaactctttttgtttcgggacactagaaaggcctgcagactgcagtgcagattttaacttgtattttattttttggtattgaaagagggagaagtttttgttatcatgaaaagacaatgcaatttccaccttcggataataattggggcatatactattggttatacttctggccctgcctttt

SEQ ID NO: 3105 - DNA, 1641 bp, Euphorbia peplus
gtatgtctaaactaaaccattttggcagcgagaggagactaggcaggcagagaaactctcacgcctatctttcttcaaatctctcggctctgcatctgcaatcgcaatggcgtcctccgattcgtcgaggcagtccctaatccctagcttcctctattcttcatcagcctcctccaaatctctactgctttccaaggcactccactccaaccctgcggcgtcccagaactcctccacgatgaagacgacgtcgtcctcgcactttgcgatcccgtctccatcggagccaaggaagatcgagatgtattctccagctttttatgctgcgtgtactgccggaggtatcctcagctgtggtcttactcatatgactgtcactcctcttgaccttgtcaagtgcaatatgcagattgatcctgctaagtataaaagcatctcgtctggttttggagttctgctaaaggagcagggagccagaggcttcttcaggggttgggtgcctacccttcttggttacagtgctcaaggcgcctgcaaatttggattttacgagttcttcaaaaagtactactctgaccttgcggggccagagaatgctgccaagtataagaccttgatttaccttgctggttcggcatctgctgaagtgattgcagatattgctctttgccctatggaagcagtgaaggtccgagtacaaactcagcctggttttgccagaggcttgtcagatgggtttcccaaatttgtcaaagctgaaggggcacttgggttgtacaaaggtcttgttcctctatggggacgccagattccttatactatgatgaagtttgcatcatttgaggccattgttgagcagatctacaagaacgttatccccacgccaaagagtgaatgcagcaaacctctacaacttggtgttagttttgcgggtggttatattgctggtgttttatgtgctattgtgtcccatcctgctgataatctggtctcgttcctcaacaatgctaaaggcgcaactgttggtgatgctgtgaagaagctaggtgtggtgggcctatttactcgtggactccctcttcgaattgtcatgattgggacactaacaggtgcccaatggggtatctatgatgcattcaaagtttttgtgggactgccaacaactggtggtgttgctcctgttgctgcccctgatgccaagtaatgttggggatatcattatttcttacagtgtccttttgttgaagggagaagaagtataggagaaaaataaacctaggattagtgactcaaggcagtgaaggattattcttttttgcattcggaactcgcaacaaattcatttcaattttgctaattaagcttaagctccatagagagacggttttggtttcatcctgccataagaagtcgcttaatgtatgaaattttcacttgaatgttatgttaggaatacaagattaattcccctgtcatagacaacctaaaataaggggcagacttgggggatattatttgtttctgtccatcttctgatgataagctttttgattgtatgttgagaaatgcattagtaaaagttttgttacttattctggaattcgaagttatcaggcttattaatttgtttgttgtttggct

SEQ ID NO: 3106 - DNA, 1536 bp, Thalictrum flavum
atcaaatcgaacaaaaccaaaccctagttattagcaatggcgatttctgaaaacactcgacaatctcttttaccaagttacctttattcttcttctgcttatacgaaaaccctagatttagaaagttttcaaggaagaaaccctagtttaccatcatcatcgccatctccatcatcaaatggaaatgtttcttcaaagagctttcttattcaagcaccaagtgaacctggaaagattgagatgtattcaccatctttctatgctgcttgtactgctggtggaattcttagttgtggtcttactcatatgactgttactcctttggatcttgtcaagtgcaatatgcagattgatcctgcaaagtacaagagtatctcatctggttttggtgttctgtttaaagagcaaggagttagaggatttttcaggggctgggttccaactcttcttggttacagtgctcagggtgcctgcaagtttggattttatgagttcttcaagaagtactattctgatcttgctggacccgagaatgcagccaaatacaagaccttgatttaccttgctggttctgcatcagctgaactgattgctgatgttgctctttgtccaatggaggctgtcaaggtccgggtccaaactcagcctggatttgccagagggttgtcagatgggttacccaagtttgtgagatctgaaggttattctggattgtacaaggggctagttcctctctgggggcgtcagattccatatacaatgatgaaatttgcatctttcgagaccattgtggagatgatgtacaagtatgcaatccccacacctaaggaccagtgcagtaaacaattgcagttgggtgtcagctttgctggtggatatgttgctggtgttttgtgcgctattgtttctcaccccgctgacaatcttgtgtctttcctcaacaatgctaagggggcaactgttggtgatgccgtcaaaaagatgggtttgttgggtctttttactcgtggtcttcctctacgtattgttatgattggaactctcactggagcacagtggggaatatatgatgctttcaaagtttttgttggcctgcctactactggtggtgctgctcctgctgcccctgcatctactgaacttgcaaaggtataatactggcaggaattcaaagcatttggatggttgtgatttgatgagcttagaagtgaagatgttgtcgaagaataataattgtagggttgctgctctgccctggtgatacacttggcaggtggggattgcattcttttaattttgctttacaaaaggagatgtgttaaaattttcttatctacatattagtttcttgaatttttgaggatggttttgagatcattcttgcgagacaaacctgtgcaatctaacatatataggtgatgacattaatccccaataggaagttaaacctgcaataacaaacaaacaagggattttggcttggtgtatatctattaatattttattgtctattactttggttggtattgtcgtaat

SEQ ID NO: 3107 - DNA, 2072 bp, Pennisetum glaucum
gcccgctgcggagcagagctgtgtctgtcgtgtgctggtggctgccgtcgcggtaaaaacaggggaggggagacgaggacgcggccgctgcctctgcctctgcctgccgcacatgctttaagtccacactccccaccgccccagatctctccgcctctcttccaacctccccacattccccggcgcgcccctccttcccccgcgcggccgcaaccgccgccgtcaggagcgagatcggcgcggctcctgtatctgtcggtgggaagagacccgcgtgtcggtgaggaggcgggtgtgggaaggaagtgaagtgaagtgaaggaaggaaggaaggatggcggcgggcggcagatccgtcgcgtgctgcgccgccgtgctgctcgcggccgcgctgctcctctccgcaccgactgccacagaggcttacgattcattggatccaaacggcaacatcactataaaatgggatattatgcaatggactcctgatggatatgttgctgttgtcacaatgttcaactaccaacaattccggcacattggggcacctggttggcagcttgggtggacatgggcaaagaaggaggtcatatggtcgatggttggggcacagactaccgaacagggtgactgctcgaagttcaagggcaacactccccactgctgcaagaaagatcccacaatcgttgatttacttccaggcactccatacaacatgcagattgccaattgctgcaaagcaggagttataaatacatttaatcaggacccggcaaatgctgctgcctccttccagattagtgtgggtcttgctggtactaccaataagactgttaaggtgccaaagaacttcactcttaagactccaggtcctgggtacacatgtgggcgtgctcttgttggcaggccaacaaagtttttctccccggatgggcgcagggcaacccaagctcttatgacatggaatgtgacttgcacatattcccaatttcttgctcaaaaaactccaacctgctgtgtttctatgtcatcattttacaatgacacaattgtgaactgcccaacatgctcttgtggctgccaaaatccaagtggatcaaactgtgtgaatgaggattcacctaacctgcaatctgcaattgatggccctggaaaatggactggtcagcctcttgtacaatgcacttcccacatgtgcccgataagaatccactggcatgtgaagctcaactacaaggaatactggagagtgaaaatcactatcaccaacttcaatttccgcatgaattacacgcagtggaacttagtcgttcaacatccaaactttgataatatcactcagctgttcagcttcaactacaaacctcttaccccatatggtggtggcataaatgatacggctatgttctggggtgtgaaattctacaatgatttgctgatgcaagctggtaaacttgggaatgtgcaatcagaactacttctccgcaaggactccaaggatttcacctttgaaaagggatgggccttcccacgccgagtgtatttcaatggtgacaattgtgtcatgccatctcccgaaaattacccatggttgcccaacgcaagccctctaacaaaacaaccattgacactcccactcttagtattctgggttgtgttggctactctgttggcatatgcatgatgagtgggatcaagaggtttagtgagtttcaagttgatgtcagattccatgaggtgcactgcagcagaccatttgttcattcaattccatggttgcacaaaagagatgacaccacgcccgagaaaagaagtttacatgtgtgtgttcttgtaatttaaagggtcgaaatgtatttcttgtttggtatatactggccccacaacacttcggtgaacttagttactgcaaattaggtaattacagttgcaccttttgtattttatagcaaactcagaatttttcattgaattatatgactgctcttcttgtagtaaatgcgcggtttttgtgttgtaagatctgttgaacagacaagacaatgatgattgagatcactaagttctggtgt

SEQ ID NO: 3108 - DNA, 1999 bp, Hordeum vulgare
gtgagggagcacactcgcagacggagcgcgtctcgtcgcagtaaaaactggggagacggccgcggccgcacatgctttaagtcccactcccaccaccaccacctgctcagtcgccgcagatctccagctccccccatcatcggcgggcgcggccgcattcctcgccgtacggagcgaagcggggatcggtgggtgggtaggtgcggctgctggggagtgtcggtggggtagcgcgggaggaaaaatggcgccggttggtggcgtcgccgggggctccagatccgcggcctgctgcgccgtgctgctcgcggcggtgctcttcttctccgcgccggccaccacagaggcttatgattcgctggatccaaatggcaacatcacgataaaatgggatattatttcgtggactccggatggttatgttgcaacggtcacaatgttcaactaccagcagttccgacacatatctgcgcctgggtggcagctagggtggtcgtgggcaaagaaagaggtcatctggtcgatggtgggggctcaggccactgagcagggtgattgctcaaaattcaagagcgcccctccccattgctgcaagagagatccgacgatcgtcgatcttcttccaggcaccccattcaaccagcaaattgccaactgttgcaaggcaggagttataaagacatttaaccaggacccaggaaatgctgcttcctccttccagattagtgttggtcttgctgggactaccaataagacggttaagatgccaaagaacttcacccttaaggccccaggtccagggtacacatgtgggcgtgctcttgttggcaggcctaccaagtattactcgtcagacgggcgcagggtaacccaagctctcatgtcgtggaatgtaacctgcacatactcccaatttcttgctcagaagactccgacctgctgtgtatctctctcatcgttttataatgacactattgtgaactgcccaacgtgctcttgcggttgccaaaacaatattactcgtccaggaagctgtgtaaatgacaattcaccttatttacaatctgccatcaatggccctggcaaactaaccgggcagcctcttgtccaatgtacgtcccacatgtgcccgataagaatccattggcatgtgaagctcaactacaaggactactggagagtgaaagtcaccatcacaaacttcaactaccgcatgaattatacagactggaacttggttgcccagcatcctaacttcgataatatcacaaagctgttcagcttcaattataagccacttacaccatatggaggccgcataaatgataccgcaatgttctggggaatgaagttctacaatgatttgctcaatcaagctggtccgcttggaaacgcgcagtcagaactactcatgcggaaggactcagagactttcaccttccagaaaggatgggcgtttccgcggcgtgtgtacttcaatggtgataactgtgtcatgccgtctcctgatgactatccatggttgcctagtgcaagccctctaacaaaacaaccatggacactcccactcttggtgttctggactgcgttggctactttgctggcttactatgtatgatgaatgagacccaagagattcagcgagcttcaagtcgctgtcaggttccatgatgtgcgcggcaacaggtcatttgttcattcaattccacggttgcatagaagagacgggtgtcgcgctgaggaaagctgatatgtttgtgttttgtaagttaaaaggggctggaaatgtttttcttgtttggtatatactggccatggaaactttggtgaacttagttactgcaatttaggtaattacggttgcaccttctgtattttatagcagacgcagacatttaatttgaatcatatgactgcctttctttgtagtgattgtatgggttacataataatgtttttgtataatttgtgaaactgagaggatgctgttggttgagat

SEQ ID NO: 3109 - DNA, 1880 bp, Pseudoroegneria spicata
  misc_feature (1251)..(1251): n is a, c, g, or t
  misc_feature (1489)..(1489): n is a, c, g, or t
  misc_feature (1616)..(1616): n is a, c, g, or t
  misc_feature (1743)..(1743): n is a, c, g, or t
ctcgcatttctcgccgtacagagcgaagcggggatcggtgggtgggtaggtgcggctgctgccagtggaagggagagtgtcggtggagtagcgggggaggaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcacgataaaatgggatattatttcgtggactcctgatggttatgttgcaaccgtcacaatgttcaactaccagcagttccgacacatatctgcacctgggtggcagctggggtggtcgtgggcaaagaaagaggtcatctggtcgatggtgggggctcaggccactgagcagggtgattgctcaaaattcaagagtgcccctccccattgctgcaagagagatccaacggttgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttaaggccccaggtccggggtacacatgtgggcgtgctcttgttggcaggcctaccaagtattactcgtcagacgggcgcagggtaacccaagctctcatgtcgtggaatgtaacctgcacatactcccaatttcttgctcagaagactccgacctgctgtgtatctctctcatctttttataatgacactattgtgaactgcccaacgtgctcttgcggctgccaaaacaatattactcgtccaggaagctgcgtaaatgacaattcaccttatttacaatctgccatcaatggccctggcaaattaaccggccagcctcttgtccaatgtacttcccacatgtgcccgataagaatccattggcatgtgaagctcaactacaaggactactggagagtgaaagtcaccatcacaaacttcaactaccgcatgaattatacagactggaacttggttgcgcagcatcctaacttcgataacatcacaaagctgttcagcttcaactataagccacttaccccatatggaggccgcataaatgacaccgcaatgttctggggaatgaagttctacaatgatttactcaatcaagctggtccgcttggaaangcgcagtcagagctactcatgcggaaggactcggagactttcaccttccaaaaaggatgggcgtttccacggcgtgtgtacttcaatggtgataactgtgtcatgccgtctcccgatgattatccatggctgcctagtgcaagccctctaacaaaacaaccatggacgctcccactcttggtgttctggactgcgttggctactttgctggcttattacgtatgatgaaatgaggccnagagatttagcgagcttcaagtcgcggtcaggttccacgaggtgcacggcaacaggtcatttgtttattcaattccacggttgcatagaagacacgggtgccatgctgaggaaagctgatatgtttntgttttgtaagttaaaaggggctggaaatgtatttcttgtttggtatatactggccacgaaactttggtgaacttagttactgcaatttaggtaattacggttgcaccttctgtattttatagcagncgcagacattttaattgaattatatgactgcctttcttgtagtgattgtatgagttacataataatgtttttgtataatttgttaaactgagaggatgctgttggttgagataacaatctagcattgcttttcctga

SEQ ID NO: 3110 - DNA, 1921 bp, Festuca arundinacea
  misc_feature (334)..(334): n is a, c, g, or t
  misc_feature (855)..(855): n is a, c, g, or t
  misc_feature (873)..(873): n is a, c, g, or t
  misc_feature (885)..(885): n is a, c, g, or t
  misc_feature (1289)..(1289): n is a, c, g, or t
  misc_feature (1371)..(1371): n is a, c, g, or t
  misc_feature (1384)..(1384): n is a, c, g, or t
  misc_feature (1425)..(1425): n is a, c, g, or t
gcacgaggcgcacccgcgcgcgtctcgtcgcagtaaaaacaggggagacggcagcggccgcacatgctttaagttccactcctaccacctcctcctcgcccccagccgcatcagatctccagctcccccccccccctccccggcgggcgagcgccaccgcggcagcattcgccgccgtaccgagtgaagcggggatcggtgtagctgttgcctgcggaagagggagtgtcggtggagcagtagcgggtgggaaggaaaatggcggcggttggtggatccgcggcggcctgctgcgccgtgctgctcgccgcggtgctgctcttctccgcaccgnccaccacagaggcttatgattcgctggatccaaatggcaacatcaccataaaatgggatattattagttggactcctgatggttatgttgcaacagtcacaatgttcaactaccaacagttccgacacatccaggcgcctgggtggcagctggggtgggcgtgggcgaagaaggaggtcatctggtcgatggtgggggctcaggccaccgagcagggtgattgctcaaagttcaagagcagccctccccattgctgcaagaaggagccaaatattgttgatcttcttccaggcaccccattcaaccagcaaattgccaattgctgcaaggcgggagttataaagacatttaaccaggacccagcaaatgctgcttcctccttccagatcagtgtaggtcttgctgggactaccaataagacggttaaggtgccgaaaaacttcactctcaaggccccaggtcctgggtacacatgtgggcgtgctcttgttggcaagcctaccaggttttactcctcagangggcgcagggcaacccangctcttatgacntggaatgtaacctgcacatactcccaatttcttgctcagaagactccaacctgctgtgtatctctgtcatcattttacaatgacactattgtgaactgcccaacatgctcttgtggctgtcaaaacaatgtcactcatccaggaagctgcgtaaatgacaattcgccttatttacaatctgccatcaatggtcctggcaaaattaccggccaacctcttgtccaatgtacttcccacatgtgcccgataagagtccactggcatgtgaagctcaactacaaggactactggagagtgaaagtcactatcacaaacttcaactaccgcatgaactattcagattggaacttagttgcccagcatcctaacttcaataatatcaccaagctttttagcttcaactncaagccacttaccccatatggaggccgcataaatgataccgcgatgttctggggaatgaagttctacaatgatttccttaancaagctggtccgntaggaaatgcgcagtcagaagtactgatgcagaaggactcngagactttcaccttggataagggatgggcctttccaaggcgtgtgtacttcaatggtgataactgtgtcatgccgtcccctgactcatatccgtggttgcctaatgcaagccctctaacaaaacaaccattgacgctcccagtcttggtattctcgattgtgttggctactttgctggcttatgtatgatgaatgagatcaaaagaatcagcgagcttcaagttgttgtcaggtcccatgaggtgcgcggcaacgggtcatttgctcattcagttacacggttgcataggagagacaggtgtcgcgcagaggaaagctgatatatgtgtgttttgtaagttgttaaaagggccggaaatgtatttgttgtttggtatatactggccacaacactttggtgaacttagttactgcaatttaggtgattacagttgcaccttttgtatttatagcaaacggatatttcattgaattatatgactggctttcttgtagt

SEQ ID NO: 3111 - DNA, 2092 bp, Triticum aestivum
ccgggctgcaggaatcggcacgaggggcgcgcaaggaagcgtccgtgaggtgagcagactcgcagacggagcgcgtctcgtctcgtcgctgtaaaaactggggagacggccgcggccgcacatgctttaagtcccactccctcctcctccaccaccacctgctcagtcgcctcagatctccagctccccccttcatcggcgggcgcggccgcattcctcgccgtacagagcggagcggggatcggtgggtgggtaggtgcggctgcgggagagtgtcggtggaggagtagcggggcaggaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcaccataaaatgggatattatttcgtggactcctgatggttatgttgcaacagtcacaatgtttaactaccagcagttccgacacatacctgcacctgggtggcagctggggtggtcgtgggcaaagaaagaggtcatctggtcgatggtgggggctcaggctactgagcagggtgattgctccaaattcaagagtgcccctccccattgctgcaagagagatccaacgattgtcgatcttcttccgggcaccccattcaaccagcaaattgctaattgttgcaaggcaggagttataaagacatttaaccaggacccaggaaatgcagcatcctccttccagattagtgtaggtcttgctgggactaccaataagacggttaagatgccgaaaaacttcacccttagggccccaggtccagggtacacatgtgggcgtgctcttgttggcaggcctaccaagtattactcgtcagacgggcgcagggtaacccaagctctcatgtcgtggaatgtaacctgcacatactcccaattccttgctcagaagactccaacctgctgtgtatctctctcatcgttttataatgacactattgtgaactgcccaacgtgctcttgcggctgccaaaacaacattactcgtccaggaagctgtgtaaatgacaattcgccttatttgcaatctgccatcaatggccctggcaaattaaccggccagcctcttgtccaatgtacttcccacatgtgcccgataagaatccattggcatgtgaagctcaactacaaggactactggagagtgaaagtcaccatcacaaacttcaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggtccgcttggaaacgcgcagtcagaactactcatgcggaaggactcagagactttcaccttccaaaaaggatgggcgtttccacggcgtgtgtacttcaatggtgataactgtgtcatgccgtctcccgatgactatccatggttgcctagtgcaagccctctgacaaaacaaccatggacgctcccactattggtgttctggactgcgttggctactttgctggcttattacgtatgatgaaacgagaccaagagattcagcgagcttcaaggcgctgtcatgttccacgaggtgcgcggcaacaggtcatttgttcattcaattccactgttgcatagaagacgcgggtgccgtgctgaggaaagctgataagtgtgtgtgttttgtaagttaaaaagggctgaaaatgtgtttcttgttttggtatatactggccatgaaactttggtgaacttagttactcgaatttaggtaattatggttgcaccttctgtattttatagcagacgcagacattttaattgaatcatatgactgcctttcttgtagtgattgtatgggttacataataatgttttgtacaatttgttaaaccgagagatgctgttggttgagacaaaaaaaaaaagcccacctgcccgggcggccgctcga

SEQ ID NO: 3112 - DNA, 2108 bp, Triticum aestivum
gcagactcgcagacggagcgcgtctcgtctcgtcgctgtaaaaactggggagacggccgcggccgcacatgctttaagtcccactccctcctcctccaccaccacctgctcagtcgcctcagatctccagctccccccttcatcggcgggcgcggccgcattcctcgccgtacagagcggagcggggatcggtgggtgggtaggtgcggctgcgggagagtgtcggtggaggagtagcggggcaggaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcaccataaaatgggatattatttcgtggactcctgatggttatgttgcaacagtcacaatgtttaactaccagcagttccgacacatacctgcacctgggtggcagctggggtggtcgtgggcaaagaaagaggtcatctggtcgatggtgggggctcaggctactgagcagggtgattgctccaaattcaagagtgcccctccccattgctgcaagagagatccaacgattgtcgatcttcttccgggcaccccattcaaccagcaaattgctaattgttgcaaggcaggagttataaagacatttaaccaggacccaggaaatgcagcatcctccttccagattagtgtaggtcttgctgggactaccaataagacggttaagatgccgaaaaacttcacccttagggccccaggtccagggtacacatgtgggcgtgctcttgttggcaggcctaccaagtattactcgtcagacgggcgcagggtaacccaagctctcatgtcgtggaatgtaacctgcacatactcccaattccttgctcagaagactccaacctgctgtgtatctctctcatcgttttataatgacactattgtgaactgcccaacgtgctcttgcggctgccaaaacaacattactcgtccaggaagctgtgtaaatgacaattcgccttatttgcaatctgccatcaatggccctggcaaattaaccggccagcctcttgtccaatgtacttcccacatgtgcccgataagaatccattggcatgtgaagctcaactacaaggactactggagagtgaaagtcaccatcacaaacttcaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggtccgcttggaaacgcgcagtcagaactactcatgcggaaggactcagagactttcaccttccaaaaaggatgggcgtttccacggcgtgtgtacttcaatggtgataactgtgtcatgccgtctcccgatgactatccatggttgcctagtgcaagccctctgacaaaacaaccatggacgctcccactattggtgttctggactgcgttggctactttgctggcttattacgtatgatgaaacgagaccaagagattcagcgagcttcaaggcgctgtcatgttccacgaggtgcgcggcaacaggtcatttgttcattcaattccactgttgcatagaagacgcgggtgccgtgctgaggaaagctgataagtgtgtgtgttttgtaagttaaaaagggctgaaaatgtgtttcttgttttggtatatactggccatgaaactttggtgaacttagttactcgaatttaggtaattatggttgcaccttctgtattttatagcagacgcagacattttaattgaatcatatgactgcctttcttgtagtgattgtatgggttacataataatgttttgtacaatttgttaaaccgagagatgctgttggttgagataacaatctagcattgtttttcctggccccccttatgtttgaagcaagtgctagaaataacacaaatcaaaagaagcacgcgacagtactcaggctaggctgaacag

SEQ ID NO: 3113 - DNA, 1989 bp, Secale cereale
gacggccgcggccgcacatgctttaagtcccactccctctccctcctccatcatcaccaccaccaccacctgctcagtcgccccagatctccggctccccctccctcggcgggcgcggccgcattcctcgccgcacggagcgaagcggggatcggtgggtgggtaggtgcagctgctgccagcggaagggagagtgtcggtggagtagcggggaaggaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcaccataaaatgggatattatttcgtggactcctgatggttatgttgcaacagtcacaatgttcaactaccagcagttccgacacatacctgcacctgggtggcagcttgggtggtcgtgggcaaagaaagaggttatctggtcgatggtgggggctcaggctactgagcagggtgattgctcaaaattcaagagtgcccctccccattgctgcaagagagatccaacaattgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttagggccccaggtccggggtacacatgtgggcgtgctcttgttggcaggcctaccaagtattactcgacagacgggcgcagggtaacccaagctctcatgtcgtggaatgtaacctgcacatactcccaatttcttgctcagaagactccgacctgctgtgtatctctctcatcgttttataatgacactattgtgaactgcccaacttgctcttgcggctgccaaaacaatattactcgtccaggaagctgtgttaatgacaattcgccttatttacaatctgccatcaatggccctggcaaattaaccggccagcctcttgtccaatgtacttcccacatgtgcccgataagaatccattggcatgtgaagctcaactacaaggactactggagagtgaaagtgaccatcacaaacttcaactaccgcatgaattatacagactggaacatggttgcccagcatcctaacttcgataatatcaccaagctgttcagcttcaactataagccacttaccccatatggaggccgcataaatgacactgcaatgttctggggaatgaagttctacaatgatttgctcaaccaagctggtccacttggaaacgcgcagtcagaactactcatgcggaaggactccgagactttcaccttccaaaaaggctgggcgtttccgcggcgtgtgtacttcaatggtgataactgtgtcatgccatctcccgatgactatccatggttgcctagtgcaagccctctgacaaaacaaccatggacactgccactcttggtattctggactgtgttggctactttgctggcttactacgtatgatgaatgagaccacgagaatcagtgagcttcaagtttgctgtcaggttccacgatgtgcgcggcaacaagtcatttgttcattaaattccacggttgcatagaagagacgggtgtcgcgctaaggaaagctgatatgtttgtgttttgtaagttaaaagggggctggaaatgtatttcttgttttggtatatactggccacggaactttggtgaacttagttactcgaatttaggtaattatggttgcaccttctgtattttatagcagacgcagacattttaattgaattatatgactgcctttcttgtagtgattatatgagttacatataataatgtttgtatgtacaatttgttaaactgaggatgcttgagataacaatctagcattgcttt

SEQ ID NO: 3114 - DNA, 2070 bp, Secale cereale
gcagacggagcgcgtctcgtctcgtctcgtcgcagtaaaaactggggagacggccgcggccgcacatgctttaagtcccactccctcctccatcaccaccaccaccacctgctcagtcgccccagatctccggctcccccctccctcggcgggcgcggccgcattcctcgccgcacggagcgaagcggggatcggtgggtgggtaggtgctgctgctgccagcggaagggagagtgtcggtggagtagcggggcagggaaaatggcgccggttggtggcgtcgccgggagctccagatccgcggcctgctgcgccgtgctgctcgcggcggtgctcttcttctccgcaccggccaccacagaggcttatgattcgctggatcctaatggcaacatcaccataaaatgggatattatttcgtggactcctgatggttatgttgcaacagtcacaatgttcaactaccagcagttccgacacatacctgcacctgggtggcagctggggtggtcgtgggcaaagaaagaggttatctggtcgatggtgggggctcaggctactgagcagggtgattgctcaaaattcaagagtgcccctccccattgctgcaagagagatccaacgattgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttagggccccaggtccggggtacacatgtgggcgtgctcttgttggcaggcctaccaagtattactcgacagacgggcgcagggtaacccaagctctcatgtcgtggaatgtaacctgcacatactcccaatttcttgctcagaagactccgacctgctgtgtatctctctcatcgttttataatgacactattgtgaactgcccaacttgctcttgcggctgccaaaacaatattactcgtccaggaagctgtgtaaatgacaattcgccttatttacaatctgccatcaatggccctggcaaattaaccggccagcctcttgtccaatgtacttcccacatgtgcccgataagaatccattggcatgtgaagctcaactacaaggactactggagagtgaaagtcaccatcacaaacttcaactaccgcatgaattacacagactggaacatggttgcccagcatccgaacttcgataatatcacaaagctgttcagcttcaactataagccacttaccccatatggaggccgcataaatgacaccgcaatgttctggggaatgaagttctacaatgatctgctcaatcaagctggtccacttggaaatgcgcagtcagaactactcatgcggaaggactcagagactttcaccttccaaaaaggatgggcgtttccgcggcgtgtgtacttcaatggtgataactgtgtcatgccatctcccgatgactatccatggttgcctagtgcaagccctttgacaaaacaaccatggacactgccactcttggtattctggactgtgttggctactttgctggcttactacgtatgatgaatgagaacaagagattcagtgagcttcaagtttgctgtcaggttccacgatgtgcgaggcaaccggtcatttgttcattaagttccacggttgcatagaagagacgggtgtcgtgctaaggaaagctgatatgtttgtgttttgtaagttaaaagggggctggaaatgtatttcttgttttggtatatactggccacgaaactttggtgaacttagttactcgaatttaggtaattatggttgcaccttctgtattttatagcagacgcagacattttaattgaattatatgactgcctttcttgtagtgattatatgagttacatataataatgttttgtacaatttgttaaactctcttgagataacaatctagctatttgttttcctgtactaacccaaaaaaaaaactagaagactacgccgaacgga

SEQ ID NO: 3115 - DNA, 1806 bp, Secale cereale
attcctcgccgcacggagcgaagcggggatcggtgggtgggtaggtgcggctgctggagagtgtcggtggaggagtagcggggcaggaaaaatggcgccggttggtggcgtcgccgggagctccagatccgcggcctgctgcgccgtgctgctcgcggcggtgctcttcttctccgctccggccaccacagaggcttatgattcgctggacccaaatggcaacatcaccataaaatgggatattatttcgtggactcctgatggttatgttgcaacagtcacaatgttcaactaccagcagttccgacacatacctgcacctgggtggcagctggggtggtcgtgggcaaagaaagaggttatctggtcgatggtgggggctcaggctactgagcagggtgattgctcaaaattcaagagtgcccctccccattgctgcaagagagatccaacgattgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttagggccccaggtccggggtacacatgtgggcgtgctcttgttggcaggcctaccaagtattactcgacagacgggcgcagggtaacccaagctctcatgtcgtggaatgtaacctgcacatactcccaatttcttgctcagaagactccgacctgctgtgtatctctctcatcgttttataatgacactattgtgaactgcccaacttgctcttgcggctgccaaaacaatattactcgtccaggaagctgtgtaaatgacaattcgccttatttacaatctgccatcaatggccctggcaaattaaccggccagcctcttgtccaatgtacttcccacatgtgcccgataagaatccattggcatgtgaagctcaactacaaggactactggagagtgaaagtgaccatcacaaacttcaactaccgcatgaattatacagactggaacatggttgcccagcatcctaacttcgataatatcaccaagctgttcagcttcaactataagccacttaccccatatggaggccgcataaatgacactgcaatgttctggggaatgaagttctacaatgatttgctcaaccaagctggtccacttggaaacgcgcagtcagaactactcatgcggaaggactccgagactttcaccttccaaaaaggctgggcgtttccgcggcgtgtgtacttcaatggtgataactgtgtcatgccatctcccgatgactatccatggttgcctagtgcaagccctctgacaaaacaaccatggacactgccactcttggtattctggactgtgttggctactttgctggcttactacgtatgatgaatgagaccacgagaatcagtgagcttcaagtttgctgtcaggttccacgatgtgcgcggcaacaagtcatttgttcattaaattccacggttgcatagaagagacgggtgtcgcgctaaggaaagctgatatgtttgtgttttgtaagttaaaggggctggaaatgtatttcttgttttggtatatactggccacggaactttggtgaacttagttactcgaatttaggtaattatggttgcaccttctgtattttatagcagacgcagacattttaattgaattatatgactgcctttcttgtagtgattatatgagttacatataataatgtttgt

SEQ ID NO: 3116 - DNA, 1951 bp, Triticum aestivum
cgtctcgtctcgtcgcagtaaaaactggggagacggccgcggccgcacatgctttaagtcccactccctcctcctccaccaccaccacctgctcagtcgcctcagatctccagctgcccccttcctcggcgggcgcggccgcattcctcgccgtgcagagcggagcggggatcggtgggtgggtagctgcagctgctgctggggagtgtcggtggaggaaatggcgccggttggtggcgtcgccgggagctccagatccgcggcctgctgcgccgtgctgctcgcggcggtgctcttcttctccgcaccggccaccacagaggcttatgattcgctggatccaaacggcaacatcaccataaaatgggatattatttcgtggactcctgatggttatgtggcaacagtgacaatgttcaactaccagcagttccgacacatacctgcacctgggtggcagctgggatggtcatgggcaaagaaagaggtcatctggtcgatggtgggggctcaggctactgagcagggtgattgctcaaaattcaagagtgcccctccccattgctgcaagagagatccaacgattgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttagggccccaggtccggggtacacatgtgggcgtgctcttgttggcaggcctaccaagtattactcgtcagacgggcgcagggtaacccaagctctcatgtcgtggaatgtaacctgcacatactcccaatttcttgctcagaagactcccacctgctgtgtatctctctcatcgttttataacgacactattgtgaactgcccaacgtgctcttgtggctgccaaaacaatattactcgtccaggaagctgtgtaaatgacaattcgccttatttacaatctgccatcaatggccctggcaaattaactggccagcctcttgtccaatgtacttcccacatgtgcccgataagaatccattggcatgtgaagctcaactacaaggactactggagagtgaaagtcaccatcacaaacttcaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggcccgcttggaaacgcgcagtcagaactactcatgcggaaggactcggagactttcaccttccaaaaaggatgggcgtttccccggcgtgtgtacttcaatggtgataactgtgtcatgccatctcccgatgactatccatggttgcctagtgcaagccctctgacaaaacaaccatggacgctcccactattggtgttctggactgtgttggctactttgctggcttattacgtatgatgaaatgagaccaagagattcagcgagcttcaagtcgctgtcatgttccatgaggtgcgcggcaacaggtcatttgttcattccattccacggttgcatagaagacacgggtgccgcgctgaggaaagctgatacgtgtgtgtgttttgtaagttaaaaagggctgaaaatgtatttcttgttttggtatatactggccatgaaactttggtgaacttagttactcaaatttaggtaattatggttgcaccttctgtattttatagcagacgcagacattttaattgaatcatatgactgcctttcttgtagtgattgtatgagttacataataatgttttgtacaatttgttaaac

SEQ ID NO: 3117 - DNA, 2013 bp, Triticum aestivum
gagcagactcgcagacggagcgcgtctcgtctcgtcgcagtaaaaactggggagacggccgcggccgcacatgctttaagtcccactccctcctgctccaccaccaccgcctgctcagtcgcctcagatctccagctcccccccttcatcggcgggcgcggccgcattcctcgccgcacggagcggagcggggatcggtgggtgggtaggtgcagcagctgctggagagtgtcggtggaggagcagcggggcaggaaaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcaccataaaatgggatattatttcgtggactcctgatggttatgttgcaacagtcacaatgttcaactaccagcagttccgacacatacctgcacctgggtggcagctggggtggtcgtgggcaaagaaagaggttatctggtcgatggtgggggctcaggctactgagcagggtgattgctcaaaattcaagagtgcccctccccattgctgcaagagagatccaacgattgtcgatcttcttccgggcaccccattcaaccagcaaattgctaattgttgcaaggcaggagttatcaagacatttaaccaggacccaggaaatgcagcatcctccttccagattagtgtaggtcttgctgggactaccaataagacggttaagatgccgaaaaacttcacccttagggcccctggtccggggtacacatgtgggcgtgctcttgttggcaggcctaccaagtattactcgtcagacgggcgcagggtaacccaagctctcatgtcgtggaatgtaacctgcacatactcccaatttcttgctcagaagactccaacctgctgtgtatctctctcatcgttttataatgacactatcgtgaactgcccaacgtgctcttgcggctgccaaaacaatattactcgtccaggaagctgtgtaaatgacaattcgccttatttgcaatctgccatcaatggccctggcaaattaaccggccagcctcttgtccaatgtacttcccacatgtgcccgataaggatccattggcatgtgaagctcaactacaaggactactggagagtgaaagtcaccatcacaaacttcaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggtccgcttggaaacgcgcagtcagagctactcatgcggaaggactcagagacttttaccttccaaaaaggatgggcgtttccacggcgtgtgtacttcaatggtgataactgtgtcatgccgtctcccgatgattatccatggttgcctagtgcaagccctctaacaaaacaaccatggacactcccactcttggtattctggactgcgatggctactttgctggcttattatgtctgatgaatgagttacaagagatccagcgagcttcaagtcgctgtcatgttccatgaggtgcgcggcaacaggtcatttgttcattcaattccacggttgcatagaagacatgggtgccgcgctgaggaaagctgatacgtgtgtgtgttttgtaagttaaaaagggctgaaaatgtatttcttgttctggtatatactggccacgaaactttggtgaacttagttactggaacttaggtaattatggttgcaccttctgtattttatagcagacgcagacattttaattgaattatatgactgcctttcttgtagtgattgtatgagttacacaataatgttttgtacaatttgttaaactgagaggatgctgttggttgaga

SEQ ID NO: 3118 - DNA, 2012 bp, Triticum aestivum
cgcagacggagcgcgtctcgtctcgtcgcagtaaaaactggggagacggccgcggccgcacatgctttaagtcccactccctcctgctccaccaccaccgcctgctcagtcgcctcagatctccagctcccccccttcatcggcgggcgcggccgcattcctcgccgcacggagcggagcggggatcggtgggtgggtaggtgcagcagctgctggagagtgtcggtggaggagcagcggggcaggaaaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcaccataaaatgggatattatttcgtggactcctgatggttatgttgcaacagtcacaatgttcaactaccagcagttccgacacatacctgcacctgggtggcagctggggtggtcgtgggcaaagaaagaggttatctggtcgatggtgggggctcaggctactgagcagggtgattgctcaaaattcaagagtgcccctccccattgctgcaagagagatccaacgattgtcgatcttcttccgggcaccccattcaaccagcaaattgctaattgttgcaaggcaggagttatcaagacatttaaccaggacccaggaaatgcagcatcctccttccagattagtgtaggtcttgctgggactaccaataagacggttaagatgccgaaaaacttcacccttagggcccctggtccggggtacacatgtgggcgtgctcttgttggcaggcctaccaagtattactcgtcagacgggcgcagggtaacccaagctctcatgtcgtggaatgtaacctgcacatactcccaatttcttgctcagaagactccaacctgctgtgtatctctctcatcgttttataatgacactatcgtgaactgcccaacgtgctcttgcggctgccaaaacaatattactcgtccaggaagctgtgtaaatgacaattcgccttatttgcaatctgccatcaatggccctggcaaattaaccggccagcctcttgtccaatgtacttcccacatgtgcccgataaggatccattggcatgtgaagctcaactacaaggactactggagagtgaaagtcaccatcacaaacttcaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggtccgcttggaaacgcgcagtcagagctactcatgcggaaggactcagagacttttaccttccaaaaaggatgggcgtttccacggcgtgtgtacttcaatggtgataactgtgtcatgccgtctcccgatgattatccatggttgcctagtgcaagccctctaacaaaacaaccatggacactcccactcttggtattctggactgcgatggctactttgctggcttattatgtctgatgaatgagttacaagagatccagcgagcttcaagtcgctgtcatgttccatgaggtgcgcggcaacaggtcatttgttcattcaattccacggttgcatagaagacatgggtgccgcgctgaggaaagctgatacgtgtgtgtgttttgtaagttaaaaagggctgaaaatgtatttcttgttctggtatatactggccacgaaactttggtgaacttagttactggaacttaggtaattatggttgcaccttctgtattttatagcagacgcagacattttaattgaattatatgactgcctttcttgtagtgattgtatgagttacacaataatgttttgtacaatttgttaaactgagaggatgctgttggttgagataatctag

SEQ ID NO: 3119 - DNA, 2027 bp, Secale cereale
gagcgcgtctcgtctcgtctcgtcgcagtaaaaactggggagacggccgcggccgcacatgctttaagtcccactccctcctccatcaccaccaccaccacctgctcagtcgccccagatctccggctcccccctccctcggcgggcgcggccgcattcctcgccgcacggagcgaagcggggatcggtgggtgggtaggtgctgctgctgccagcggaagggagagtgtcggtggagtagcggggcagggaaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcaccataaaatgggatattatttcgtggactcctgatggttatgttgcaacagtcacaatgttcaactaccagcagttccgacacatacctgcacctgggtggcagctggggtggtcgtgggcaaagaaagaggttatctggtcgatggtgggggctcaggctactgagcagggtgattgctcaaaattcaagagtgcccctccccattgctgcaagagagatccaacgattgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttagggccccaggcccggggtacacatgtgggcgtgctcttgttggcaggcctaccaagtattactcgacagacgggcgcagggtaacccaagctctcatgtcctggaatgtaacctgcacatactcccaatttcttgctcagaagactccgacttgctgtgtatctctctcatcgttttataatgacactattgtgaactgcccaacgtgctcttgtggctgccaaaacaatattactcgtccaggaagctgtgtaaatgacaattcgccttatttacaatctgccatcaatggccctggcaaattaaccggccagcctcttgtccaatgtacttcccacatgtgcccgataagaatccattggcatgtgaagctcaactacaaggactactggagagtgaaagtcaccatcacaaacttcaactaccgcatgaattacacagactggaacatggttgcccagcatcctaactttgataatatcaccaagctgttcagcttcaactataagccacttaccccatatggaggccgcataaatgacactgcaatgttctggggaatgaagttctacaatgatttgctcaatcaagctggtccacttggaaatgcgcagtcagaactactcatgcggaaggattcagagactttcaccttccaaaaaggatgggcgtttccgcggcgtgtgtacttcaatggtgataactgtgtcatgccatctcccgatgactatccatggttgcctagtgcaagccctctgacaaaacaaccatggacactgccactcttggttttctggaccgtgttcgctactttgctggcttactacgtatgatgaatgagaccaagagattcagtgagcttcaagtttgctgtcaggttccacgatgtgcgcggcaacaagtcatttgttcattaaattccacggttgcatagaagagacgggtgtcgcgctaaggaaagctgatatgtttgtgttttgtaagttaaaagggggctggaaatgtatttcttgttttggtatatactggccacggaactttggtgaacttagttactcgaatttaggtaattatggttgcaccttctgtattttatagcagacgcagacattttaattgaattatatgactgcctttcttgtagtgattatatgagttacatataataatgtttgtatgtacaatttgttaaactgaggatgcttgagataacaatctagcattgcttttcc

SEQ ID NO: 3120 - DNA, 1863 bp, Triticum aestivum
tgcccccttcctcggcgggcgcggccgcattcctcgccgtgcagagcggagcgggggtcggtgggtgggtagctgcagctgctgctggggagtgtcggtggaggaaatggcgccggttggtggcgtcgccgggagctccagatccgcggcctgctgcgccgtgctgctcgcggcggtgctcttcttctccgcaccggccaccacagaggcttatgattcgctggatccaaacggcaacatcaccataaaatgggatattatttcgtggactcctgatggttatgtggcaacagtgacaatgttcaactaccagcagttccgacacatacctgcacctgggtggcagctgggatggtcatgggcaaagaaagaggtcatctggtcgatggtgggggctcaggctactgagcagggtgattgctcaaaattcaagagtgcccctccccattgctgcaagagagatccaacgattgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttagggccccaggtccggggtacacatgtgggcgtgctcttgttggcaggcctaccaagtattactcgtcagacgggcgcagggtaacccaagctctcatgtcgtggaatgtaacctgcacatactcccaatttcttgctcagaagactcccacctgctgtgtatctctctcatcgttttataacgacactattgtgaactgcccaacgtgctcttgtggctgccaaaacaatattactcgtccaggaagctgtgtaaatgacaattcgccttatttacaatctgccatcaatggccctggcaaattaactggccagcctcttgtccaatgtacttcccacatgtgcccgataagaatccattggcatgtgaagctcaactacaaggactactggagagtgaaagtcaccatcacaaacttcaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggcccgcttggaaacgcgcagtcagaactactcatgcggaaggactcggagactttcaccttccaaaaaggatgggcgtttccccggcgtgtgtacttcaatggtgataactgtgtcatgccatctcccgatgactatccatggttgcctagtgcaagccctctgacaaaacaaccatggacgctcccactattggtgttctggactgtgttgtctactttgctggcttattacgtatgatgaaatgagaccaagagattcagcgagcttcaagtcgctgtcatgttccatgaggtgcgcggcaacaggtcatttgttcattccattccacggttgcatagaagacacgggtgccgcgctgaggaaagctgatacgtgtgtgtgttttgtaagttaaaaagggctgaaaatgtatttcttgttttggtatatactggccatgaaactttggtgaacttagttactcaaatttaggtaattatggttgcaccttctgtattttatagcagacgcagacattttaattgaatcatatgactgcctttcttgtagtgattgtatgagttacataataatgttttgtacaatttgttaaaccgagaggatgctgttggttgagataa

SEQ ID NO: 3121 - DNA, 2056 bp, Triticum aestivum
gccgcggccgcacatgctttaagtcccactccctcctcctccaccaccacctgctcagtcgcctcagatctccagctccccccttcatcggcgggcgcggccgcattcctcgccgtacagagcggagcggggatcggtgggtgggtaggtgcggctgcgggagagtgtcggtggaggagcagcggggcaggaaaaatggcgccggttggtggcgtcgccgggagctccagatccgcggcctgctgcgccgtgctgctcgcggcggtgctcttcttctccgcaccggccaccacagaggcttatgattcgctggatccaaatggcaacatcaccataaaatgggatattatttcgtggactcctgatggttatgttgcaacagtcacaatgttcaactaccagcagttccgacacatacctgcacctgggtggcagctggggtggtcgtgggcaaagaaagaggtcatctggtcgatggtgggggctcaggctactgagcagggtgattgctcaaaattcaagagtgcccctccccattgctgcaagagagatccaacgattgtcgatcttcttccgggcaccccattcaaccagcaaattgctaattgttgcaaggcaggagttataaagacatttaaccaggacccaggaaatgcagcatcctccttccagattagtgtaggtcttgctgggactaccaataagacggttaagatgccgaaaaacttcacccttagggcccctggtccggggtacacatgtgggcgtgctcttgttggcaggcctaccaagtattactcgtcagacgggcgcagggtaacccaagctctcatgtcgtggaatgtaacctgcacatactcccaatttcttgctcagaagactccaacctgctgtgtatctctctcatcgttttataatgacactatcgtgaactgcccaacgtgctcttgcggctgccaaaacaatattactcgtccaggaagctgtgtaaatgacaattcgccttatttgcaatctgccatcaatggccctggcaaattaaccggccagcctcttgtccaatgtacttcccacatgtgcccgataagaatccattggcatgtgaagctcaactacaaggactactggagagtgaaagtcaccatcacaaacttcaactaccgcatgaattatacagactggaacatggttgcccagcatcctaacttcgataatatcacaaagctgttcagcttcaactataagccacttaccccatatggaggccgcataaatgacaccgcaatgttctggggaatgaagttctacaatgatttgctcaatcaagctggcccgcttggaaacgcgcagtcagaactactcatgcggaaggactcggagactttcaccttccaaaaaggatgggcgtttccccggcgtgtgtacttcaatggtgataactgtgtcatgccatctcccgatgactatccatggttgcctagtgcaagccctctgacaaaacaaccatggacgctcccactattggtgttctggactgtgttgtctactttgctggcttattacgtatgatgaaatgagaccaagagattcagcgagcttcaagtcgctgtcatgttccatgaggtgcgcggcaacaggtcatttgttcattccattccacggttgcatagaagacacgggtgccgcgctgaggaaagctgatacgtgtgtgtgttttgtaagttaaaaagggctgaaaatgtatttcttgttttggtatatactggccatgaaactttggtgaacttagttactcaaatttaggtaattatggttgcaccttctgtattttatagcagacgcagacattttaattgaatcatatgactgcctttcttgtagtgattgtatgagttacacaataatgttttgtacaatttgttaaaccgagagatgctgttggttgagataacaatctagcattgtttttcctggccccccttatgtttgaagcaagtgctagaaataacacaaatcaaaagaagcacgcgacagtactcaggctaggctgaacaga

SEQ ID NO: 3122 - DNA, 1794 bp, Hordeum vulgare
actcactcctattcccacccccaccggaagtcacggcgcgcctccgtgtctcgtcgcagtccaccacctgtcccctgccttctgtccgcctcacaccccagatctccagctccccccaagcagggctcacctgggtcggcgcagctgctccgtggcaggccaccgggtgtcggcggggggacgaaatggcggcggtcggtggctgcgccgttctgctcgccgcggcgctgctcctctccgcgccggccgccacagaggcgtacgattcgctagatccgaccgggaacatcaccataaaatgggacattatatcgtggactcctgatggctatgttgcagctgtcacaatgtacaactaccagcagttccggcacatatcggcgcccgggtggcagctggggtggacgtgggccaagaaggaggtcatctggtccatggtgggggctcagaccaccgagcagggtgactgctccaagtttaagaccaaccctccccattgctgcaagagagatccgaccgtcatcgatcttctcccggggacaccgtacaaggaccaagtcgccaactgctgcaagggaggagttataagtacatttaaccaggacccaggaaatgctgcctcctccttccagatcagtgtaggccttgctgggactacaaataagacggttaaggtgcccaaaaacttcacccttaagaccccaggtcccggctacacatgcagccgtgctattgttggcaggcctaccaagtttctctcatcggatcggcgcaggacgacacaagctcttatgacatggagcgtaacctgcacgtactcccagtttcttgctcagaagaccccaacctgctgtgtagctctctcgtcgttttataataacactattgtgagatgcccaacatgctcttgcggttgccaaaacaataatactcatccaggaagctgtgtaaatgccaactcaccttatttgcaatctgccatcgacggccctggcaaatacaccggccagcctcttgtccagtgcacttcccacatgtgcccggtaacagtgcactggcatgtgaagctcaactacaaggactactggagagtcaaagtaaccatcacaaacttcaactaccgcatgaactacacagactggaacctggtcgtccagcatcccaacttcaataacatcacaaagctgttcagcttcaactacaagccgctagccccgtacggaggccgcataaatgacagcgcgatgttctggggaatgaagttctacaatgacctgctcaatcaagctggtccgttcggaaacgcgcagacggaaatacttctgcagaaggacccggagatcttcaccttcgagaaaggatgggccttcccgcggcgtgtgtacttcaacggcgacaactgcgtcatgccgccgcccgacgcctatccatggctgcctaacgcgagccctctgatgaagaaaccgtggacgctcgagctcttggtgttctggactgcgctggccaccctgctggcctattatgtctgacaaacgatgtcggcgagcttctggtgtgcggcaaagggtccggtcgtctgttcattcggttccacagttgcatatatataagagacgcggtgaggaaagctgatgtgtgtatatgggttctgctaagttaaatagggccaaaaatgtagtggccgccaagcttcggtgaactgattaattgaattgtatggctgtagtaaattaaatgtatgagttacaataatgtttgtgtgaaatggagaggatgctgttggtcagatgtgga

SEQ ID NO: 3123 - DNA, 1723 bp, Hordeum vulgare
cggaagtcacggcgcgcctccgtgtctcgtcgcagtccaccacctgtcccctgccttctgtccgcctcacaccccagatctccagctccccccaagcagggctcacctgggtcggcgcagctgctccgtggcaggccaccgggtgtcggcggggggacgaaatggcggcggtcggtggctgcgccgttctgctcgccgcggcgctgctcctctccgcgccggccgccacagaggcgtacgattcgctagatccgaccgggaacatcaccataaaatgggacattatatcgtggactcctgatggctatgttgcagctgtcacaatgtacaactaccagcagttccggcacatatcggcgcccgggtggcagctggggtggacgtgggccaagaaggaggtcatctggtccatggtgggggctcagaccaccgagcagggtgactgctccaagtttaagaccaaccctccccattgctgcaagagagatccgaccgtcatcgatcttctcccggggacaccgtacaaggaccaagtcgccaactgctgcaagggaggagttataagtacatttaaccaggacccaggaaatgctgcctcctccttccagatcagtgtaggccttgctgggactacaaataagacggttaaggtgcccaaaaacttcacccttaagaccccaggtcccggctacacatgcagccgtgctattgttggcaggcctaccaagtttctctcatcggatcggcgcaggacgacacaagctcttatgacatggagcgtaacctgcacgtactcccagtttcttgctcagaagaccccaacctgctgtgtagctctctcgtcgttttataataacactattgtgagatgcccaacatgctcttgcggttgccaaaacaataatactcatccaggaagctgtgtaaatgccaactcaccttatttgcaatctgccatcgacggccctggcaaatacaccggccagcctcttgtccagtgcacttcccacatgtgcccggtaacagtgcactggcatgtgaagctcaactacaaggactactggagagtcaaagtaaccatcacaaacttcaactaccgcatgaactacacagactggaacctggtcgtccagcatcccaacttcaataacatcacaaagctgttcagcttcaactacaagccgctagccccgtacggaggccgcataaatgacagcgcgatgttctggggaatgaagttctacaatgacctgctcaatcaagctggtccgttcggaaacgcgcagacggaaatacttctgcagaaggacccggagatcttcaccttcgagaaaggatgggccttcccgcggcgtgtgtacttcaacggcgacaactgcgtcatgccgccgcccgacgcctatccatggctgcctaacgcgagccctctgatgaagaaaccgtggacgctcgagctcttggtgttctggactgcgctggccaccctgctggcctattatgtctgacaaacgatgtcggcgagcttctggtgtgcggcaaagggtccggtcgtctgttcattcggttccacagttgcatatatataagagacgcggtgaggaaagctgatgtgtgtatatgggttctgctaagttaaatagggccaaaaatgtagtggccgccaagcttcggtgaactgattaattgaattgtatggctgtagtaaattaaatgtttgggttcc

SEQ ID NO: 3124 - DNA, 1611 bp, Secale cereale
agaggcttatgattcgctggatccaaatggcaacatcaccataaaatgggatattatttcgtggactcctgatggttatgttgcaacagtcacaatgttcaactaccagcagttccgacacatacctgcacctgggtggcagctggggtggtcgtgggcaaagaaagaggttatctggtcgatggtgggggctcaggctactgagcagggtgattgctcaaaattcaagagtgcccctccccattgctgcaagagagatccaacgattgtcgatcttcttccgggcaccccattcaaccagcaaattgccaattgttgcaaggcaggagttataaagacatttaaccaggacccaggaaatgctgcatcctccttccagattagtgtaggtcttgctgggactaccaataagacggttaagatgccgaaaaacttcacccttagggccccaggtccggggtacacatgtgggcgtgctcttgttggcaggcctaccaagtattactcgacagacgggcgcagggtaacccaagctctcatgtcgtggaatgtaacctgcacatactcccaatttcttgctcagaagactccgacctgctgtgtatctctctcatcgttttataatgacactattgtgaactgcccaacttgctcttgcggctgccaaaacaatattactcgtccaggaagctgtgtaaatgacaattcgccttatttacaatctgccatcaatggccctggcaaattaaccggccagcctcttgtccaatgtacttcccacatgtgcccgataagaatccattggcatgtgaagctcaactacaaggactactggagagtgaaagtcaccatcacaaacttcaactaccgcatgaattacacagactggaacatggttgcccagcatccgaacttcgataatatcacaaagctgttcagcttcaactataagccacttaccccatatggaggccgcataaatgacaccgcaatgttctggggaatgaagttctacaatgatctgctcaatcaagctggtccacttggaaatgcgcagtcagaactactcatgcggaaggactcagagactttcaccttccaaaaaggatgggcgtttccgcggcgtgtgtacttcaatggtgataactgtgtcatgccatctcccgatgactatccatggttgcctagtgcaagccctttgacaaaacaaccatggacactgccactcttggtattctggactgtgttggctactttgctggcttactacgtatgatgaatgagaacaagagattcagtgagcttcaagtttgctgtcaggttccacgatgtgcgaggcaaccggtcatttgttcattaagttccacggttgcatagaagagacgggtgtcgtgctaaggaaagctgatatgtttgtgttttgtaagttaaaggggctggaaatgtatttcttgttttggtatatactggccacgaaactttggtgaacttagttactcgaatttaggtaattatggttgcaccttctgtattttatagcagacgcagacattttaattgaattatatgactgcctttcttgtagtgattatatgagttacatataataat

SEQ ID NO: 3125 - DNA, 1453 bp, Sorghum bicolor
ggatagacaagcatatatagctgtacctgtacgtagctgggagcctgggctgggagctatagctagctaggctgcgcgccgctgaggcctcaggcggaggggagaatggcgacgggcggcagactggccgtcacttgctccgccgccgtgctgctcgccgtggcgctgctgatctccgcaccggacgccgcagaggcttatgattctctagatccaaacggcaacatcactataaaatgggatgttatgcaatggactcctgatggatatgtcgctgttgtcacaatgtacaattaccaacaatttcggcacattgggccacccggatggcagcttgggtggacatgggcaaagaaggaggttatatggtcaatggttggggctcaggccaccgaacagggtgactgctcaaagttcaagggcaacattcctcacagctgcaagaaagatcccgtgatcgttgatttacttccaagcacaccatatgacatgcaaattgccaattgctgcaaggcaggagttataagtacaattagtcaggatccagcaaatgctgcttcctcatttcagctcagtgtaggtctttctgggtctaccactaagactgtcaaggtgccgaagaacttcacccttaggactcctggccccggttacacctgtgggcgtgctattgttggcaagcctactatatttttctctgcagatggccgcagggcaaccaaagctctaatgacatggaatgtgacctgcacgtattcccaatttcttgctcagaagactccgtcctgctgtgtatctctttcatcgttttataacaacactactgtgaactgcccaacatgctcctgtggctgccagaacccaagtggatcaaactgtgtgaataagggttcgcctcgcctacgatctgctattgatggccctggcaaatggagtggcgagcctcttgtggagtgcacttcccacatgtgccccgtaaaaatcaactggcacgtgaagcagaacagcaaggactactggagagtgaagatcaccatcacaaacctcaacttccgaatgaactacagcgagtggaacctggttgttcagcatccaaacttcgataacatcactcagttgttcggcctcaactacaaaccactcactccatatgggggtgacataaatgacacggcaatgttctggggtgtgaagtcctacaatgatgtgctgatgcaagacggtaagcttgggatggtgcagtcagagctccttctccgtaaagactcccggactttcacattcgaaaagggatgggccttcccacgccgggtgtacttcaatggtgataactgtgtcatgccagctcctgaaaattacccatcgttgccaatgcaagcctagtaataaggctgtaacgaaagaaccgtcgttcggtttgattacggctgattgccatttacaaggaataaat

SEQ ID NO: 3126 - DNA, 1800 bp, Sorghum bicolor
cacacactcgccagctagctctataccctgctggatagacaagcatatatagctgtacctgtacgtagctgggagcctgggctgggagctatagctagctaggctgcgcgccgctgaggcctcaggcggaggggagaatggcgacgggcggcagactggccgtcacttgctccgccgccgtgctgctcgccgtggcgctgctgatctccgcaccggacgccgcagaggcttatgattctctagatccaaacggcaacatcactataaaatgggatgttatgcaatggactcctgatggatatgtcgctgttgtcacaatgtacaattaccaacaatttcggcacattgggccacccggatggcagcttgggtggacatgggcaaagaaggaggttatatggtcaatggttggggctcaggccaccgaacagggtgactgctcaaagttcaagggcaacattcctcacagctgcaagaaagatcccgtgatcgttgatttacttccaagcacaccatatgacatgcaaattgccaattgctgcaaggcaggagttataagtacaattagtcaggatccagcaaatgctgcttcctcatttcagctcagtgtaggtctttctgggtctaccactaagactgtcaaggtgccgaagaacttcacccttaggactcctggccccggttacacctgtgggcgtgctattgttggcaagcctactatatttttctctgcagatggccgcagggcaaccaaagctctaatgacatggaatgtgacctgcacgtattcccaatttcttgctcagaagactccgtcctgctgtgtatctctttcatcgttttataacaacactactgtgaactgcccaacatgctcctgtggctgccagaacccaagtggatcaaactgtgtgaataagggttcgcctcgcctacgatctgctattgatggccctggcaaatggagtggcgagcctcttgtggagtgcacttcccacatgtgccccgtaaaaatcaactggcacgtgaagcagaacagcaaggactactggagagtgaagatcaccatcacaaacctcaacttccgaatgaactacagcgagtggaacctggttgttcagcatccaaacttcgataacatcactcagttgttcggcctcaactacaaaccactcactccatatgggggtgacataaatgacacggcaatgttctggggtgtgaagtcctacaatgatgtgctgatgcaagacggtaagcttgggatggtgcagtcagagctccttctccgtaaagactcccggactttcacattcgaaaagggatgggccttcccacgccgggtgtacttcaatggtgataactgtgtcatgccagctcctgaaaattacccatcgttgccaatgcaagcctagtaataaggctgtaacgaaagaaccgtcgttcggtttgattacggctgattgccatttacaaggaataaatgtcacgggttgattacgtcgcttggagctccacttttgctaacgaagaccgttcgtatttaggacaaagggctgcttatgattttttttttatgattatgaattgcgatgagttgaataagcgatgcccagttcaaattatgtgaatttgtttggttggaacaatgcaccactgatacccctgattgggccgaaacgcgtggtcgtcattgggctcagttgggaagcccgcgcgcttgtttctggcgaattgactttacccatgtggccgtgtgtggtctttgtcacgtactcttttcctttggcgtgacgtgaa

SEQ ID NO: 3127 - DNA, 1871 bp, Secale cereale
tgcgtcctccacgccccagatctccagctccccccacctcccaacgcaggggccggctgctccgtggccacagagcgtcggcggggggacgaaatggcggcgctttctggctgcgccctgctgctcgccgcggcgctgctcctctccgcgccggccgccacagaggcgtacgattcgctagatccgaacgggaacatcaccataaaatgggatcttaaagagtggactcctgatggttatgttgcaatggtcacaatatacaactaccagcagttccggcacatatctgcgcccgggtggcagctggggtggacgtgggccaagaaggaggtcatctggtccatggtgggggctcagaccaccgagcagggcgactgctctaagttcaagaccaaccctccgcattgctgcaagagagatccgaccgtcatcgatcttctacccggaacaccgtacaaagaccaagtcggcaactgctgcaagggaggagttataagtacgtttaaccaggacccggcaaatgctgcctcctccttccagatcagtgtaggccttgctgggactaccaataagacggttaagctgcccaaaaacttcactcttaagacccctggtccgggctacacatgcggccgtgctattgttgtgaggcccaccaagtttccctccccggatgggcgcaggatgacacaagctcttatgacatggaatgtaacctgcatgtactcccagtttcttgctcagaagaccccaacctgctgtgtagctctctcgtcgttttacaataacactattgtgagctgcccaacatgctcttgcggctgccaaaacaataacactcatccaggaagctgtgtaaatcccaactcaccttatttacagtctgccatcgatggccctggcaaatacaccggccagcctcttgtccagtgcacttcccacatgtgcccggtaaaagtccactggcatgtgaagctcaactacaaggactactggagagtcaaagtaaccatcacaaacttcaactaccgcatgaattacacagactggaacctggttgtccagcaccccaacttcaacaacatcacaaagctcttcagcttcaactacaagccgctctccccgtacggaggccgcataaatgacagcgcgatgttctggggaatgaagttctacaatgatctgctcaatcaagccggtccattcggaaatgcgcagacggaaatacttctgcagaaggacccagagaccttcaccttcgaaaagggttgggccttcccgcggcgcgtctacttcaacggcgacaactgcgtcatgccgcctcccgacgcctatccgtggctgcctaacgcgagccctccgatgaagcaaccgtggacgctcgagctcttggtgttctggaccgcgctggccaccctgctagcctattatgtctgatgatgaacaatgtcggcgagcttctgtcgggtgccacgaggtgcgcggcaaagggtcatttgttcattcggttccacagttgcatataagagatggggtgaggaaagctgatgatgtgtgtatatgtgttctgctaagttaaatagggccagaaatgtagtggccgcgaagctttggtgaactgattaattgaattgtatggctgtagtcaattaaatgtatgaggtagataataatgtttgtgtgaaatggaggggatgctgttggtcagatgatctagcaattgttttgctgactcctctgttgttgctggaagcaagttgctgagctgattcattttgatcttcagtgctagttagagacaacatgaatcaaaagctttgtacaactccgaatctgttgcctccactcgctcatcactactcttacaaata

SEQ ID NO: 3128 - DNA, 735 bp, Saccharum officinarum
cttaatccttcaccagctagccggccagcacgcacctccattccttaaatccgtccatctctcttgctccagtcagcactagccaaccaacagcaaacgaacaatggctgccgccgtcatcaacgcgccagcagctgctcgttgctcggccgccgggccgccgcagctgctgccaccacggggcgctgcgtcgtcgtttccgccgtcgatgatgaggaagaggacgacgggtgcggccggccggcttgtcgcggtctcggcggtgggtgacgtcgcggcggagggcaacacgtacctcatcgccggcgcggtggccgtcgcgctcgtgggcacggccttccccatactcttctcgcgcaaggacacgtgcccggagtgcgacggcgccgggttcatccggaaggcaggcgcgacgctgcgggcgaacgcggcgaggaaggacgaggcccagatcgtctgccccaactgcaacggcctcggcaagctcggacagatcgacaagtagccagcttataatcccatccacacccatcagccatgcatgctaagctcactgaatccacattgtctgcatcatatacatatgcatatatagagaacctggagtatatatgtatgtatatgtgcatgcatggaccaaactgctctttttctgcatgctcattgaagggaacatgtggagaatcaaaggtatatgaaaacgctctaaaagaaatctggtttctgacggaatat

SEQ ID NO: 3129 - DNA, 866 bp, Sorghum bicolor
cagctagccaagtagccagccagccaccttccattcatcaccagctagctagtagcaacaatggctgccgtcgtcaacgcgccagcagcaactgctcgttgctcggcggccgggccacaactgctgccagtgccaccacggggcgcatttcttctgccgccgtcgatgatgaggaagaggacgacgacgggggcgcccgccggcggccggcttgtcgcggtctcggcggtgggcgacgtcgcggcggagggcaacacgtacctcatcgccggcgcggtggccgtcgcgctcgtgggcacggccttccccatactcttctcgcgcaaggacacgtgcccggagtgcgacggcgccgggttcatccgcaaggcgggcgtgaggctgcgggcgaacgcggcgaggaaggaccaggcccagatcgtatgccccaactgcaacggactcggcaagctcggacagatcgacaagtagctaatcccatccacacccagcatcacccatgcatgcatgcatgctaattaagctcacttcttccacattattggacatgtgcatgtgcatgcatgcatggacaaataaactactgctcttctgtgcatgctcatttgatttgagtgagcatgtggacaatcaaatcaaaaagtatgtgtacatgctgtaaattaaatctgctttctgacgggttctgaatgtatatgctgaatgagtgtcaatttggtctgtaatgtgtaacgtgttgctttgtcagaaacacttttgtgtaatgacattgttctcggtgtgttgtatgttatagtaatgtttataaaaaaacattactttctctataaaaagtggtcgtgaataagaactctttgtactccaaa

SEQ ID NO: 3130 - DNA, 987 bp, Sorghum bicolor
ggccggcagcgacgtgccttcccctgatcccctcccttccctcgcttatccactttgtgaggtcgcaactttatcctcgtcgctctcctctctcacccacctccaaccttaatcctttcaccagctagccaagtagccagccagccaccttccattcatcaccagctagctagtagcaacaatggctgccgtcgtcaacgcgccagcagcaactgctcgttgctcggcggccgggccacaactgctgccagtgccaccacggggcgcatttcttctgccgccgtcgatgatgaggaagaggacgacgacgggggcgcccgccggcggccggcttgtcgcggtctcggcggtgggcgacgtcgcggcggagggcaacacgtacctcatcgccggcgcggtggccgtcgcgctcgtgggcacggccttccccatactcttctcgcgcaaggacacgtgcccggagtgcgacggcgccgggttcatccgcaaggcgggcgtgaggctgcgggcgaacgcggcgaggaaggaccaggcccagatcgtatgccccaactgcaacggactcggcaagctcggacagatcgacaagtagctaatcccatccacacccagcatcacccatgcatgcatgcatgctaattaagctcacttcttccacattattggacatgtgcatgtgcatgcatgcatggacaaataaactactgctcttctgtgcatgctcatttgatttgagtgagcatgtggacaatcaaatcaaaaagtatgtgtacatgctgtaaattaaatctgctttctgacgggttctgaatgtatatgctgaatgagtgtcaatttggtctgtaatgtgtaacgtgttgctttgtcagaaacacttttgtgtaatgacattgttctcggtgtgttgtatgttatagtaatgtttataaaaaaacattactttctctataaaaagtggtcgtgaataagaactctttgtactccaaa

SEQ ID NO: 3131 - DNA, 2127 bp, Sorghum bicolor
gacccggcagaccggagatacgtgtgcgacgctgaacccgcgacgtggacgcgcgagaagatccctccacacggatctcctcctgtccaccagctcagctacttcaactgacgagccggcgcacggccaaaagattctcgtggacatctccggcgcccacttgtatggttgtatcccgcgcgcgctctcgggacaagctagctcgccatcgccgcccgcgtcgcgtccatggaaatggtggagtgctccctcgtcgctacacttgctccgcgcccgctgccgggacgagtccggaaggccttgccgcggccggcggttcttggtgggagagcgagactccgggtgctgtccgcgggcctgggccgagagcagcctccgccgccgcagcaggcgggagtccgggcttccgggccggatcacggcggccggacgctgggacacgctgcggtggggctcgccgccgcggccgtggtgtcactgaccgggttctccggggatgtgtccccgctgccggcgccgcctgcccgggccgagtcgctcaccgtcgcgttccccgtctccaaggcgcgcgaggtgaacagagtgcagaagacgctggttgagacgtgggggctgatccgtgagacctttgttgatcctaccttcaaccaccaagattgggatcaaaaactgcagcaaaccatggtagagatatttccactgaaatcagcggatgctgcctacagtaagatcagtgggatgctatccacactcggcgatccatttacgaggatcatcagccccatggagtaccagagttttaggataggaagtgatgggaatgtgcaaggggttggggtgttcataaacaaggagccaagctctggacggttgcttgttatggactgcattcagggaggcccagcagatcgagcaggcatccatgaaggcgatgaactagttgagatagatggcaaaagtgtttctggtttggatggagaggctgcggctcagaggcttagaggccgtgtaggaacaacagtgaaagtgaagttgttagatggaactgacagtgaaaggggtgggagtttaaggcaaaaggaggtccagctgtctcgtgaaattatcaacctttcacctgtgtcaactgcaattatctctcataggtctgatgatggccatgagtgcaagactggttatgttagattagcttccttttctcagactgcagcagctgaaatggaaaatgccgtgaaaaggatggaggatgtgggtgtccagtcttatattctagatctacggaataacccaggaggtctagtaaaagctggtcttgatgtggctcaaatttggttggatggagatgaaactcttgtcaacactattgatcgtgatgggaatgtgctaccaataaatatgatccaagggcattcgttaacgcatgaccctcttgttgtgcttgtcaatgaaggaagtgcaagtgcaagtgaaatcttggcaggggcattacatgacaatggacgagctattctggttggccatagaacctttggtaaaggaaaaattcagagtgtgactgagctggatgatggctctgctctgtttatcacagttgcaaagtatctatctccagcgctgcatgaaattgatcaagtaggaatccaacctgacatacaatgcagccctgatgtcctatctttgccaagagcgccttcgctaaaagaaaacagcgaggccacaagtttggagatggattcatgtatcatggttgccgaacaagcgttggaaattgagcaaacaaagggttctgcttcttagatgtgctacttctgggctctctatatgttgcattgtagagtagattggtagcttaccgtagaggcttaaagttctgtatatgtagtggtgtatatatataggctgatcctcgcatgtttcattttaggcattatctattcggtggttcatgggaatgcatataagttgaccctgtgtcggtttgattcttggcatatgccatcacatattcagaactatagcatgcaattttttgtaattaggcttgttggttcttgtgtaacctttaaggttcatcagcatccaaaggtcagggaaggtcaggggatcgattaagagagaattaagttt

SEQ ID NO: 3132 - DNA, 2377 bp, Sorghum bicolor
acccaatatctgttgtctcgcgcaccaccacccaaacgcctcgacccggcagaccggagatacgtgtgcgacgctgaacccgcgacgtggacgcgcgagaagatccctccacacggatctcctcctgtccaccagctcagctacttcaactgacgagccggcgcacggccaaaagattctcgtggacatctccggcgcccacttgtatggttgtatcccgcgcgcgctctcgggacaagctagctcgccatcgccgcccgcgtcgcgtccatggaaatggtggagtgctccctcgtcgctacacttgctccgcgcccgctgccgggacgagtccggaaggccttgccgcggccggcggttcttggtgggagagcgagactccgggtgctgtccgcgggcctgggccgagagcagcctccgccgccgcagcaggcgggagtccgggcttccgggccggatcacggcggccggacgctgggacacgctgcggtggggctcgccgccgcggccgtggtgtcactgaccgggttctccggggatgtgtccccgctgccggcgccgcctgcccgggccgagtcgctcaccgtcgcgttccccgtctccaaggcgcgcgaggtgaacagagtgcagaagacgctggttgagacgtgggggctgatccgtgagacctttgttgatcctaccttcaaccaccaagattgggatcaaaaactgcagcaaaccatggtagagatatttccactgaaatcagcggatgctgcctacagtaagatcagtgggatgctatccacactcggcgatccatttacgaggatcatcagccccatggagtaccagagttttaggataggaagtgatgggaatgtgcaaggggttggggtgttcataaacaaggagccaagctctggacggttgcttgttatggactgcattcagggaggcccagcagatcgagcaggcatccatgaaggcgatgaactagttgagatagatggcaaaagtgtttctggtttggatggagaggctgcggctcagaggcttagaggccgtgtaggaacaacagtgaaagtgaagttgttagatggaactgacagtgaaaggggtgggagtttaaggcaaaaggaggtccagctgtctcgtgaaattatcaacctttcacctgtgtcaactgcaattatctctcataggtctgatgatggccatgagtgcaagactggttatgttagattagcttccttttctcagactgcagcagctgaaatggaaaatgccgtgaaaaggatggaggatgtgggtgtccagtcttatattctagatctacggaataacccaggaggtctagtaaaagctggtcttgatgtggctcaaatttggttggatggagatgaaactcttgtcaacactattgatcgtgatgggaatgtgctaccaataaatatgatccaagggcattcgttaacgcatgaccctcttgttgtgcttgtcaatgaaggaagtgcaagtgcaagtgaaatcttggcaggggcattacatgacaatggacgagctattctggttggccatagaacctttggtaaaggaaaaattcagagtgtgactgagctggatgatggctctgctctgtttatcacagttgcaaagtatctatctccagcgctgcatgaaattgatcaagtaggaatccaacctgacatacaatgcagccctgatgtcctatctttgccaagagcgccttcgctaaaagaaaacagcgaggccacaagtttggagatggattcatgtatcatggttgccgaacaagcgttggaaattgagcaaacaaagggttctgcttcttagatgtgctacttctgggctctctatatgttgcattgtagagtagattggtagcttaccgtagaggcttaaagttctgtatatgtagtggtgtatatatataggctgatcctcgcatgtttcattttaggcattatctattcggtggttcatgggaatgcatataagttgaccctgtgtcggtttgattcttggcatatgccatcacatattcagaactatagcatgcaattttttgtaattaggcttgttggttcttgtgtaacctttaaggttcatcagcatccaaaggtcagggaaggtcaggggatcgattaagagagaattaagttttggcactgaaacaaatcaatcttctttctaaggcactaaaaattttgaactttttttttatctaacaccgagttgaattgtttttcgtaaatggtactaccgtccatttgtttgaatgcccaaatagacggcggttatatttacagaagaaaatttcaatttggtgccatgtaaggaagttcaaattttatagtgcactagaaggaag

SEQ ID NO: 3133 - DNA, 2151 bp, Setaria italica
gacccgccgactggagtggagatacgtgtgcgagcctgcgcccgcgacgtggacgcgcgggaaaatccctccacacggatctcctcccgtccaccagcccagctgctacttcaactgaagacggcacagccagagagattctcgtggacttctccggtgtccacttgtacacccgtatcccgcgcgttccggagagaaaagctagctcttctcgccattgccgccgctggcgtcgcgtccatggaaatggtggagtgctccctcgccgccactctagccccgcgcccgctgcccggctgggtccggaaggccccgccgcggccggccgttcttgaggcggggagagcgaggctccgggtgcggtcggcgaggcgggagcagcctccgctgccggagccggtggcggtccggagcccctctgggacggagcacggcggtcgggcgctggggcaggcggcggcggggtttgccgccgcggccgtggtgtcgctgaccgggttcgccggtgacatgtccccgctgccgacgcccccaccggcccgggccgagtcgctcaccgtcgcgttccccgtcgcgaaggcgcgcgaggtgaatcgggtgcagaagacgctggtggaggcgtgggggctgatccgtgagaccttcgttgatcccaccttcaaccatcaagattgggatcagaaactgcagcaaacaatggtagagatgtttccactgaaatcagctgacgcggcctatggtaagattagtggaatgctttccacgctcggcgacccatttacaaggatcatcagcccaacggagtatcagagtttcaggataggaagcgatgggaatgtgcaaggggttggggtattcataaacagggagccaagctctggacgcttgcttgttatggactgcattcagggaggcccagccgatcgagcaggcatacatgaaggcgatgagctagttgagatagacgggaaaagtgtttctgggttggatggagaggctgcagctcagaggcttagaggccgtgtaggaacaacagtgaaagtgaaactattagatggagctgacaatgacaggggtggcaggattaggcaaaaagaggtccagctatctcgtgaaattatcaatctttctcctctatcaactacaattatctctcataggtcggacgatggccatgagtgcaagactgggtatgttagactagctgccttttctcagactgctgcagctgaaatggaaaatgccgtaaaaaggatggaggatgagggtgtcgagtcatatattctagatctgcggaataatccaggtggattggtcaaagctggtctcgatgtggctcaaatttggttggatggagatgaaactcttgtcaacactattgatcgtgaggggaatgtgctaccgataaatatgatccaagggcattcattaacacatgaccctcttgtagtgcttgtcaatgaaggaagtgcaagtgcaagcgaaatcttggcaggggctttacatgacaatgggcgagctattctagtcggccacagaacctttggtaaaggaaaaattcagagtgtcactgagttggatgatggctctgctctgtttatcacggtcgcgaagtatctctctccagcactgcatgaaatcgatcaagtagggatccagcctgacatacaatgcagccctgatatcctatctctgccgagagcgcctcaactaagagaaaacagcgaggccacaagtttggagatggattcatgtatcatggtggcagagcaagcgttgggaatagagcaaacaaagggttctgcttcttagatggttcagctcataggctctgtatattgttgaattcaacagtagtagattgtatagctgatagtatagactgataaagtgctgtaatggtgtatatataggctggctgatcctcgcatgcttgattttaggcatcatctattcggcggttcgtggcaatgtgtatgaattgaccttgccaaatgcccgtgtttcgttaattctcagcatgtacgaccagaaattcagaattatagcatgaaaatattttaattaggactgttgattgttgtgtaatctttaaggttcatcagcatctaaaaggtcacggattggttattataataattccaatttgac

SEQ ID NO: 3134 - DNA, 2179 bp, Panicum virgatum
cccgtggccgtctccggccggtgtccacttgtacagctgcatcccgcgcgctcccggccgagaggagctagctcgcccagtcgttgccgccggcgtcgtcgcgtcgcgtccatggaaatggcggtggagtgctccctcgccgccacactcgccccgcgaacgctgcccggccgggtccgaaaggcctcgccgcggccggccgttcttgcggggagggcgaggcttcgggtgcggtcgacggcgaggcgagagcaccctccgccgccggagccggtggcactccggggcgcttctgggacggggcacggctgccgggcagtgcggcaggcggcggcgggcctcgctgctgccgccgtggtgtcgctgaccgggttcgccggtgacgtgtccacgctgctgccgccgacgccgcctgctcgggccgagtcgctcaccgtcgcgttccccgtcgcaaaggcgcgcgaggtgaaccgggtgcagaggacgctggtggaggcgtggggtctgatccgtgagaccttcgttgatcccaccttcaaccatcaagattgggatcagaaactgcagcaaaccatggtagaaatgtttccactgaaatcggctgacgcggcctacagtaaaatcagtgggatgctttccacgcttggcgacccatttacaagaatcatcagtccgatggagtatcagagtttcaggataggaagcgatggaaatgtgcaaggggttggggtgttcataaacagggagccaagctctggacgcttgcttgttatggactgcattcagggagggccagcagatcgagcaggcatacatgaaggcgatgagctagttgagatagatgggaagagtgtttctggattggatggagaggctgcagctcagaggcttagaggccgtgtaggaacaacagtgaaagtgaaactattagatggaactgaaaatgataggggtggcaggagtaggcaaaaagaggtccagctgtctcgtgaaatcatcaacctttcacctctatcaactacaattatctctcataggtcggacgatggccatgagtgcaagactggatatgttagactagctgccttttctcagactgctgcagctgaaatggaaaatgccgtgaaaaggatggaggatgagggcgtcgagtcatatattctagacctgcggaataacccaggtggattagtaaaagctggtctcgatgtggctcaaatttggttggatggagatgaaactctcgtcaacactattgatcgcgagggaaatgtgctaccaataaatatgatccaagggcattcattaacacatgaccctcttgtagtgcttgttaatgaaggaagtgcaagtgcaagtgaaatcttggcaggagcattacatgacaatgggcgagctattctggtgggccacagaacctttggtaaaggaaaaattcagagtgtcactgagttggatgatggctctgctctgtttatcacggttgcgaagtatctctctccagcgttgcatgaaatcgatcaagtaggaatccagcctgacatacaatgcagccctgatatactatccttgccgagagcacctacactaagagaaaacagcgaagcgacaagattggagatggattcatgtatcatggtggcagagcatgcattggaaattgagcaaatgaaaggttctgcttcgtagatgttcagcttataggctctgtatattcttgtattctactgtagattgtatagctgatagtatagactgataaagtgctgtaacgatatgtgtataggctgactgatcctcacatgtttgattttaggcatcatcaattaggcggtttatgggaatgtacatgagttgaccttgtcatatgcctgtgttgcattgattctcaacatgtatcatcagaaattcagaattatagcatgtaaattttgtaattgggtctgttgattattgtgtaatgtttaatgttcataagcatctaataattccaattggagtctagaacgacctttggaggtttgtccgtaaggcataatgtccactatgataggtagattaagaccaacaaagtttcttggccatttcgaaacatgagactaggagaacgaaggaatttgaatggaatgtatgaataatgtgcaaactagaatgagtagtgtgggtttgattaaaattc

SEQ ID NO: 3135 - DNA, 2091 bp, Oryza sativa
gccgccaacccccaccaggagattcctcccctcgactcgactcgactcgattccgcccacttgtatatctcccgcgcgccaccaccaccatcgcgccatcgcgtccatggagatggtggagtgctcgctgcccgccgcccgggccccgcgcccactgccccgccgcctcccgccgctccccggcggcaggccggctcttggcgccgccgggaggagcggcagccggctccgggtgcggtcggagcggacgaggaggagggacagcccgacgatgccgacggctgcgtcggagcgcgacggcggcggccgtgccgcgctgggcaaggcggcagcggggctcgccgcggcggccgtggtgtcgctgaccgggctcgccgcggagcccctctcgccgccgccgccggcgcgggccgagtcgctcaccgtcgcgttccctgtctccaaggcccgcgaggtgaaccgggtgcagaggacgctggtggaggcgtgggggctgatccgtgagaccttcgtggatcccaccttcaatcaccaagattgggacatgagactgcagcagaccatggtggagatgttcccgctgaaatcggaggatgccgcctatggtaagatcagcgggatgctgtccacactcggcgatccgttcaccaagatcatcagccccaaggaatatcagagtttcaggattggaagcgatgggagtgtccaaggggttggggtgttcataaacaaggagcctagctctggacgcttgcttgttatggactgcattgaaggtggcccagcagatcgagcaggcctgcatggaggcgatgaactagttgagatcgatgggaagagtgtttctgggttggatggagaagctgcagctcagagacttagaggtcgtgttggaacaactgtgaaagtgaaagtgttggatggcactgaaaacgaaaggaatggtaggataagacaaaaggaggtccagctatctcgtgaggttatcaatctttcacctctatcaacagcaattatctctcataggtcggacgatggccgtgagtgcaaaactgggtatgttaggctagctgcattctctcagactgctgcagctgaaatggaaagtgccattaagaagatggaggatgagggtgtccagtcatatattttagatctgcgaaataatcctggtggtctagtaaaagcaggtcttgacgtggctcaaatgtggttggatggaaatgaaactcttgtcaacactgttgaccgtgagggaaatgtcctaccaataaatatggcccggggccattctttaacacatgatccccttgtcgtacttgtcaatgaaggaagtgcaagtgcaagtgaaatcttggcaggagcattacatgacaatggtcgtgctattttggtcggccacagaacttttggaaaaggaaaaatacagagtgtgactgaattggatgatggatctgctctgtttatcacggtcgcaaaatatctctctccagcactgcatgaaatcgaccaagtaggcatccaacctgacatacaatgcacccctgaaatgttatctttgccaagagcaccttcgctaaaagaggacgacaaagccacaaatctggagatggattcatgtatcatggtggcagagcaagcattggaaattgagaaatcaaagggatctgcttcgtaggtacttctgtaagccagaatcctttgtatgtccacatttagttggtcaggttcatagtggcatctgcagatgaaattcagcatagctccatgtataatattgtaatctaccgtaggttgtatagttagtataggctgtaatgataatatatataggctgataactgtgatgttagattgtaggcaaagaagcaccagaaattagttatctcgtcttcaggggccaaatgcccttgtcattgattcgagatgtgtcaataggaatttgtaattgtcacttgttaatcattgcatattgtctaccaatgccagtacaacatattgcttcaacagttaattgtaagtgagattcctcaaaaaggcactagtcattacatgcatgagatgatcatacccatttggaaggcatttgat

SEQ ID NO: 3136 - DNA, 1997 bp, Oryza sativa
gccaccaccaccatcgcgccatcgcgtccatggagatggtggagtgctcgctgcccgccgcccgggccccgcgcccactgccccgccgcctcccgccgctccccggcggcaggccggctcttggcgccgccgggaggagcggcagccggctccgggtgcggtcggagcggacgaggaggagggacagcccgacgatgccgacggctgcgtcggagcgcgacggcggcggccgtgccgcgctgggcaaggcggcagcggggctcgccgcggcggccgtggtgtcgctgaccgggctcgccgcggagcccctctcgccgccgccgccggcgcgggccgagtcgctcaccgtcgcgttccctgtctccaaggcccgcgaggtgaaccgggtgcagaggacgctggtggaggcgtgggggctgatccgtgagaccttcgtggatcccaccttcaatcaccaagattgggacatgagactgcagcagaccatggtggagatgttcccgctgaaatcggaggatgccgcctatggtaagatcagcgggatgctgtccacactcggcgatccgttcaccaagatcatcagccccaaggaatatcagagtttcaggattggaagcgatgggagtgtccaaggggttggggtgttcataaacaaggagcctagctctggacgcttgcttgttatggactgcattgaaggtggcccagcagatcgagcaggcctgcatggaggcgatgaactagttgagatcgatgggaagagtgtttctgggttggatggagaagctgcagctcagagacttagaggtcgtgttggaacaactgtgaaagtgaaagtgttggatggcactgaaaacgaaaggaatggtaggataagacaaaaggaggtccagctatctcgtgaggttatcaatctttcacctctatcaacagcaattatctctcataggtcggacgatggccgtgagtgcaaaactgggtatgttaggctagctgcattctctcagactgctgcagctgaaatggaaagtgccattaagaagatggaggatgagggtgtccagtcatatattttagatctgcgaaataatcctggtggtctagtaaaagcaggtcttgacgtggctcaaatgtggttggatggaaatgaaactcttgtcaacactgttgaccgtgagggaaatgtcctaccaataaatatggcccggggccattctttaacacatgatccccttgtcgtacttgtcaatgaaggaagtgcaagtgcaagtgaaatcttggcaggagcattacatgacaatggtcgtgctattttggtcggccacagaacttttggaaaaggaaaaatacagagtgtgactgaattggatgatggatctgctctgtttatcacggtcgcaaaatatctctctccagcactgcatgaaatcgaccaagtaggcatccaacctgacatacaatgcacccctgaaatgttatctttgccaagagcaccttcgctaaaagaggacgacaaagccacaaatctggagatggattcatgtatcatggtggcagagcaagcattggaaattgagaaatcaaagggatctgcttcgtaggtacttctgtaagccagaatcctttgtatgtccacatttagttggtcaggttcatagtggcatctgcagatgaaattcagcatagctccatgtataatattgtaatctaccgtaggttgtatagttagtataggctgtaatgataatatatataggctgataactgtgatgttagattgtaggcaaagaagcaccagaaattagttatctcgtcttcaggggccaaatgcccttgtcattgattcgagatgtgtcaataggaatttgtaattgtcacttgttaatcattgcatattgtctaccaatgccagtacaacatattgcttcaacagttaattgtaagtgagattcctcaaaaaggcactagtcattacatgcatgagatgatcataccca

SEQ ID NO: 3137 - DNA, 1935 bp, Triticum aestivum
gcacgagggccacattgcgtgattgctcgcgtccatggaaatggtagagtgctccctggccgcctcccgcgccgcgaggcccgtgcccggccgggtcccgaggtccccggcgcctgttcttggtgttggcgccgggagagccaggctccgggtgcggtccgagaggcgggagcagcctccgccggtcatcagggcttccgcgccgccggagcacgacggaggggcgctggcgaaggcggccgcggggctcgccgccgctgccgtggtgtcgctgaccgggttcgccggggacttggccccgccgccggcgctggccgagtcgctcacggtcgccttccccgtctccaaggcccgagaggtgaaccgggtgcagaggacgctggtggaggcatggggtttgatccgtgagaccttcgtcgatcccaccttcaaccaccaagactgggaccagaaacttcagcagacgatggtggagatgttcccgctgaaatcggcagacgccgcctacggcaagatcagcgggatggtgtccacgctaggcgaccccttcacaaggatcatcacccccaaggaatatcagagtttcaggatcggaagtgatgggaatttgcaaggggttggcatattcataaacagggaccctgcctcaggacgcttgcttgttatgaactgcattgagggaggcccagccgaccgagcgggcatacgtgaaggcgatgagctagttgagatcaacgggaatagtgttttggggttggacgtggaagctgtggctcagagacttagaggtcgtgctggaacgactgtggaagtaaaactattggatggtactggaaatgaaaggagtggtaggataaagcaaaaagaggtccagctatctcgtgaggttatcaatctttcacctctatcaacggcaattatctcccatagatcgggtgatgggcatgagggcaagactgggtatgttaggttagctgcattttctcagactgctgctgctgaaatggaaagggccattaaaaagatggaagatcaaggtgtccagtcatatattttagatctgcggaataatccaggtggtttagtaacagctggtcttgatgtggctcaaatttggttagatggagatgaaactctagtgaacaccgttgaccgtgagggcaatgtgcaagcaataaatatggtccaaggccaatctttaacacatgatcctcttgtggtgcttgtcaacgaagaaagtgccagtgcaagcgaaattttggctggggcattgcatgacaatggccgtgctattctggtaggccacaaaaccttcggtaaaggaagaatacagagcgtgacagagctggacgacggttctgctctattcatcacggttgcaaagtatctctctccggcactgcacgaaatcgaccatgtagggatccaacccgacatacaatgcaccgctgacacgctatcattaccgagagcgccttcgctcaccgggaacaatgaggccgcaagtttggagatggactcgtgcattatggtggcggagcaggcgttggagattcagcaatcgaagggttccgcttcgtagatggtttcatactgatagccagaactgaacctcatatgttggctacatgtacactgttgtatcatgccttgtagtgtatatattcagtagtatagactatagattggatcactggatagtgatgtaacagtgtgtaggctgatcctatgttgttagatttgtaggtggtgaagcaggggttcattccatgggtcatatgcccggatcaacgttgttgattcgacagctgatcaggttttggaattgtaacctgtattgttgttgtactacagcacattggctgcctgcatcattatcaattcattctggtacgagctagcggaatgcacgagctgagataccgctggaacaga

SEQ ID NO: 3138 - DNA, 1973 bp, Triticum aestivum
acccgcgcccgtccccgttgccacattgcgtgattgctcgcgtccatggaaatggttgagtgctccctggccgcctcccgcgccgcgaggcacgtgcccggccgggtcccgaggtccccggcgccggttcttggtgttggcgccgggagagccaggctccgggtgcggtcggagaggcgggagcagcctccgcctgtcgtcagggcctccgcgccgccggagcgcgacggtggggcgctggggaaggccgctgcggggctcgccgccgctgccgtggtgtcgctgaccggcttcgccggggacttggccccgccgccggcgctggccgagtcgctcacggtcgccttccccgtctccaaggcccgagaggtgaaccgggtgcagaggacgctggtggaggcatgggggttgatccgcgagaccttcgtcgatcccaccttcaaccaccaagactgggaccagaaacttcagcagacgatggtggagatgttcccgctgaaatcagcagacgccgcctacggcaagatcagcgggatggtgtccacgctaggcgaccccttcacaaggatcatcacccccaaggaatatcagagtttcaggatcggaagtgatgggaatttgcaaggggttggcatattcataaacagggaccctgcctcaggacgcttgcttgttatgaactgcattgagggaggcccagccgaccgagcgggcatacgtgaaggcgatgagctagttgagatcaacgggaatagtgttttggggttggacgtggaagctgtggctcagagacttagaggtcgtgctggaacgactgtggaagtaaaactattggatggtactggaaatgaaaggagtggtaggataaagcaaaaagaggtccagctatctcgtgaggttatcaatctttcacctctatcaacggcaattatctcccatagatcgggtgatgggcatgagggcaagactgggtatgttaggttagctgcattttctcagactgctgctgctgaaatggaaagggccattaaaaagatggaagatcaaggtgtccagtcatatattttagatctgcggaataatccaggtggtttagtaacagctggtcttgacgtggctcaaatttggttagatggagatgaaactctagtgaacaccgttgaccgtgagggcaatgtgcaagcaataaatatggtccaaggccaatctttaacacatgatcctcttgtggtgcttgtcaacgaagaaagtgccagtgcaagcgaaattttggctggggcattgcatgacaatggccgtgctattctggtaggccacaaaaccttcggtaaaggaagaatacagagcgtgacagagctggacgatggctctgctctattcatcacggttgcaaagtatctctctccggcactgcacgaaatcgaccatgtcgggatccaaccggacatacaatgcaccgctgacgcgctatcgttaccgagagcgccttcgctcaccgggaacaacgaggccgcaagtttggagatggactcgtgcattatggtggcggagcaggcgttggagattcagcaatcgaagggttccgcttcgtagatgctttctcactgatacccggaactgaacctcatgtgttggctacacgtacactgttgtatcctaccttgtgtatatattcgttagtatagattggatcactggatagtgatgtagcaatgtataggctgatcatatgttgttagctttgtaggtggtgacccccgcaaaataaaaagagagagagagagaagaagaaagatttgtagttggtgaagcaggggttcattccatgggtcatatgcccgaatcaacgtcgttgattcgacagctgatcaggttttggaattgtagcttgtattgttgtactacgcacattggctgcctgtcatcattatcaatttatcgtggtacgagctagcggaatgcacgagctgaga

SEQ ID NO: 3139 - DNA, 2014 bp, Avena sativa
ccagaatgggccacgtctcagcgcgcggagatctcccacacggatctcctcctgtccaccaaaagattcttccgcctgctcactcctcccacccgctggtgtggactccggcggccggcgggttatatctcgcaacgaccccgatcccacccggccccgttgccacattgcgtgattccatggaaatggtagagtgctcattcgtcgccgcgcgtgccccgcggcgcatgctccctaagaccccaccggcggttcttggcatcgggagagccaggctccgggtgaggtccgaggggctggagcagcctccgccggttatcaggacttcctcaccgccggagcacgacggcagggcgctggggaaggcggcggcggggcttgcggccgcagccgttgtttcgctgaccggattcgccggggacatcatcaccccgccgccggcctgggccgagtcgctcaccgtcgccttccccgtatccaaggcccgcgaggtgaaccgggtacagaggacgttggtggaggcatggggcctcatccgtgagaccttcgtcgaccccaccttcaaccaccaagactgggaccagaaacttcagcagacgatggtggagatgttccctctgaaatctgcggacgccgcctatggcaagatcagcgggatggtgtccacgctgggcgaccccttcacaaagatcatcagccccaaggaataccagagtttcaggatcggaagcgacggaaacctgcaaggggtcggcatattcataaacacggaacctggctccggacgcttgcttgttatgaactgcgttcagggaggaccagccgatcgagcgggcatacgtgaaggcgatgagcttgttgagatcgatgggaatagtgttttggggttggacggagaagctgtggctcagagacttcgaggtcgtgctggaacaacagtgcaagtgaaactgttggatggtactgaaattgaaagaagtggcaggacaaagcaaaaagaggtccagctatctcgtgaagttatcaatatttcacctctgtcaactgcaatcatctctcataggtcgggtgatggccttgagggcaagactgggtatgttaggttagctgccttttctcagactgctgctgctgaaatggaaagtgccgtccaaaggatggaggatgaaggtgtccagtcatatattttagatctgcggaacaatccaggtggtttagtaaaagctggtcttgatgtggctcaaatttggttagatggagatgaaactctagtgaacaccgttgatcgggagggcaatgtgcgggcaataaatatggtccagggccaatctttaacacatgatcctcttgtggtgcttgtcaacgaagaaagtgccagcgcaagtgagatcttggctggagcgttgcatgacaatggccgtgcaattctggtaggccacaaaacattcggcaaaggaagaatacagagtgtgacagagctggatgacgggtctgctctgttcatcacggttgcaaagtacctgtctccggcgctgcatgagatcgaccacatcgggatccagcctgacatacagtgcaccccggacatgctatctttgccgagagtgcctcccctcagcgagaacagcgaggccgccacgagtctggagatggactcgtgtatcatggtggcggagcaggcgctggagattcaacagtcgaagggatccgtttcgtagggaaggttttactgatagccagagtgagaccctcggcatgttagctacatgctccatatgtatattgatgtatcctgcattgcgtgtagtgtatatattccatagtatagacgactcaatagtgttgtaacaaatgtataggctgatataatctctgatgttagatttgtaggtgatggggcttcatagttcatgggtttgggtttcggatttgtaaagtgtattgttgtatgtacagcacattggctgcctatatagatatgccatacaattttagcaaagaggagtgatattaa

SEQ ID NO: 3140 - DNA, 2015 bp, Hordeum vulgare
tcctctctctctctcgtgcagactccggcgggtttatatcccgcgcgctcgcaggaaccccgagcccacccgcgcccgctcccgtggccgcattgcgtgattgctcgcgtccatggaaatggtagagtgctccctggccgcctcccgcgccgcgaggcccgtgctcggccgggtcccgaggtccccggcgccgtttcttggcgccgggagggccaggctccgggtgcggtccgagaggcgggagcagcctccgccggtcgtcagggcggagcgcgacggcggggcgctggggaaggcggccgctgggctcgccgccgcagcagtggtgtcgctttccgggttcgccggggacttcaccccgccgccggcgcgggccgagtcgctcaccgtcgccttccccgtctccaaggcccgagaggtgaaccgggtgcagaggacgctggtggaggcatgggggctgatccgtgagaccttcgtagaccccaccttcaaccaccaagactgggaccagaaacttcagcagacgatggtggagatgttcccgctgaaatcggcagacgccgcctacggcaagatcagcgggatggtgtccacgctaggggaccctttcacaaagatcatcacccccaaggaatatcagagtttcaagatcggaagcgatgggaatttgcaaggggttggcatattcataaatagggaccctgccaccggacgcttgcttgttatgaactgcattgacggaggcccagccgacagagcaggcatacacgaaggcgatgagctagttgagatcaatgggaatagtgttttagggttggacgtagaagctgtggctcagagacttagaggtcgtgctggaacgactgtggaagtgaaactgttggatggtactggaattgaaaggagtggtaggataaagcaaaaagaggtccagctatctcgtgaggtaatcaatctttcacctctatcaacgacaatcatctcccatagatcgggtgatgggcatgagggcaagactgggtatgttaggctagctgcattttctcagactgctgctgctgaaatggaaagtgccattaagaaaatggaggatcaaggtgtccagtcatatattttagatctgcggaataatccaggtggtttggtaacggctggtcttgatgtggctcaaatttggttagatggagatgaaactctagtgaacactgttgaccgtgagggcaatgtgcaagcaataaatatggtccaaggccaatctttaacacatgatcctcttgtggtgcttgtcaacgaagaaagtgccagtgcaagcgaaattttggctggggcactgcatgacaatggccgtgctattctggtaggccacaaaacctttggcaaaggaagaatacagagtgtcacagagctggatgatggctctgctctattcatcacggttgcaaagtatctctctccggcgctgcacgaaatcgaccatatcgggatccaacccgacatacagtgcaccgctgacgcgctatccttaccgagagcgccttcgctcaccgagagcaacgaggccgcgagtctggagatggactcgtgcattatggtggcggagcaggcgttggagattcagcaatcgaagggttctgcttcgtagatggttcattactgatagccacaactggaccctcctatgttggctactacctctgtaaataaatatagtactccaacgcctggatcactgttgtattctgcattgtagtgtgtgtatacggtagtgtagactatagactggatcactggttagtgatgtaagattgtataggctgatcctatgttgttagatttgtaggtggtgaagcaggggttcatgggtgatcagggttagagattgtaacttgtattgttgtactataaacagcacattggctgcccagcatcattatcagtttattccggtatgacctagcggaatgcacaggctgagataccgctggaagatacactttccatatctattttttcga

SEQ ID NO: 3141 - DNA, 2098 bp, Brachypodium distachyon
aaaagattcttccgcttcttcgtcctccccctccccagtgggctccggcagcttaatatctcgcgcgctcgcgagaacccgaggcccgagcacccgaccccattgtcacattccgtgattgcttttgcgtccatggaaatggtagagtgctcactagctgccgcccgcggcccccgcggcccccgcgccctgctcggccgtgtccccaggccctcgccggcggttcttggcgccgggagaaccaagctccgggtgcggtcggagaggcgggggcagcctccgccggttgtcagggcctccccgccgccggagcacgacggcagggcgctagggaaggcggcggtggggctcgccgcagcagccgtggtgtcgctgaacgggctcgcgggggacttctccccgccgccggccctggccgagtcgctcaccgtcgcgttccccgtctccaaggcccgagaggtaaaccgggtgcagaggacgctggtggaggcatgggggctgatccgtgagacctttgtcgatcccaccttcaaccaccaagactgggaccagaaacttcagcagactatggtggagatgttcccactgaaatccgcagatgctgcctatggcaagatcagtgggatggtgtccactctaggcgatccgttcacaaagatcatcagccccaaggaatatcagagtttcaggatcggaagtgatgggaacttgcaaggggttggcatattcataaataaggaacctggctctggacgcttgcttgttatgaactgcattgagggaggcccagctgatcgagcaggcatacgtgaaggcgatgagctagttgatatcgatgggaatagtgtctttgggttggatggagaaactgtggctcagagacttcgaggtcgtgctggaacgactgtggaagtgaaactattggatggtactggaaatgataggagtggtaggacaagacaaaaggaggtccagctacgtcgtgaagtgatcaatctttcacctgtatcaactgcaatcatatctcatagttcaggtgatggccatgaggaaaagactgggtatgttaggctagctgccttttctcagactgctgctgctgagatggaaagtgccattaaaaagatggaggatgagggtgtccagtcatatattttagatctgcggaataatccaggtggtttagtaaaagctggtcttgatgtggctcaaatatggttagatggagatgaaactcttgtgaacacagtcgaccgtgaggggaatgttcgaccaataaatatggtccaaggccaatctttaacacatgatcctcttgtggtgcttgtcaatgaagaaagtgccagtgcaagtgaaattttggcaggagcattacatgacaatggccgtgctattttagtaggtcacaaaaccttcggtaaaggaagaatacagagtgtgacggagttggatgatggctctgctctattcatcacagtcgcgaagtacctctctccagcactgcatgaaatcgaccaagtcgggatccaaccagacatacaatgcacccctgacatgctatctttaccaagagcacctttgctaagtgaaaacggtgaagccccaagtttggagatggattcgtgtattatggtggcagagcaagcgttagaaattcagcaatcgaaggggtctgcttcgtatatggttagccagattgttgctctgatgccatgctgaattgatgcacctaactggttatcaaaagttcgagctgttatggaagggtgcttaatgtatttcgacagatggaaattcagctttggaaattcaaactctcgtcagcatgttggctgtatgtatatagctgtatccgcattacattgtatatagactgtagtatagactgaatagtgttgtaacaatgtataggctgatccggtaatgtagatttgtaggttactaggcactggaacttagctgtttggtgcttcgtggtggtcatatgcccccgttgatttgacaagcacagatttcagaattgtaacttgtattaatgtactacatttggcatattggctgctctacataaatagtatcagttttattttctagtaag

SEQ ID NO: 3142 - DNA, 2353 bp, Brachypodium distachyon
atggaagccaagactgagctcttctttgaagatttgtctacatctaaaaagagaaggcctgatgttattgaagacatagtcattgcaaactttccaaatactctagcaaaccagggaagtaatctccatatagaatggcaaaccataccccatttcgacaccacccaaacgtacaagcccgagtccgtgacgtgtcttgcgcggggagattccctcggcagggatctcctggtgtccacaaaacccagcggaacaaccaaaagattcttccgcttcttcgtcctccccctccccagtgggctccggcagcttaatatctcgcgcgctcgcgagaacccgaggcccgagcacccgaccccattgtcacattccgtgattgcttttgcgtccatggaaatggtagagtgctcactagctgccgcccgcggcccccgcggcccccgcgccctgctcggccgtgtccccaggccctcgccggcggttcttggcgccgggagaaccaagctccgggtgcggtcggagaggcgggggcagcctccgccggttgtcagggcctccccgccgccggagcacgacggcagggcgctagggaaggcggcggtggggctcgccgcagcagccgtggtgtcgctgaacgggctcgcgggggacttctccccgccgccggccctggccgagtcgctcaccgtcgcgttccccgtctccaaggcccgagaggtaaaccgggtgcagaggacgctggtggaggcatgggggctgatccgtgagacctttgtcgatcccaccttcaaccaccaagactgggaccagaaacttcagcagactatggtggagatgttcccactgaaatccgcagatgctgcctatggcaagatcagtgggatggtgtccactctaggcgatccgttcacaaagatcatcagccccaaggaatatcagagtttcaggatcggaagtgatgggaacttgcaaggggttggcatattcataaataaggaacctggctctggacgcttgcttgttatgaactgcattgagggaggcccagctgatcgagcaggcatacgtgaaggcgatgagctagttgatatcgatgggaatagtgtctttgggttggatggagaaactgtggctcagagacttcgaggtcgtgctggaacgactgtggaagtgaaactattggatggtactggaaatgataggagtggtaggacaagacaaaaggaggtccagctacgtcgtgaagtgatcaatctttcacctgtatcaactgcaatcatatctcatagttcaggtgatggccatgaggaaaagactgggtatgttaggctagctgccttttctcagactgctgctgctgagatggaaagtgccattaaaaagatggaggatgagggtgtccagtcatatattttagatctgcggaataatccaggtggtttagtaaaagctggtcttgatgtggctcaaatatggttagatggagatgaaactcttgtgaacacagtcgaccgtgaggggaatgttcgaccaataaatatggtccaaggccaatctttaacacatgatcctcttgtggtgcttgtcaatgaagaaagtgccagtgcaagtgaaattttggcaggagcattacatgacaatggccgtgctattttagtaggtcacaaaaccttcggtaaaggaagaatacagagtgtgacggagttggatgatggctctgctctattcatcacagtcgcgaagtacctctctccagcactgcatgaaatcgaccaagtcgggatccaaccagacatacaatgcacccctgacatgctatctttaccaagagcacctttgctaagtgaaaacggtgaagccccaagtttggagatggattcgtgtattatggtggcagagcaagcgttagaaattcagcaatcgaaggggtctgcttcgtatatggttagccagattgttgctctgatgccatgctgaattgatgcacctaactggttatcaaaagttcgagctgttatggaagggtgcttaatgtatttcgacagatggaaattcagctttggaaattcaaactctcgtcagcatgttggctgtatgtatatagctgtatccgcattacattgtatatagactgtagtatagactgaatagtgttgtaacaatgtataggctgatccggtaatgtagatttgtaggttactaggcactggaacttagctgtttggtgcttcgtggtggtcatatgcccccgttgatttgacaagcacagatttcagaattgtaacttgtattaatgtactacatttggcatattggctgctctacataaatagtatcagttttattttctagt

SEQ ID NO: 3143 - DNA, 2521 bp, Panicum virgatum
gcaagctagcgcgcgcccagattctctctcgcgcctccgctttaccttctccttctggccttccccgcgccatggctcacgaacgggagccgctcctgcagcagcagcagagcggcggcgggaatgccgccggtgccaaggggtcgcccacggcggcgcccgccgccgccccgctgccgtcgctggccaggaccgtgctcaagttcctcatgtgggcggtgttcctcacctgggccgcggggatcttcttctacccgaccaagcccgtgcaggccgtgttcaagaagtgggttgggctcaccagggactccacgtttggcatcgccggtaccatttttctgaccttcagcgcacccatcctgataattgcgcttctggcatatgtgtacatctccttcttcccgagtgatcatatggagaagaggaagctgaggtcattgagtttccagctctggacattccctgttcttgtcgatggcccttttggagttgtttctgcagttgaattcatcggaattgtcctatttatcgtttatgttgtctactcaatgacctactatgctttggagagtgtgagccttgtctcaaaatttgatacaccatcaaagactgatagtgagttgatactgcatgtcatcggtcttcgcttaggatcagttgggctgttctgcatgttgttcctgttcctgccagttgcaaggggctcagttcttcttcggcttatcgacattccgtttgagcatgctactagataccacgtctggctcggacatctcacgatggctctctttacattgcatggcttgtgctatgtgatcgaatggtccatgcaagggctcctacttaaaaagatggcaggatggaaggaagttggaattgcaaacttccctggcgtgatcagcttggcagctggcctacttatgtgggtgacctcacttcacccagtgaggaagaagttctttgagctcttcttctacacccaccaactctacgtcatctttgtcgtgttcttggcattacacgtcggcgacttcatcttcagcatttcagctggggccgtcttcctcttcatgctcgatcgcttcctaaggttttggcagtcaagggccaaagttgacatcatttcagctgcctgccgcccatgcgggacagtggagctagtcttctcaaaaccagcaagtctccgctacaatgctctcagtttcatcttcattcaagtgcgcgagttgtcattcttgcagtggcatccattcagcgtatcttcgagtccaatggatgggaggtaccacatgtcggttctcataaaagtactgggcacatggactgagaagctgaggagcatcatcaccgatgtccaggagcagaacaggggtgactctgagttgcaatgtggtcgcataacagcctgtgtggaagggccgtatggacatgaatctccctatcacttgatgtacgagaatctcatcctggtggcaggaggaattggaatatcgccattcttggcgatcttgagtgacataatccacaggatcgaggagggcaagcaatgcatgcccaagaacgtgctggtcctgtggtcagtgaagaagtccaaggagctttctctcttgtcggccgtcgatgcgcagaccatcagttcatctgtctctgacaagttgcgcttggatatccaggcattcgtgacccaagaaacccaggctccattggaggatggcatcgttggcgacgaccagaaagtccctggcatgttcgtcaagaacgggacgaccatgtccgggctggtcggcaccggggacaacttctgggcggccatgtacttcctggcgtcgacgctcgggttcctcctggcgtacgccctggtgcaggtgtactacgtgaagccccacaacgtggtggcgtggtggtacctgggcctcctgttcatgctgtgcatggccgccggcgtcgccctccccggcggcctcgtcgtgctcctgtggcacctgtccgagaagcggaggctggaggacgagaagtgggacgccgccgcctcccagtcgccgcgggcagccgcgcccgcggcaggtggtgacgccgccgacgccgacgccgcccccggcgtcggcctcgccgccctgcggacgacccggtacgggtgccggccagacttcgaagcggagttcgcggcgttcgcggagcgcgccggcgacgcggcggacgtgggcgtgctggtgtgcggtccacaggggttgcagacgagcgtggcgagggagtgccgggcgcggaacctccgccgcggcggcggggcgggcaagagcggcagccgcgcggtcttccacttcaacagccacagcttcgacctctgattacacacgcgccgataggataggcccgtgaagcacacatgcatgctgcctctgtaattatgctgtatactccctccgtttttaaatatatgacactattgactttttttcttcgtttggctattcgtcttttctacaaatatttatgcaaataatcaaatcttcaagttagattc

SEQ ID NO: 3144 - DNA, 2610 bp, Setaria italica
ggctagtgcggccctagattctctcgcgcctccactttaccttcttctggccttctccgcgccatggcccacgaacgggagccgctcctgcggcagcagagcggcggcggtggcgccgccgccccgctgccgtcgctggccaggaccgtgctcaagttcctcatgtgggcggtgttcctcacctgggccgcggggatcttcttcctcccgaccaagcccgtgcagacggtgttcaggaagtggatcagcctcaccagggactccacgtttggcctcgccgggggcgttttcctgaccttcagtgcgcccattctgatcattgcgctcctggcatatgtgtacatctccttctttccaagtgaccatatggagaagaggaagctgaggtcactgagtttccgtctctggacactccctgttcttgtcgatggcccttttggagtcgtttctgcagttgaattcatcggaattgtcctatttatcatttacgtcgtctactcaatgacctattatgctgtggagagcgtgagtcttatccaagaattccatataccatcaatgaccaatagtgagttgatgctgcatatcatcggcctccgtttaggatcagttgggttgttctgcatgctcttcctgttcctgccagtcgcgaggggctcagttcttcttcggcttatcgacattccatttgagcatgctactagataccacgtctggcttggacatcttacgatggctctctttacattgcatggcttgtgctatgtgatcgaatggtcaatgcaggggcgactacttgaagaaatggcagaatggaaggaaattggggtggcaaatctacctggtgtgatcagcttggtagccggccttcttatgtgggtgacctcacttcaccccgtgaggaagaggttctttgagctcttcttctacacccaccaactctacatcatctttatcgtgttcttggcgctccatgtcggcgactacatcttcagcttttcggctggggcggtcttcctcttcatgctcgaccgcttcctcaggttctggcagtcaagggcgaaagttgacatcatttcagctgcctgccgcccatgcgggactgtggagctagtcttctcaaaaccagcaagtctccgctacaatgctctcagtttcatcttcattcaagtgcgcgagttgtcattcttgcagtggcatccattcagtgtatcttctagccccatggatgggagataccacatgtcggtactaataaaagtacttggcacatggactgaaaaactgaggagcaccatcaccggcgtccaggagcagaacagaggtgactccgagttgcaatgcggccgcataacagcctgcgtggaagggccgtacgggcatgaatcaccctaccacttgatgtacgagaatctcatcctggtggcaggaggcatcggaatatcgccgttcttggcgatccttagcgacataatccacaggatcgaggagggcaagcaatgcatgcccaagaacgtgctggtcctgtggtcagtcaagaagtccaaggagctttctctcttgtcggcagtcgatgcgcagaccatcacttcatttgtctctgaaaaattgcatctggatatccaggccttcgtgacccaagaatcccaggctcctttggaggatggcatcgttggggacgagcagaaagcccccggcatgttcgtcaagaacgggacgaccatgtccgggctggtcggtaccggggacaacttctgggcggccatgtacttcctggcgtcgacactgggcttcctcctggcgtacgccctggtgcgggtgtactacgtgaagccccacaacgtggtggcgtggtggtacctgggcctcctgttgatgctgtgcatggccgccggcgtcgccctccccggcgggctcgtcgtgctcctgtggcacttctccgagaagcggaggctggagaacgacaagtgggacgccgccgcctcccagtcaccgcgcgccgccgagcagacaccggccggtggcggtgacgacgacgccgtccccggcgtcagcctcgccgccatgcggacgacccggtacgggtgccggccaaacttcgaagcggagttcgcggcgttcgcggagcgcgccggcgacgcggcggacgtgggcgtgctggtgtgcgggccgccggggctgcagacgagcgtggcgagggagtgcagggcgcggaacctccggcgcggcgccgcggcggagaagggcagcagccgcgccgtcttccatttcaacagccacagcttcgacctctaatggatcacacactacacgtaccggctgggtccgaagagcacgtagagtccagtccatacgtgcacgttgcacagttgttacagatacatgctgtttctgcagtcgttatatgccgtataacgcgtgtgtatatatgtagctgatgaatacaaaaattaatcgtacgaggatgtgtatctgcatgtgacacgtgtagcatattcatgcatcatactatgcatgatcgaaacagagaggttaagggggtgtttatcgtatcgaatatttgatactaattagaagtattaaatataatctaattacaaaactaattgc

SEQ ID NO: 3145 - DNA, 752 bp, Sorghum bicolor
tggtggagttctagttccttcccctcgaagagaagagggggaaaacctagagagagagagagagagagagaggaggggaaaaaatcgtttcccggtccgcgctcggctgccgtgaatcccacctcccagtttcccagagcaagcgagcgggacagcgcgccaggatcggaggccgagacgccatcaatcagcaactgcacgcgcgcggccggccgcgggacggaggaggagatgggtctgtgctcgtgctgctgccggtgcctggagctgctgtgctcggtcctcctcccgcccctcggcgtctgcctccgccacggctgctgctccctggagttctggatcagcgtgctgctcaccatcctcggctacctccccggcgtcctctacgccgtctacgtcatctgctccgtcgacccccaccgccaccgcgaccccgacgacgactacgtctacgtcgcctgaccgacggacggagagatccccgtgcctccgctgctacctccgtccgctgtgctgtgtgcatctctttgttgggttagtagactaaatccgtcatgtgcccgtctgtaaactgtaaattcgtgtgtccaatctgacaatctggacgaattcatttcataaagatcttgtgtcatgggatctgtgcagttaattggggttacttcgctaccacgatcagttgtgctcgtgaatgaaactgcagatggttattaatccctcgcattttccctcattgtcagttgagatcaatt

SEQ ID NO: 3146 - DNA, 837 bp, Sorghum bicolor
aaaaaaagtcttatagacgtaaccttgactcctggagtgacacgtaaaaattttcattgttgactcgccccagctcgcgcgataccgcgtcgtgccgtgctgattggtggagttctagttccttcccctcgaagagaagagggggaaaacctagagagagagagagagagagagaggaggggaaaaaatcgtttcccggtccgcgctcggctgccgtgaatcccacctcccagtttcccagagcaagcgagcgggacagcgcgccaggatcggaggccgagacgccatcaatcagcaactgcacgcgcgcggccggccgcgggacggaggaggagatgggtctgtgctcgtgctgctgccggtgcctggagctgctgtgctcggtcctcctcccgcccctcggcgtctgcctccgccacggctgctgctccctggagttctggatcagcgtgctgctcaccatcctcggctacctccccggcgtcctctacgccgtctacgtcatctgctccgtcgacccccaccgccaccgcgaccccgacgacgactacgtctacgtcgcctgaccgacggacggagagatccccgtgcctccgctgctacctccgtccgctgtgctgtgtgcatctctttgttgggttagtagactaaatccgtcatgtgcccgtctgtaaactgtaaattcgtgtgtccaatctgacaatctggacgaattcatttcataaagatcttgtgtcatgggatctgtgcagttaattggggttacttcgctaccacgatcagttgtgctcgtgaatgaaactgcagatggttattaatccctcgcattttccctca

SEQ ID NO: 3147 - DNA, 846 bp, Setaria italica
tgacactggagctgcccctcaagttcgaggccggctagctcaacctcatttccagatcagatctggatcctaacctcgagaccccacctcaagctgacacgtagaactcacattattggttgactttggaggcgatagtgccgccgcgtcgtgccgtgctgaatttcgagttccttccgctcgacgggaagaaatatccagccgttccccttccccttgttcccgaagcgaccgagcagagcagcgcgcgaggatccgaggaggaagagaaggggaacgagatgggcctgtgctcgtgctgctgccggtgcctggagctcctgtgctccgtcctgctcccgcccctcggcgtctgcctccgccacggctgctgctccttggagttctggatcagcgtcctgctcaccatcctcggttacctccccggcgtcctctacgccatctacgtcatctgctccgtcgacccccaccgccacgacgaccccgacgactacgtctacgtcgcctgaccgccggatgcgtcgccgatccgccgtggtgttctggtgtgctccctacctacctatctacgcccgtgcgtctctgtgttgggttcgtagacttaaatcctttccgtgcccatgtgtaaattgtaaattggtgtatccaatctgacaatctggacgaattcatctggtggagatctggagttgtggagtttgtgcagtcaattgggttaattttggtacctggtccggttgcggttgtgaattggctcctctgaatgaggatggttcttgtgtccttgagtaatttgcctcattcaaagtttagatcgattcgagacagcctaatgttatgtagtgg

SEQ ID NO: 3148 - DNA, 502 bp, Panicum virgatum
gctcgaagtgaagaaatagccgcggccgttccccattccccattccccgaactcgcaaagcaagcgagcagagcagcgggcgaggatccgatccgagatgggcctgtgctcgtgctgctgccggtgcctggagctcctgtgctccgtcctgctcccgcccctcggcgtctgcctccgccatggctgctgctccatggagttctggatcagcgtcctgctcaccatcctcggctacctccccggcgtcctctacgccatctacgtcatctgctccgtcgacccccacagccgccgcgaccccgacgactacgtctacgtcgcctgaccccaaggatgcgtccccaattcgccatgctgttctggtgtgcccccctaactacctatcattctacgcccgtttatccaatttgtaaattggtgtatccaatctgacattctggacgaattcatcttgttgtgatctggagctacgattgtgcagtcaattgggttaattttgatt

SEQ ID NO: 3149 - DNA, 695 bp, Saccharum officinarum
gtcgacccacgcgtccggccgagttcagttccttccgctcgaagagaagaggggaaaaaaagaaaacctcgttccccggtccgcgctcggctgccgtgaatccattctcccagttcccaaagcaagcgagcagggcagcgcgccaggatcggaggccaagacgccatcaatcagcaactgcacgcgcgcggccggccgcaggaggacgagatgggcctgtgctcgtgctgctgccggtgcctggagctgctgtgctccgtcctcctcccgcccctcggcgtctgtctccgccacggctgctgctccttggagttctggatcagcgtgctgctcaccatcctcggctacctccccggcgtcctctacgccgtctacgtcatctgctccgtcgactcccaccgccaccgccaccgcgaccccgacgacgacgactacgtctatgtcgcctgaccgatggacggatccccgcggtgctctggtccgtgcctctgctgtgtgcatctctgtgttgggttagtagactaaatccgtcctgtgcccgtctgtaaactgtaaattcgagtgtccaatctgacaatctggacgaattcattcccataaagatctggtgttgtgggatctatgcagttaattggggttgctttgctaccaaacataaaaattatacatgttatttttattttattggactaaat

SEQ ID NO: 3150 - DNA, 652 bp, Panicum virgatum
gggagttccttcagctcgaagggaagaaatagccagccattccccttccccgaatttgcaaagcaagcgagcaggagcagcgcgcggggatccgatccgagatgggcctgtgctcgtgctgctgccggtgcctggagctcctgtgctccgtcctgctcccgcccctcggcgtctgcctccgccatggctgctgctccatggagttctggatcagcgtgctgctcaccatccttggctacctccccggcgtcctctacgccatctacgtcatctgctccgtcgaccccaacggccgccacgaccccgacgactacgtctacatcgcctgatcccaaggatgcgtccccaattctccatgctgttctggtgtacccctacctacctatcaatctacgcccgtgtatctctctgtgttgggttagtggacggttaaatccatcccgtgcccgtgtataatctgtaaattccaatctgacaatttggacagattcatcttgtggagatctggagttacgtttgtgagtcaattgggttaattttggtaattgttctgtagtggttgtggatcgcctcctttgaatatgattatgggtcttgaatcctggagtagtttgcctcaatggctcaatgaaagtttagatcaattcgagac

SEQ ID NO: 3151 - DNA, 669 bp, Triticum aestivum
cagaaaaacagagcacccgcacagaaaagcagagacccgcacgcatcgttggtccagctccccttccctcccgcagttccacccccgcctccgagtccggcgaccgcaagcaacccagccggcgaccgcagcgagcgagcgagcgcgatggggctgtgctcgtgctgctgccggtgcctggagatcctgtgcgccatcctcctcccgcccctcggcgtctgcctccgccacggctgctgctccatggagttctggatcagcgtgctgctcaccatcctcggctacctccccggcgtcctctacgccgcctacgtcatctgctccgtcgaccccgaccgcgtccgccgccgcgacgacgactacatctacgtcgcctgagcagcactcctcccctcccccgccgtgtggtctttctatgggattaggttagtggaatgaaccagccctgttcctgccccctgtatatgtacattttggacgggttatatatagtacctgaaattggatccagatttgctggtaccgtggattgcagttaccgcttacttgcctgattcagctgtggttgttggtttatgagtatttcatctgggttcatttcaactttgctgtgatgataatactttgatataacaaattccatcctagatccatttcagaaaaaaaaaa

SEQ ID NO: 3152 - DNA, 684 bp, Pennisetum glaucum
gtagtgagtttcgagtcccttccgctcgacgagaagaaacagccagaggcgttcgttccccatctccgaactccccgaagcgagcgagcgagcagagcagcgcccgaggatccgaggcagcgagtcaccaaccggccggccgcaggaggaagagggggacgagatggggtgctgttgccggtgcctggagctcctgtgctccgtcctgctcccgcccctcggcgtctgcctccgccacggctgctgctccttggagttctggatcagcgtcgtgctcaccatcctcggctacctccccggcgtcctctacgccatctacgtcatctgctctgtcgacccccaccgccacgacgaccccgacgactacgtctacgtcgcctgaccaccggatggcgccgccgatccgccagccatggtgttctggtgtgctccatacctacctaccgatctacgcacgcccgtgtctctgtgttgggtacttgggttcgtagacttcgaatcatttccgtgcccgtgtgtaaattgtaaatcggtgtatccaatttgacaatctggacggattcatcttgtggagatctggatttgtggagtttctgctgtcgattgggttaatttcggtaactggtccaattgcagttgtgaattcgctcctgtatccatgagtgttgccccattcaaagttta

SEQ ID NO: 3153 - DNA, 2989 bp, Triticum aestivum
ggggagatatgtcacatattggagagaaaggtctcaacttatcgggtggacagagagcccgtctagcattggcaagggctttgtatcatgactctgatgtatacttgttcgatgatatacttagtgcagttgactcacaggttgcttcatggatcctcgaaaaggccattatgggaccacaaatgaagcgaaaaacacgattattaagcacccacaatctccaggctatttatgctgcagatatgattgtggtcatggctaatggatttgtcaaatggttcgggacattggacagtttcttggcaactccatattcaaaaatatctaatccagatagttcatctgctgtctcagcaacaagttcacaaaaaataaaggaccaagcacctttgaattcaacactaaagatgtgcttgacaatggttcagtggttgatcaggaggaacaaagagatcagactgaagcagagggcaggaaagaaggcatggttgagataattgtgtacaaaaaatatgcaacacttgcagggtggtcaatggtatttctgatatttgtgactgcattcttaatgcaagcatctcgtaatggcaatgatctttggttgacttactgggtggatagcagctcaggcaccaataacacaagattttatctgactatcctcgctgggtttggcataatcaactcctttttcacattgggaagggcattttcttttgcatatggcggtctgtgtgcggcaattcagatacatgcagatcttcttggcagtctaatcggtgccccggtttcttttttcgaccaaaatcccagtggccgaatactgaatagattatcgtcagacctctacactgttgatgattctcttccatttatcctcaatatatttgtggccaacttcttcggcttacttggcacccttgttgttttgtgttattcacaggttatgtttctactcatcttagtccctctctggcttatctacagcaaagtgcagttctattacaggtcgacatcacgtgaagtacgacggcttgacagtgttgctcgttcacctatctattcatcttttacagagacacttgatggttcatcaacgataagagcattccaaaaggaggttttttcttagagaggttcatccaacaactgacactatatcagaaaacatcctactctgagcttactgctagtctgtggctctcactaagactccagttgttggcagggttgatcattttattcatcgctgtgatttccgttgttggcttccatagcaactctcctgttaagtttggtacacctggactggttggcctggcgttatcgtatgcagcacctgttgtatcactgttgaatagcttcttaaccacttttacagagacagaaaaggaaatgatctctgttgagagggttgttgagtatgtcgatatacctcaagaagaactccagggatcagaatctcctgatagaagttggccaacagaagggaagattgagtttgagcatgtaactctaaggtacaaagcggatctaccaccagctttggatgaaatatcattccatattgaatctggcatgcaggttggaataataggaaggaccggagcaggaaaatccagtatactgaatgcacttttccgtttaactccaatatgcaatggtcgcatcttagtagacggttttgatgtggccaaagttgctgtccaagatcttcgtggacattttgcagtagtaccccagagtccgtttttgtttgatggttctttgagggaaaacctagaccctttcggtataacaacagatatcaggatatgggaagctcttgaaaaatgccatatgaaggcagagatagaatcaataggaggactcaatattcatgtgaaagaaagtggtggatccttttcagtaggccagcgacaactcctatgtctcgcccgtgctatcctaaaatcatcaaaggtactttgccttgatgagtgcacagccaatgttgacaatcagacagcattcctgttacagaaaactatttctgctgaatgcaagggcatgacggtcctcaccatagcccaccgcatttcaactgtgatgaagatggacaatattctagttcttgatcaaggcaaactggttgaagaaggaaacccggaggttcttatgaatgatgacagatcaagattctcacgatttgcgaaggcatctatgtgatcctaggaaaatcatgtgccactctgtgttgtactactagatgaaacactagcgcttagctgcatctctcactttgatcaatgataccgtcttcagctcgcatgcgcatctaagagcttataggaagcctgatcctctagcttatgaatcgatttgtcggaactcaaggttttctgaaatggatctaggatataatttgttatatcaaagtattgtcatcacagcaaagttgaaatgaacccagatgaaatactcataaaccaacaatcacaaccgaaccaggcaagtaagcagtagtactgcagtaattgcaatccacggtaccagcaaatctggatccaatttcaggcactatgtaacccgtccaaaatgtacatatacaggggggcaggaacagggctggttcattccactaacctaatcccacagaaagaccacacggcgggggaggagaggagtgctgctcaggcgacgtagatgtagtcgtcgtcgtggcggcggacgcggtcggggtcgacggagcagatgacgtaggcggcgtagaggacgccggggaggtagccgaggatggtgagcagcacgctgatccagaactccatggagcagcagccgtggcggaggcagacgccgaggggcgggaggaggatggcgcacatgatctccaggcaccggcagcagcacgagcacagccccatcgcgctgtctccggctgggttgctcgcggtcgccggactcggaggcggaggcggagctgcgggagggaagtcgaccaacaacgatg

SEQ ID NO: 3154 - DNA, 494 bp, Triticum aestivum
cgcacgcatcgttggtccagctcccctcccctcccgcagctccgcccccgcctccgagtccggcgaccgcaagcaacccagccggcgaccgcagcgagcgagcgagcgcgatggggctgtgctcgtgctgctgccggtgcctggagatcatgtgcgccatcctcctcccgcccctcggcgtctgcctccgccacggctgctgctccatggagttctggatcagcgtgctgctcaccatcctcggctacctccccggcgtcctctacgccgcctacgtcatctgctccgtcgaccccgaccgcgtccgccgccgcgacgacgactacatctacgtcgctgagcagcactcctcccctcccccgccgtgtggcctttctgtgggattaggttagtggaatgaaccagccctgttcctgcccccctgtatatgtacattttggacgggttatatagtgcctgaaattggatccagatttgctgtaccgtggattgca

SEQ ID NO: 3155 - DNA, 527 bp, Triticum aestivum
cgttggtccagctccccttccctcccgcagttccacccccgcctccgagtccggcgaccgcgagcaacccagccggagaccgaccgcagcgagcgagcgagcgcgatggggctgtgctcgtgctgctgccggtgcctggagatcatgtgcgccatcctcctcccgcccctcggcgtctgcctccgccacggctgctgctccatggagttctggatcagcgtgctgctcaccatcctcggctacctccccggcgtcctctacgccgcctacgtcatctgctccgtcgaccccgaccgcgtccgccgccacgacgacgactacatctacgtcgcctgagcagcactcctctcctcccccgccgtgtggtctttctgtgggattaggttagtggaatgaaccagccctgttcctgcccccctgtatatgtacattttggacgggttacatagtgcctgaaattggatccagatttgctggtaccgtggattgcaattactgcagtactactgcttacttgcctggttcgg

SEQ ID NO: 3156 - DNA, 554 bp, Cynodon dactylon
gggggctcccgtatttctcagaaaaagcggagccgcgccaagaggaccgaccggaggcgaaggaggagatgggcttgtgctcgtgctgctgccggtgcctcgagctcctgtgctccgtcctcctcccgcccctcggcgtctgcctccgccatggctgctgctccctggagttctggatcagcgtggtgctcaccgtcctcggctacgtccccggcgtcctctacgccgtctacgtcatcctcaccgtcgaccctcgcggccgcgaccgcgaccctgacgatgactactactacgtcgcctgatccgccgatctcggtggcccctgcctcccatcgccgcgtgggtagccgcttacccgtcttggttagtaggataaacggatcctgttgatgtcccttgtaaattggagtgttcatgttgctcaataatacgacaatttgatcaaattacctgaatccaaatgtgctgctggtggttctatgctgttaatttagagtggactaggtacatgattcggctctggttactacgaaggctgatgttaatttggaata

SEQ ID NO: 3157 - DNA, 499 bp, Avena sativa
cacctccgcctccgagtccggcgaccgcgagcgagcagccaggggcagcaagcaagcaaccgcggcgcgcggggaagggagcgagatggggctgtgctcgtgctgctgccggttcctggagatcctctgcgccatcctcctcccgcccctcggcgtctgcctccgccacggctgctgctccatggagttctggatcagcgtgctgctcaccatcctcggctacctgccgggcgtcctctacgccgcctacgtcatcctctccgtcgaccccgaacgcgtccgccgcggcgaccccgacgactacatctacgtcgcctgatgatccaccctgcggtcaagccgtgcgcgcatcctccctccctcccctgccgtgtgctggtcctctgtatggggttataaataggttagtagaatgtcaggcctgtttcttccccttgtatatgttcagtttagacgggtttatatactactacttgaactggatcaagatttgctggta

SEQ ID NO: 3158 - DNA, 613 bp, Secale cereale
gactcagcccgcacaagtcgcgaggcctcgctgtccctctgcccgcgtctccgtgtcccccaacccaaccgagccgcgatctctatctcccccacagaaaaacagagccgcgcacgcatcgttgttggtcgacatccatccctcccgcagttccgcctccgagtccggccaacgcgagcaacccagccggaggcagcagcgagcgagcgaaccgcgatggggatgtgctcgtgctgctgccggtgcctggagatcctgtgcgccatcctcctcccgcccctcggcgtctgcctccgccacggctgctgctccatggagttctggatcagcgtgctgctcaccatcctcggctacctgccgggcgtcctctacgccgcctacgtcatctgctccgtcgaccccgaccgcgtccgccgccgcgacgacgactacatctacgtcgcctgagcagctcccctcccccgccgtgtggtctttctgtgggattaggttagttgaatgaaccagtcctgttcctgccccctgtatatgtacattttggacgggttatatagtacctaaaactggatccagatttgccggttacagttcgcttatggcttcctaattgcct

SEQ ID NO: 3159 - DNA, 562 bp, Triticum aestivum
cgttggtccagctcccctcccctcccgcagctccgcccccgcctccgagtccggcgaccgcgagcaacccagccggagacagctgcgggcgagcgaaccgcgatggggctgtgctcgtgctgctgccggtgcctggagatcatgtgcgccatcctcctcccgcccctcggcgtctgcctccgccacggctgctgctccatggagttctggatcagcgtgctgctcaccatcctcggctacctgccgggcgtcctctacgccgcctacgtcatctgctccgtcgaccccgaccgcgtccgccgccgcggcgacagcgacgacgactacatctacgtcgcctgagcagaaccagccgccgctcctcccctcccatcctgtgggattaggttagtggaatgaaccagtcctgttcctgccccctgtatacgtacacttcgggtgacaggttatatacctgaaattggatccagatttgctggtaccgtttaatgcagttactgcttacttgcctggttcagttgtggttgctggtttatgagtatttcatctgggttcatttcaa

SEQ ID NO: 3160 - DNA, 711 bp, Brachypodium distachyon
gggctccaccgctccagcctccaggtagcaagtgcttgtgttttgctgtcctctctccgacacctcgtcgatcgagttcctaaagagaagcaagcaagcaaaggggatccccccgcctccgcatccggcgacagcgaccaaccggagccaacagcgggccgcaggagggagcggggagatgggtctggggtcgtgctgctgccggtgcctggagatcctgtgcgccatcctcctcccgccgctcggcgtctgcctccgccacggctgctgctccatggagttctggatcagcgtgctgctcaccatcctcggctacctgcccggcgtcctctacgccgcctacgtcatcctctccgttgaccccgaccgcgtccgccgccgcggccacgacgacgacgatgactacatctacgtcgcctgaccgaccaccaacttgtggccggccatccatgactgcctctgcctccctcccctgcatcgatctctgtatggtgttcggttagtagaatccagagtccctgttcctgccccctgtaaacctgtcgtaccatgtacttgtatcatgttaaatttcaacgagattttgagacggtttgccgactgccgttcgtgtgtggcagcttacttgcctgcgtcagttgtgattgtgagtgtcttgactgatccactttaacttggttacaaacataatcgaccccatccttattcatt

SEQ ID NO: 3161 - DNA, 1017 bp, Brachypodium distachyon
tgtaaaacttcgactcgacggaaatgaaatttccaactgtccctctacagcttgggctccaccgctccagcctccaggtagcaagtgcttgtgttttgctgtcctctctccgacacctcgtcgatcgagttcctaaagagaagcaagcaagcaaaggggatccccccgcctccgcatccggcgacagcgaccaaccggagccaacagcgggccgcaggagggagcggggagatgggtctggggtcgtgctgctgccggtgcctggagatcctgtgcgccatcctcctcccgccgctcggcgtctgcctccgccacggctgctgctccatggagttctggatcagcgtgctgctcaccatcctcggctacctgcccggcgtcctctacgccgcctacgtcatcctctccgttgaccccgaccgcgtccgccgccgcggccacgacgacgacgatgactacatctacgtcgcctgaccgaccaccaacttgtggccggccatccatgactgcctctgcctccctcccctgcatcgatctctgtatggtgttcggttagtagaatccagagtccctgttcctgccccctgtaaacctgtcgtaccatgtacttgtatcatgttaaatttcaacgagattttgagacggtttgccgactgccgttcgtgtgtggcagcttacttgcctgcgtcagttgtgattgtgagtgtcttgactgatccactttaacttggttacaaacataatcgaccccatccttattcatttcagaaagtctcgactctcgagctatgttaacagaatcataatctagaagatcatgttaacatgttccttgctcttgggggataaagtatcagtgatcaaagtgagtgctacgactatgccctagtgtttcccctggtactataacagagtagcacaagatttccccagaatcacatcctagatgcctttgcaaattgtgagaatcttgagcattcgtcattcctaagaacctctgggtttccttcttcgacc

SEQ ID NO: 3162 - DNA, 733 bp, Hordeum vulgare
gaacttgcagccaacccagcccgcacaggtcgcgatctgcccccgcagagaaacagagccgcgcacgcatcgttgttggtcgacatccctcccgcagtccacacctccgcctccgagtccggcgaccgcgagcaacccagccgggagaccgcagcgagcgaagcgcgatggggatgtgctcgtgctgctgccggtgcctggagatcatgtgcgccatcctcctcccgcccctcggcgtctgcctccgccacggctgctgctccatggagttctggatcagcgtgctgctcaccatcctcggctacctgccgggcgtcctctacgccgcctacgtcatctgctccgtcgaccccgaacgcgtccgccgccgcggcgacagcgacgacgactacatctacgtcgcctgagcggcaaccagccgctgctcctcccctccgtcccccgccgcgtggtctctctatgggattaggttagtggaatgaaccagccatgttcctgcccccctgtatatgtatatgtaatgtatgtgtacactttggatgacagcttatatacctgaaattggatccagatttgctggtaccgtggaatgcaattactgcagtactgcttacttgcctggttcagttgtgattcttggtttatgagcatttcatctgggttcatttcaactttgctgtgataatacttggatataacagattctatcctagatccatttcagaaaacctcg

SEQ ID NO: 3163 - DNA, 592 bp, Hordeum vulgare
caacccagcccgcacaggtcgcgatctgcccccgcagagaaacagagccgcgcacgcatcgttgttggtcgacatccctcccgcagtccacacctccgcctccgagtccggcgaccgcgagcaacccagccggagaccgcagcgagcgaagcgcgatggggatgtgctcgtgctgctgccggtgcctggagatcatgtgcgccatcctcctcccgcccctcggcgtctgcctccgccacggctgctgctccatggagttctggatcagcgtgctgctcaccatcctcggctacctgccgggcgtcctctacgccgcctacgtcatctgctccgtcgaccccgaacgcgtccgccgccgcggcgacagcgacgacgactacatctacgtcgcctgagcggcaaccagccgctgctcctcccctccgtcccccgccgcgtggtctctctatgggattaggttagtggaatgaaccagccatgttcctgcccccctgtatatgtatatgtaatgtatgtgtacactttggatgacagcttatatacctgaaattggatccagatttgctggtaccgtggaatgcaattactgcag

SEQ ID NO: 3164 - DNA, 1952 bp, Saccharum officinarum
cccaattcggcgattcccatggcgggctaccgcgggggctcctccaccgccgcctccgccggcggcgcggcggcggcggccttcgccacgcggatgctgctcctcctcacgctgctgccgctcgcgctcgccgccttcgccttcgcgctccagtggcgcggcggcatgcgggacccggccggcgccgcctggcccgccgacacgcagcggttcccgggcatggagaacagcccgctcggatcctcctcctcgtcttcccacgggggcggtggctcctacttcgccgtctcctcctcctcgtcctcccccggagccgactgcgccgagatcctcggccggagcgccgcgtcctccaacggaatctcgctctaccgcgggtggagcttcgactccgaatcttctataaccccaaagatctgtatcacaggaagcacatctgctggcctacaccagattcttccatggttgtattatcacaaagtcattggtgtttcacatttctttctctttgttgaaggagaggctgcaaagccagctgtcacctctgttcttgaatctattcggggtgtcaaaattatttacagaactaaagaattgaaagagaaacaggacaaaagccgcatttggaacgagacttggctatcaggtttcttttacaagccgtgtaatttcgaactatttgtcaagcaatcactaaacatggaaatggctattattatggcaagggatgctggaatggattggatcattcaccttgatactgatgagttgattcacccagctggtgcccgagagtactccctgaggcgattgcttttagatgttcctgacaatgttgacatggttatcttccccaattatgagagcagcatcgagcgtgatgacattaaggatcctttcactgaggtttccatgtttaagaaaaattatgatcatcttccgaaggatacatactttggtctatacaaagaagcaacacgtggtaatccaaactacttccttacttatggtaatgggaaatcggccgcaagggttcaggagcatttgcgtccaaatggtgctcatagatggcataattacatgaaatctccaaatgaaatcaaattggaggaggctgctattctgcattacacctacacaaagttctcagacctaacctcaaggagggataggtgtggttgcaagccaactaaagaagatgtgaagcgatgttttatcttggaatttgaccgtttggcctttataattgcatcaacagcgactgaggaggagatgaggaactggtaccgggaacatgttgtatggaccgataaagacaccaatttgaaacttttgaggaagggtgtcttaacacgtatatatgcgcccatggcgatcatccgtgggctcaaggaatctggtgtctttaccaatgcagtaacatcagcgaaagcacagtcgaaaacaaagtcatcaaacatgggtctcggaaacgaggccatccagctaaatggaacaggtggtcagtccacactggaaggtggtcacgaaaagttgcaggcaaccgtaagaaagatcctggaaatggttgacgcccaggaagaagcaatgccgccaatgtcgcccccgggttttcttgagctgactgaaagcaccactgctttgtcatgacgcaatttggggttctggaggcgttgtcgagtatttactcgggtttagccatgcatgctgtcttgagcatacggataacataggcttgtttggtcgtcgttgctgtatcttgcaacccccaatatatgtgttgggctgatgtaaaatcgcttcaatcgagtaggctggtgagcaagtacagggcatcagaatagtatactgcgatgtatacagaaagctggtgaatctctcctgttggaaaccaaaccatggattgttgtctaacaagtactgataagcatattagtaattgtttggtcgtc

SEQ ID NO: 3165 - DNA, 2088 bp, Sorghum bicolor
cgcgagtgtgcttgtcttgtacagccaacgactgcgcacctcgcgtcctcctcctcctccaatcccaattcccatggcgggctaccgcgggggctcctccaccgccgcctccgccggcggcgggggcggcgcgtcggccgcggccttcgccacgcggatgctcctcctcctcacgctgctgccgctcgcgctcgccgccttcgccttcgcgctccagtggcgcggcggcatgcgggacccggccggcgccgcctggcccgccgacacgcagcgcttcccgggcatggagaacagccctctcgggtcctcctcgtcttcccacgggggcggtgcctcctacttcgcggtatcctcctcctcctcctcctccccgggagccgactgcgccgagatcctcggccggagcgccgcgtcttcttccaacggaatctcgctctaccgcggatggaacttcgactccgaatcttctataacccccaagatctgtatcacgggaagcacatctgctggcctacaccagattctcccatggttgtattatcacaaggtcattggtgtttcacatttctttctctttgttgaaggagaggctgcaaagccagctgtcacctctgttcttgaatctattcggggtgtcaaaattatttacagaactaaagagttgaaagagaaacaggacaaaagccgcatttggaacgagacttggctatcaggtttcttttacaagccttgtaattatgaactatttgtcaaacaatcactaaacatggaaatggctattattatggcaagggatgctgggatggattggatcattcaccttgatactgatgagttgattcacccagctggtgcccgagagtactccctgaggcgattgcttttagatgttcctgacaatgttgacatggttatcttccccaattatgagagcagcattgagcgtgatgacattaaggatcctttcactgaggtttccatgtttaagaaaaattatgaccatctaccaaaggatacatactttggtctatacaaagaagcaacacgtggtaatccaaactacttccttacttatggtaatggaaaatcggctgcaagggttcaggagcatctgcgtccaaatggtgctcatagatggcataattacatgaaatccccaaatgaaatcaaattggaggaggctgctattctgcattacacctacacaaagttctcagacctaacctcaaggagggataggtgtggttgcaagccaactaaagaagatgtgaagcgatgttttatcttggaatttgaccgtttggcctttataattgcatcaacagcgactgaggaggagatgaggaactggtaccgggaacatgttgtatggaccgataaagacaccaatttgaaacttttgaggaagggtgttttaacacgtatatatgcgcccatggctatcatccgtgggctcaaggaatctggtgtctttaccaatgcagtaacatcagcgaaagcacagtcgaaaacaaagtcatcaaacacgggtttcggaaacgaggccatccaactaaacggaacagctggtcagtccacactagaaggtggtcacgaaaagttgcaggcaaccgtaagaaagatcctagagatggttgacgcccaggaagaagcaatgccgccaatgtcgcccccaggttttcttgagctgactgaaagcgccactgctttgtcatgatgcaatgcggggtcctggaggcgttgtcgagtacttactcagtcaggtttagccatgcatgctgtcttgagcatacggtcatacggataacataggcttgtttggtcttcgttgctgtgtcttgcaaccctcaatgtatgtgttgggctgatgtaaaatcgcttcaaaaaatcaagtaggctggtgagcaaggacagggcatcagaatagtatactgcgtctgcgatgcatacagaattgttgtctcatgttggaaaccaaaccatggattgttgtctaacatgtactgataagcatatatagtttattgattggccgtggatggcaggaatgcttgagaatgtctttccgaataaaaacagctgcctgct

SEQ ID NO: 3166 - DNA, 2161 bp, Sorghum bicolor
tccagtcctccttcttcttcttccccaacgctttggacttggagttctccgcgagtgtgcttgtcttgtacagccaacgactgcgcacctcgcgtcctcctcctcctccaatcccaattcccatggcgggctaccgcgggggctcctccaccgccgcctccgccggcggcgggggcggcgcgtcggccgcggccttcgccacgcggatgctcctcctcctcacgctgctgccgctcgcgctcgccgccttcgccttcgcgctccagtggcgcggcggcatgcgggacccggccggcgccgcctggcccgccgacacgcagcgcttcccgggcatggagaacagccctctcgggtcctcctcgtcttcccacgggggcggtgcctcctacttcgcggtatcctcctcctcctcctcctccccgggagccgactgcgccgagatcctcggccggagcgccgcgtcttcttccaacggaatctcgctctaccgcggatggaacttcgactccgaatcttctataacccccaagatctgtatcacgggaagcacatctgctggcctacaccagattctcccatggttgtattatcacaaggtcattggtgtttcacatttctttctctttgttgaaggagaggctgcaaagccagctgtcacctctgttcttgaatctattcggggtgtcaaaattatttacagaactaaagagttgaaagagaaacaggacaaaagccgcatttggaacgagacttggctatcaggtttcttttacaagccttgtaattatgaactatttgtcaaacaatcactaaacatggaaatggctattattatggcaagggatgctgggatggattggatcattcaccttgatactgatgagttgattcacccagctggtgcccgagagtactccctgaggcgattgcttttagatgttcctgacaatgttgacatggttatcttccccaattatgagagcagcattgagcgtgatgacattaaggatcctttcactgaggtttccatgtttaagaaaaattatgaccatctaccaaaggatacatactttggtctatacaaagaagcaacacgtggtaatccaaactacttccttacttatggtaatggaaaatcggctgcaagggttcaggagcatctgcgtccaaatggtgctcatagatggcataattacatgaaatccccaaatgaaatcaaattggaggaggctgctattctgcattacacctacacaaagttctcagacctaacctcaaggagggataggtgtggttgcaagccaactaaagaagatgtgaagcgatgttttatcttggaatttgaccgtttggcctttataattgcatcaacagcgactgaggaggagatgaggaactggtaccgggaacatgttgtatggaccgataaagacaccaatttgaaacttttgaggaagggtgttttaacacgtatatatgcgcccatggctatcatccgtgggctcaaggaatctggtgtctttaccaatgcagtaacatcagcgaaagcacagtcgaaaacaaagtcatcaaacacgggtttcggaaacgaggccatccaactaaacggaacagctggtcagtccacactagaaggtggtcacgaaaagttgcaggcaaccgtaagaaagatcctagagatggttgacgcccaggaagaagcaatgccgccaatgtcgcccccaggttttcttgagctgactgaaagcgccactgctttgtcatgatgcaatgcggggtcctggaggcgttgtcgagtacttactcagtcaggtttagccatgcatgctgtcttgagcatacggtcatacggataacataggcttgtttggtcttcgttgctgtgtcttgcaaccctcaatgtatgtgttgggctgatgtaaaatcgcttcaaaaaatcaagtaggctggtgagcaaggacagggcatcagaatagtatactgcgtctgcgatgcatacagaattgttgtctcatgttggaaaccaaaccatggattgttgtctaacatgtactgataagcatatatagtttattgattggccgtggatggcaggaatgcttgagaatgtctttccgaataaaaacagctgcctgctaagtgctaacgacttaagtattac

SEQ ID NO: 3167 - DNA, 2084 bp, Setaria italica
ccactcgtgccaagcaacgctcgacttctccgcgagtgtgctgtacagccaacgactccgcaccgcgcctcctccaccgaccggccggcctcccatcccatggcgggctaccgcggcggctcctcctccgcctcctccgccggcgggggcggcgcgtcggccgcggccttcgccacgcggatgctcctcctcctcacgctgctgccgctcgcgctcgccgccttcgccttcgtgctccagtggcgcggcggcatgcgggacccggccggcgccgcctggcccgacgacacgcagcgcttcccggggatggagaacagccctctcggatcctcctcctcctcctcctccactcggggcaaaggctcctacttcgccgtctcctcctcctcctccgcggcagcagactgcgccgagatcctcggccggagcgcatcctcccacggagtctcgctctacggcggctggagcttcgattctgaatcttctataactcccaagatctgtatcacgggaagcacatctgctggcctgcaccagattcttccatggttgtattatcacaaggtcattggtgtttcacatttttttctctttgttgaaggagaggctgcgaagccagctgtcacctctgttcttgaatctattcggggtgtaaaaatcatttacagaactaaagaactgaaagagagacaggacaaaagccgcatctggaatgagacttggctgggaggtttcttttacaagccgtgcaattatgaactatttgttaagcaatcacttaacatggaaatggctattattatggcaagggatgctggaatggattggataattcaccttgatactgatgagttgattcatccagctggtgcgcgagagtactctctaaggcgattgcttttagacgttcctgacaatgttgacatggttatcttccccaattatgagagcagcattgagcgggatgacatcaaggatccatttactgaggtttcaatgtttaagaaaaattacgaccatctcccaaaggatacatactttggcctatacaaagaagcaacacgtggtaatccaaattacttcctcacttatggtaatggaaaatcagctgcaagggttcaggagcatttgcgtcccaatggtgctcatagatggcataattacatgaaaaccccaaacgaaattaaactggaggaggctgctatcctgcattacacctacacaaagttttcagacttaacttcaaggagggataggtgtggctgcaagcccactaaagaagatgtgaagcgatgtttcatcttggaatttgaccgattggcctttataattgcatcaacagctactgaggaggagatgaggaactggtatcgagaacatgttgtatggaccgataaggacaccaatttgaaacttttgagaaagggtgtgttgacacgtatatatgcgccaatggctatcatccgtggtctcaaggaatccggcatcttcacctccgcagtaacatcagcgaaagtgcagtcaaaaacaaagtcgtcgaacatgggtcttgagaacaaggagtccatcctacccaatgtaacagctgggcaatccacattggaaggtggccatgagaaattgcaagcaactgtaagaaagatcctagaaatggttgatgcccaggaggaagctatgccgccaatgtcaccccccggttttgttgagctgattgaaagcgctttgtcatgaggccatgtgagattgatcaggcgatcttgactgatgtcgctcctgggcagatgaaactttaacaatgcatatgcagcgtggaacatatagatagcagaggcttgtttgatcgatgtatcttgcgactccccccatgccttgtgctgatgtaaattgcttccatcacgtgggctggtaagcaagtgcaagacatgagaataacatactcactgtaatatatacaacagaaatcaggcgaatctttccccgggtttaagttatagattgattgatgttaaatttctactgagaagcatatgcacatcgcttgaccatgttgtggtggtggctgacgcaaatgcagtactgatcga

SEQ ID NO: 3168 - DNA, 1929 bp, Panicum virgatum
gcctcccatcccatcccatggcgggctaccgcggcgcctcctccgctgccgggggcggcgcgggggctgcggccttcgccacgcggattctgctcctcctcacgctgctgccgctcgcgctcgccgccttcgccttcgtgctccagtggcgcggcggcatgggggacccggccgccgccgcctggcccgccaacaagcagagcttccccggcatggagaacagcccgctcggatcctcctcctcctccccagggggcggaggctcctacttcgccgtctcctcctcgtcctccgcggcagccgactgcgccgagatcctcggccggagcgcatcctcgaacggaatctcgctctatcgcggctggaacttcgattctgaatcttccatcacccccaagatctgtatcacaggaagcacatctgctggcctacaccagattcttccgtggttgtactatcacaaggtcatcggcgtttcacattttattctctttgttgaaggagaggctgcgaaaccagctgtcacctctgttcttgaatctattcggggtgtaaaaattatttacagaactaaagaactgaaagagaaacaggacaaaagccgcatttggaacgagacttggctggcaggtttcttttacaagccatgcaattatgaactatttgttaagcaatcacttaacatggaaatggctattattatggcaagggatgctggaatggattggatcattcaccttgatactgatgagttgattcatccagctggtgcgagagagtactctcttaggcgattgcttttagatgttcctgacaatgttgatatggttatcttccccaattacgagagcagcattgaacgggatgacatcaaggatccatttactgaggtttcaatgtttaagaaaaattacgatcatctcccaaaggatacatactttggcctatacaaagaagcaacacgtggtaatccaaattacttcctcacttatggtaatggaaaatcagctgcaagggttcaggagcatttgcgtcccaatggtgctcatagatggcataattacatgaaaaccccaaacgaaatcaaattggaggaggctgctatcctgcattacacctacacaaaattctcggacctaacctcaaggagggataggtgtggctgcaagccaactaaagaagatgtgaagcgatgctttatcttggaatttgaccgtttggccttcataattgcatcgacagctactgaggaggagatgaggaactggtataaggaacatgttgtctggactgataaggacaccaatttgaaacttttgagaaagggcgtgttaacacgtatatatgcgccgatggctatcatccgtggtctcaaggaatctggcgtctttacctcggctgtaacatcagcgaaagcacagtcagaaacaaaatcatcaaacatgggtctcggaggcaaggagtccatcataccaaacacaacagctggccatgaaaaattgcaagctactgcaagaaagatcctagagatggttgatgcccaggaagaagcgatgccgccactgtcaccccccggttttgttgagctgactgaaagtgctttgtcatgaggccatgtgagattgtggagttgctctggactgatgatgctcatgggctcttggcggatgaaactttaaccatgcatgaagcgttgaacatatagataacaaacagagaggaggcttgtttggtgggtgtatcttgcctccccatgtcttgtgctgatgtaaaattgcttttattacgtaggctggtaagcaagtgcaagacatgagagtagtatactgtaatatatgcagaaatcaggcgaatctttgtcctggtttgagttaattcctacggagaagcatatatatattgtgacgcaaaggcaatattggtagacgt

SEQ ID NO: 3169 - DNA, 1996 bp, Brachypodium distachyon
caccgacccgactctccccaatggcgggctaccgcggggcctcctcctccgcggccggcgccggcggcggggcggcggcgttcgcgacgcgcgtgctactcctcctgacgctgctgccgctcgcgctcgcggccttcgccttcgtgctccagtggcgcggcggcatgcgcgacccgacggggaccgcctggcccgccgacacccagcggttccccggcatggagaacagcccgctcgggtcctcctcctcgggtggcgggggctcctacttcgcagtcacctccgcgtagggctcctccgcggccgccgactgcgccgagatcctcggccgcagcgcctcctcccacggcatctccctctaccgaggctggagcttcgactccgacgccgctataacccccaagatctgcatcacgggaagcacatctgctagcctacaccaaattcttccatggttatattatcacaaggtcattggtgtttcacactttattctatttgttgaaggagaagcagctaaaccagctgttacttctgttcttgaatctattcggggtgtaaaaattattttcagaactaaggaactaaaagagcaacaggacagaagccgcatttggaatgagacttggctttcgggtttcttttacaagccgtgcaattatgaactatttgttaagcagtcacttaatatggaaatggctattgttatggcaagggatgctggaatggattggatcatacatcttgacactgatgagttaattcatccagcgggtgcccgagagtactctctgaggcgattgcttttagatgttcctgataatgttgacatggttatcttccccaactatgagagcagcattgagagggatgacatcaaagatccttttaccgaggtttccatgtttaagaagaactatgatcatcttccgaaggatacatattttggcctatacaaagaagcaacgcgcggtaatccaaactacttcctcacttatggtaatgggaaatcagcggcaagggtccaggagcatatgcgtccaaatggtgcccatagatggcataattacatgaaaaccccaaatgaaatcaagttggaggaggctgctattctgcattacacttacacaaagttctcggacttaacttcaagaagggataggtgtggctgcaaaccaacaaaggaggacgtgaagcgttgttttatcttggaattcgacagattggccttcataattgcgtcaacagctaccgaggaagagatgaggaactggtaccgggaacatgttgtatggactgacaaagataccaatttgaaacttttgaggaaaggcgttttaacacgcatatatgcgccaatggctattattcgtggtctcaaggaatctggcatcttcactgctgcagtaacttctgcaaaagcaaattccaaagtgaagtcatcgaacagtcttgaaaacaagtctgtccacgcaaatgtaacagctgctcgatccacaacattgaatgaacgtggtagtcacaattctcaagcaaccgcaagaaaggttctggaaatggttgatattcaggaaggagcgatgccaccaatgtcaccccctggtttccttgagctcgtcgaaagtgcgttgtcatgaatgtgagattctgtaagcatgcttgattgttcttggctttcgacgagcagctcttccgagccgaggtacctaaccatacagtggtgactgctgatcatgtatctcttctttggtgcagactgcaggttgccactactcagctagttcacctttatgtatagatagcgctagggtcgcttggcgacgtgttgttgtgttaactccggatgtcatatgttgtatctcgctcttagtatggatgagaggtaaactaaatcccaatgagacatgcatttatttgaccatgttttattggtcgttaatgcgaaggaaatactgatggatgaagatttctcatttctcaggttactgcatgctaa

SEQ ID NO: 3170 - DNA, 2469 bp, Brachypodium distachyon
tccgccggcaacgctcgctgctgagctcgagccggctgcacaacacaagcgggggcgagaggcggaggcccccacgcccactccctccctcttcaccaacctgccaccgacccgactctccccaatggcgggctaccgcggggcctcctcctccgcggccggcgccggcggcggggcggcggcgttcgcgacgcgcgtgctactcctcctgacgctgctgccgctcgcgctcgcggccttcgccttcgtgctccagtggcgcggcggcatgcgcgacccgacggggaccgcctggcccgccgacacccagcggttccccggcatggagaacagcccgctcgggtcctcctcctcgggtggcgggggctcctacttcgcagtcacctccgcgtagggctcctccgcggccgccgactgcgccgagatcctcggccgcagcgcctcctcccacggcatctccctctaccgaggctggagcttcgactccgacgccgctataacccccaagatctgcatcacgggaagcacatctgctagcctacaccaaattcttccatggttatattatcacaaggtcattggtgtttcacactttattctatttgttgaaggagaagcagctaaaccagctgttacttctgttcttgaatctattcggggtgtaaaaattattttcagaactaaggaactaaaagagcaacaggacagaagccgcatttggaatgagacttggctttcgggtttcttttacaagccgtgcaattatgaactatttgttaagcagtcacttaatatggaaatggctattgttatggcaagggatgctggaatggattggatcatacatcttgacactgatgagttaattcatccagcgggtgcccgagagtactctctgaggcgattgcttttagatgttcctgataatgttgacatggttatcttccccaactatgagagcagcattgagagggatgacatcaaagatccttttaccgaggtttccatgtttaagaagaactatgatcatcttccgaaggatacatattttggcctatacaaagaagcaacgcgcggtaatccaaactacttcctcacttatggtaatgggaaatcagcggcaagggtccaggagcatatgcgtccaaatggtgcccatagatggcataattacatgaaaaccccaaatgaaatcaagttggaggaggctgctattctgcattacacttacacaaagttctcggacttaacttcaagaagggataggtgtggctgcaaaccaacaaaggaggacgtgaagcgttgttttatcttggaattcgacagattggccttcataattgcgtcaacagctaccgaggaagagatgaggaactggtaccgggaacatgttgtatggactgacaaagataccaatttgaaacttttgaggaaaggcgttttaacacgcatatatgcgccaatggctattattcgtggtctcaaggaatctggcatcttcactgctgcagtaacttctgcaaaagcaaattccaaagtgaagtcatcgaacagtcttgaaaacaagtctgtccacgcaaatgtaacagctgctcgatccacaacattgaatgaacgtggtagtcacaattctcaagcaaccgcaagaaaggttctggaaatggttgatattcaggaaggagcgatgccaccaatgtcaccccctggtttccttgagctcgtcgaaagtgcgttgtcatgaatgtgagattctgtaagcatgcttgattgttcttggctttcgacgagcagctcttccgagccgaggtacctaaccatacagtggtgactgctgatcatgtatctcttctttggtgcagactgcaggttgccactactcagctagttcacctttatgtatagatagcgctagggtcgcttggcgacgtgttgttgtgttaactccggatgtcatatgttgtatctcgctcttagtatggatgagaggtaaactaaatcccaatgagacatgcatttatttgaccatgttttattggtcgttaatgcgaaggaaatactgatggatgaagatttctcatttctcaggttactgcatgctaagaacaattagttgaactacctgctgggaaatgaagcctgaacagttgcttttcttgccatgttttctggacgaaattgttgtggatacagcagaatatacgtgtatgacaaacttggaaatttagctcaaactctgtcgagcacgaattagtctagacttcacaaaaaagacccagctctaatgcgcacagtcgattggtggaactaaaatttaaataaaaagtgtagaacatcacttttttttaggaaatatgtagaacatcacttattttcacacctcattcgtctattccttttcgtcttgctgacatgtgtgcagttatatcctttttgtattaaccggagcttattgatatgtgtcgcttgcca

SEQ ID NO: 3171 - DNA, 1695 bp, Pennisetum glaucum
ggatgctgctcctcctcacgctcctcccgctcgcgctcgccgccttcgccttcgcgctccagtggcgcggcggcatgcgggacccggccggcgccgcatggcccgacgacgcgcagcggttccccggcatggagaacagcccgctcggatcctcctcctcctcctcctccgctaggggcagagggtcctacttcgccgtcacctcctcctcctcctccgcggcggcggactgcgccgagatcctcggccggagctcatcctcctccagcggaatctcgctctaccgcggctggagcttcgactccgaatctgctgctgttactcccaagatctgtatcacgggaagcacatctgctggcctgcaccagattcttccatggttgtactatcacaaggtcattggcgtttcacatttttttctctttgttgaaggagaggctgcgaagccagctgtcacctctgttcttgaatctattcggggtgtaaaaatcatttacagaactaaagaactgaaagagagacaggacaaaagccgcatctggaatgagacttggctgggtggtttcttttacaagccatgcaattacgaactgtttgttaagcaatcactcaacatggaaatggctattattatggcgagggatgctggaatggattggatcattcaccttgatactgatgagttgattcatccagctggtgcacgagagtactctctaaggcgactgcttttagatgttcctgacaatgttgacatggttatcttccccaattatgagagcagcattgagcgggatgacatcaaggatccatttactgaggtttcaatgtttaagaaaaattatgatcatctcccaaaggatacatactttggcctatacaaagaagcaacacgtggtaatccaaattacttcctcacttatggtaacggaaagtcagctgcaagggttcaggagcatttgcgtcccaatggtgctcatagatggcataattacatgaaaaccccaaatgaaatcaaactggaggaggctgctatcctgcattacacttacacaaagttctcagacctaacttcaaggagagataggtgtggctgcaagcccactaaagaagatgtgaagcgatgtttcatcttggaatttgaccgattggcctttataatcgcatcaacagctactgaggaggagatgaggaactggtaccgggaacatgttgtatggacagataaggacaccaatttgaaacttttgagaaagggtgtgttgacacgtatatatgcaccaatggctatcatccgtggtctcaaggaatccggcgtcttcacctccgcagtaacatcagcgaaagcgcagtcaaaaagaaagtcgtcaaacatcatgggtgttgagaacaaggactccatgctgcccaatgtaacagccggacagtccacattggaaggtggccacgaaaacttgcaagcaaccgtaagaaagatcctagaaatggttgatgcccaggaggaagctatgccgccgatgtcaccccccggtttcgtcgagctgactgaaagcgctttgtcatgaggaggccatgcgagattctggaggcgatctttcttgactgatgccgctcctgggcggatgcaaattttaacagcgcacgtgcagcgtcgagcataaagatcacagaggctttgtttggtcgttgtatctt

SEQ ID NO: 3172 - DNA, 3211 bp, Oryza sativa
cactcctctcgtcgtcttcgcgtgtgcgacgctgggagagagtacaaccgaactaaaagcggcgaaggcgtctctgtccagtccaccaaccaaccaccgccatggcgggataccgcggcgggggttccgcctcgggcggcggcggcgggggggcgtcgtcggcgtcggcgttcgcgacgcgggtgctgctgctcctcacgctgctgccgatggcgctggccgcgttcgccttcgcgctgcagtggcgcggcgggatgcgcgacccggcgggcgcggcgtggcccgcggagacgcagaggttccccggcatggagaacagcccgctcggatcctcctcctcctcctcgggcgggggcgggggaggcgggtcctacttcgccgtcacctcgtcgcagtcctcctccgcggccgcagactgcgccgagatcctcggccggagcgcggcgtcctcctcgcacggcggcatctcgctctaccgcgggtggggcttcgactccgacgcgggactaacccccaagatctgtatcacgggaagcacatctgcagggttacaccaaattcttccatggttgtactaccacaaggtcatcggtgtttcacactttttcctttttgttgaaggagaggctgcgaaaccagctgttacctcagttcttgaatccattcggggtgtaaaaatcatttacagaactaaagaattgaaagagaaacaggacagaagtcgcatttggaatgagacttggctggcaggtttcttttacaaaccgtgcaattatgaactatttgtcaaacagtcgctgaacatggaaatggctatcattatggcaagggatgctggcatggactggatcattcatcttgataccgatgagctaattcatccagctggtgcccgggagtactctctgaggcgattgcttttagatgttcctgataatgttgacatggttatcttccccaactatgagagcagcattgagcgagatgacatcaaagatcctttcacagaggtttccatgtttaagaaaaattatgatcatcttccaaaggatacatattttggcctatacaaagaagcaacgcgtggtaatccaaactattttctcacttacggtaatgggaaatcagcagcaagggttcaggagcatctgcgtccaaatggtgctcatagatggcataattacatgaaaaccccaaatgaaatcaagttggaggaagctgctattctgcattacacttacacaaagttctcagacttaacttcaaggagggataggtgtggctgcaagcccacaaaggaagatgtgaagcgatgttttatcttggaatttgacagattggcctttataattgcatcaacagctaccgaggaggaaatgaggaactggttccgggaacatgttttatggaacgacaaagataccaatttgaagcttttgaggaagggtgtgttgacacgcatatatgccccaatggctatcattcgtggtctcaaggaatccggcgtattcaccaccgcggtaacttcagcaaaagcgcatgcaaaatttaagtcatcaaatacggatctcaaaaacaaggagtctattcatccaaatataacccaaggtgatcatttgcaagccacagtaagaaagatcctagaaatggttgatgcccaggaagaagcgatgccaccaatgtcgcctcccggtttccttcatcaaaccgtcgaaactgctctatcgtgaagctgagtgggattccggagttaaaaactagaccgctatgcctgccaatggcagctgtttcggtgatttaagatcgctaaccttacaaagatgatgagattattatagactgcagactgcgtatgccgcttcacttatgtgtatagataagcactggggatgttagaacatggacattgtataatcttgcaatttttgatgtcttgtgctgatgtaaaatcacatatgttatacctagattggcattatcaagtgcaaatcatcacggtatctaccgagaaacataatgcaagtgaaaccctgctgtcaatatttttatactgaaattgtataccatttgcacataggtttacccctcttgaatacttgagtagtagtagtaacatagtcaacaaactttgcattcaatagacggaccaaagattcaaaatggatgggccttatttcgagtaatagctggatcatatcccttttccttacagtcttcacagatttcgtcctcttgaatacttgaaagtgtaacacaatcaaacaaactttatattcaaagatgtatcaaaatggatgagccttatttcgagaaacagctggaccatcccttctcattagggtgttcacagattcttgttctctgcatccaagttggcccctagaacaatcatggtaacaaatctacacggttacagtggcttcgatgtcctgaagtctgagggtaacagctcttctgtgagcctctagtccttcgacttcagccatctttgccacatgcggacccagacttctcaacccttcctctgacaaggactggacagtgatgtacttgaggaatgagttcagtgacacgccgctatacatccttgcgtaaccataggttggaaggacatggtttgtgccgcttgcatagtcgcccacgctctccggggtccattgtcccaagaagaccgaccctgtgatgaaaaaacgatcgcctgagattaccattgaagtatgaaaatgttcaggtcaagattaagacgctgacaggtatgcctatacctgcattctcgacaagatcctcccactgttcagcatcctttacattgatgatcaaatgctcaggggcatacatattggagaatgaaattgcctacataaggaagaaagagggggcttgtcaacaatccctgggaacggcaatagatcagataattttcatttaccttcatgcatgctgcaaaattctacgacctcaaactccagtgatgtatagtacgtgccttacaaattataaataattcgagagtgggcaggaatgaagaattacctcaaccatgtctttcgcaaaaacagtgaaactgtggccaagagctttcgaagcaaattctcccctaggaagagcagagcactgcttgctaacttctgcctcaatagcacccaaatcaacaccgtctcccgcaacaactagaacaacctgactgtctgggccatgttccgcctaaaat

SEQ ID NO: 3173 - DNA, 2015 bp, Oryza sativa
gcggcgaaggcgtctctgtccagtccaccaaccaaccaccgccatggcgggataccgcggcgggggttccgcctcgggcggcggcggcgggggggcgtcgtcggcgtcggcgttcgcgacgcgggtgctgctgctcctcacgctgctgccgatggcgctggccgcgttcgccttcgcgctgcagtggcgcggcgggatgcgcgacccggcgggcgcggcgtggcccgcggagacgcagaggttccccggcatggagaacagcccgctcggatcctcctcctcctcctcgggcgggggcgggggaggcgggtcctacttcgccgtcacctcgtcgcagtcctcctccgcggccgcagactgcgccgagatcctcggccggagcgcggcgtcctcctcgcacggcggcatctcgctctaccgcgggtggggcttcgactccgacgcgggactaacccccaagatctgtatcacgggaagcacatctgcagggttacaccaaattcttccatggttgtactaccacaaggtcatcggtgtttcacactttttcctttttgttgaaggagaggctgcgaaaccagctgttacctcagttcttgaatccattcggggtgtaaaaatcatttacagaactaaagaattgaaagagaaacaggacagaagtcgcatttggaatgagacttggctggcaggtttcttttacaaaccgtgcaattatgaactatttgtcaaacagtcgctgaacatggaaatggctatcattatggcaagggatgctggcatggactggatcattcatcttgataccgatgagctaattcatccagctggtgcccgggagtactctctgaggcgattgcttttagatgttcctgataatgttgacatggttatcttccccaactatgagagcagcattgagcgagatgacatcaaagatcctttcacagaggtttccatgtttaagaaaaattatgatcatcttccaaaggatacatattttggcctatacaaagaagcaacgcgtggtaatccaaactattttctcacttacggtaatgggaaatcagcagcaagggttcaggagcatctgcgtccaaatggtgctcatagatggcataattacatgaaaaccccaaatgaaatcaagttggaggaagctgctattctgcattacacttacacaaagttctcagacttaacttcaaggagggataggtgtggctgcaagcccacaaaggaagatgtgaagcgatgttttatcttggaatttgacagattggcctttataattgcatcaacagctaccgaggaggaaatgaggaactggttccgggaacatgttttatggaacgacaaagataccaatttgaagcttttgaggaagggtgtgttgacacgcatatatgccccaatggctatcattcgtggtctcaaggaatccggcgtattcaccaccgcggtaacttcagcaaaagcgcatgcaaaatttaagtcatcaaatacggatctcaaaaacaaggagtctattcatccaaatataacccaaggtgatcatttgcaagccacagtaagaaagatcctagaaatggttgatgcccaggaagaagcgatgccaccaatgtcgcctcccggtttccttcatcaaaccgtcgaaactgctctatcgtgaagctgagtgggattccggagttaaaaactagaccgctatgcctgccaatggcagctgtttcggtgatttaagatcgctaaccttacaaagatgatgagattattatagactgcagactgcgtatgccgcttcacttatgtgtatagataagcactggggatgttagaacatggacattgtataatcttgcaatttttgatgtcttgtgctgatgtaaaatcacatatgttatacctagattggcattatcaagtgcaaatcatcacggtatctaccgagaaacataatgcaagtgaaaccctgctgtcaatatttttatactgaaattgtataccatttgcac

SEQ ID NO: 3174 - DNA, 2032 bp, Triticum aestivum
ccacgcgtccgcttccggcaacgctcgctggggagcagctccacaaccagaggggcggacggaggtctccaccaacctgccaccgactccccccaatggcgggctaccgcagcgcctcctcctcctccgcggccggcgccggaggggcggcggtgttcgcgatgcgcgtgctcctcctcctcacgctgctgccgctcgcgctcgccgcgttcgccttcgcgctccagtggcgcggcggcatgcgcgaccccaccggcaccgtgtggcccgccgacacgcagcggttccccggcatggagaacagcccactgggctcctcctcatcctccacgggaggccgaggctcctacttcgccgtctcctccgcgtcggcctcctccgcggccgccgactgcgccgagatcctcggccggagcgcctcctcccacggaatctctctctaccgaggctggagcttcgactccgacaccgctataacccccaagatctgtatcacgggaagcacatctgctagcttacaccaaattcttccatggttgtattatcacaaggtcattggtgtttcacactttattctatttgttgaaggagaggctgctaaaccagctgttacttctgttctcgaatctattcggggtgtaaaaattatttacagaactaaagaactaaaagaacaacaggacagaagccgcatttggaatgaaacttggctttcaggtttcttttacaagccatgcaattatgagctttttgttaagcagtcacttaacatggaaatggctattgttatggcaagggaggctggaatggattggatcatacatcttgataccgacgagttaattcatccagcgggtgccagggagtactctcttaggcggctgcttttggatgttcctgataatgttgacatggttatcttccccaactatgagagcagcgttgagcgggatgacattaaagatccttttactgaggtttccatgtttaagaagaactacgatcatcttccgaaggatacatactttggcctatacaaagaggccacgcggggtaatccaaactacttcctcacttatggtaatgggaaatcagcggcaagggtccaggagcatatgcgtccgaatggtgctcatagatggcataattacatgaaatccccaaatgaaattaagttggaggaggctgctattctgcattacacttacacaaagttctcggacttaacttcaagaagggataggtgtggctgtaagccaacaaaggaggatgtgaaacgatgttttatcttggagtttgacagattggccttcataattgcatcaacagctaccgagcaagagatgaggaactggtaccgggaacatgttgtatggactgacaaagatacaaatttgaagcttttgaggaagggcgttttaacacgcatatatgcaccaatggctattattcgtggtctcaaggaatctggcatcttcatcgatgcagtaacttctgcaaaagcacaccctaaagcaaacattggtcttgaaaacaatgagtctatccacaccaatgtaacagccgctcagtccacaaccttgaaagaaggcggtaatgacaattctcaagcaactgcaagaaagattctggaaatgattgatgtccaggaagaagcgatgccgccaatgtcaccccctggtttccttgagctcatggaaagcgcattgtcatgaaattatgggaaatgctggaggcttgcttgattcttgtggctgccaagaggttcctaaccatgcagtgttgactgtacgtttgagcacatacatctcgtcttgggtgcaggactatagattgtcaccacgtatatgtacagatagggctggggttgttgggcgttgcgttgtcttgttaaccgccgatgtcttatgatgtatcctgctgtcaattttgaaccttagattgaggtaaaccttgtcccagtgagaggaatgtgatatttgaccatattttattggtcgttgatccaaatgaaatactgatgaaacttttc

SEQ ID NO: 3175 - DNA, 2046 bp, Hordeum vulgare
cagtctccttccggcaacgctcgctggagagcagctccacaaccagagggccggacggaggtctccaccaacctgccaccgactatccccaatggcgggctaccgcagcacctcctcctccgcggctggcggcggaggggcggcggtgttcgcgatgcgcgtgctcctcctcctcacgctgctgccgctcgcgctggccgccttcgccttcgcgctccagtggcgcggcggcatgcgcgacccgaccggcgccgtgtggcccgccgacacgcagcggttccccggcatggagaacagcccgctcggctcctcctcctccacgggaggccgaggctcctacttcgccgtctcctccgcgtcggcctcctccgcggccgccgactgcgccgagatcctcggccggagcgcctcctcccacggaatctctctctaccgaggttggagcttcgactccgacaccgctattacccccaagatctgtatcacaggaagcacatctgctagcttacaccaaattcttccatggttgtattatcacaaggtcattggtgtttcacactttattctatttgttgaaggagaggctgctaaaccagctgttacttctgttcttgaatctattcggggtgtaaaaattattttcagaactaaagaactaaaagaacaacaagacagaagccgcatttggaatgaaacgtggctttcaggtttcttttacaagccatgcaattatgagctttttgttaagcagtcacttaacatggaaatggctattgttatggcaagggaggctggaatggattggatcatacatcttgataccgatgagttaattcatccagcgggtgccagggagtactctctgaggcggttgcttttggatgttcctgataatgttgacatggttatcttccccaactatgagagcagcgttgagcgggatgacattaaagatccttttaccgaggtttccatgtttaagaagaactacgatcatcttccgaaggatacatactttggcctatacaaagaggccacgcggggtaatcctaactacttcctcacttatggtaatgggaaatcagcggcaagggtccaggagcatatgcgtccgaatggtgctcatagatggcataattacatgaaaaccccgaatgaaattaagttggaggaggctgccattctgcattacacttatacaaagttctcagacttaacttcaagaagggataggtgtggctgtaagccaacaaaagaggatgtgaaacgatgctttatcttggagtttgacagattggccttcataattgcatcaacagctactgagcaagagatgaggaactggtaccgggaacatgttgtatggactgacaaagatacaaatttgaagcttttaaggaagggcgttttaacacgcatatatgcaccaatggctattattcgtggtctcaaggaatctggcatcttcatcaatgcagtaacttctgcaaaagcacaccctacagcaaacattgctcttgaaaacaataagtctatccacacaaatgtaacagcggctcagtccacaaccttgaaagaaggcggcaatgacaattctcaagcaactgcaagaaagatcctggaaatgattgatgtccaggaagaagcgatgccgccaatgtcaccccccggtttccttgagctcatagaaagcgcattgtcatgaaattatggaaaatgctggaggcttacttgattcttgtggctgacaagaggttcctaaccatgcagtgttgactgtacttttgagcacatatacctcgtcttggatgcagactgtagattgtcaccacgcatatgtacagatagggttggggttgttgggcgttgcgttgtcttgtttactcccgatgtcttatgatgtatcctgctgtcagttttgaaccctagattgaggtaaaacttgccccagtgagaggaatgtaaaatttggccatattttattggtctttgatccaaatgaaatactgatggaaacttttctcaagttatactccctccgttcct

SEQ ID NO: 3176 - DNA, 1904 bp, Secale cereale
tactcccagtggcggctacgcagcgctctccctcgcgcgcgcggagggcggcggtgttcgcgatgcgcgtgctcctcctcctcactctgctgccgctcgtgctcgccgcgtttcgccttcgcgctccagtggcgcggcggcatgcgcgaccccaccggcaccgtgtggcccgccgacacgcagcggttccccggcatggagaacagcccgctcggatcctcctcctcctccacgggaggccgaggctcctacttcgccgtctcctccgcgtcggcctcctccgcggccgccgactgcgccgagatcctcggccggagcgcctccacccacggcatctcgctctaccgaggttggagcttcgactccgacaccgctataactcccaagatctgtatcacgggaagcacatctgctagcttacaccaaattcttccatggttgtattatcacaaggtcattggtgtttcacactttattctatttgttgaaggagaggctgctaaaccagtggttacttctgttcttgaatctattcggggtgtaaaaattatttacagaactaaagaactaaaagaacaacaggacagaagccgcatttggaatgaaacttggctttcaggtttcttttacaagccatgcaattatgagctttttgttaagcagtcacttaacatggaaatggctattgttatggcaagggaggctggaatggattggatcatacatcttgataccgacgagttaattcatccagcgggtgccagggagtactctctgaggcggttgcttttggatgttcctgataatgttgacatggttatcttccccaactatgagagcagcgttgagcgggatgacattaaagatccttttaccgaggtttccatgtttaagaagaactacgatcatcttccgaaggatacatactttggcctatacaaagaggccacgcggggtaatccaaactacttcctcacttacggtaatggcaaatcagcggcaagggtccaggaacatatgcgtccgaatggtgctcatagatggcataattacatgaaaagcccgaatgaaattaagttggaggaggctgctattctgcattacacttatacaaagttctcggacttaacttcaaggagggataggtgtggctgtaagccaacaaaggaggatgtgaaacgatgttttatcttggagtttgacagattggccttcataattgcatcaacagctactgagcaagagatgaggaactggtaccgggaacatgttgtatggactgacaaagatacaaatttgaagcttttgaggaagggcgttttaacacgcatatatgcaccaatggctattattcgtggcctcaaggaatctggcatcttcatcgatgcagtaacttctgcaaaagcacaccctaaagcaaacattggtcttgaaagcaatgagtctatccacaccaatgtaacagccactcagtccacaaccttgaaagaaggcggtcatgacatttctcaagcaacagcaagaaagatcctggaaatgattgatgtccaggaagaagcgatgccgccaatgtcaccccctggtttccttgagctcatggaaagcgcattgtcatgaaattatgggaaatgctggaggcttgcttgattcttgtggctgacaagaggttcctaaccatgcagtgttgactgtacttttgagcacatatatctcgtcttgggtgcaagactatagattgtcaccacgtatatgtacagatagggctggggttgttgggcgttgcgttgtcttgttaaccgccgatgtcttatgatgtatcctgctgtcagttttgaaccttagattgaggtaaaccttgtcccagtgagaggaatatgatatttgaccatattttattggtcgtt

SEQ ID NO: 3177 - DNA, 1253 bp, Sorghum bicolor
ccgctctccgcctcttcctccacggctccaccacgcactaaccctaaagctttcccgcgttgccggcgatgagcagccttcgagccatctcctctctcctccatatctactactcgtccgccgccgtgagacgaggcgccgggcggctggggttcgcaccggcgctcggcgggagcttccgggtaccgtcgaattccggtccgcccgcgttcgtgctcgacgaggtcgctagggcggccggcggggttcgaaggagagcgtccacgcgcgcggcgagttgggattcggagaagtcgccgtacgagacgcttgagctgggtagggatgcagacgaggagaccataaagactgcctacagaagattggccaagttctatcaccctgatgtttatgatggtaagggaacccttgaggaaggggaaactgctgaagctcgtttcatcaagatccaagcagcgtatgagctgttgattgataatgaaaggagaagggcatatgatagagatcatcatgtgaatccgatgaaggcttctcaagcatggatggagtgggtaatgaagaagcggaaagcttttgaccaacgtggtgacatggctgtggctgcttgggctgagcagcagcaacgcgaaatgacactacgggcacggcgtctctcacgctcaaaggttgatcctgaggaagaaaggaagctatttgccaaggaaaagaaggcatctatggaattctacagcacaactctgaagagacatacccttgtgttacggaagagggatattatgcgcaagaaggcagaggaggagagggataatgagatcagtagacttctagcggcggaagggcttgagctggatacagatgaagatgaaaacaagacttttttggggtaacgcttttgatacttacccctagtttattctcttcctccattccaacagtagctgaagattcagtgacaatgggtctgcaaggcgaaatagttgaactcgtcgggaaccctggtgcctggagatatgcgccgaggatccaagtataatctctcggggcagagtttagcattttaccggagagcagaaagaaaaggcaaatgatggatgcgtaagggctgtagtagtagggttgtaatatgattcaatgaaaaatttcttgcaagcaagagatacgcttgagatatgtatttttcattgtttttgaacgtaacagtgataaagtgatacatggtttatgaatgtaaatgaattgtacagatttgtgac

SEQ ID NO: 3178 - DNA, 972 bp, Saccharum officinarum
tgccggcgatgagcagccttcgagccatctcctccctcctccatatctactacgcgtccgccgccgtgagacgaggcgacgggcgtctggggttcgcgacggcgctcggcgggagcttccgggtaccgtcgaattccgctccgcccgcgttcgtgctcgacgaggtcgcgagggcggccggcggggttcggaggagggcgtccacgcgcgcggcgagttgggactcggagaagtcgccgtacgagacgcttgagctgggtagggatgcagacgaggagaccataaagactgcctacagaagattggccaagttctatcaccctgatgtttatgatggtaagggaacccttgaggaaggggaaactgctgaagcgcgtttcatcaagatccaagcagcgtatgagctgttgattgatgatgaaaggagaagggcctatgatagagagcatcatgtgaatccgatgaaggcttctcaagcatggatggagtgggtaatgaagaagcggaaagcttttgaccaacgtggtgacatggctgtggctgcttgggctgagcagcagcaacgcgaaatgacactacgggcacggcgtctctcacgctcaaaggttgatcctgaggaagaaaggaagctatttgccaaggaaaagaaggcatctatggaattctacagcacaactctgaagagacatacccttgtgttacggaagagggatattatgcgcaagaaggcagaggaggagagggataatgagatcagtagacttctagcggcggaagggcttgagctggatacggatgaagatgaaaacaagacttttttggggtaacgcttttgatacttacccctattttattctctttcaccatttcagcaatagttgaagatccagtgacaatgagtacacaaggcgaaatagttgaacttcttggaaaaccctggtgccttgtagatgttgcgccaaggatccaaaa

SEQ ID NO: 3179 - DNA, 1241 bp, Setaria italica
gcggacctccggcctagcctgcacggctccgcctcttcctcctccacgcccaaaccctaagcttccccccacctcgccggcgatgaacagcctccgagccatctcctccctcctccacatctactcctcgtccgccgccgcgggacgaagcgccaggcggctgggtttcgtgccggcgctcggcgggagcttccgggtcccatcgagtccggggccgcccgcgttcgtgctcgacgaggtcgcgagggcggccggcggggcgcggaggagggcttccacgcgcgcggcgagctgggattcggagaagtcgccgtacgagacgcttgagttgggcagggatgcagacgaggagaccataaagacagcttacagaagattggccaagttctatcaccctgatgtttatgatggcaagggaacccttgaggaaggggaaactgctgaagcccggttcatcaaaatccaagcagcatatgagctgttgattgatgatgaaaggagaagagcatatgatagagagcatcatgtgaatccaatgaaggcttctcaagcatggatggagtgggtaatgaagaagcgaaaagctttcgaccaacgtggtgacatggctgtggctgcctgggctgagcagcagcaacgcgaaatgacactacgagcacggcgtctctcacgctcaaaggttgatcccgaggaggaaaggaaactatttgccaaggagaagaaggcatctatggaattctacagcacaactctaaagagacataccctcgtcttgcggaagagggatattatgcgcaagaaggcggaggaagagaggaacaacgagatcagtagacttctagcggcggaagggcttgagctggatacagatgaagatgaggacaaaacctttttggggtaaacgcttttgatacttacccctaatttgttgtcttcctccattccagcaatagttgaagatccagcgacaacgacacaaggtggaactaagctcatgggaccctggagtctggagatgtacatggagaaatattgtgtcagaatataatcctcaagtttagtattacctggggagttggaaggaaaggtaaatgaagtaaaatcctccaggtggtaggctgtagtatgattgaagcaaagatgcgcctctaatcgatgacactgtactgtatatacaccaaagtagtctgttctactggaaatcaataccataatcaaccatgcatgccttttgctgtttc

SEQ ID NO: 3180 - DNA, 1452 bp, Brachypodium distachyon
cccctgatcgccggcgatgagcagcctccgagcaatctccatcctcctccacacctactactgctcctccgccggccgaggcgctaggcggctttggttcgcgccgccgctcggcgggagcttccgcgccccgtccaaggcgccgcccgcgttcgtgctcgacgaggtcgcgagggcggctgggggcgcgcggaagagggcggcgtccacgcgcgccaccgcgagctgggattccgagaagtccccgtacgagacgctcgagctggacagggatgccgacgaggataccataaagacatcatacaggagattggccaagttctatcaccctgatgtttatgatggtaagggaaccctcgaggaaggagagactgctgaagcccgtttcatcaaaatccaagctgcatatgagctgctgattgatgatgaaaggagaaaggcatatgataaagagcattttgtgaatccactgaaggcttctcaggcatggatggagtgggtgatgaaaaaacgaaaagcttttgataaacgcggcgacatggcggtagctgcttgggcagagcaacaacagcgagaattgacactacgtgcgcgccgtctctctcggtcaaaggttgatccggaggaggaaaggaggttacttgccaaggaaaggaaggcatccatggaattctacagcacaactctaaaaagacatacccttgtcctacggaagcgggaccttatgcggaagaaagcagaggaagacaggaaagatgagatcagtagacttctagctgctgaggggcttgagttagatacagacgaagatgataacaaaactttcctgaagtaattccatccagtatttacacaccattttatccaccccatcacagatatcctggaaggtattgttcaaattccatcacaatgaagtatataaaggcaagaaaaaatcggcctcactggaaatgctgagttacactggtacttcttggatcaggaagaaacccccttggtgcaattgtaggattatcccatggagcttaaagaaaacaaagtgaagtgatccatcagtactggattgctgcagccttatagtgtgattcaacccaaaaaaacgtaggtggataagacttgcaagagattgactatccgatatgtatacttgttacatgcaagatgtaattatgttagggtggccttgggtcgctgtttgggctagagcaaatttagtgctagctgggtcctgtgtaaatattctgcagaaggcagaagcagcagtcatgtttgtgttttagtaagcaggaatactgcagtttcagtatgcatattcttgtgtccgccatctacataatgtttcatgcctattatatgcatacctattgtatgttcaaatatgaacataaccttaaatgatggttacaagatcacagttataagaagtggttttgaatatgaacctaataa

SEQ ID NO: 3181 - DNA, 1587 bp, Brachypodium distachyon
ttatgaagagaagtgatccacgtgtcaccatcgggaagcgttccctccattccaccacacaacggccgctgcgagctccggcttacctcctcctccacgccctaaccctaagcccctgatcgccggcgatgagcagcctccgagcaatctccatcctcctccacacctactactgctcctccgccggccgaggcgctaggcggctttggttcgcgccgccgctcggcgggagcttccgcgccccgtccaaggcgccgcccgcgttcgtgctcgacgaggtcgcgagggcggctgggggcgcgcggaagagggcggcgtccacgcgcgccaccgcgagctgggattccgagaagtccccgtacgagacgctcgagctggacagggatgccgacgaggataccataaagacatcatacaggagattggccaagttctatcaccctgatgtttatgatggtaagggaaccctcgaggaaggagagactgctgaagcccgtttcatcaaaatccaagctgcatatgagctgctgattgatgatgaaaggagaaaggcatatgataaagagcattttgtgaatccactgaaggcttctcaggcatggatggagtgggtgatgaaaaaacgaaaagcttttgataaacgcggcgacatggcggtagctgcttgggcagagcaacaacagcgagaattgacactacgtgcgcgccgtctctctcggtcaaaggttgatccggaggaggaaaggaggttacttgccaaggaaaggaaggcatccatggaattctacagcacaactctaaaaagacatacccttgtcctacggaagcgggaccttatgcggaagaaagcagaggaagacaggaaagatgagatcagtagacttctagctgctgaggggcttgagttagatacagacgaagatgataacaaaactttcctgaagtaattccatccagtatttacacaccattttatccaccccatcacagatatcctggaaggtattgttcaaattccatcacaatgaagtatataaaggcaagaaaaaatcggcctcactggaaatgctgagttacactggtacttcttggatcaggaagaaacccccttggtgcaattgtaggattatcccatggagcttaaagaaaacaaagtgaagtgatccatcagtactggattgctgcagccttatagtgtgattcaacccaaaaaaacgtaggtggataagacttgcaagagattgactatccgatatgtatacttgttacatgcaagatgtaattatgttagggtggccttgggtcgctgtttgggctagagcaaatttagtgctagctgggtcctgtgtaaatattctgcagaaggcagaagcagcagtcatgtttgtgttttagtaagcaggaatactgcagtttcagtatgcatattcttgtgtccgccatctacataatgtttcatgcctattatatgcatacctattgtatgttcaaatatgaacataaccttaaatgatggttacaagatcacagttataagaagtggttttgaatatgaacctaataacatcaattttgtgtaaacactag

SEQ ID NO: 3182 - DNA, 1484 bp, Secale cereale
gactaggcgttccctcccttccagctttccaccacacaaccgcccgccgctccgagctccggctcgccccctcctccctcgacgcgcgccctagacctgcgccccagggtcgccggcgatgagcagcctccgagccacctccgccctcctccacacctactacacttcgtccgccgctgccggccgggtcggcgccaggcggctcggcgggagcttccgcgtcccgtccaaggcgccgtccgcgttcgtgctcgacgaggtcgcgagggcggcggggggcgtgcggaggagggcggccacgcgcgcggcgagctgggattccgagaagtccccgtacgagacgctcgagctggaaagggatgccgacgaggagaccataaaggtcgcatacaggagattggccaagttctatcaccctgatgtttatgatggtaagggaacccttgaggaaggagagactgctgaagcccgtttcatcaaaatccaagcagcatatgagctgttgattgatgacgaaaggagaaaggcatacgacaaagagcattttgtgaatccactgaaggcttctcaggcatggatggagtgggtgatgaaaaagcgaaaagctttcgataaacgtggcgacatggcggtagctgcttgggctgagcaacagcagcgagaattgacgcttcgggcccgacgtctctccaggtcgaaggttgacccagaggaggaaaggaggttactcgccaaggaaaggaaggcatcgatggagttctacagcacgactctgaaaagacataccctcgtactacggaagagggacattatgcgcaagagggaggaggaagacaagatgagtgagatcagtagacttctagctgccgaggggcttgagttagatacagacgaagatgatgatgacacaactttcttgaagtaattctatccagtatttaccccccaattatattgaactccggtcccagaagccctggaaggtttccttgaagttgcttccgtcgcactgaagtatataaggcaagaaaatccggccttgttgagcatgatgagttgtatactgatacttgttggatcggaaaatcctatctgtgcagatgtaggattgtcccatggagcagaaagaggaggaatgtgaaatgattcttcagtgctgattgccgcaggcctgcagtgtaatcggcgaaggatggatacaagacttgcaagagctacgactatcagatgtgtataatttgtcacacgcaagatgtaattatgttaaggtggcatctaaccgcagttaccagctgcgtgtaacagtggccctgtgttatagtgctactgtagaaggcagatgaagcagagccaagtttgtgtttcagcctaaaattcttcccgtggccgggcactgtttcattacctgttataccactacaatgcatgattcgcttgtcgtccttgttagaatctgaaggcttctgaatgatgatgaatactac

SEQ ID NO: 3183 - DNA, 1441 bp, Oryza sativa
ccacgtgtcaccatcgcgaggcgttccctccatttcaccacaaaaaggaaaaaaaaaagacggaaaaactgcgcctccaagctccgacctctctcccctcctccgcgccctaaccctaggccctccgcgtcgccggcgatgagcggcctccgagccatctccaccctactccacacctgcgccgccgccgccgcgggaggctccagtcggcgggtcgctctcgcgccgccgctcggtcggagcttccgcgtcccgtggagggcgccctccgcgttcgtcttcgacgaggtcgcgagggccgcggggggcgagcggaggagggtgtctacgcgcgcagcgagctgggattcggagaaatcaccgtacgagacgctcgagctggacagggatgcagatgaggagacaataaagacggcatacaggcgattggccaagttctatcaccctgatgtttatgatggtaagggaacccttgaggaaggggaaactgccgaagcccgcttcatcaaaatccaagcagcatatgagctactgattgatgaccaaaggagaaagtcatatgacagagagcatcatgtgaatccaatgaaggcttctcaggcatggatggagtgggtgatgaaaaagcgaaaagcttttgatcaacgtggtgacatggcagtagctgcttgggctgagcaacagcatcgggaaatgacattacgtgctcgccgtctctcacgatcaaagattgatcctgaggaggagaggaaactgtttgccaaggaaaagaaggcatccatggaattctacagcaccactctaaagaggcatacccttgtcctgcggaagagggatattatgcgcaagaaggcagaggaagacaagaagaaagagatcagtagacttctagctcttgaggggcttgagctagatacagatgaagacgacaacataaatttcctaaagtaactacgcaaatgttctttcacaaattccatccacctctcccagcatatactagaaggtttcgccaaagttccatttagtgaatatatattgacgcaagaaaaaatgagctcaagggaaacattggatcataactgttggaaatccagaattctcccatggagcagaaagatgtggccaacggcgaaatccatctgggccaactgctgcaacctgcagcccagtgattcaatcaaagttctttatgcagatcctctattcattgtttccagcagatggactgtattgcaagggatatgactatcagatatgtatacttgttacatgcgaaattgtaattatgctagggtaattttgtaaccttcttgtttgtccgagcaaaacaaagtgcattctctgtgtggtgcctctagctctgacactttgtaaatactacagaaaacatccaaagctattgtttactgggcatgaataatgttgtttcaaatcatcc

SEQ ID NO: 3184 - DNA, 1410 bp, Oryza sativa
atttcaccacaaaaaggaaaaaaaaaagacggaaaaactgcgcctccaagctccgacctctctcccctcctccgcgccctaaccctaggccctccgcgtcgccggcgatgagcggcctccgagccatctccaccctactccacacctgcgccgccgccgccgcgggaggctccagtcggcgggtcgctctcgcgccgccgctcggtcggagcttccgcgtcccgtggagggcgccctccgcgttcgtcttcgacgaggtcgcgagggccgcggggggcgagcggaggagggtgtctacgcgcgcagcgagctgggattcggagaaatcaccgtacgagacgctcgagctggacagggatgcagatgaggagacaataaagacggcatacaggcgattggccaagttctatcaccctgatgtttatgatggtaagggaacccttgaggaaggggaaactgccgaagcccgcttcatcaaaatccaagcagcatatgagctactgattgatgaccaaaggagaaagtcatatgacagagagcatcatgtgaatccaatgaaggcttctcaggcatggatggagtgggtgatgaaaaagcgaaaagcttttgatcaacgtggtgacatggcagtagctgcttgggctgagcaacagcatcgggaaatgacattacgtgctcgccgtctctcacgatcaaagattgatcctgaggaggagaggaaactgtttgccaaggaaaagaaggcatccatggaattctacagcaccactctaaagaggcatacccttgtcctgcggaagagggatattatgcgcaagaaggcagaggaagacaagaagaaagagatcagtagacttctagctcttgaggggcttgagctagatacagatgaagacgacaacataaatttcctaaagtaactacgcaaatgttctttcacaaattccatccacctctcccagcatatactagaaggtttcgccaaagttccatttagtgaatatatattgacgcaagaaaaaatgagctcaagggaaacattggatcataactgttggaaatccagaattctcccatggagcagaaagatgtggccaacggcgaaatccatctgggccaactgctgcaacctgcagcccagtgattcaatcaaagttctttatgcagatcctctattcattgtttccagcagatggactgtattgcaagggatatgactatcagatatgtatacttgttacatgcgaaattgtaattatgctagggtaattttgtaaccttcttgtttgtccgagcaaaacaaagtgcattctctgtgtggtgcctctagctctgacactttgtaaatactacagaaaacatccaaagctattgtttactgggcatgaataatgttgtttcaaatcatcc

SEQ ID NO: 3185 - DNA, 1287 bp, Triticum aestivum
gaattcggcacgagcgcgcgccctagacctgcgccccagggtcgccggcgatgagcagcctccgagccacctccgccctcctccacacctactacacttcgtccgccgctgcctgccgggtcggcgccaggcggctcggcgggagcttccgcgtcccgtccaaggcgccgtccgccttcgtgctcgacgaggtcgcgagggcggcggggggcgtgcggaggaaggcggccacgcgcgcggcgagctgggattcggagaagtccccgtacgagacgctcgagctggaaagggatgccgacgaggaaaccataaaggtcgcatacaggagattggccaagttctatcaccctgatgtttatgatggtaagggaacccttgaggaaggagagaccgctgaagcccgtttcatcaaaatccaagcagcatatgagctgttgatcgatgacgaaaggagaaaggcatacgataaagagcattttgtgaatccaatgaaggcttctcaggcatggatggagtgggtgatgaaaaagcgaaaagctttcgataaacgtggcgacatggcggtagctgcttgggccgagcaacaacaacgagaattgacgcttcgtgctcgacgtctctctaggtcgaaggttgacccagaggaggaaaggagattactcgccaaggaaaggaaggcttctatggagttctacagcacaactctaaaaagacataccctcgtattacggaagagggacatcatgcgcaagagagaagaggaagacaagatgagtgagatcagtaggcttctagctgccgaggggcttgagttagatacagacgaagatgatgatgacacaactttcttgaagtaattctatccagtatttacccgccaattatatccaccccccgtcccagaagccctggaaggtttccttgaagttgcttccatcgcactgaagtatataaggcaagaaaattcggccttgttgagcatgatgagttgtatattgataactgttggatcggaaaatcctatctgcgcagatgtaggattgtcccatggagcagaaagaggaggaatgtgaagtgattcttcagtgctgattgccgcaggccagcagtgtaatcggcgaaggctggattcaagacttgcaagagctacgactatcaggtgtgtatacttgttacatgcaagatgtaattatgttaaggtggtatccaggcgctgttaccagctgcttgtaaccgtggccctgtgctatactactgtagaaggcagataagcagccaggtttgtgt

SEQ ID NO: 3186 - DNA, 1413 bp, Hordeum vulgare
cgcccgccgctccgaccttcggctcgcccccctcctcctccacgcgcgccctaaccttgcgctgcgccccaggtcgccggcgatgagcagcctccgagccatctccgccctcctccacaccgagtactactcttcgtccgccgctgccggccgggtcggccccaggcggctcggcgggagcttccgcgtcccgtccaaggcgacgtccgcgctcgtcctcgacgaggtcgcgagggcggccgggggcgtgcggaggagggcggccacgcgcgcggcgagctgggattccgagaagtccccgtacgagacgctcgagctggaaagggatgccgacgatgagaccataaaggtcgcgtacaggagattggccaagttctatcaccctgatgtttatgatggtaagggaacccttgaggaaggagagaccgctgaagcccgtttcatcaaaatccaagcagcatatgagctgttgattgatgacgaaaggagaaaggcatacgacaaagagcattttgtgaatccattgaaggcttctcaggcatggatggagtgggtgatgaaaaagcgaaaagctttcgataaacgtggcgacatggcggtagctgcttgggctgagcaacagcaacgagaattgacgcttcgtgctcgacgtctctctaggtcgaaggttgacccagaggaggaaaggagattactcgccaaggaaaggaaggcttctatggagttctacagcacaactctaaaaagacacaccctcgtactacggaagagggacattctgcgcaagagagaggaggaagacaagatgaatgagatcagcagacttctagctgccgaggggcttgagttagatacagatgaagatgacgatgacacaactttcttgaagtaattctatccagtatttacctgccaattatatccagcctccatcgcagaaggcctggaaggtttcgctgaagttacctctatcgcgctgccgtatataaggctaagagaaacccggccttgttggacacggttagtcgtacgctggtaactgttggatcgggaaatcctatctgcacagatgtaggattatcccatagagcagaaacaggaggaaagcgaagtgattcttcagtgctgattgatgcagggctgcagtgtaatcggcaagaagatgatagaagacttgcaagagctactactatcagatgtgtatacttgttacatgcaagatgtaattatgttaatgtggcatccgggcgcagttaccagctgcgtgtaaccgtggccctatgttatactccctccgtcccaaaataattgacttgactttgtactaagggagtattgtagaaggcaggtgaagcagccaggtttgtgttttcagcctagattcttcctgtgtccggacactgtttcatcacc

SEQ ID NO: 3187 - DNA, 1338 bp, Avena sativa
cacaaccgccgctccgagctccggctcgcctcctccttcacgctctaaccctaagccccccgggtcgccggcgatgagcggcctccgagccatctccaccctcctccacacctactactactcgtccgccgccgccggccgaggcgccaggcggctcgtgttcgcgccgcggctcggcggggggttccgcgtcccgtccaaggcgtcggtcgcggggccggcggggagcgtgcggagaagggcgtccacgcgtgcggagagctgggattcggagaagtccccgtatgagacgctcgagctggacagggatgctgatgaggacaccataaagacggcatataggagattggccaagttctatcaccctgatgtttatgatggtaagggaacccttgaggaaggagagactgctgaagcccgattcatcaaaatccaagcagcatatgagctgttgattgatgatgaaaggaaaagggcatatgataaagaccattatgtgaatccaatgaaggcttctcaggcatggatggaatgggtgatgaaaaagcgaaaagcttttgataagcgtggagacatggcggtagctgcttgggcagagcagcaacaaagagaattgacgctacgggcgcgacgtctctctaggtcaaaggttgacccagaggaggaacgaaggttaatcgccaaggaaaggaagtcatccatggaattttacaacacaactctgaagagacatacccttgtactgcggaagagagaccttatgcgcaagagagaagaggaagacaagaataacgaaatcagtagactcctagctgccgaggggcttgagttagatacagaggaagaggataacaaaactttcttagagtgattctatccgtatatactcgcaaatttgttccgcccaatcccagaaaggttccgttgaagttccatggcggtgaagtatataaggcgggaaaacccggtaacagctggatcagcaaatcctcgatgtgcagatgtaagattgtcccatggagcagaacgaggagaaaagggatagcagctggtccatcagtgcttgatagctgcagcactgctgtgtgatacagcaacatacagtaaatgtgtggcaaaaggctacgactgtgttcagatgcgtatacttttccatgtaagatgtaagcagggtttgccctgggccagggcgataattgcaatgcctctggagtcgcgacccgggaggcggctagcgtttcttgtctttccaacccctgtattccgctcctaatgtgtttacaagatagtcgaacgtcgacgagctaaatgtatatatgtgtaggtgactgtttgatc

SEQ ID NO: 3188 - DNA, 877 bp, Sorghum bicolor
tagcagcttgctctagtacacacgaacgaacggtacgtacgtccatcgctagctcgctcgccatggcctccctctcctctgccaccatcaccgccccttccgccttcgccgcgccggccgcccgcgccgtggccaggaggtcgtccttcaccgtgcgcgcctctctcggcaaggccgccggcacggccgccgtggccgtggccgccagcgcccttcttgccggcggcgccatggcccaggaggtgctgctgggcgcaaacggaggcgtgctcgtcttcgagcccagcgagttcaccgtcaaggccggcgacaccatcaccttcaagaacaacgccgggtacccgcacaacgtcgtcttcgacgaggacgaggtgcccagcggcgtggacgccaccaagatctcgcaggaggagtacctcaacgcgccaggcgagacctactccgtcaccctcaccgtgccgggcacctacggcttctactgcgagccgcaccaaggagccggaatggtcggcaaggtcaccgtcaactaactacgtcctactactagtatctcctcctcctcctcctcctcctcctcctcctcctcctcctcctccttactagctgttgcatttcctgctttatttgtactccggtccacatgcatcctcgattatccaccgtccgtaccatcgatcgatctcttctttcacaccaacaatgcaagaagcagtgccgtgcagtgtgtgtatgagagtgagagctagagacccgccttctttttgtttgctgatgaatcgatacagtcgtcatcgtgatttatgttcactactgcaataacaatttcagtcacaaaaggttaacagaagcgggcgagacacccgtctctgattacaca

SEQ ID NO: 3189 - DNA, 1076 bp, Sorghum bicolor
gctggccggccagaggcctcttgcttcttgctgctatctagtatctatcctccctctagcagcttaattagcagcttgctctagtacacacgaacgaacggtacgtacgtccatcgctagctcgctcgccatggcctccctctcctctgccaccatcaccgccccttccgccttcgccgcgccggccgcccgcgccgtggccaggaggtcgtccttcaccgtgcgcgcctctctcggcaaggccgccggcacggccgccgtggccgtggccgccagcgcccttcttgccggcggcgccatggcccaggaggtgctgctgggcgcaaacggaggcgtgctcgtcttcgagcccagcgagttcaccgtcaaggccggcgacaccatcaccttcaagaacaacgccgggtacccgcacaacgtcgtcttcgacgaggacgaggtgcccagcggcgtggacgccaccaagatctcgcaggaggagtacctcaacgcgccaggcgagacctactccgtcaccctcaccgtgccgggcacctacggcttctactgcgagccgcaccaaggagccggaatggtcggcaaggtcaccgtcaactaactacgtcctactactagtatcttctccatatatattgcgccgccatggatccggccaccatgcatattcctcctcctcctcctcctcctcctcctcctcctcctcctcctccttactagctgttgcatttcctgctttatttgtactccggtccacatgcatcctcgattatccaccgtccgtaccatcgatcgatctcttctttcacaccaacaatgcaagaagcagtgccgtgcagtgtgtgtatgagagtgagagctagagacccgccttctttttgtttgctgatgaatcgatacagtcgtcatcgtgatttatgttcactactgcaataacaatttcagtcacaaaaggttaacagaagcgggcgagacacccgtctctgattacacatctctactctaatcaccatgttttatatcaccgcctatattagaatagaaaaaaaaaaccaaaaaaaaaagaaacagaaactgct

SEQ ID NO: 3190 - DNA, 3074 bp, Sorghum bicolor
aaatcttattgtgcgatctacgtatttttagtataaattgttagctatcccgtagcaacgcacggacatgctacctagtaataattaaaagacgaacaagaaaactggtggtcctggaatcagtagtgttgcattggcaatgttgtaacgtgttaggggtacgtacgggttttgcggcagaaatctgatccggaatggatgcatgcgtccatcacagccataagccggtgccagtacgggataagaaaatccgatgccgcgcgtcgctggccacccattattcgtcgtctcgctcgcctccatcgatacatctcatcctccccctggcccctgccatgcatttttatttggagagctggccggccagaggcctcttgcttcttgctgctatctagtatctatcctccctctagcagcttaattagcagcttgctctagtacacacgaacgaacggtacgtacgtccatcgctagctcgctcgccatggcctccctctcctctgccaccatcaccgccccttccgccttcgccgcgccggccgcccgcgccgtggccaggaggtcgtccttcaccgtgcgcgcctctctcggcaaggccgccggcacggccgccgtggccgtggccgccagcgcccttcttgccggcggcgccatggcccaggaggtgctgctgggcgcaaacggaggcgtgctcgtcttcgagcccagcgagttcaccgtcaaggccggcgacaccatcaccttcaagaacaacgccgggtacccgcacaacgtcgtcttcgacgaggacgaggtgcccagcggcgtggacgccaccaagatctcgcaggaggagtacctcaacgcgccaggcgagacctactccgtcaccctcaccgtgccgggcacctacggcttctactgcgagccgcaccaaggagccggaatggtcggcaaggtcaccgtcaactaactacgtcctactactagtatcttctccatatatattgcgccgccatggatccggccaccatgcatattcctcctcctcctcctcctcctcctcctcctcctcctcctcctccttactagctgttgcatttcctgctttatttgtactccggtccacatgcatcctcgattatccaccgtccgtaccatcgatcgatctcttctttcacaccaacaatgcaagaagcagtgccgtgcagtgtgtgtatgagagtgagagctagagacccgccttctttttgtttgctgatgaatcgatacagtcgtcatcgtgatttatgttcactactgcaataacaatttcagtcacaaaaggttaacagaagcgggcgagacacccgtctctgattacacatctctactctaatcaccatgttttatatcaccgcctatattagaatagaaaaaaaaaaccaaaaaaaaaagaaacagaaactgctaagctcgccaatgtgccaccgtgtgctcccgccttcaataccattgtcacgcatgttattgaccttaacggattcgcttgttgtcatttcaagattaagggcttgtttggcatagctcaacttcattagtaaagctgtttttttagaaaatagcttcatgagtgactttctagatgaagttgagctatttttgaaaaagtgtttggcaaaatagcttcaccaactacttcatgcatagttgagaaaaatgagatagagagctgcaataagctacttttttcagcttcattccaacttatgtctttgtgagaggagggaaaaaacatcttcatccatgaagctgttttggaaataagtgtttagcaaaaaaacaacagctcatgaagctgttgtgagctgtaccaaacaggccctaactctccaagatttttagaatgacttacaatttgggacggagggagtacttgggttgtcgtcctatttcccagggctcacctacatccagtgaacaacagcttccaaaagggatcccaaggagaatagcatcgaaggggattcaaacaagaacatacatgatgttcatagttgcaaagtccccatgaaggcccccgccatccatggcacgtttcatttcagggtcacaaggcacaccatgtgttggcccctcatcggatccgccaatatgacccattaatttgttgggcatgctgcatggtctgaggagaagagagggaggtcatcgggagggagagaggtgcattgttgggcaaacgttgtagatccgatcaagttcatcgcatgccatcggcgtgttgcttcaaccgggtagctagaggaagggatcagactatggaggtgggatagatggacccggtggtggatcaggaggagcaggcaggcggattgtcatgatgtggaaggggtggcagatcttgagagggagaggatggagagaggcacgtagtgttggacgcagatgagggctagttgtagaatcaagatggctgactagaagggtgcaaacaatcatttcttctaaaacttaatcacgaaggtttgccgatctaaatgtggaattaacaaactaaccataacttcaccccctaactaagttcaaaaaataccgtaacaaaagactaaataagagagcaactaaggtgcccagctagtgagagcttacctaaataattctacctgtcaaggtcatacaacctaagaacctagagcacaagggagctcctagtctcctacacttgctagtgagtagaaggtaaacaacaagctacattagttagcactagtcgagataagctactcaactactcgagctacacaagcaactacacaagtataaagatagctcaagtaaaggtacaagtgtagtatgcaaatcaacgggagacaaggttgacatcatggcttttctccttaggtttagtggcttgataaccacatgctccccaatgaggcaagtttaagggattgccgctcctctcgctagcttcatagcccacaaggcaggctcaaacgtgagcattagactcgagtcggtcgatcaacttgagactccaacaagtcttgctttactaaagttgttctttgccttcctccgacggcaatgggcacaagagccccaaacaagtc

SEQ ID NO: 3191 - DNA, 1068 bp, Saccharum officinarum
ctggccacccattcgtcgtctcggtctcgcctccacctcatctcccctgccgtgtttttatttcttgtgcgtgctcggagagctggccggcctcttgctgctatctatctagcttaataattagctgacgatcgaccgacctcgctcgccaatcgccatggcctccctctcctctgccaccatcaccgccccttccttcgccgcgccggccgcccgcgccgtggccaggaggtccttcaccgtgcgcgcctctctcggcaaggccgccggcaccgccgccgtggccgtggccgccagcgccctgcttgccggcggcgccatggcccaggaggtgctgctgggcgcaaacggaggcgtgctcgtcttcgagcccagcgagttcaccgtcaaggccggcgacaccatcaccttcaagaacaacgccgggtacccgcacaacgtcgtcttcgacgaggacgaggtgcccagcggcgtcgacgccaccaagatctcgcaggaggagtacctcaacgcgccaggcgagacctactccgtcaccctcaccgtgccgggcacctacagcttctactgcgagccgcaccaaggggccggaatggtcggcaaggtcaccgtcaactaataatttatttacgtcgtatcttcctgcatattgcggcggcatgccgtgccccgtgcccgtgcatgtccttactagctcttgttgcttttcattcctgctttgtactccgatccaccgtaccatctatgtatttgtttctcttcacacaacaatgcaacaagcagtagtgcagtgtgagagagagagagaaccttcttttttgtttgctgatgaatcgatcaaatgcagtggtattgtctgcacctgctacgactacatatatattagaccgcgtcctctgtatgtaatccatccatcgctccgtcaagtaataatagtatatgtatctctcccaaaattcgaagggtgaaaaggatggatagggcaccgtttcacggcctggtattggtattagaaaatagtggggcggccggttctagaggattcaggtttacgtccgcgtgcttgga

SEQ ID NO: 3192 - DNA, 927 bp, Pennisetum glaucum
tggcctcctctctcctgctcctccagcaagcatcctcaccagtcaccaccagtagagctgccagagccagcataatggcctccctctcctctgccgccgtgaccgccccttccttcgccgctgcccggcccgcccgcgccgcccgacggtcgtctgtggtggtgcgcgcctcccttaaggccgccggcaccgccgccgtggccgttgccgccagcgccctgctggccggcggcgccatggcccaggaggtgctcctgggcgccaccggaggcgtgctcgtcttcgagcccagcgacttcaccgtcaaggccggcgacaccatcaccttcaagaacaacgccggcttcccgcacaacgtggtgttcgacgaggacgaggtgcccagcggcgtcgacgccgccaagatctccaaggaggagtacctcaacgcgccgggggagaccttctccgtcaccctcaccgtgccggggacctacgggttctactgcgagccgcaccaaggagcagggatggtcggcaaggtcaccgtcaactaagcgcaacgacgacgaccatgcaaatccatttccctatcctaatcaaattgttcttcttgcgttcatccatcatcgatccaggcaggataagtctactgtgtccaagtatgactctactatgagagcgatcgttcgagagctttaattctattagcttgccattaatttgctgctgccctgtacttaaatcccttgcatgcatgcctccacacatgctgtacgagtacgtaccatcggtaccaacacgtcctagcatatcgtcattgcttcaccaccatacactatcatcatcttctaatttctgcttcatatatgcattactctttttttttctttatcagttaattttaatctgtacctctcatatatatatattaatgtatatctgtat

SEQ ID NO: 3193 - DNA, 795 bp, Panicum virgatum
gcctgcctatagcctgctccctctccctctccctctctctctagtctagtccaccaccaaccattatggcctccctctcctctgccgccgtcaccgccccttccttcgcggcttcccggcccgcccgcgccgctgccaggcgctctgctgccttcaccgtgcgcgcctcgctcggcaaggccgccggcaccgccgccgtggccgtggccgccagcgccctgctcgccggcggcgccatggcccaggaagtgctgctcggcgccaacggaggcgtcctcgtcttcgagcccagcgagttcaccgtcaaggccggcgaggccatcaccttcaagaacaacgccgggtaccctcacaacgtggtcttcgacgaggacgaggtgcccagcggcgtcgacgccgccaagatctcgcaggaggagtacctcaacgcgccgggcgagacctactccgtcacgctcaccgtgccgggaacctacggattctactgcgagccgcaccaaggagccgggatggtcggcaaggtcaccgtcaactgatgcgatgccatgccatgccatgatcgagtatatatattcaagcgtatctgcgtatgtacgtaccaggctataggctagctagctagagagcttagcttgccactcagatcagtcatcatctccatcttgtaccaagtggcatgcatgcatgcatgcatgctattacttcatcatatttatatcatcggcattgccttgcttcttttactcttttcactattcactattattatagaatacacattacacatgtttctct

SEQ ID NO: 3194 - DNA, 558 bp, Setaria italica
cctctctcttgctcctccataatcaccacccacctaccactagctaccagcatggcctccctctcctctgccgccgtgaccgccccttccttcgccgctgcccggcccgcccgcgccgccgttgccagccgacggtcgtctgtggtggtgcgcgcctcgctcggcaaggccgccggcaccgccgccgtggccgtggctgccagcgccctgcttgccggcggcgccatggcccaggaggtgctcctgggcgccaacggaggcgtgctcgtcttcgagcccagcgagttctccgtcaaggccggcgacaccatcaccttcaagaacaacgccggctacccgcacaacgtggtcttcgacgaggacgaggtgcccagcggggtggacgccgccaagatctcgcaggaggagtacctcaacgcgccgggggagacctactccgtcaccctcaccgtgccgggaacctacagcttctactgcgagccgcaccaaggagcagggatggtcggcaaggtcaccgtcaactaagcaatccattgttcgttcatcatccaggatact

SEQ ID NO: 3195 - DNA, 3757 bp, Setaria italica
tagcaagcaagcaattcgacgccgccgttagcatcgagattgggagggagggagggagccatggaattcgtcgaggagaccaagaagagatccctgacggtcgcccccttcgagtgcgcctggggcgaggagcttcgcttccgggagcccggccgtggctgcgtctccttcgaggcatccgcccacaacgacgtcaccctggtgttccgccaccaccccgggagccaccactaccactacaagatggacaccagccgccactacactgtcatcctgggtagccacaggaacaagcgcctcaggatccaggtcgatggagccaccgttgctgatgtcgccgcccccggcctgtgctgctccaactccttccaggccttctggatcaccatctgcgacggcctaatcaccatcggccaaggaaggcaccccaacaccaacctcctcttccagtggctcgatcccgatcccaacccagatgttcagtacgtcggcctatccagctgggacaagcacgtaggctataggaacataagcattctcccagcagctccccagtacagcatactttggacccaaaagttgttatgctgtgggaaaccaggcacggcagatgactccgaccagaggctgcttgcagactttctcgagagctgggacttgtctgatgctgtatttgtggttggcaccgaaaggaagcttgtccctgcacacagaattgtcctctgtgcttctggagatttcccttttcaaatagcggaccatggagctaccatccaacttccatcagtatcctacccacttctccactcccttcttgagtatatctacacaggttctacacagattgctgaatgtctactaagttccctgctggagttgagctcgcattttaaagtcaaaccattgatcaaatgttgtgaagaaatcatcgactgttcgggagtggataagaaactttcagagtccggcaaaatcttaaaattatcaagtagcggattccagcaagatcataaatttggttccttccctctcaaggacccagtggatgcgcagaaaattggacagttccttgcaaatggcaaacatagtgatataaatatctatgttaatggacacggtcttgttgccaaggctcacaagcttatccttagcctgtggagcgtgccgtttgcaaagatgttcacaaacgggatgaaggaaagtagtgcctccgatgtatttttcaaagatgttcctcctgaagcattctttctcctccttcagtttatgtacaatggggaacttaaggtggatacccaggatattacatcagtgctggtgcagctgcttctattatcagatcagttcgccatcactgttcttcagtttgaatgctgtaaacgaataatggaatgcctttcagaggacacagtatgttcagtcttacaggcagtttcatcaatcccatcttgtaaactgcttgaagaagtatgcaagaggaattttgctacacactttgattattgcacaactgcttgcacggactttgtgttgttagatgaggcaacatttaaggatattcttcaggcaataattttgcagcatggcgatatgacggtaacatcggaagagagggttctggatgccatcttaacctggtgtatggggacttgtgaaactttttactggacttcagtagataagctcttgagaacttcaacacctgagcaactctttggagagaggctttccgccatcgatactttactaccgtttgtgaggttccctttgatgcagctgtccatgctaaagaggatggagataagtaatctggcgaaccacatacaagtattcagacagctggttgcagaagcaattgagttctctcatgccggacaatggacaccgacatcatatgagtgcgagagatttcagcacaggcgctcgagctataaagagctccagtatatctctgatggtgatagcaatggcgttatctactatgccggaacatcatttgggaaacaccagtggatgaatcctgtattagccaagaatatcactgtggtggcaagcagcccaaattcgaggcacacggatccgaaggctttggtttcgaagaattaccaggggacttgctttgctgggccttgtattgaagatggcaagaagatttcttggtggatggtagacatcggacaggaccaccagctgatgtgcaactactacacggtgaggcaggatggctccacaaccttcatgaggtcctgggttcttcagggatccatggacggtcggaactggacgagcctccgcgtccacgaggaggacgcgaccatttgccatcccgggcagttcgcgtcgtggcccgtcgtgggcccgccggccctgctgcccttccggttcttcagggtggccctgacgggcccggccgcgggcggcagcgtctccaacgcgtggaacctctgcatttgcttcctggagctctacggctacttgcgctaactagattatattactccttttatacaatatacacacacatgtatgctacctttttatttgctcgatctgtactctactcaccgtgtatacgagattatatattgcttgcagcttgcttgaattaaaacatacttattaattatttgtttcaagataaattatataatacgtacgcatgctgctgcaggaaccttgtcctgtttattataaaggaataaaaacgatatatataatctctagaaatgacatacacagcacaaacatatgcatacccatatgagaaatacaaatttaattcgctaaagaaaaggagtaaggatgaagtagaaagaagatgatgatatatggtggacgcatgcatgcgatttagtacatggcagcagcaaatgccaagagacgatggatcgaggatggaggagaatcatattggagatggcaagctaggctcaagctctcgcttctcatggtacagtagtacagtatcctggatgatgaacgaacaatggattgcttagttgacggtgaccttgccgaccatccctgctccttggtgcggctcgcagtagaagctgtaggttcccggcacggtgagggtgacggagtaggtctcccccggcgcgttgaggtactcctcctgcgagatcttggcggcgtccaccccgctgggcacctcgtcctcgtcgaagaccacgttgtgcgggtagccggcgttgttcttgaaggtgatggtgtcgccggccttgacggagaactcgctgggctcgaagacgagcacgcctccgttggcgcccaggagcacctcctgggccatggcgccgccggcaagcagggcgctggcagccacggccacggcggcggtgccggcggccttgccgagcgaggcgcgcaccaccacagacgaccgtcggctggcaacggcggcgcgggcgggccgggcagcggcgaaggaaggggcggtcacggcggcagaggagagggaggccatgctggtagctagtggtaggtgggtggtgattatggaggagcaagagagaggtcgagcagcaagcaagctttagccaggcgcaggcagctggagaggagggagaaatagcataggaggaggatgaggcagccgcaacgggtggccagggagccatccttatcccatcgaatggctgagcgtgcatgcccatggatttcccttccctcgctccctcctcgtccatcaactccttcgtgccatctcctgaatgaatgtccggcctgcccaagcccaatgtgtgtgggtgtg

SEQ ID NO: 3196 - DNA, 767 bp, Cynodon dactylon
atttgaactgaagaaacccagccagcggcactcaggagaatggcctccctttcctctgcagccgtgaccgccccttccttcgcggcgcccgcccgcgccgtctcccggaggtcctccctcaccgtgcgcgcctccctcggcaaggtcgccggcaccgccgccgtcgccgttgccgccagcgccatgctggccggcggcgccatggcgcaggaggtgctcctcggcgccaacggtggcgtcctcgtcttcgagcccagcgagttcaccgtcaagtccggcgagaccatcaccttcaagaacaacgccggcttcccgcacaacgtcgtgttcgacgaggacgaggtgcccagcggcgtcgacatctccaagatctcgcaggaggagtacctcaacgcgccaggggagaccttctccgtcacactcaccgtcccaggcacctacggcttctactgcgagccacaccaaggagcgggaatggtgggcaaggtcaccgtcaactaatccgtccttcttcatcaacctactactcctatcattagcacagccccgccgcatgtctgtactcgatattatccctataattcattaagatccctccttctgtactatgtaattgaatgctaaagatgagacctctgttttctttgctagtgaatctcaacactctatatacatacggtgctcctcttgcacaagcacaactttggagatgcgatacaaaaacacttagtgctccagtgtctgtaatgcttgttaaaagtgtatcc

SEQ ID NO: 3197 - DNA, 936 bp, Panicum virgatum
ctcgctatttctccctcctctccacctgccggggcctgccttctccctctttctatttgattgtcttgcagcttctttatttgctccaccaccacctacaaggctaaggctccaagctagctaggaactcaaaatactaacaatggcctccctctcctctgccgccgtcaccgccccttccttcgccgcggctgcccggcccgcccccaggcgctctgctgctttcaccgtgcgcgcctcgctcggcaaggccgccggcaccgccgccgtggccgtggccgccagcgccctgctcgcaggcggcgccgccatggcccaggaggtgctgctgggcgccaacggaggcgtcctcgtcttcgagcccagcgagttcaccgtcaaggccggcgaggccatcaccttcaagaacaacgccgggtacccccacaacgtggtcttcgacgaggacgaggtgcccagcggcgtcgacgctgccaagatctcgcaggaggagtacctcaacgcgcccggcgagacctactccgtcacgctcaccgtgccggggacctacggattctactgcgagccgcaccaaggagccggaatggtcggcaaggtcaccgtcaactgatgcatgctgcgatatatctatcatctgcgcatgcatctactgcgtgctatcaattacagtactacaagtattatgtattcaaacgtatgtacctaccaggaggctaggctagctagctagagagcttattagcttgccttcccctcaagagtcagtgaccatcttgtacctaccaagtggcctgaatgcatgcatgctattgcttcatcatatatcatcggcccaccttgcattgcttcttttactcattttttttagctactaataattattaaaaactgttgtatatggattattataagctgtataaaaggttcacaatacac

SEQ ID NO: 3198 - DNA, 560 bp, Eragrostis curvula
cgcggggcactaagcatcatcatctgaccagaagcgcgcagccatggcctccctttcctctgccgccgtgaccgccccttccttcgcggctcccgcccgagctgtggcgaggagggcctcctctctgagcgtgcgcgcctccctcggcaaggccgccggcaccgccgccgtggccgtggccgccagcgccctgcttgccggcggcgccatggcacaggaggtgctcctgggcgccaacggcggcgtgctggtgttcgagcccaacgagttctccgtcaagtccggcgagaccatcacgttcaagaacaacgcggggtacccgcacaacgtggtgtttgacgaggacgaggtgcccagcggcgtcgacgtcaacaagatctcgcaggaggagtacctcaacgccccaggcgagaccttctccgtcaccctcaccgtcccggggacctacagcttctactgcgagccgcaccaaggggcaggcatggtcggcaaggtcaccgtcaactaggaattccatatctatctatcaatctatctatctattaagaagaagaagaaga

SEQ ID NO: 3199 - DNA, 790 bp, Eragrostis curvula
ggggggccaattgctgctgtcccgccggcatttgctaccactaagtgagcatcatctgaccagccatggcctccctttcctctgccgccgtgaccgccccttccttcgcgcccgcccgcgctgtggcgaggagagcctcctctctgagcgtgcgcgcctccctcggcaaggccgccggcaccgccgccgtggccgttgccgccagcgccctgcttgccggcggcgccatggcgcaggaggtgctactgggcgccaacggcggcgtgctggtgttcgagcccaacgagttctccgtcaagtccggcgagaccatcacgttcaagaacaacgcggggtacccgcacaacgtggtgttcgacgaggacgaggtgcccagcggcgtcgacgccaccaagatctcgcaggaggagtacctcaacggcccaggcgagaccttctccgtcaccctcaccgtcccggggacctacagcttctactgcgagccgcaccaaggggccggcatggtcggcaaggtcaccgtcaactaggattcataattccctatctatctatctatctatcaagaagaagaagagccttaattccatcatcgtatccatctatctatactctcgatgcatgcagacccttcaatcaattaattaagagctgctgcttcattcctccttaattatcatctgtactacttgttaatcactgcaggcttcattacatcatctatcattttgcggcgagagttattgtacgcgtttatcttatcttatgtacacagaagacagctattaattca

SEQ ID NO: 3200 - DNA, 1170 bp, Oryza sativa
gttttcattccggcccagaaagcagctgctgagctgggtgggcatcacgaatcgatgggggaagctaagctagggcagtgtgggggtgggcccacctaatccgggtgagccaatgggctgcggccacgaggtcgataagatggcgcgcgacgacgctggccacccaacctctcaatcccaacccgagctcagatcattggattggtttatagcaaccactacaccggcgccgctgctgctgaaccataggagtactacgcagacgcagacgcagacgcagaccaagaagaaatacaatacactagctaccatggccgctctttcctctgccgccgtcaccatcccttccatggccccctccgctcccgggcggaggaggatgagatcttcgctggtcgtgcgcgcctcgctcggcaaggcagccggcgcggccgcagtggccgtggccgccagcgccatgctcgcgggcggcgccatggcgcaggaggtgcttctcggcgccaatggcggcgtgctggtgttcgagccgaacgacttcaccgtcaagtccggcgagaccatcacgttcaagaacaacgccggcttccctcacaacgtggtgttcgacgaggacgcggttccgagcggcgtcgacgtgtccaagatatcgcaggaggagtacctcaacgcccccggcgagaccttctccgtcacgctcaccgtccccggcacatacggcttctactgcgagccgcacgccggagctgggatggtcggcaaggtcaccgtcaactaattattctttcttctcaatctaaatatgcctcctacggctctatcctatatatatatatatcgatttgtccatcgcgaatatactacgtaccgatgatctgttcctcagttttctcttgtgtgtatgcaagtgtgtatcaattatcaatagcaatgagacgaacaattcaacgatatattatctatgttgatgatttgtgtcatatacatatcatatctcgtcttccggtttcgcccggaattcgattggtccatgcgtggaacattatattaaatttgcgagccaactattgaatgaatgcgtgtcgtccgtgcttctactagatcaaagtatagcaagtactccccccgtttcacaatgtaagtcattttagcatttcccacattcatattttt

SEQ ID NO: 3201 - DNA, 866 bp, Oryza sativa
cgagctcagatcattggattggtttatagcaaccactacaccggcgccgctgctgctgaaccataggagtactacgcagacgcagacgcagacgcagaccaagaagaaatacaatacactagctaccatggccgctctttcctctgccgccgtcaccatcccttccatggccccctccgctcccgggcggaggaggatgagatcttcgctggtcgtgcgcgcctcgctcggcaaggcagccggcgcggccgcagtggccgtggccgccagcgccatgctcgcgggcggcgccatggcgcaggaggtgcttctcggcgccaatggcggcgtgctggtgttcgagccgaacgacttcaccgtcaagtccggcgagaccatcacgttcaagaacaacgccggcttccctcacaacgtggtgttcgacgaggacgcggttccgagcggcgtcgacgtgtccaagatatcgcaggaggagtacctcaacgcccccggcgagaccttctccgtcacgctcaccgtccccggcacatacggcttctactgcgagccgcacgccggagctgggatggtcggcaaggtcaccgtcaactaattattctttcttctcaatctaaatatgcctcctacggctctatcctatatatatatatatcgatttgtccatcgcgaatatactacgtaccgatgatctgttcctcagttttctcttgtgtgtatgcaagtgtgtatcaattatcaatagcaatgagacgaacaattcaacgatatattatctatgttgatgatttgtgtcatatacatatcatatctcgtcttccggtttcgcccggaattcgattggtccatgcgtggaacattatattaaa

SEQ ID NO: 3202 - DNA, 546 bp, Cynodon dactylon
acttctctcgccagggtagggagcacgccgccgacgcgccaggagcccccggcctcccctccgccgccaaaatggtgaacgttcctaagaccaagaagacctactgcaagaacaaggagtgcaagaagcacactctccacaaggtcactcagtacaagaagggtaaggatagcctgtctgcccagggaaagcgtcgttatgaccgcaagcagtcaggatatggtggtcagacaaagcctgtcttccacaagaaggccaagaccaccaagaagatcgtgctgaagctgcagtgccagagctgcaagcactactcccagcacgccatcaagaggtgcaagcattttgagattggtggagacaagaagggcaagggaacatccctcttctaagctgctcatcacctacctggacgctgaagttgtggggtctcttgatacttatcgtccaatgtctatgttattaggagttaaacgcagactgctatgtgttcaaattccaatgtctgacatttacttctgagaacctatatgaagttttgtagctggt

SEQ ID NO: 3203 - DNA, 575 bp, Cynodon dactylon
agggtttcccgcaccgagcttgcaggccgccgccgccaggacgcaccgaaggaggaggaagccacagctcggcagccatggtgaacgtccccaaaaccaagaagacctactgcaagaacaaggaatgcaagaagcacacccttcacaaggttacccagtacaagaagggaaaggatagcctctctgctcaggggaagcgccgttatgaccgcaagcagtcaggatatggagggcagacaaagcctgttttccacaagaaggccaagactacaaagaagattgtgctgaagctgcagtgccagagctgcaagcactactctcagcatgccatcaagaggtgcaagcactttgaaatcggtggagacaagaagggcaagggaacctctctcttctaatctgaagatagttctactgtcacactatcaagttttctgtcagaagttactcctaagaaactgtttttctgtcttatttttatcgtgagatgcactgggtaggattatgtctttgggttggtatggtataatgtatgtaccctatttttactgtttgcatctgctaaatccaaatccagt

SEQ ID NO: 3204 - DNA, 602 bp, Pennisetum glaucum
tctggagcacacgccgcaggagccctacctctcctgcggcaacttctcggccggaaagggagcacacgccgcaggagccctacctctcccttccgccgccgccaaaatggtgaatgttcctaagaccaagaagacctactgcaagaacaaggagtgcaagaagcacactctccacaaggtgactcagtacaagaagggcaaggatagcctgtctgcccagggaaagcgtcgttatgatcgcaagcagtcaggatatggtggtcagaccaagcctgtgttccacaagaaggccaagaccaccaagaagattgtgctgaagctgcagtgccagagctgcaagcactactcacagcatgcgatcaagaggtgcaagcattttgagattggtggagacaagaagggcaagggaacatctcttttttagattgcatcgcctatctggatgctgaagttgtggtgtctactactgttcgtaaaacctcttgtcaaatttcagtgttactagtagttcttaatgtggaccatgcttatgtatccaaattccaatgcctgacatttgagtgttggtggacttttggctaaatgaagttttgtagcttgaa

SEQ ID NO: 3205 - DNA, 783 bp, Pennisetum glaucum
acttctcggccggaaagggagcacacgccgcaggagccctacctctcccttccgccgccgccaaaatggtgaatgttcctaagaccaagaagacctactgcaagaacaaggagtgcaagaagcacactctccacaaggttacccagtacaagaaaggaaaggatagcctttcagctcaagggaagcgtcgttatgaccgcaaacagtcaggatatggtggccagacaaagcctgttttccacaagaaggccaagacaacgaagaagattgtgctgaagctgcagtgccagagctgcaagcactattctcagcacgcgatcaagaggtgcaagcactttgagattggtggcgacaagaagggcaagggaacctctctcttctaagctgatgataaacttgttcttagccccaggtcgtctgccagaagttaccatttggaaagtcctatgttatccttacatagggagatacatcacatgggaacccactggattaatacaagttataatcttatgccttgtgtctgaatcagctattttgtcagataaatttggtacaatatagtttgtacgagaccaaatgatgaatgtgttattgtgttggagctcagtatcttttgctgcaagtactcaggcgagtttagctatcttgctgtgttcaagctttgagatgaagtttttctcggactgaattcttggatctttttgtgttgaatagtgatattcatcgtattccggataatattttctttgacccttttggtcggtgggacggataatatcc

SEQ ID NO: 3206 - DNA, 671 bp, Avena sativa
gtcacgagcgcagttagggtttttccgcaccgagctcgcgccgccgccagggacaccaccaaggccggaggaagcagcagctcagtagccatggtgaacgttccgaaaaccaagaagacctattgcaagaacaaggagtgcaagaagcacacacttcacaaggttacccagtacaagaagggaaaggatagcctttctgctcagggaaagcgtcgttatgaccgcaaacagtcaggatatggtgggcagacaaagcctgttttccacaagaaggccaagacaacaaagaagattgtgctgaagcttcagtgccagagctgcaagcactactctcagcacgcgatcaagaggtgcaagcactttgagattggtggagacaagaagggcaagggaacttctctcttctaatctgatgatagccatgttctcctactcaagttgtctgtcagaagttgccttacggatgtttttcttttattgttctactgagatgcatctgcttgaataccttatgcttttcatttgttgtatcaactgtttggtgtggtccttttgatacatactctactaagttgtgtttcatgccagaaattctgagttgtagtgacactgtcacggtttcttagtgatcgactgttctcttagtgaccctcgtggttgagctgctgccc

SEQ ID NO: 3207 - DNA, 806 bp, Sorghum bicolor
gcaatcccgatagaaatccggcaacgtatcaaaaagatgatgaactggccaatcttcaaaggtggcgcggcggcctttctagtcgggcctggtttcgcacgggcacggcccatgaagtgcacggcccgaatcggagaaaaccctagggcggtcgcctccccataagagcggatagggagcctctcgaccaccccgccgccgccgccaccactcgctgcagctctcgaccggatagggagcacgccgcacaagcccttccggcctcctttccgccgccgccaaaatggtgaacgttcctaagaccaagaagacctactgcaagaacaaggagtgcaagaagcacactctccacaaggtgactcagtacaagaagggtaaggatagcctgtctgcccagggaaagcgccgttatgaccgcaagcagtcaggatatggtggtcagaccaagcctgtcttccacaagaaggctaagaccaccaagaagattgtgctgaagctgcagtgccagagctgcaagcactactcacagcacgcaatcaagaggtgcaagcattttgagattggtggagacaagaagggcaagggaacatctcttttctaagtttatcatcaccaatgtgtgtgggtctactactgttctaaagactttttgtcaaagtagttctgaaagcagaccatgctatgtatccaaattccaatgcctgacatttgctctgagtgttggtcgacttttggctaaatgaacttttgtagcttgaatcgtcattgattctgttgtgtgttcgattttattctgccattcccaa

SEQ ID NO: 3208 - DNA, 1063 bp, Sorghum bicolor
gcaatcccgatagaaatccggcaacgtatcaaaaagatgatgaactggccaatcttcaaaggtggcgcggcggcctttctagtcgggcctggtttcgcacgggcacggcccatgaagtgcacggcccgaatcggagaaaaccctagggcggtcgcctccccataagagcggatagggagcctctcgaccaccccgccgccgccgccaccactcgctgcagctctcgaccggatagggagcacgccgcacaagcccttccggcctcctttccgccgccgccaaaatggtgaacgttcctaagaccaagaagacctactgcaagaacaaggagtgcaagaagcacactctccacaaggtgactcagtacaagaagggtaaggatagcctgtctgcccagggaaagcgccgttatgaccgcaagcagtcaggatatggtggtcagaccaagcctgtcttccacaagaaggctaagaccaccaagaagattgtgctgaagctgcagtgccagagctgcaagcactactcacagcacgcaatcaagaggtgcaagcattttgagattggtggagacaagaagggcaagggaacatctcttttctaagtttatcatcaccaatgtgtgtgggtctactactgttctaaagactttttgtcaaagtagttctgaaagcagaccatgctatgtatccaaattccaatgcctgacatttgctctgagtgttggtcgacttttggctaaatgaacttttgtagcttgaatcgtcattgattctgttgtgtgttcgattttattctgccattcccaattcgtattcttttgtattcttttggtctacggatatcggcttggaaccatatccgtgcgaactttgaatgcacgttcgtgctccgtagcacgtctctctctcaaagctcgttatgcagtgcatgtgccgtaagattcgatgtgattggaaatctaaaagttttggtaaaattttttgtaactgaacaaggcttcaggtcgacgtccgcggtggggaaggcaaaaagtggctgggccggcgcgtttggcgatctggtc

SEQ ID NO: 3209 - DNA, 724 bp, Saccharum officinarum
agaaaaccctagacagcggcgggcgcctcctcataaaagcacagggcttcttccccagccgccgccactcgctgcagcctctcgaccggatagggagcacgccgcacgagccccttacgccgccgccaaaatggtgaacgttcccaagaccaagaagacctactgcaagaacaaggagtgcaagaagcacactctccacaaggtgactcagtacaagaagggtaaggatagcctgtctgcccagggaaagcgtcgttatgaccgcaagcagtcaggatatggtggtcagaccaagcctgtcttccacaagaaggccaagaccaccaagaagattgtgctgaagctgcagtgccagagctgcaagcactactcacagcacgcgatcaagaggtgcaagcattttgagattggtggagacaagaagggcaagggaacatctcttttctaagtttacaatcacctatgcgtgtgggtctactactgttctaaaaacttgtcgtcaaatttcaatgttactagtagttctgaaagcagacaatgctatgtatccaaattccaatgcctgacatttgttccgagtgttggtcgacttttggctaaatgaagttttgtagcttgaatcatcattgaatctgttctgtgtttgatttgaaaaaaaaaacataaaaataatatcacccacgcgtccgcgcacgcgtggctcgacccggttacccaacccctg

SEQ ID NO: 3210 - DNA, 569 bp, Triticum aestivum
ctcaaccggataggtagcaccggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatagcctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagctgtggtctactactactgttataaaaacatgtcgccaaattcaatgttaatgttaccaatggaaagcagccatgctatgtaccaatcccaagcctgacatttggtctgggcgttggccactttttggggtaaagaaacttttgtactttgg

SEQ ID NO: 3211 - DNA, 521 bp, Allium cepa
agtcagccgccgtttcctgcttcctaaccctaagctcatcggagttccaaccttagttttgctttgcagccatggttaacgttccaaagacaaagaaaacttactgcaagaacaaggagtgcaagaagcacaccttgcacaaagttactcaatacaagaaaggggaaggatagtctttctgctcagggtaagaggcgttatgacaggaagcagtctgggtatggtggacagactaagccggttttccacaaaaaggcaaaaactactaagaagattgtgctcaaattgcagtgtcagagttgcaagcattactcacagaaagcaatcaagagatgcaagcattttgagattggaggagacaaaaagggcaagggaacatctttgttttaaattataaactttgtctatctatgcaacgctactgttatgattaaaatgctgttatgtttaacttctttaaagtctttctaaatttttatttgatccgttattttagtttccctattatatgaatattcctt

SEQ ID NO: 3212 - DNA, 577 bp, Secale cereale
tttcagctttcggcggcggcggcgcactcctcgtgttctcacccaggcgcgcactcctcccctccactcgccgtcgtcgtctcggacccaccgccgcttccgcagccatggtgaacgttccgaagaccaagaagacctactgcaagaacaaggagtgcaagaagcacaccctcccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacagcgtgccatcaagaggtgcaagcactttgaaatcggtggagacaagaagggcaagggaacatctctcttctaatctgatgatatcaccgttatgtttagaatgttgtgccagaattctcacaagaagaatgtattatctttaatattctggttataaccctatggactatggagcatatgttttgctattgtgttgactactttctcctagatctaatcgacaa

SEQ ID NO: 3213 - DNA, 528 bp, Secale cereale
ccacgcgtccgcagaaagggaagcacgccggagccccatctccccggccgtcaaaatggtgaacgttccgaagaccaagaagacctactgcaaaaacaaggagtgcaagaagcacacacttcacaaggtcactcagtacaagaagggtaaggacagtctgtctgcccagggaaagcgtcgttatgacaggaagcagtcgggatatggtggtcagactaagcctgttttccacaagaaggcaaaaaccaccaagaagattgtgctgaagctgcagtgccagagctgcaagcactattcccagcgtgccatcaagagatgcaagcattttgagattggtggagacaagaagggcgaaggggacatctcttttctagagtgctttcacctctctggagtggtgggtggtcaagaactattactacttgtgttaagagtttgttgttaggagctaaattaatcagaccttgtcatgtaaccaaactcctgtgtctggcatttaagtaaggggtgacattttgctgaatgaag

SEQ ID NO: 3214 - DNA, 1719 bp, Triticum aestivum
cccaagcgccgccattctcccccttccccctttcctcaccgccgcccacgccgcaggagaagaagcagacgcgcggaggagagcttccaggcggcgaccatggtgaacgttccaaagaccaagaagacctactgcaagaacaaggagtgcaagaagcacaccctccacaaggttacgcagtacaagaaaggcaaggacagtctttctgctcagggaaagcgccgttacgaccgcaagcagtcaggatatggtggccagacaaagcctgttttccacaagaaggccaagacaacaaagaagattgtgctgaagctgcagtgccagagctgcaagcattactcgcaacgcgctatcaagaggtgcaagcactttgagatcggtggagacaagaagggcaaggggacctctctcttctaagctgatgatatccctgttttgttcagtgttgtgccagaacttcccactcgaacaatgtattagtatcatattggtattctgggtataactgtatgggctatggagcatatgttttgcctttcctgtcaacgactctcttcagatccttgagacaagtaaaaaatagctgtcccgatcctcgatctgttctcaaccctccctccgtccgtcgcagctccagatttccttccccatggctccgatcaagatcggcatcaatggtttcggccggatcggcaggcttgtggccagggttgcgctccagagccccgatgtcgagctcgtcgccgttaacgaccccttcatcaccaccgactacatgacctacatgttcaagtatgacactgtccacggacagtggaagcaccatgaagttaaggtgaaggactccaagacccttctcttcggtgagaaggaggttgcggtgtttggctgcaggaacccagaggagatcccatgggctgctgctggtgctgagtacgttgttgagtccaccggtgttttcactgacaaggacaaggctgcagctcacattaagggtggtgccaagaaggtcatcatttctgctcccagcaaggatgctcccatgtttgtctgtggtgtcaatgagaaggaatacaagtctgacatcgacattgtctccaacgctagctgcaccactaactgccttgctcctctgctaaggttatcaatgacaggtttggcatggttgagggtttgatgaccacagttcatgccatgactgcaacccagaagactgttgatggtccttccagcaaggactggagaggtggaagggctgccagcttcaacatcattccaagcagcactggtgccgcaaaggctgttggcaaggtgctcccagagcttaacggaaagttgactggaatggccttccgtgttcccactgttgatgtttctgttgttgatctgactgttagacttgcgaagccagcaacctatgatcagattaaggctgctatcaaggaggagtctgagggaaacctcaagggcattttgggttacgttgatgaggaccttgtttccactgactttcagggtgacaacaggtccagcatcttcgatgccaaggccgggattgctctgaacgacaactttgtcaagcttgtctcctgggtacgacaacgagtggggatacagcacccgccgtgggtcgacctcatccgtcacatgcacagcaccaagtaaatgagaagcatgaagatacaggggagagtggttgccccaagaggagtgttcaaa

SEQ ID NO: 3215 - DNA, 505 bp, Triticum aestivum
cttgtgtccccgccgccgccacctgctgcagcttctcaaccggataggtagcaccggagcaggtagaacgctgcacaatccccttcgccgccgccaagatggtgaacgttcctaagaccaagaagacgtactgcaagaacaaagagtgcaagaagcacacactccacaaggtgactcagtataagaagggcaaggatacctgtctgcccagggaaagcgccgttatgaccgcaagcagtcaggatatggtggtcagaccaagcctgtcttccacaagaaggccaagaccaccaagaagattgttctgaagctgcagtgccagagctgcaagcactactcacagcacgccatcaagagatgcaagcattttgagattggtggagacaagaagggcaagggcacatctcttttctaagcttctcgtccacctgtctggttgttgagttgaagctgtggtctactactactgttataaaaacatgtcgccaaattcaatgttaatgtt

SEQ ID NO: 3216 - DNA, 2133 bp, Triticum aestivum
aaagaggattcaagctacaaaagatcattctgccaagtcgatcgttgctcaaatgccagataaaggggtttggatacatgacagggtctgattgattcaactcataacatcaaaacaatatgacaagtagtaatagttcttgaacacaacgactacagataggtgaaagcaatctagaagagggatgttcccttgcccttcttgtctccaccgatctcaaaatgcttgcacctcttgatggcgcgctgggagtagtgcttgcagctctggcactgcagcttcagcacaatcttcttggtggtttttgccttcttgtggaaaacgggcttggtctgaccaccgtatcccgactgcttcctgtcataacgacgctttccctgggcagacaggctgtccttacccttcttgtattgagtgaccttgtgaagggtgtgcttcttgcactccttgtttttgcagtaggtcttcttggtcttcggaacgttcaccatggcggcggcggcggcggtgcggtgctcgcgctcggtcggttagcgtcgtcgtcggcagcggcggcggtgacgagcgggtgggcgccggacagctggagggcgcggccggcgcggcagatcccgaagtacccggacgcagcggcgcttggggaggctgagcgcacgctggcgtccttcccgccgctggtgtttgcgggggagacgcggacgctggaggagcgcctcggggaggcggccatgggccgggcgttcctcctgcagggcggcgactgcgccgagagcttcaaggagttcggcgccaacaacatccgcgacaccttccgcctcatgctccagatggccgtcgtcctcaccttcgggggccagatgcccatcatcaaggttggaaggatggcaggccaatttgcaaagccaagatcgaacccaatcgagactagagatggagtgacgctgccgtcctatcaaggtgacatcatcaacaacgatgatttcgatgagaaatcgcgtgcaccaaaccctcaaaggttgattagagcctacagtcagtctgcgagcaccctgaatcttttgagagcatttgcccatggaggatatgctgatcttcagagagtcaccgagtggaacctcgactttctgaggcacagcacgcagggagacaggtatgtggagcttgcccagagggttcatgacgccatcgggttcatgcttgctgctggtctgcctcctcagcatcccatgatgaccacagctgaattctggacatcccatgagtgccttcacttgccatatgagcaggcactgaccagggaggactccacttctggcctctattacgactgctctgcacacatgctctgggttggggagagaactaggcagctggatggtgctcatgttgaattcctccgcggtatttccaatcctgtcggcataaaggtgagtgataagcttgattcatcggagcttgtgaaactctgtgagattttgaatcctcacaacaagcccgggaggctgacacttatcacaaggatgggggccgagaacatgcgtgccaagctcccccatatgatcagagccgtgcgtcaagcagggctgattgtcacctgggtcagcgatcccatgcacgggaacaccatcagcgcaccttgcgggctcaagacaagatcattcgatgcaatccgggctgagcttcgggctttctttgatgtacatgagcaagaggggagctaccccggaggggttcacctagagatgacagggcagaacgttacagagtgcattggtggatccaacacagtgaccttcgacgatctcagttcccgctaccgcacgcactgcgaccccaggctgaacgcatcgcagtcgcttgagctggcctttgccattgccgagaggctaaggaagaagagagacaggacatggactagcctgatatctaaagtagaagcttaagatatcaatcttagatttcttccctgcaaaactatcttcagctgctagaggacataattttacattctttagtttttgtagtagtataggtgccgtttgattttggaaatgccgaggaaaaatctccctcaaataataggatatagctgttttggtgcagtacttgtgcttggttcaattccagtttctt

SEQ ID NO: 3217 - DNA, 692 bp, Hordeum vulgare
ctgcgctctcctacactttcagctttcggcggcggcggcgcactcctcgtgtcctcctcctcctcctctcgccgtcgtcgtctccggtccaccgccgcttccgcagccatggtgaacgttccgaagaccaagaagacctactgcaagaacaaggagtgcaagaagcacaccctccacaaggttacccagtataagaagggtaaggacagcctttctgctcaggggaagcgtcgctatgaccgcaagcagtctggatatggtggccagacgaagcctgttttccacaagaaggccaagacaacaaagaagattgtgctgaagttgcagtgccagagctgcaagcactactcacaacgtgctatcaagaggtgcaagcactttgaaatcggtggagacaagaagggcaagggaacatctctcttctaagatgatgatcttgctgttatgtttagaatgttgtgccagaacttcccacaagaagaatgtattatctttaaatttctggttataacccatgggctatggagcatttgttttgcaattgtgtcgactactgttataacccatgggctatggagcatttgttttgcaattgtgtcgactactttctccagatctaattgacaagaaaaatgttctttatccttggagttttgtatttttgttcctggtctaactagaattgctgctgc

SEQ ID NO: 3218 - DNA, 775 bp, Hordeum vulgare
cgacggtctcgcgactcgcaaaccctagctcgcgacagcacagggccacaaaaccacacccctctccctccccgccgccacttgccgcaactcctccaccagaaagagaagcacgccggagctccatctcctcggccgtcaaaatggtgaacgttccgaagaccaagaagacctactgcaaaaacaaggagtgcaagaagcacacacttcacaaggtcactcagtacaaaaagggtaaggacagtctgtctgcccagggaaaacgtcgttatgacaggaagcagtcgggatatggtggtcagaccaagcctgtcttccacaagaaggcaaaaaccaccaagaagattgtgctgaagctgcagtgccagagctgcaagcactactcccagcgtgccatcaagagatgcaagcattttgagatcggtggagacaagaagggcaaggggacatctcttttctaaactgcgctcacctatctggagtggtggtggtcaagaactagtactacttgtgttaagggtttgttgttaggagctaaattaatcagaccttgtcatgtatccaaactcctgtgtctggcatttaagtaaggggcgactttttggccaagaaagttttgtagtttgaatcctctttcattccgtatcatgtcttattttgacaccatgcagttgagtgacatggtaatttgagctttgctgatcctttttggcctatgataactgttcccaatgactgctggggaaactgcctacggtttcttttcttcctagct

SEQ ID NO: 3219 - DNA, 630 bp, Hordeum vulgare
attaaactagcaaacatgttattatgatttcagcaatgaattgctatgtgcttatctgatgtgataaaattcctggtcatttattccataaccatggtgaacgttccgaaaaccaagaagacctactgcaagaacaaggagtgcaagaagcacaccctccacaaggtcacgcaatataagaaaggaaaagatagtctttctgctcaggggaagcgtcgttatgaccgcaagcagtcaggatatggtggccagacaaagcctgttttccacaagaaggccaagacaacaaagaagattgtgctgaagctgcagtgccagagctgcaagcattactcacagagagccatcaagaggtgcaagcattttgaaatcggtggagacaagaagggcaagggaacctctcttttctaagctgatgatatccctgttatgttcagaatgttgtgccagaacttcccacctgaacaatctattatcttaatattctggctataactctatcggccatgtagcatatgttttgcctttctgtccaactactttcttcagatccatgagacaagtaaaaaaggttctctatgtgctcttgagttcgttgtatttgttcttgatcttattaggattgtactc

SEQ ID NO: 3220 - DNA, 601 bp, Allium cepa
ccatccctcgtcgttggccttagggtccaggtactcagaaggcagtcggtagtcaacgcagagtagggggaaccctaagctcatcggagttccaaccttagttttgctttgcagccatggttaacgttccaaagacaaagaaaacttactgcaagaacaaggagtgcaagaagcacaccttgcacaaagttactcaatacaagaaagggaaggatagtctttctgctcagggtaagaggcgttatgacaggaagcagtctgggtatggtggacagactaagccggttttccacaaaaaggcaaaaactactaagaagattgtgctcaaattgcagtgtcagagttgcaagcattactcacagaaagcaatcaagagatgcaagcattttgagattggaggagacaaaaagggcaagggaacatctttgttttaaattataaactttgtctatctatgcaacgctactgttatgattaaaatgctgttatgtttaacttctttaaagtctttctaaatttttatttgatccgttattttagtttccctattatatgaatatccttgaacaaatccgtttatttttattttagtttcgatttt

SEQ ID NO: 3221 - DNA, 547 bp, Allium cepa
cgtggtaatcaacgacgacgagtaccgggggtcgattagcgcgtgcttttctcaactccatcaattaatcatggtcaacgttccaaaaacaaagaagacatactgcaagaacaaagaatgcaagaaacacactttacacaaggtgactcagtataagaagggcaaagatagcctttcagctcaaggaaagaggcgttatgaccgaaagcagtctggttatggtggtcagactaagcccgtctttcacaagaaggctaaaaccacaaagaaaattgtgctcaagttgcaatgtcagagctgcaagcattactctcaaaaagccatcaagaggtgcaagcattttgaaatcggtggagacaagaagggcaagggaacatcactcttctaaatatgtttttcatcctttttgtttagcgaacgatttgtgctgtggttttatctttattgttgaaatctgtagtgttgctgaatgattttgttgaacctcttgatatgaatatttttggatctattgcatttagatggataattcagtttatctttgttt

SEQ ID NO: 3222 - DNA, 578 bp, Allium cepa
aacatgaagtaacaatccggactgaatccagggataaaacagtaatatgacaataaatctaaaccctagatatataaatcatactttgccaatctgaaccagcttcatttagcggctgtgcttttctcaactccatcaattaatcatggtcaacgttccaaaaacaaagaagacatactgcaagaacaaagaatgcaagaaacacactttacacaaggtgactcagtataagaagggcaaagatagcctttcagctcaaggaaagaggcgttatgaccgaaagcagtctggttatggtggtcagactaagcccgtctttcacaagaaggctaaaaccacaaagaaaattgtgctcaagttgcaatgtcagagctgcaagcattactctcaaaaagccatcaagaggtgcaagcattttgaaatcggtggagacaagaagggcaagggaacatcactcttctaaatatgtttttcatcctttttgtttagcgaacgatttgtgctgtggttttatctttattgttgaaatctgtagtgttgctgaatgattttgttgaacctcttgatatgaatatttt

SEQ ID NO: 3223 - DNA, 570 bp, Allium cepa
cttttctcaactccatcaattaatcatggtcaacgttccaaaaacaaagaagacatactgcaagaacaaagaatgcaagaaacacactttacacaaggtgactcagtataagaagggcaaagatagcctttcagctcaaggaaagaggcgttatgaccgaaagcagtctggttatggtggtcagactaagcccgtctttcacaagaaggctaaaaccacaaagaaaattgtgctcaagttgcaatgtcagagctgcaagcattactctcaaaaagccatcaagaggtgcaagcattttgaaatcggtggagacaagaagggcaagggaacatcactcttctaaatatgtttttcatcctttttgtttagcgaacgatttgtgctgtggttttatctttattgttgaaatctgtagtgttgctgaatgattttgttgaacctcttgatatgaatatttttggatctattgcatttagatggataattcagtttatctttgttttctgacttaagcaacaatgactatgttactgtcgatgttatgactcatttgagctgaattacaggtac

SEQ ID NO: 3224 - DNA, 564 bp, Allium cepa
ataaaatcaattagtcagccgccgtttcctgcttcctaaccctaagctcatcggagttccaaccttagttttgctttgcagccatggttaacgttccaaagacaaagaaaacttactgcaagaacaaggagtgcaagaagcacaccctgcacaaagttactcaatacaagaaagggaaggatagtctttctgctcagggtaagaggcgttatgacaggaagcagtctgggtatggtggacagactaagccggttttccacaaaaaggcaaaaactactaagaagattgtgctcaaattgcagtgtcagagttgcaagcattactcacagaaagcaatcaagagatgcaagcattttgagattggaggagacaaaaagggcaagggaacatctttgttttaaattataaactttgtctatctatgcaacgctactgttatgattaaaatgctgtcatgtttaacttctttaaagtctttctaaatttttatttgatccgttattttagtttccctattatatgaatatccttgaacaaatccgtttatttttatcttagtttcga

SEQ ID NO: 3225 - DNA, 842 bp, Secale cereale
gttggcacaccaccagccctgaccaaccaaagtgacattcaggcccatgaaggaagcgacggtctcgcgactcgcaaaccctagctcgcgagcacagggccacaaaaccacacccctctccctgcccgccgccacttgccgcaactcctccaccagaaagggaagcacgccggagccccatctccccggccgtcaaaatggtgaacgttccgaagaccaagaagacctactgcaaaaacaaggagtgcaagaagcacacacttcacaaggtcactcagtacaagaagggtaaggacagtctgtctgcccagggaaagcgtcgttatgacaggaagcagtcgggatatggtggtcagactaagcctgttttccacaagaaggcaaaaaccaccaagaagattgtgctgaagctgcagtgccagagctgcaagcactattcccagcgtgccatcaagagatgcaagcattttgagattggtggagacaagaagggcaaggggacatctcttttctagagtgctttcacctctctggagtggtggtggtcaagaactattactacttgtgttaagagtttgttgttaggagctaaattaatcagaccttgtcatgtaaccaaactcctgtgtctggcatttaagtaaggggtgacattttgctgaatgaagttttgtagtttgaaacctctttcattccgtataatttctcattttatttgcttcagtatattgttgagtgacatggtaatttgagctttgctgctgagttcggatgctttttgacatatgataactgttcctagtgtctgctgggaaaattacttggtgttggaaagtttaaat

SEQ ID NO: 3226 - DNA, 717 bp, Secale cereale
gcgcccctcgtatataaccaaccaccccttcgctctccgaccctttcagctttcggcggcggcggcgcactcctcgtgttctcacccaggcgcgcactcctccccctccactcgccgtcgtcgtctcggacccaccgccgcttccgcagccatggtgaacgttccgaagaccaagaagacctactgcaagaacaaggagtgcaagaagcacaccctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacagcgtgccatcaagaggtgcaagcacttcgaaattggtggagacaagaagggcaagggaacatctctcttctaagctgatgatatcgccgttatgtttagaatgttgtgccagaacttcactcaagaagaatgtattatctttaattttctggttataaccctatgggttatggagcatatgttttgctattgggtcaactactttctccagatctaattgagaagtaaaatgttctttatgcttggagtttggtatttttgttcttggtctgatcagaattgctgtcgcagtgtatgcttattatgtgctgaatgcccttt

SEQ ID NO: 3227 - DNA, 836 bp, Secale cereale
cctcctcctcctccactcgccgtcgtcgtctcggatccgcagccatggtgaacgttccgaagaccaagaagacctactgcaagaacaaggagtgcaagaagcacaccctccacaaggttacccagtacaagaaaggcaaggatagcctttctgctcagggaaagcgtcgttatgaccgcaagcagtctggatatggtggccagacaaagcctgttttccacaagaaggccaagacaacaaagaagattgtgctgaagttgcagtgccagagctgcaagcattactcacagcgcgctatcaagaggtgcaagcactttgaaatcggtggagacaagaagggcaagggaacatctctcttctaagctgatgatatcgccgttatgtttagaatgttgtgccagaacttcactcaagaagaatgtattatctttaattttctggttataaccctatgggttatggagcatatgttttgctattgggtcaactactttctccagatctaattgagaagtaaaatgttctttatgcttggagtttggttttttttgttcttggtctgatcagaattgctgtcgcagtgtatgcttattatgtgctgaatgcccctttaagtttttaaaaaaaaaaaaaaaaaacaaaaaaaaaaaaaaacaaaaaaaaaaaaagaaaaaaaaaaagaaaaaaagaaaagaagaaagagagagagagagagagagagagagagatagactagtacgtacaggactagactagatcgtagtagggtgtacgtatatgtacaggtcgagacgtacgctgcacagctgtctgactgtactgtagctgtgtgtgtg

SEQ ID NO: 3228 - DNA, 608 bp, Secale cereale
ggcggcggcggcgcactcctcgtgttctcacccaggcgcgcactcctcctcctcctccactcgccgtcgtcgtctcggatccgcagccatggtgaacgttccgaagaccaagaagacctactgcaagaacaaggagtgcaagaagcacaccctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacagcgcgccatcaagaggtgcaagcacttcgaaatcggtggagacaagaagggcaagggaacatctctcttctaagctgatgatgtcgctgttatgtttagaatgttgtgccagaacttcacgcaagaagaatgtactatctttaattttctggttataaccctatgggctatggagcatatgttttgctattgggtcaactactttctccagatctaatcgacaactaaaatgttctttatgctcatagtttggtatatgcttatgatgcgccgaa

SEQ ID NO: 3229 - DNA, 729 bp, Secale cereale
cccaagcgccgctattctcccttccccttttcccttctaccccgtcccccgccgcaggagaagaagcagaagcgcggaggagagcttccaggcggcgaccatggtgaacgttccaaagaccaagaagacctactgcaagaacaaggagtgcaagaagcacaccctccacaaggttacacaatacaagaaaggcaaggatagtctttctgctcaggggaagcgtcgttatgaccgcaagcagtcaggatatggtggccagacaaagcccgttttccacaagaaggccaagacaacaaagaagattgtgctgaagctgcagtgccagagctgcaagcattactcacaacgcgccatcaagaggtgcaagcactttgaaatcggtggagacaagaagggcaagggaacctctctcttctaagctgatgatgcccccgttatgttcagagtgccgtgccagaacttcccactcgaacaatgtattatctcattaatattctgggtatgaactctatgggctatggagcatatgtttgcctttgtgtcaagtgtcaactactctcatcagatccatgagacaagtaaaatattctttatgcttgagttcgttctacttgttcttggtctacttaggattgtagtatatgttagtggctttacatttcaaatgtgtgctccctctgtttcaaaatttatgttcagatttcagctttgattcatatgaaatgcttt

SEQ ID NO: 3230 - DNA, 755 bp, Secale cereale
ggtctcgcgactcgcaaaccctagctcgcgagcacagggccacaaaaccacacccctctccctgcccgccgccacttgccgcaactcctccaccagaaagggaagcacgccggagccccatctccccggccgtcaaaatggtgaacgttccgaagaccaagaagacctactgcaaaaacaaggagtgcaagaagcacacacttcacaaggtcactcagtacaagaagggtaaggacagtctgtctgcccagggaaagcgtcgttatgacaggaagcagtcgggatatggtggtcagactaagcctgttttccacaagaaggcaaaaaccaccaagaagattgtgctgaagctgcagtgccagagctgcaagcactattcccagcgtgccatcaagagatgcaagcattttgagatcggtggggacaagaagggcaaggggacatctcttttctagagtgctttcacctctctggagtggtggtggtcaagaactattactacttgtgttaagagtttgttgttaggagctaaattaatcagaccttgtcatgtatccaaactcctgtgtctggcatttaagtgaggggtgacattttgctgaatgaagttttgtagtttgaaacctctttcattccgtataatttctcattttatttgcttcagtatattgttgagtgacatggtaatttgagctttgctgctgagttcggatgctttttgacatatgataactgttcctagtgtctgactaggt

SEQ ID NO: 3231 - DNA, 693 bp, Secale cereale
agctttcggcggcggcggcgcactcctcgtgttctcacccaggcgcgcactcctccccctccactcgccgtcgtcgtctcggacccaccgccgcttccgcagccatggtgaacgttccgaagaccaagaagacctactgcaagaacaaggagtgcaagaagcacaccctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacagcgcgccatcaagaggtgcaagcacttcgaaatcggtggagacaagaagggcaagggaacatctctcttctaagctgatgatgtcgctgttatgtttagaatgttgtgccagaacttcacgcaagaagaatgtactatctttaattttctggttataaccctatgggctatggagcatatgttttgctattgggtcaactactttctccagatctaatcgacaactaaaatgttctttatgctcatagtttggtatatgcttatgatgcgccgaatagaaacccttaaaaaaaaaaaaaaaaaaaaaaaaaaaaaaaaaaaaaaaaaagaaaaaaaaaaaaaaa

SEQ ID NO: 3232 - DNA, 674 bp, Secale cereale
ctcgcgactcgcaaaccctagctcgcgagcacagggccacaaaaccacacccctctccctgcccgccgccacttgccgcaactcctccaccagaaagggaagcacgccggagccccatctccccggccgtcaaaatggtgaacgttccgaagaccaagaagacctactgcaaaaacaaggagtgcaagaagcacacacttcacaaggtcactcagtacaagaagggtaaggacagtctgtctgcccagggaaagcgtcgttatgacaggaagcagtcgggatatggtggtcagactaagcctgttttccacaagaaggcaaaaaccaccaagaagattgtgctgaagctgcagtgccagagctgcaagcactattcccagcgtgccatcaagagatgcaagcattttgagatcggtggggacaagaagggcaaggggacatctcttttctagagtgctttcacctctctggagtggtggtggtcaagaactattactacttgtgttaagagtttgttgttaggagctaaattaatcagaccttgtcatgtatccaaactcctgtgtctggcatttaagtgaggggtgacattttgctgaatgaagttttgtagtttgaaacctctttcattccgtataatttctcattttatttgcttcagtatattgttgagt

SEQ ID NO: 3233 - DNA, 739 bp, Secale cereale
ctttcggcggcggcggcgcactcctcgtgttctcacccaggcgcgcactcctccccctccactcgccgtcgtcgtctcggatccaccgccgcttccgcagccatggtgaacgttccgaagaccaagaagacctactgcaagaacaaggagtgcaagaagcacaccctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcccagcgcgccatcaagaggtgcaagcactttgaaatcggtggagacaagaagggcaagggaacatctctcttctaagctgatgatattgtcgttatgtttagaatgttgtgccagaacttcactcaagaagaatgtattatctttaattttctggttataaccctatgggttatggagcatatgttttgctattgggtcaactactttctccagatctaattgagaagtaaaatgttctttatgcttggagtttggtatttttgttcttggtctgatcagaattgctgtcgcagtgtatgcttatgatgcgctgaatgccctttgtttttaggtctcctgtccgttttttctggctttggcaatttgttttcgtatgttgtatcccaaaaaaaaa

SEQ ID NO: 3234 - DNA, 724 bp, Secale cereale
gactccattctcccccttgcccctttcctcacccccgccccgccgcaggagaagaagcagacgcgcggaggagagcttccaggcgtcgaccatggtgaacgttccaaagaccaagaagacctactgcaagaacaaggagtgcaagaagcacaccctccacaaggttacacaatacaagaaaggcaaggatagtctttctgctcagggaaagcgtcgttatgaccgcaagcagtcaggatatggtggccagacaaagcccgttttccacaagaaggccaagacaacaaagaagattgtgctgaagctgcaatgccagagctgcaagcattactcacaacgcgccatcaagaggtgcaagcactttgaaatcggtggagacaagaagggcaagggaacctctctcttctaagctgatgatatccccgttatgttcagagtgctgtgccagaacttcccactcgaacaatgtattatctcattaatatctgggtatgaactctatgggctgtggagcatatgttttgcctttgtgtcaagtgtcaactactctcatcagatccatgagacaagtaaaatgttctttatgctagagttcgttctgcttgttcttggtctacttaggattgtagtatatgtttgtggctttacatttcaaatatgtgctccctctgtttaaaaatttatgttcagatttcagctttgattcatatgaagtgcttttgaa

SEQ ID NO: 3235 - DNA, 793 bp, Secale cereale
ttcgggttcggttcgagaggagagtagctagcctagtctagggtttccgtaggacaagcagaggagaggggagatccatggcggagacggagtaccgctgcttcgtggcggcctcgcctgggccaccgacgaccacaacctccagcaggccttcagccagtacggcgagatcctcgacgccaagatcatcaacgaccgcgagacgggcaggtcccgtggtttcggcttcgtgacgttcggcagcgaggagtcgatgcgccaggccatcgaggagatgaacggcaaggagctcgacgggcgcaacatcaccgtcaacgaggcccagtcccgccgccgccatggtgaacgtaccaaagaccaagaagacctactgcaaaaacaaggagtgcaagaagcacacccttcacaaggtcactcagtacaagaagggtaaagacagtctgtctgcccagggaaagcgccgttatgacaggaagcagtcaggatatggtggtcagaccaagcctgttttccacaagaaggcaaaaaccaccaagaagattgtgctgaagctgcagtgccagagctgcaagcactactcccagcgcgccatcaagcggtgcaagcattttgagatcggtggagacaagaagggcaagggaacatccctcttctagattgctttcacctatctgtaatcattgtggtcaagaactatttctacttgtcgtaatgtttcagtgttatgagttgaatcaatcagaccttgcatgtactcctaaaccctttctactggtactaagttttagaacgg

SEQ ID NO: 3236 - DNA, 747 bp, Secale cereale
gtgagggcgaaaccctagctggccgcgccctcgtatataaccgaccaccccttcgccctccgaccctttcagctttcggcggcggcggcgcactcctcgtgttctcacccaggcgcgcactcctccccctccactcgccgtcgtcgtctcggatccaccgccgcttccgcagccatggtgaacgttccgaagaccaagaagacctactgcaagaacaaggagtgcaagaagcacaccctccacaaggttacccagtacaagaaaggcaaggatagcctttctgcccagggaaagcgtcgttatgaccgcaagcagtctggatatggtggccagacaaagcctgttttccacaagaaggccaagacaacaaagaagattgtgctgaagttgcagtgccagagctgcaagcattactcacagcgcgccatcaagaggtgcaagcactttgaaatcggtggagacaagaagggcaagggaacatctctcttctaagctgatgatattgccgttatgtttagaatgttgtgctagaacttcactcaagaagaatgtattatctttaattttctggttataaccctatgggttatggagcatatgttttgctattgggtcaactactttctccagatctaattgagaagtaaaatgttctatatgcttggagtttggtatttttgttcttggtctgatcagaaatgctgtcgcagtgtatgcttatgatgcgctgaatgccctttagttttt

SEQ ID NO: 3237 - DNA, 661 bp, Triticum aestivum
cacccctcgtatataaccgcgcaccccttcgccctcccaccatttcagttttcggcggcggcggcgcactcccgtgttctcacccaggcgcgcactcctcctcgccgtctcggatccaccgccgcttccgcagccatggtgaacgttccgaagaccaagaagacctactgcaagaacaaggagtgcaagaagcacaccctccacaaggttacccaatacaaaaagggtaaggacagtctttctgcccaggggaagcgtcgttatgaccgcaagcagtctggatatggtggccagacaaagcctgttttccacaagaaggccaagacaacaaagaagattgtgctgaagttgcagtgccagagctgcaagcattactcacaacgtgctatcaagaggtgcaagcacttcgaaatcggtggagacaagaagggcaagggaacatctctcttctaagctgatgatattgtcgttatgtttagaatgttgtgccagaacttcccacaagaagactgtattatctttaattttctggctataaccctattggcaatggagcatatgttttgctattgtgtcaactactttctccagatccaatcgacaagtaaaatgttatttattctctgagtttggtatttttgttcttggtctaattaaattg

SEQ ID NO: 3238 - DNA, 1021 bp, Triticum aestivum
gccgcaactcctccaccagaaagggaagggaagcacgccggagccccatctccccggccgtcaaaatggtgaacgttccgaagaccaagaagacctactgcaaaaacaaggagtgcaagaagcacacacttcacaaggtcactcagtacaagaagggcaaggacagtctatctgcccagggaaagcgtcgttatgacaggaagcagtcgggatatggtggtcagaccaagcctgttttccacaagaaggcaaaaaccaccaagaagattgtgctgaagctgcaatgccagagctgcaagcactactcccagcgtgccatcaagaggtgcaagcattttgagatcggcggagacaagaagggcaaggggacatctcttttctagactgctttcacctatctggagtggtggtggtcacgaagtattactacttgtgttaagggttcgttgttaggagttaaattaatcagaccttgtcatgtatccaaactcctgtgtcttgcatttaagcaagaggcgagttttggctaagtgaagttttgtagcttgaatcctctttcattccgtataatgtcaatcaactccatggtgttaaaatgtttctagagcatggtaatttgagctttgctgatgctttttggcatatgtagctgttctcagtgactgctggggaaattgcgaagggttcttcctacccaacgtgtctagttgtgggtaattagagctagggaatggggatttgaaatcaagaaggaaacccatcttgaaattctatcataactttcctccgtctcttatttagtcattcccatgaatcaaaacggaatagtttctacatatcctcacacatgattcccatcttaatacaacttcctgctttagacccccatccctcttttgaaaaatatcgccaaccgtgctgtcatgggatgaatccaactgatttcttgtagtgatggactcccctagaaagctatttcatcgatatgaggtttcctactcttcgcattgtagattacgcc

SEQ ID NO: 3239 - DNA, 919 bp, Triticum aestivum
aagcccatattcccgaagctactacacctgccgtccctagggttttgctgcgctgatatttcacccaagcgccgccattctcccccttccccttttcctcaccgccgcaggagaagaagcagacgcgcggaggagagcttccaggcggcgaccatggtgaacgttccaaagaccaagaagacctactgcaagaacaaggagtgcaagaagcacaccctccacaaggttacacaatacaagaaaggcaaggatagtctttctgctcagggcaagcgtcgttatgaccgcaagcagtcaggatatggtggccagacaaagcctgttttccacaagaaggccaagacaacaaagaagattgtgctgaagctgcagtgccagagctgcaagcattactcgcaacgcgccatcaagaggtgcaagcacttcgaaatcggtggagacaagaagggcaagggaacctctctcttctaagctgatgatacccctgttatgttcagagtgttgtgccagaacttcccactcgaacaatgtattatctcgttaatttctgggtatgaactctatgggctatggagcatttgttttgcctttgtgtcaagtgtcaactactctcgtcagatccatgagacaagtaaaatgttctttagggcatgtacaatggtgctatcttaagagtgccacgtaggataaatgatgaggtggaggagagagaactcataagagaaggcttgtcttctcttatttaagataagacaagagatgatctcttagcataatatatctcaccatatttttaggaattgctaattattgaagataagattaagagatgacccattgtagacatttttctttgtcatctctaaattacatgtaaaacttaagataaaactatcttatcaaccattgtacatgccct

SEQ ID NO: 3240 - DNA, 747 bp, Triticum aestivum
atcataaaagtggcattcaggcccatgaaggaagcgacggtctcgtgactcgcaaaccctagctcgcgagcacagggccacaaaaccacacccctctccctgcccgccgccacttgccgcaactcctccaccagaaagggaagcacgccggagtcccatctccccggccgtcaaaatggtgaatgttccgaagaccaagaagacctactgcaaaaacaaggagtgcaagaagcacacacttcataaggtcactcagtacaagaagggtaaggacagtctgtctgcccagggaaagcgtcgttatgacaggaagcagtcgggatatggtggtcagaccaagcctgttttccacaagaaggcaaaaaccacaaagaagattgtgctgaagctgcaatgccagagctgcaagcactactcccagcgtgccatcaagaggtgcaagcattttgagatcggtggagacaagaagggcaaggggacatctcttttctagactgctttcacctatctggagtggtggtggtcaagaagtattactacttgtgttaagagtttgttgttaggagttaaattaatcagaccttgtcatgtatccaaactcctgtgtctcgcatttaagcaagaggcgacttttggctaagtgaagttttgtagcttgaatcctctttcattccgtataatgtctttattttaacagcatggagttgattgacatggtaatttgagctttgcatattctttttggca

SEQ ID NO: 3241 - DNA, 1335 bp, Triticum aestivum
cgtgagggcaaaaccctagctgccggcgccctagtatataaccgcgcaccccttcgcaccccggccctttcagctctcggcggcggcggtgcacttgtgacctcaaccaggcgagcactcctcctcctcgccgtcgtcgtctccgatccaccgccgcttccgcagccatggtgaacgttccgaagaccaagaagacctactgcaagaacaaggagtgcaagaagcacaccctccacaaggttacccagtacaagaaaggcaaggacagcctttctgctcaggggaagcgtcgttatgaccgcaagcagtctggatatggtggccagacaaagcctgttttccacaagaaggccaagacaacaaagaagattgtgctgaagctgcagtgccagagctgcaagcattactcacagcgtgccatcaagaggtgcaagcactttgaaatcggtggagacaagaagggcaagggaacatctctcttctaatctgatgatatcaccgttatgtttagaatgttgtgccagaacttctcacaagaagaatgtattatctttaatattctggttataaccctatggactatggagcatatgttttgctattgtgttgactactttctccagatctaatcgacaagtaaaatgttttttaaaaaaaaaaaaaaaaataaaaatggataaaaaacaaactagtgccgcaaccaatcggcagcagcaatcatgtgacgatccggccctaggaatgtggataagcgcttcggcgagcacaacaatcactccgtggtgtgatagggtcgtgacatgttgaaaccctgggcatcactgacgcccatatcgcgagtacctgcatcatcgcttgcccctgcatgctatactaggtaagaggtcaaaaccgatcagctttaccatcagttgcgcattctagaataacgcctgtgcagtcacatggaccctgtacgaccaggccctgggtgagggtgcctcccacaagtgagggcgcaccagaggtgatgaagcgtaccgccctttcctggcgatatattcccagtgtttatgggttgatcccccggtttacccggtaaatgatctaatccctatgtgccgatttcggttccgatttttccgtccttttttgacgtttatgccactatatattcccccagaggtctagattaggtgggccccctatccggattcgaattatgggttttaggggcttccacacccccgaaaaactttttttgggggtaggcttctcgtccgggcttggacccacaatcaaggggtttctcgccctgttcattgtggtctccaacccttttttattgagtcccct

SEQ ID NO: 3242 - DNA, 746 bp, Triticum aestivum
tagtcttttcggtcggtcggtcggtcgtctacttccttcgttgtttcttctcacccaggcgcgcactcctcctcctccactcgccgtcgtcgtcgcggatcctccgccgcttccgcagacatggtgaacgttccgaagaccaagaagacctactgcaagaacaaggagtgcaagaagcacaccctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacaacgcgctatcaagaggtgcaagcactttgaaatcggtggagacaagaagggcaagggaacatctctcttctaagctgatgatatcgctgttatgtttagaatgttgtgccagaacttcccacaagaagaatgtattatctttaattttctggttataaccctatgggctatgaagcatatgttttgctattgtgtcaactactttctccagatctaatcgacaagtaaaatgttgtttatgctcggagtgcggtatctttgttcttggtctgattagaattgctgtcgcagtgtatgctcatgatggatgaatgtaaccgttaagttaaaaaccgaaaggcgcgctcgtgcgtgtcgctcacccaaggcacagagggtacg

SEQ ID NO: 3243 - DNA, 792 bp, Triticum aestivum
atatttcacccaagcgccgccattctcccccttccccctttcctcaccgccgcccccgccgcaggagaagaagcagccgcgcggaggagagcttccaggcggcgaccatggtgaacgttccaaagaccaagaagacctactgcaagaacaaggagtgcaagaagcacaccctccacaaggttacacaatacaagaaaggcaaggatagcctttctgcccaggggaagcgtcgttatgaccgcaagcagtcaggatatggtggccagacaaagcctgttttccacaagaaggccaagacgacaaagaagattgtgctgaagctgcagtgccagagctgcaagcattactcacaacgcgccatcaagaggtgcaagcactttgagatcggtggagacaagaagggcaagggaacctctctcttctaagctgatggtattcctgttatgttcagagtgttgtgccagaacttcccactcgaacaatgtattatcgcattaatttctcggtatgaactctatgggctatggagcatatgttttgcctttgtgtcaagtgtcaactactctcgtcagatccatgggacaagtaaaatgttctttgtgcttgagttcgttctgcttgttcttgctccctctggttcaaaatatatgttcagatttgctttcgtccatatgaagtgcttctgaataagaatccagtaatgttgaatatgtgtagcatagaaaacattggagtgatctagtacagcttcctctattagcattccactgaccggcacgaaatctgttgcag

SEQ ID NO: 3244 - DNA, 883 bp, Triticum aestivum
gtgagggcgaaaccctagctggccgcgccctcgtatataagcgcgcaccccttcgctctccgaccctttgagctttcggcggcggcggcgcactcctcgtgttctcacccaggcgcgcactcctcctcctcgccgtcgtcgtcgcggatccaccgccgcttccgcagccatggtgaacgttccgaagaccaagaagacctactgcaagaacaaggagtgcaagaagcacacgctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacaacgcgctatcaagaggtgcaagcactttgaaatcggtggagacaagaagggcaagggaacatctctcttctaagctgatggtatcctgttatgtttaggatgttgtgccagaacttcccacaagaagaatgtattatctttaattttctggttataaccctatgggctatggagcatatgttttgctattgtgtcaactactttctccagatctaatcgacaagtaaaatgttgtttatgctcggagtgcggtatctttgttcttggtctgattagaattgctgtcgcagtgtatgctcatgatgggatgaatgccctttgtttttagttctcctgtctatttttctcgctttggcaaattgttttgttatgctgtttcccactatgctgctgttggcatggtctgtgatcttgctcggccaaactgaccctacgctattgaaaactacaacatgcatttgttgtctcc

SEQ ID NO: 3245 - DNA, 573 bp, Triticum aestivum
atggtgaacgttccgaagaccaagaagacctactgcaagaacaaggagtgcaagaagcacaccctccacaaggttacccagtacaagaaaggcaaggacagcctttctgctcaggggaagcgtcgttatgaccgcaagcagtctggatatggtggccagacaaagcctgttttccacaagaaggccaagacaacaaagaagattgtgctgaagctgcagtgccagagctgcaagcattactcacagcgtgccatcaagaggtgcaagcactttgaaatcggtggagacaagaagggcaagggaacatctctcttctaatctgatgatatcaccgttatgtttagaatgttgtgccagaacttctcacaagaagaatgtattatctttaatattctggttataaccctatggactatggagcatatgttttgctattgtgttgactactttctccagatctaatcgacaagtaaaatgttttttattgcttggagttttgtatttttgttcctggtctaactaaaattgctgttgcacagcgtgtgcttgtgatgcgcagaaatagaaccttac

SEQ ID NO: 3246 - DNA, 882 bp, Hordeum vulgare
ctcctcgtgtcctcctcctcctcctctcgccgtcgtcgtctccggtccaccgccgcttccgcagccatggtgaacgttccgaagaccaagaagacctactgcaagaacaaggagtgcaagaagcacaccctccacaaggttacccagtataagaagggtaaggacagcctttctgctcaggggaagcgtcgctatgaccgcaagcagtctggatatggtggccagacgaagcctgttttccacaagaaggccaagacaacaaagaagattgtgctgaagttgcagtgccagagctgcaagcactactcacaacgtgctatcaagaggtgcaagcactttgaaatcggtggagacaagaagggcaagggaacatctctcttctaagatgatgatcttgctgttatgtttagaatgttgtgccagaacttcccacaagaagaatgtattatctttaaatttctggttataacccatgggctatggagcatttgttttgcaattgtgtcgactactgttataacccatgggctatggagcatttgttttgcaattgtgtcgactacttcctccagatctaattgacaagaaaaatgtcctttaaaataagtaaggaggagagggagaaggaggtggagagggagagatgagatagattacctgggggggcgccggcccatttgcctatagggggggtttaaattactgggcgggttttaaacgtgggatgggaaacccggggttccaattattgttgtggaaatccctttgcagttgggtttaaaaagagaccccgacgctttcacaattgccccgagggaaggcaatgggagggattggggaatcgcgatttggtaaaatcattgtccaaggcaagggagattt

SEQ ID NO: 3247 - DNA, 751 bp, Hordeum vulgare
aaaccctagctcgcgacagcacagggccacaaaaccacacccctctccctccccgccgccacttgccgcaactcctccaccagaaagagaagcacgccggagctccatctcctcggccgtcaaaatggtgaacgttccgaagaccaagaagacctactgcaaaaacaaggagtgcaagaagcacacacttcacaaggtcactcagtacaaaaagggtaaggacagtctgtctgcccagggaaaacgtcgttatgacaggaagcagtcgggatatggtggtcagaccaagcctgtcttccacaagaaggcaaaaaccaccaagaagattgtgctgaagctgcagtgccagagctgcaagcactactcccagcgtgccatcaagagatgcaagcattttgagatcggtggagacaagaagggcaaggggacatctcttttctaaactgcgctcacctatctggagtggtggtggtcaagaactagtactacttgtgttaagggtttgttgttaggagctaaattaatcagaccttgtcatgtatccaaactcctgtgtctggcatttaagtaaggggcgactttttggccaagaaagttttgtagtttgaatcctctttcattccgtatcatgtcttattttgacaccatgcagttgagtgacatggtaatttgagctttgctgatcctttttggcctatgataactgttcccaatgactgctggggaaactgcctacggtttcttttcttcc

SEQ ID NO: 3248 - DNA, 550 bp, Hordeum vulgare
cccctttcctcaccacctcccccgccgcaggagaagcagcagacgcgcggaggagagcttccaggcggcgaccatggtgaacgttccgaaaaccaagaagacctactgcaagaacaaggagtgcaagaagcacaccctccacaaggtcacgcaatataagaaaggaaaagatagtctttctgctcaggggaagcgtcgttatgaccgcaagcagtcaggatatggtggccagacaaagcctgttttccacaagaaggccaagacaacaaagaagattgtgctgaagctgcagtgccagagctgcaagcattactcacagagagccatcaagaggtgcaagcattttgaaatcggtggagacaagaagggcaagggaacctctcttttctaagctgatgatatccctgttatgttcagaatgttgtgccagaacttcccacctgaacaatctattatcttaatattctggctataactctatcggccatgtagcatatgttttgcctttctgtccaactactttcttcagatccatgagacaagtaaaaaa

SEQ ID NO: 3249 - DNA, 599 bp, Hordeum vulgare
cgtcacgaggcgccgccgagcgcgctcaccgcaccgccgccgccgccagccgaccgagcgcgctcaccgcaccgccgccgccgccgccgccagccgaccgagcgcgctcaccgcaccgccgccgccgtcgcagccatggtgaacgttccaaagaccaagaagacctactgcaagaacaaggagtgcaagaagcacacccttcacaaggtcactcagtacaagaagggtaaagacagtctgtctgcccagggaaagcgccgttatgacaggaagcagtcgggatatggtggtcagaccaagcctgtcttccacaagaaggcaaaaaccaccaagaagattgtgctgaagctgcagtgccagagctgcaagcactactcccagcgcgccatcaagaggtgcaagcattttgagatcggtggagacaagaagggcaagggaacgtcactcttctagattgctttcacctatctgtagtcgttgtggtcaagaattattactgcttgtatcgatgttatgagttgaatcaaccagaccttgtcatgtatccaaacctgtttatctggcatttgagcaacgatcgacttttttgcaaaatgatc

SEQ ID NO: 3250 - DNA, 652 bp, Brachypodium distachyon
agctcggaagcacacgaccataaaaccatacccctttccctcgccgccgccactcgccgcaactcctcgcatcagatagggaagagcaccggagccatatccccccgaccgacaaaatggtgaacgttccgaagaccaagaagacctattgcaagaacaaggagtgcaagaagcacacccttcacaaggtcacacagtacaagaaggggaaagacagcctgtctgcccagggaaagcgccgttatgacaggaagcagtcaggatatggtggtcagactaagcctgttttccacaagaaggcgaaaaccaccaagaagattgtgctaaagctgcagtgccagagctgcaagcactactcccagcgtgccatcaagaggtgcaagcactttgagatcggtggagacaagaagggcaagggaacatccctcttctaaattgcttactcctatgtggagttgcggtggtcatcaatgttactacttgtcttcaggttttgatgttaggcgtaaaattaaaacagatttgtcgtgcatccaaactctagtgtctggcatttgagtaaggggtctacttttggctaaatgatgttctgtagcttgaatcctcctttgaatcatataacgacttgtttaaatctcttcctgtgtgatgt

SEQ ID NO: 3251 - DNA, 845 bp, Brachypodium distachyon
aaaccctagctcggaagcacacgaccataaaaccatacccctttccctcgccgccgccactcgccgcaactcctcgcatcagatagggaagagcaccggagccatatccccccgaccgacaaaatggtgaacgttccgaagaccaagaagacctattgcaagaacaaggagtgcaagaagcacacccttcacaaggtcacacagtacaagaaggggaaagacagcctgtctgcccagggaaagcgccgttatgacaggaagcagtcaggatatggtggtcagactaagcctgttttccacaagaaggcgaaaaccaccaagaagattgtgctaaagctgcagtgccagagctgcaagcactactcccagcgtgccatcaagaggtgcaagcactttgagatcggtggagacaagaagggcaagggaacatccctcttctaaattgcttactcctatgtggagttgcggtggtcatcaatgttactacttgtcttcaggttttgatgttaggcgtaaaattaaaacagatttgtcgtgcatccaaactctagtgtctggcatttgagtaaggggtctacttttggctaaatgatgttctgtagcttgaatcctcctttgaatcatataacgacttgtttaaatctcttcctgtgtgatgtagatctgatgtccagtccgattagttagtttgatgcctcttcatgtcatctgcaccagactgatggtgtagctgaatttttcattttaacatgagaatggaagaaaactaatttcggtctgtctgctcatagggaagtagatgcatgtgtagtgaaccaggattgatgcagtcgtccagtgagacc

SEQ ID NO: 3252 - DNA, 1649 bp, Brachypodium distachyon
atcgcttcctataacatctatcggatctcgtacacgagcacagttagggttttctgcacagagctcgcgccgccgccagtacacgcccaggcaggaggaagccacagatttgcagccatggtgaatgttccgaagaccaagaagacctactgcaagaacaaggagtgcaagaagcacacccttcacaaggttacacagtacaagaagggaaaggatagtctttctgctcaggggaagcgtcgttatgaccgcaaacagtcaggatatggtgggcagacaaagcctgttttccacaagaaggccaagacaacaaagaagattgtgctgaagcttcagtgccagagctgcaagcactactcacagcgtgcgatcaagaggtgcaagcactttgaaatcggtggagacaagaagggcaagggaacatctctcttctaatcttatgatacccattttgttctactctggagttgtctgccagaagttacccttgagaatgtttttcttatccttgtactgagatgcatctactggaatgcgttatggtttgcatttgcatcaaatcttctgtgagatctatttaatacatagttttgatggagatgtgccttacgtttattagtttgtgagatctatttgatacatatggttcattgaactgtgacgatcgcttcagatgaacatgagcttgatgaacattgagagaggtgaacttcgaatcatcttttataatgtctgtagctgtatccttctcatttttggtaccaggttgaggtttttgtcacctgattcttatgtggaataattaattgatgttgcaaatctttgtatgctagatatctattgaaatgaaatccaccaggctttacacctttgagaattcgttgtaggcccatggactgtcctggcacatttatgttggaccgcatcagagaaataaaccctagctgccggtgactgtctcgtttggcccgcggatccactggcccctctcgccttcagagaaaggaatcctagctgccagggattctgtcttgtttgctcgacggattcacttgcgctcttcccttcaatggctgccttggcattgaaaggatggcaagaagcgggtctatgcttggattggtatcttattggtggttttggtgttccacgatgttgaattggtggtggaattggcgctgcgtgaaataaaggtactccacctcctttgttgcaatgtttcttatcagagagtgtcaaattgccggtgaatttgagtccttctggctctacctcgtcttgtgtcagcgagtttgttttggtccgtgcactattttgctacatgtcggaattcttcatcaatttggaatggcggcgatggatggatgacttaagatttcagggtgcaatactggttgatgctctttcaaggccgggggatacccaccttttcagaagaaaaaaactgttgctccattgctttactagagacgcggagaagatgaagctacagcgactagaacatgaaggatcattgcatccaggaatagtgtttctcttctttggggttttcgtcgggtcattttcttctttttgcagttgacgtgccatggtttctatgttctgtacagttcaatatttttttaattaaaaaggctaattattgattc

SEQ ID NO: 3253 - DNA, 1835 bp, Brachypodium distachyon
accgaagctcggaggcctggccttatcgcttcctataacatctatcggatctcgtacacgagcacagttagggttttctgcacagagctcgcgccgccgccagtacacgcccaggcaggaggaagccacagatttgcagccatggtgaatgttccgaagaccaagaagacctactgcaagaacaaggagtgcaagaagcacacccttcacaaggttacacagtacaagaagggaaaggatagtctttctgctcaggggaagcgtcgttatgaccgcaaacagtcaggatatggtgggcagacaaagcctgttttccacaagaaggccaagacaacaaagaagattgtgctgaagcttcagtgccagagctgcaagcactactcacagcgtgcgatcaagaggtgcaagcactttgaaatcggtggagacaagaagggcaagggaacatctctcttctaatcttatgatacccattttgttctactctggagttgtctgccagaagttacccttgagaatgtttttcttatccttgtactgagatgcatctactggaatgcgttatggtttgcatttgcatcaaatcttctgtgagatctatttaatacatagttttgatggagatgtgccttacgtttattagtttgtgagatctatttgatacatatggttcattgaactgtgacgatcgcttcagatgaacatgagcttgatgaacattgagagaggtgaacttcgaatcatcttttataatgtctgtagctgtatccttctcatttttggtaccaggttgaggtttttgtcacctgattcttatgtggaataattaattgatgttgcaaatctttgtatgctagatatctattgaaatgaaatccaccaggctttacacctttgagaattcgttgtaggcccatggactgtcctggcacatttatgttggaccgcatcagagaaataaaccctagctgccggtgactgtctcgtttggcccgcggatccactggcccctctcgccttcagagaaaggaatcctagctgccagggattctgtcttgtttgctcgacggattcacttgcgctcttcccttcaatggctgccttggcattgaaaggatggcaagaagcgggtctatgcttggattggtatcttattggtggttttggtgttccacgatgttgaattggtggtggaattggcgctgcgtgaaataaaggtactccacctcctttgttgcaatgtttcttatcagagagtgtcaaattgccggtgaatttgagtccttctggctctacctcgtcttgtgtcagcgagtttgttttggtccgtgcactattttgctacatgtcggaattcttcatcaatttggaatggcggcgatggatggatgacttaagatttcagggtgcaatactggttgatgctctttcagtgagtatttgaccccagctatggccgtttcgatgttcaaaacctttggtcgcaattcaaattatgtgtgatcttgttgctctatattttttttattttttttgcagaggccgggggatacccaccttttcagaagaaaaaaactgttgctccattgctttactagagacgcggagaagatgaagctacagcgactagaacatgaaggatcattgcatccaggaatagtgtttctcttctttggggttttcgtcgggtcattttcttctttttgcagttgacgtgccatggtttctatgttctgtacagttcaatatttttttaattaaaaaggctaattattgattctgtttggctatgagatgaaacagttaactgaaatcaaataaaaagcagtcagttc

SEQ ID NO: 3254 - DNA, 739 bp, Cynodon dactylon
gctagggttctccgcttcgacctcacgccgccgccaggacgcacggacggaggaagctgcagatcggcagccatggtgaacgttcctaaaaccaagaagacatattgcaagaacaaggaatgcaggaagcacacccttcacaaggttacccagtacaagaagggaaaggatagcctttcagcacaaggaaagcgtcgttatgaccgcaagcagtcaggctatggagggcagacaaagcctgttttccacaagaaggccaagacaacaaagaagattgtgctgaagctccagtgccagagctgcaaacactactctcagcacgccatcaagaggtgcaagcactttgaaattggtggagacaagaagggcaagggaacctctctcttttaatctgatgatagaagccaactatctagtttgtcagaagctactgttagaatgttttcttgttccttgtggagatacatcaggtggattatctcgcagggatagtattgaaccctatgtttgcaatttgccttagctgtttttaaatttgggaatatatgttcaagcaatagagctatgatcggtctcagtttcagttgtgtgtgattagttgtttgggtttgtagcttcttgtgccatgcgttgcatttgtgattaaggttataaaagccaagcagtgcttgagcagaaactgttgcgggtgaccaccaaatctggaggaattctctgactccatgtgtaaggagcgctg

SEQ ID NO: 3255 - DNA, 538 bp, Avena sativa
cgttgccgcagcagccgcctcctgctagcagccgccgagatggtgaacgttccaaagaccaagaagacctactgcaagaacaaggagtgcaaaaagcacaccctccacaaggtcactcagtacaagaagggtaaggacagcctgtctgcccagggaaagcgtcgttatgacaggaagcagtcaggatatggtggtcagaccaagcctgttttccacaagaaggcaaaaaccaccaagaagattgtgctgaagctgcagtgccagagctgcaagcactactcccagcgtgccatcaagaggtgcaagcattttgagatcggtggagacaagaagggcaagggaacatctctcttctaaattgctttcagctatctagggtcatggtggttgacaacatgtgattttgatgtttggagttgagttagaacagacctcgtcatgtatcaaactcttatgtctggtattgaagtaatggtcgacttatttttggctaaatgaagtatttcagcttgaatcctctttgaacccgcgtaatgac

SEQ ID NO: 3256 - DNA, 554 bp, Avena sativa
aatcgcgccgccatctccccgtcgttgccgcagcagccgcctcctgctagcagccgccgagatggtgaacgttccaaagaccaagaagacctactgcaagaacaaggagtgcaaaaagcacaccctccacaaggtcactcagtacaagaagggtaaagatagcctgtctgcccagggaaagcggcgttatgacaggaagcagtcaggatatggaggtcagactaagcctgttttccacaagaaggcaaaaaccaccaagaagattgtactgaagctgcagtgccagagttgcaagcactactcccagcgtgctatcaagaggtgcaagcattttgagatcggtggagacaagaagggcaagggaacatctcttttctaaattgctctcacccatctggagtttcggtagtcatcttaatatttcgatgttaggagttggattaaaacataccttatcatgtatcccatcttcagtatcttgtatttaagtgcgggtctactttgtggctaaacaaagtttttgtagcttgaatcctgtttctattgacttgttt

SEQ ID NO: 3257 - DNA, 539 bp, Avena sativa
aatcgcgccgccatctccccgtccttgccgctgcagacgcctcctgcgccgccgacgagatggtgaacgttccgaagaccaagaagacctactgcaagaacaaggagtgcaaaaagcacaccctccacaaggtcactcagtacaagaagggtaaagatagcctgtctgcccagggaaagcggcgttatgacaggaagcagtcaggatatggaggtcagactaagcctgttttccacaagaaggcaaaaaccaccaagaagattgtactgaagctgcagtgccagagttgcaagcactactcccagcgtgctatcaagaggtgcaagcattttgagatcggtggagacaagaagggcaagggaacatctcttttctaaattgctttcacccatctggagtttcggtagtcatcttaatatttcgatgttaggagttggattaaaacattcccatctccagtatcttgtatttaagtgcgggtctactttgtggctaaacgaagtttttgtagcttgaatcctgtttctattgacttgttt

SEQ ID NO: 3258 - DNA, 617 bp, Avena sativa
ccgccatctccccgtcgttgccgcagcagccgcctcctgctagcagccgccgagatggtgaatgttccgaagaccaagaagacctactgcaagaacaaggagtgcaaaaagcacaccctccacaaggtcactcagtacaagaagggtaaggatagcctgtctgcccagggaaagcgtcgttatgacaggaagcagtcaggatatggtggtcagaccaagcctgttttccacaagaaggcaaaaaccaccaagaagattgtgctgaagctgcagtgccagagctgcaagcactactcccagcgtgccatcaagaggtgcaagcattttgagatcggtggagacaagaagggcaagggaacatctctcttctaaattgctttcagctatctagggtcatggtggttgacaacatgtgattttgatgttcggagttgacttagaacagaccttgtcatgtatcaaactcctgtgtctggtattgaagtaatggtcgacttatttttggctaaatgaagtatttcagcttgaatcctctttgaacctgcgtaatgacttgttttaatcctgcactatagttctgatgtccagggttacctcttagtgattggttacttgca

SEQ ID NO: 3259 - DNA, 566 bp, Pseudoroegneria spicata
agaaagggaagcacgccggagccctatctccccggccgtcaaaatggtgaacgttccgaagaccaagaagacctactgcaaaaacaaggagtgcaagaagcacacacttcacaaggtcactcaatacaaaaagggtaaggacagtttgtctgcccagggaaagcgtcgttatgacaggaagcagtcgggatatggtggtcagaccaagcctgtcttccacaagaaggcaaaaaccaccaagaagattgtgctgaagctgcagtgccagagctgcaagcactactcccagcgtgccatcaagaggtgcaagcattttgagatcggtggagacaagaagggcaaggggacatctcttttctagactgctttcacctatctggagtggtggtggtcaagaactattactacttgtgttaagagtttgttgttaggagttaaattaatcatacctcgtgtatccaaactcttgtcatttaagtaaggggcgacttttggttaaatgaagttttgtagtttgaatcctctttcattccatattataacaccatggagttgagtgacatggt

SEQ ID NO: 3260 - DNA, 565 bp, Pseudoroegneria spicata
cggcggcggcgcactcgtgatcccaaccaggcgcgcactcctcctcctcgccgtcgtcgtctcggatccaccgccgcaaccatggtgaacgttccgaagaccaagaagacctactgcaagaacaaggagtgcaagaagcacaccctccacaaggttacccaatacaaaaagggtaaggacagtctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacagcgcgctatcaagaggtgcaagcactttgaaatcggtggagacaagaagggcaagggaacatctctcttctaagctgatgatatcgctgttatgtttagagttttgcgccagaacttcccacaagaagaatgtattatctttaattttctggttataaccctatgggctatggagcatttgttttgctaatgtgtcaactactttctccagatctaatcgacaagtaaaatgttcttta

SEQ ID NO: 3261 - DNA, 563 bp, Pseudoroegneria spicata
  misc_feature (27)..(27): n is a, c, g, or t
caccaccgtcccagccgcaggagaagnagcagacgcgcggaggagagcttccaggcggcgaccatggtgaacgttccgaaaaccaagaagacctactgcaagaacaaggagtgcaagaagcacaccctccacaaggtcacgcagtataagaagggaaaggacagtctttctgcacaggggaagcgtcgttatgaccgcaagcagtcaggatatggtggccagacaaagcccgttttccacaagaaggccaagacaacaaagaagattgtgctgaagctgcagtgccagagctgcaagcattactcacaacgcgccatcaagaggtgcaagcactttgaaatcggcggagacaagaagggcaagggaacctctcttttctaagctgatgatatccctgttatgttcagaatgttgtgccagaacttcccccactcgaacaatgtattatcttgatattctggctatactctatgggccatgtagcatatgttttgcctttctgtcaactactttcttcagatccatgagacaagtgaaaatgttctttatgctctcgagtttga

SEQ ID NO: 3262 - DNA, 747 bp, Saccharum officinarum
gctctcttctgatatatcgctccggtgctagggttttctgggatcccacctcacgccgccgcaaggactctcgcacggacggagccacggaggaagccactacgcggcagccatggtgaacgttccgaaaaccaagaagacctactgtaagaacaaggaatgcaggaagcacaccctgcacaaggttacccagtacaagaaaggtaaggatagcctttcagctcaagggaagcgtcgttatgaccgcaaacagtccggatatggtggtcagacaaagcctgttttccacaagaaggcaaaaacaactaagaagattgtgctgaagctgcagtgccagagttgcaagcactactctcaacacgcgatcaagaggtgcaagcactttgagatcggtggcgacaagaagggcaaaggaacctctctgttctaggctgatcataaacttgctcagggcctcaagtatctgtcagaatttaccattagaaacaccttgtgcatctgctcttttatcatatcttttttggtacgatgtagtttgtatgagaccaagatattattttgtgttattattatattttgcggcaaggctctccctcgccatttggttgagtactcatactcctcaaattgtcaagatgatcgtttggttgactgtaaacatatagttctgggctttttgggcaaacaacagttcaatttactgaatccatcgcgagactggtattggttgaaaaaaaaaaaaaaaag

SEQ ID NO: 3263 - DNA, 715 bp, Triticum aestivum
ccctagctcgcgagcacagggccacaaaaccacacccctctccctgcccgccgccacttgccgcaactcctccaccagaaagggaagcacgccggagtcccatctccccggccgtcaaaatggtgaatgttccgaagaccaagaagacctactgcaaaaacaaggagtgcaagaagcacacacttcataaggtcactcagtacaagaagggtaaggacagtctgtctgcccagggaaagcgtcgttatgacaggaagcagtcgggatatggtggtcagaccaagcctgttttccacaagaaggcaaaaaccacaaagaagattgtgctgaagctgcaatgccagagctgcaagcactactcccagcgtgccatcaagaggtgcaagcattttgagatcggtggagacaagaagggcaaggggacatctcttttctagactgctttcacctatctggagtggtggtggtcaagaagtattactacttgtgttaagagtttgttgttaggagttaaattaatcagaccttgtcatgtatccaaactcctgtgtctcgcatttaagcaagaggcgacttttggctaagtgaagttttgtagcttgaatcctctttcattccgtataatgtctttattttagtaaaaaaaaaaaaaaagcccacctcggccgcgaccacgcttatcccggggccatggtggccggggacattccacctc

SEQ ID NO: 3264 - DNA, 763 bp, Triticum aestivum
tggttccagagacgcaggcgtgggtacccggtacaggaatttcaggggatgtcggtcgaacaaggggtcggcgggctggggacacgaggaccactgacatgggactggaaggagtagtaaagctcctcgctggcggcggtgcacttgtgacctcaaccaggcgagcactcctcctcctcgccgtcgtcgtctccgatccaccgccgcttccgcagccatggtgaacgttccgaagaccaagaagacctactgcaagaacaaggagtgcaagaagcacaccctccacaaggttacccagtacaagaaaggcaaggacagcctttctgctcaggggaagcgtcgttatgaccgcaagcagtctggatatggtggccagacaaagcctgttttccacaagaaggccaagacaacaaagaagattgtgctgaagctgcagtgccagagctgcaagcattactcacagcgtgccatcaagaggtgcaagcactttgaaatcggtggagacaagaagggcaagggaacatctctcttctaatctgatgatatcaccgttatgtttagaatgttgtgccagaacttctcacaagaagaatgtattatctttaatattctggttataaccctatgggctatggagcatatgttttgctattgtgttgactactttctccagatctaatcgacaagtaaaatgttttttatgcaaaaaaaaaagaaaaaaaaacaaaatactctgcgttgataccactgcttgctgatacta

SEQ ID NO: 3265 - DNA, 557 bp, Triticum aestivum
accgagcgcgagcaccgcaccgccgccgcggccgccatggtgaacgttccgaagaccaagaaaacctactgcaaaaacaaggagtgcaagaagcacacgcttcacaaggtcactcaatacaagaagggtaaggacagcctgtctgcccagggaaagcgtcgttatgacaggaagcagtcgggatacggtggtcagaccaagcccgttttccacaagaaggcaaaaaccaccaagaagattgtgctgaagctgcagtgccagagctgcaagcactactcccagcgcgccatcaagcggtgcaagcattttgagatcggtggagacaagaagggcaagggaacgtctctcttctagattgctttcacctatctggagtcgttgtggtcaagaactattactacttgtcttgatgtttttgatgttatgagttgaattgaccagaccttctaatgtatccaaacccctttatctggcatttgagcaacgatcgacttggcagaatggtcttttgtagcttgaatcctcttttaatctcaggcattgccgtaatgtggata

SEQ ID NO: 3266 - DNA, 618 bp, Triticum aestivum
gcgacgctagacaaccgagcgcgagcaccgccgccgccgccgccgccatggtgaacgttccgaagaccaagaaaacctactgcaaaaacaaggagtgcaagaagcacacccttcacaaggtcactcaatacaagaagggtaaggacagcctgtctgcccagggaaagcgtcgttatgacaggaagcagtcgggatatggtggtcagaccaagcccgttttccacaagaaggcaaaaaccaccaagaagattgtgctgaagctgcagtgccagagctgcaagcactactcccagcgcgccatcaagaggtgcaagcattttgagatcggtggagacaagaagggcaagggaacatccctcttctagattgctttcacctatctgtagtcattgtgttcaagaactattactacttgtcgtaatgttttgatgttatgagttgaatcaatcatgtatccaaacccctttatctggcatttgagcaacgatcgacttggcagaatgatcttttgtagcttgaatcctcttttaatctcaggcattcccgtaacgtggatatggatgtcatgtgccccgatcggtataatttgagctttgctgctgctgtttaaaaaaaaaa

SEQ ID NO: 3267 - DNA, 736 bp, Triticum aestivum
atatttcacccaagcgccgccattctcccccttccccctttcctcaccgccgcaggagaagaagcagacgcgcggaggagagcttccaggcggcgaccatggtgaacgttccgaaaaccaagaagacctactgcaagaacaaggagtgcaagaagcacaccctccacaaggtcacacaatataagaagggaaaggacagtctttctgctcaggggaagcgtcgttatgaccgcaagcagtcaggatatggtggccagacaaagcctgttttccacaagaaggccaagacaacaaagaagattgtgctgaagctgcagtgccagagctgcaagcattactcgcaacgcgccatcaagaggtgcaagcactttgaaatcggtggagacaagaagggcaagggaacctctctcttctaagctgatgatatccctgttatgttcagaatgttgtgccagaacttgccacccgaacaatgtattatcttattattctggctataactctatgggccatgtagcatatgttttgccttcctgtcaactacttcagatccatgagacaagtaaaaatgatctttatggtcttgagttcgttatgggtgttcttgatcttactaggattgtatatgtttctggttttacgttttgaatgtttactccctctgtctcaaaatttatgttaggattttagctttgaatgtggtttaatagtattttgttagttgttaaaaaaaaaa

SEQ ID NO: 3268 - DNA, 698 bp, Triticum aestivum
cccctttcctcaccgccgcaggagaagaagcagacgcgcggaggagagcttccaggcggcgaccatggtgaacgttccgaaaaccaagaagacctactgcaagaacaaggagtgcaagaagcacaccctccacaaggtcacacaatataagaagggaaaggacagtctttctgctcaggggaagcgtcgttatgaccgcaagcagtcaggatatggtggccagacaaagcctgttttccacaagaaggccaagacaacaaagaagattgtgctgaagctgcagtgccagagctgcaagcattactcacagcgcgctatcaagaggtgcaagcactttgaaatcggtggagacaagaagggcaagggaacctctctcttctaagctgatgatatccctgttatgttcagaatgttgtgccagaacttgccacccgaacaatgtattatcttattattctggctataactctatgggccatgtagcatatgttttgccttcctgtcaactacttcagatccatgagacaagtaaaaatgatctttatggtcttgagttcgttatgggtgttcttgatcttactaggattgtatatgtttctggttttacgttttgaatgtttactccctctgtctcaaaatttatgttaggattttagctttgaatgtggtttaatagtattttgttagttgttacaaaa

SEQ ID NO: 3269 - DNA, 795 bp, Triticum aestivum
ctaatatttcacccaagcgccgccattctcccccttccccctttcctcaccgccgcccacgccgcaggagaagaagcagacgcgcggaggagagcttccaggcggcgaccatggtgaacgttccaaagaccaagaagacctactgcaagaacaaggagtgcaagaagcacaccctccacaaggttacgcagtacaagaaaggcaaggacagtctttctgctcagggaaagcgccgttacgaccgcaagcagtcaggatatggtggccagacaaagcctgttttccacaagaaggccaagacaacaaagaagattgtgctgaagctgcagtgccagagctgcaagcattactcgcaacgcgctatcaagaggtgcaagcactttgagatcggtggagacaagaagggcaaggggacctctctcttctaagctgatgatatccctgttttgttcagtgttgtgccagaacttcccactcgaacaatgtattagtatcatattggtattctgggtataactgtatgggctatggagcatatgttttgcctttcctgtcaacgactctcttcagatccttgagacaagtaaaaatgttctttctgcttttgagttcgttatgtttgttactggtcccattaggactgtatatgtttctggttttacactttgattgtgtattctctctgtttcaaaagtaatgtttaggttttagctttgaatgtgattttattgctgaatatgttgttgtgaagtgcttagcataatgacattggagtgatcaagtacagcttcctgt

SEQ ID NO: 3270 - DNA, 658 bp, Hordeum vulgare
tttaactatgtggtcctatgatggcatgaaatctttgagacctgattattctaatgatgacaaccataagcatgtttctgagaacctaattgaagtgaacgttccaaagaccaagaagacctactgcaagaacaaggagtgcaagaagcacacccttcacaaggtcactcagtacaagaagggtaaagacagtctgtctgcccagggaaagcgccgttatgacaggaagcagtcgggatatggtggtcagaccaagcctgtcttccacaagaaggcaaaaaccaccaagaagattgtgctgaagctgcagtgccagagctgcaagcactactcccagcgcgccatcaagaggtgcaagcattttgagatcggtggagacaagaagggcaagggaacgtcactcttctagattgctttcacctatctgtagtcgttgtggtcaagaattattactgcttgtatcgatgttatgagttgaatcaaccagaccttgtcatgtatccaaacctgtttatctggcatttgagcaacgattgacttttttgcaaaatgatccttcgtagtttgaatcctcttctaatctcatgcattgccgtactgtcgatatgaatgtcatgtggcctgatcggtataatttgagctgtgccgcagctgttta

SEQ ID NO: 3271 - DNA, 653 bp, Allium cepa
ttcatttagcggctgtgcttttctcaactccatcaattaatcatggtcaacgtaccaaaaacaaagaagacatactagcaagaacaaagaatgcaagaaacacactttacacaaggtgactcagtataagaagggcaaagatagcctttcagctcaaggaaagaggcgttatgaccgaaagcagtctggttatggtggtcagactaagcccgtctttcacaagaaggctaaaaccacaaagaaaattgtgctcaagttgcaatgtcagagctgcaagcattactctcaaaaagccatcaagaggtgcaagcattttgaaatcggtggagacaagaagggcaagggaacatcactcttctaaatatgtttttcatcctttttgtttagcgaacgatttgtgctgtggttttatctttattgttgaaatctgtagtgttgctgaatgattttgttgaacctcttgatatgaatatttttggatctattgcatttagatggataattcagtttatctttgttttctgacttaagcaacaatgactatgtttactgtcgatgttatgactcatttgagctgaattcaggtcagtgataacactgtattttagtaacccgatcagatcagttacgtaacccaatccaattgtttttag

SEQ ID NO: 3272 - DNA, 600 bp, Allium cepa
ggataaaacagtaatatgacaataaatctaaaccctagatatataaatcatactttgccaatctgaaccagcttcatttagcggctgtgcttttctcaactccatcaattaatcatggtcaacgttccaaaaacaaagaagacatactgcaagaacaaagaatgcaagaaacacactttacacaaggtgactcagtataagaagggcaaagatagcctttcagctcaaggaaagaggcgttatgaccgaaagcagtctggttatggtggtcagactaagcccgtctttcacaagaaggctaaaaccacaaagaaaattgtgctcaagttgcaatgtcagagctgcaagcattactctcaaaaagccatcaagaggtgcaagcattttgaaatcggtggagacaagaagggcaagggacatcactcttctaaatatgtttttcatcctttttgtttagcgaacgatttgtgctgtggttttatctttattgttgaaatctgtagtgttgctgaatgattttgttgaacctcttgatatgaattatttttggatcctattgcatttagatggaataattctaagtttattcttttgttttac

SEQ ID NO: 3273 - DNA, 441 bp, Allium cepa
ttcatttagcggctgtgcttttctcaactccatcaattaatcatggtcaacgttccaaaaacaaagaagacatactgcaagaacaaagaatgcaagaaacacactttacacaaggtgactcagtataagaagggcaaagatagcctttcagctcaaggaaagaggcgttatgaccgaaagcagtctggttatggtggtcagactaagcccgtctttcacaagaaggctaaaaccacaaagaaaattgtgctcaagttgcaatgtcagagctgcaagcattactctcaaaaagccatcaagaggtgcaagcattttgaaatcggtggagacaagaagggcaagggacatcactcttctaaatatgtttttcattcctttttgtttagcgaacgatttgtgctgtggttttatcttttattgttgaatctgtagtgttgctga

SEQ ID NO: 3274 - DNA, 650 bp, Oryza sativa
gccgcagaccttctccttcccctccccgccgccactcgccgcagcgtctcgaccagacaagggagcgcctccgaaaccctagctccccctttcccctccgcggccgccaaaatggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcattttgaaattggtggagacaagaagggcaagggaacatctcttttctaaactacctactggatactgaagttgtgggtctactgtgcttcatacttaaatgttattaggagcttaatttaagcagaccatatcatgtattcaagtactctagcaaggattggctttctgctgaatcaagttttgttgcttaatgctcattgaatccaatgtgatgcatgtgtttatgttgcactgcaattttgtcttatggcagttttacgtcgtcccta

SEQ ID NO: 3275 - DNA, 609 bp, Oryza sativa
ccccgccgccactcgccgcagcgtgtcgaccagacaagggagcgcctccgaaaccctagctccccgccttcccctccgcggccgccaaaatggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagtcaccttgcttaatgctcgtcgaatccaatgtgatgcctgtcttcacatagcact

SEQ ID NO: 3276 - DNA, 565 bp, Secale cereale
tggtgaacgttccaaagaccaagaagacctactgcaaaaacaaggagtgcaagaagcacacccttcacaaggtcactcagtacaagaagggtaaagacagtctgtctgcccagggaaagcgccgttatgacaggaagcagtcaggatatggtggtcagaccaagcctgttttccacaagaaggcaaaaaccaccaagaagattgtgctgaagctgcagtgccagagctgcaagcactactcccagcgcgccatcaagcggtgcaaacattttgagatcggtggagacaagaagggcaagggaacgtccctcttctagattgctttcacctatatgttgtcgttgtggtcaagaactattactacttgtcttaatgtatcagtgttatgagttgaatgaaccagacctttgtcatgtatcgaagcccctttatctgtcatttaagcaaggatcgacttggcagaatgatcttttgttgcttgaatcctcttttgatctcaggcattgccgtactgtgaatatggaatgtcatgtgccccaatcagtataatttgagcttggctgcc

SEQ ID NO: 3277 - DNA, 786 bp, Picea glauca
attttactcaaataagtccttttgggctcctctggttctggttctttgttgagcggcgcgcaaggaaagcagaggaggacgacgacgacgacgacgagattatcagcggctccgcgtgtggatcgtagcaatggtcaatgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcagcatgcgatcaagcgttgcaaacattttgagattggtggagacaagaaggggaagggaacgtcccttttctaaactttcagctatgttccagctttctattgatcattttacattcttgtttgcatatctgtttgaggacagaagttgtgttgtttattagtagattggtggagacaaggggaagggaacatcccttttctaaactttcagctatgttccagctttctatcgatcattttacattcttgtttgcatatctgtccgaggacagaagttttgttgtgttgtttattagtagatagagtcaaaccaactgaagatgccaatttaattttgcctgtctaaaggcctcttgcactttatttataaaacaaaccctcagattcaaaaaaaaaaaaaaaagagctctt

SEQ ID NO: 3278 - DNA, 761 bp, Picea glauca
gcgcttcgctcatggttgaaaaggcctccgtgtgccttatgtaaactctgaaggtttctcgtggtgcagtagcggcagctagaattgaaagaagcacattctctcagagttcgggctgtttatttccttcaatcacaatggtcaatgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaagggaaagggaacgtcccttttctaaactttcagctatgttccagctttctatcgatcattttacattcttgtttgcatatctgtctgaggacagaagttgtgttgtttattagtagattggtggagacaaggggaagggaacgtccttttctaaactttcagctatgttccatctttttatcgatcattttacattcttgtttgcatatctgtccgaggacagaagttttgttgtttgcatatctgtccgaggaccaactgaagatgccaatttaattttgcctgtctaaaggcctcttgcactttatttataaaacaaaccatcggattc

SEQ ID NO: 3279 - DNA, 798 bp, Picea glauca
tttactcaaataaagtccttttgcgctcctctggttctttgttgagcggcgcgcaaggaaagcagagaggaggaggacgacgacgacgaggttatcagcggctccgcgtgtggatcgtagcaatggtcaatgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttctatcgatcattttacattcttgtttgcatatctgtttgaggacagaagttgtgttgtttattagtagattggtggagacaaggggaagggaacgccccttttctaaactttcagctatgttccagctttctatcgatcattttacatttttgtttgcatatctgttcgaggacagaagttttgttgtgttgtttattagtagatagagtcaaaccaactgaagatgccaatttaattttgcctgtctaaaggcctcttgcactttatttatataacaaacccttggattcaaattttgcttggttatgttttctggttattctatattaaaaaa

SEQ ID NO: 3280 - DNA, 866 bp, Picea glauca
cccgaataggtgcaaagggcatggactatttaaccaaaacacgtggcatcatcaacgactatcatcgatatggcgaatcaacggtgttatcgcgcttcgctcatggttgaaaaggcctccgggtgcgttatgtaaactctgaaggtttctcgtagtgcagtagcggcagctagaattgaaagaagcgcattctctcagagttcgggctgtttatttccttcaatcacaatggtcaacgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttctatcgatcattttacattcttgtttgcatatctgtctgaggacagaagttgtgttgtttattcgtagattggtggagacaaggggaagggaacgtccttttctaaactttcagctatgttccagctttctatcgatcattttacattcttgtttgcatatctgtccgaggacagaagttttgttgtgttgtttattagtagatagagtcaaaccaactgaagatgccaatttaattttgcctgtctaaaggcctcttgcactttatttataaaacaaaccctcggattcaaatttt

SEQ ID NO: 3281 - DNA, 808 bp, Picea glauca
gacgacgacgacgaggttatcagcggctccgcgtgtggatcgtagcaatggtcaatgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcagcatgcgatcaagcgttgcaaacattttgagattggtggagacaagaaggggaagggaacgtcccttttctaaactttcagctatgttccagctttctattgatcattttacattcttgtttgcatatctgtttgaggacagaagttgtgttgtttattagtagattggtagagacaaggggaagggaacatcccttttctaaactttcagctatgttccagctttctatcgatcattttacattcttgtttgcatatctgtccgaggacagaagttttgttgtgttgtttattagtagatagagtcaaaccaactgaagatgccaatttaattttgcctgtctaaaggcctcttgcactttattataaacaaacctcacattccaattttgcttggttatgtttcctggttattctatattaaaaactaatcttctgttgctaagaaaaaaaaaaacaaaaatactctcgtacgtactactacctacgtgtccttcgtagtacagtcacgacgac

SEQ ID NO: 3282 - DNA, 692 bp, Picea glauca
tctggttctttgttgagcggcgcgcaaggaaagcagagaggaggaggacgacgacgacgaggttatcagcggctccgcgtgtggatcgtagcaatggtcaatgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttctatcgatcattttacattcttgtttgcatatctgtctgaggacagaagttgtgttgtttattagtagattggtggagacaaggggaagggaacgtccttttctaaactttcagctatgttccatctttctatcgatcattttacattcttgtttgcatatctgtccgaagacagaagttttgttgtttgcatatctgtccgaggaccaactgaagatgccaatttaattttgcctgtctaaaggcctcttgcacttt

SEQ ID NO: 3283 - DNA, 650 bp, Triticum aestivum
ggtctcgcgactcgcaaaccctagctcgcgagcagagggccacaaaaccacacccctctccctccccgccgccacttgccgcaactcctccaccagaaagggaagggaagcacgccggagccccatctccccggccgtcaaaatggtgaacgttccgaagaccaagaagacctactgcaaaaacaaggagtgcaagaagcacacacttcacaaggtcactcagtacaagaagggcaaggacagtctatctgcccagggaaagcgtcgttatgacaggaagcagtcgggatatggtggtcagaccaagcctgttttccacaagaaggcaaaaaccaccaagaagattgtgctgaagctgcaatgccagagctgcaagcactactcccagcgtgccatcaagaggtgcaagcatttgagatcggcggagacaagaagggcaaggggacatctcttttctagactgctttcacctatctggagtggtggtggtcacgaagtattactacttgtgttaagggttcgttgttaggagttaaattaatcagaccttgtcatgtatccaaactcctgtgtcttgcatttaagcaagaggcgagttttggctaagtgaagttttgtagcttgaatcctctttcattccgtataatgtc

SEQ ID NO: 3284 - DNA, 439 bp, Cenchrus ciliaris
cttctcgcccggataggcagcacgccgcaggagccccagctctcccttccgccgctgccaaaatggtgaacgttcctaagaccaagaagacctactgcaagaacaaggagtgcaggaagcacactctccacaaggtgacccagtacaagaagggcaaggatagcctgtctgcccagggaaaacgtcgttatgaccgcaagcagtcaggatatggtggtcagaccaagccagtgttccacaagaaggccaagaccaccaagaagattgtgctgaagctgcagtgccagagctgcaaacactactcacagcacccgatcaagaggtgcaaacatttcgagattggtggagacaagaaggggaagggaacatctcttttctaaattgcttacctatctggatgctgaagttgtggtgtctactactgttcttaaaacccatc

SEQ ID NO: 3285 - DNA, 701 bp, Setaria italica
atggagaccgagacgcatgaaattttctgggccaagagggcccgcgcgcggttttcggttccgacctcgcgccgccgccaggacactcggaccgacggaggaggaagctacagctcggcagccatggtgaacgttccgaaaaccaagaagacctactgcaagaacaaggaatgcaggaagcacaccctgcacaaggttacccagtacaagaaaggaaaggatagcctttcagctcaagggaagcgtcgttatgaccgcaaacagtcaggatatggtggtcagacaaagcctgttttccacaagaaggccaagacaacaaagaagattgtgctgaagctgcagtgccagagctgcaagcactactcgcagcacccgatcaagaggtgcaagcacttcgagatcggtggcgacaagaagggcaagggaacctctctcttctaagctgatgataaacttgttcttagccccaggtcatctgccagaagttaccatttggaatgttctatgttatccttatatagggagatacatcagatgggaacccactggagtgatacaagatatatcttgtgctttgtgtctgaatcagctgttttgtcagataaatttggtacaatatagtttgtacgagaccaaatgatgaatatgctattatgttcgagctccggatcttttttgccgcaagtactccagccagttaa

SEQ ID NO: 3286 - DNA, 729 bp, Setaria italica
cccggagtaaaccctagcccgcagcggaacgcctcaccataaaagcacgccccttctccccccgccgccgccactcgccgcaacttctcgcccggatagggagcacgccgcaggagccctagctctcccttccgccgccgccaaaatggtgaacgttccgaagaccaagaagacttactgcaaaaacaaggagtgcaggaagcacactctccacaaggtgactcagtacaagaagggtaaggacagcctatctgcccagggaaagcgtcgttatgaccgcaagcagtcaggatatggtggtcagaccaagcctgtgttccacaagaaggccaagaccaccaagaagattgtgctgaagctgcagtgccagagctgcaagcattactcacagcacccgatcaagaggtgcaagcattttgagattggtggagacaagaaggggaagggaacatctcttttctagattgcttgcctatctggatgctgaagttgtggtgtctactactgttcttaaaacctctcgtcaaatttcagtgtcattagtagttcttaatgcggaccatgcttatgtatccaaattccaatgcctgacatttgctctgagtgttggtcgacttttggctaaatgaagttttgtagcttgaatctgttctttttgtttgaatttgtgtctgccattgatcgtgcttgtgttaactttgcggcaaggttgtgtgaagttgtctggtt

SEQ ID NO: 3287 - DNA, 548 bp, Leymus cinereus x Leymus triticoides
  misc_feature (84)..(85): n is a, c, g, or t
  misc_feature (169)..(169): n is a, c, g, or t
gcacgaggatcccaaccaggcgcgcactcgtcctcttcgcggtcgtcgtctcggatccaccgccgcttctgcagccatggtganngttccgaagaccaagaagacctactgcaagaacaaggagtgcaagaagcacaccctccacaaggttacccaatataaaaagggnaaggacagtctttctgctcaggggaagcgtcgttatgaccgcaagcagtctggatatggtggccagacaaagcctgttttccacaagaaggccaagacaacaaagaagattgtcctgaagttgcagtgccagagctgcaagcattactcgcaacgtgctatcaagaggtgcaagcactttgagattggtggagacaagaagggcaagggaacatctctcttctaagctgatgatatcgctgttatgtttagagtgttgtgccagaacttctcacaagaatgtattatctttaattttctggttataaccctatgggctatggagcatatgttttgctattgtgtcaactagtactttcttcagatctaatcgacaagta

SEQ ID NO: 3288 - DNA, 546 bp, Eragrostis curvula
  misc_feature (23)..(23): n is a, c, g, or t
  misc_feature (29)..(29): n is a, c, g, or t
  misc_feature (31)..(31): n is a, c, g, or t
  misc_feature (33)..(33): n is a, c, g, or t
  misc_feature (40)..(40): n is a, c, g, or t
  misc_feature (43)..(43): n is a, c, g, or t
  misc_feature (48)..(48): n is a, c, g, or t
  misc_feature (100)..(100): n is a, c, g, or t
  misc_feature (103)..(103): n is a, c, g, or t
tgtctgcgcacttctcgccaggntagggngnangccgccnaancgctngcccccgcgcctcccctccgccgtcaaaatggtgaacgttcccaagaccaanaanacctactgcaagaacaaggagtgcaagaagcacactctccacaaggtcactcagtacaagaagggcaaggatagcttgtctgcccagggaaagcgtcgttatgaccgtaagcagtcaggatatggtggtcagaccaagcccgtcttccacaagaaggccaagaccaccaagaagattgtgctgaagctgcagtgccagagctgcaagcactactcccagcacgctatcaagaggtgcaagcattttgagattggtggagacaagaagggcaagggaacatctctcttctaagcttctcatcacctacctggatgctgaagttgtggtgttcttaatactctgtcgaatgtctatgttactaggagtttaaaagcagactgtgctatgtattcaaattccaatgtctgacatttacttctaagagttggccgacttttgcctga

SEQ ID NO: 3289 - DNA, 817 bp, Zea mays
aaatattggaccaaggaacaggcccatgaactcgctaaagcgcaggaggcccggctctgttctgatatatcgctccgccgctagggttttcagggatcccgcctcacaccgccgcaaggactcgcgacggacggagcaacggaggaagcaactacgcggcagccatggtgaacgttccgaaaaccaagaagacctactgtaagaacaaggaatgcaggaagcacaccctgcacaaggttacccagtacaagaaaggtaaggatagcctttcagctcaagggaagcgacgttatgaccgcaaacagtctggatatggtggtcagacaaagcctgttttccacaagaaggcaaaaacaacaaagaagattgtgctgaagctgcagtgccagagctgcaagcactactctcaacacccgatcaagaggtgcaagcactttgagatcggtggtgacaagaaaggcaagggaacctctctgttctaagcgtatcataaacttgctcagggtctcaagtatctgtcagaatttaccattacaaacaccctgtgcttagcttctgcatatgttcttttgtcacatctttttggtacgttgtagtttgtatgagaccaagctattgtttcgtgttattattatatttcatgaaattgtcaacatgaccgtttgcttgactgtaaacatagttctgagctttgggcaaacagtagtttaatttatcgtatccatcttgagactgttgtttgttcgaaatataatggtggaatgacgtcgttaagcgcatggtacgtttgttcgaaagtcttacaatgttacgcgtt

SEQ ID NO: 3290 - DNA, 692 bp, Avena sativa
gaccatcgccacctgaaaaccctaacccgcaactcctccatcagagatagggaagcacgccggagagaccttattcccctgccgccaaaatggtgaacgttccgaagaccaggaagacctactgcaagaacaaggagtgcaagaagcacacccttcacaaagtcactcagtacaagaagggtaaagacagcctgtctgcccagggaaagcgtcgttatgacaggaagcagtcgggatatggtggtcagaccaagcctgttttccacaagaaggccaaaaccaccaagaagattgtgctgaagctgcagtgccagagctgcaagcactactcccagcgcgccatcaagaggtgcaagcattttgagatcggtggagacaagaagggcaagggaacatctctcttctaaatcgctttcacctatctggggtctgtggttgtcgacaacattactacttatcttaagatttcaatgttagtagttaaaataaattgctttcacctatctggggtttgtggttgtcaacaacatcactacttgtcttgagatttcgatgttagtagttaaaattaaacagccttgtcatgtatccaaactcttgtgtctggcatttatgtaatggtcgacttctggctttctgtagcttgaatcctcatgatggcttgttttaatctcacgctgctgtacggttga

SEQ ID NO: 3291 - DNA, 581 bp, Avena sativa
gcacgccggagagaccttattcccctgccgccaaaatggtgaacgttccaaagaccaggaagacctactgcaagaacaaggagtgcaagaagcacacccttcacaaagtcactcagtacaagaagggtaaagacagcctgtctgcccagggaaagcgccgttatgacaggaagcagtcgggatatggtggtcagaccaagcctgttttccacaagaaggccaaaaccaccaagaagattgtgctgaagctgcagtgccagagctgcaagcattactcccagcgtgccatcaagaggtgcaagcattttgagatcggtggagacaagaagggcaagggaacatcactcttctaaatcgctttcacctatctgggttctgtggttgtcgacaacattactgcttatcttaagattccgatgttagtagttaaaataaatttctttcacctatctggggtctgtggttgtcaacaacattactacttgtcttaagatttcgatgttagtagttaaaattaaacaagccttgtcatgtatccaaactccagtgtctggcatttatgtaagggtcgacttctggct

SEQ ID NO: 3292 - DNA, 558 bp, Avena sativa
gagcgcagttagggttttccgcaccgagctcgccccgccgccagggacacaccaaggccggaggaagcagcagctcagtagccatggtgaacgttccaaaaaccaagaggacctattgcaagaacaaggagtgcaagaagcacacacttcacaaggttacccagtacaagaagggaaaggatagcctttctgctcagggaaagcgtcgttatgaccgcaaacagtcaggatatggtgggcagacaaagcctgttttccacaagaaggccaagacaacaaagaagattgtgctgaagcttcagtgccagagctgtaagcactactctcagcgcgcgatcaagaggtgcaaacactttgagatcggtggagacaagaagggcaagggaacttctctcttctaatctgatgatagccatgttctcctactcaagttgtctgccagaagttaccttaaggatatttttgttttattgttctactgagatgcatctgcttgaataccttatgcttttcatctgtatcaactgtttagtgtgatccttttgatacatggtctac

SEQ ID NO: 3293 - DNA, 527 bp, Avena sativa
gctccccgtcgttgccgcagcagccgtctcctgctagcagccgccgagatggtgaacgttccgaagaccaagaagacctactgcaagaacaaggagtgcaaaaagcacaccctccacaaggtcactcagtacaagaagggtaaggacagcctgtctgcccagggaaagcgtcgttatgacaggaagcagtcaggatatggtggtcagaccaagcctgttttccacaagaaggcaaaaccaccaagaagattgtgctgaagctgcagtgccagagctgcaagcactactcccagcgtgccatcaagaggtgcaagcattttgagatcggtggagacaagaagggcaagggaacatctctcttctaaattgctttcagctatctagggtcatggtggttgacgacatgtgattttgatgttcggagttgacttagaacagaccttgtcatgtatcaaactcctgtgtctggtattgaagtaatgttcgacttatttttggctaaatgaagtatttcagcttgaatcctc

SEQ ID NO: 3294 - DNA, 580 bp, Avena sativa
ctccccgtcgttgccgcagcagccgcctcctgctagcagccgccgagatggtgaacgttccgaagaccaagaagacctactgcaagaacaaggagtgcaagaagcacaccctccacaaggtcactcagtacaagaagggtaaagatagcctgtctgcccagggaaagcgtcgttatgacaggaagcagtcaggatatggtggtcagaccaagcctgttttccacaagaaggcaaaaccaccaagaagattgtgctgaagctgcagtgccagagttgcaagcactactcccagcgcgccatcaagaggtgcaagcattttgagatcggtggagacaagaagggcaagggaacatctctcttctaaattgctttcagctatctggggtcggtgctggttgacaacatgtattatgattttgatgttaggagttgaattagaacagaccttgtcatgaatcaaactccggtgtctggtattgaagtaagggtcgaatttttggctaaatgaagtatttcagcttgaatgctcttttgaaccctcataatgacttgttttaatactgcactacagttctgatgt

SEQ ID NO: 3295 - DNA, 804 bp, Ananas comosus
gtcaagagtcctgtctcttgccagctctggaaatattggtccttaagtgctggacttcctatttttcatttagttctttgaactttgccaatgaaacctttgaactaccttcttgctagtaacagtcaattgcaaagatccaaacttttgcaatggctgaaacctggtggacattgctggatgatttagtttgtggaggattcgtatatcattgcagatcgttattttgcgccggcgtttctgctgctattgtagttcttgttattcatagttttccttggtggttcttgcccatgcaaccttttgcaaaatatatttgttttataggtgaacgttccaaagacgaagaagacatactgcaagaacaaggaatgtcggaagcacaccctccacaaggtcactcagtataagaaaggtaaagatagcctctccgctcaagggaagcgccgttacgaccgaaagcagtcgggttatggtggacaaacgaagcccgttttccacaagaaggcaaaaacgaccaagaaaattgtgttgaagctgcaatgtcagagttgcaagcattactctcaacacgcaattaagagatgcaagcattttgagattggtggagacaagaaagggaagggtacatctcttttctaatttgttgggcatctcccagtttgtcactttattgccttttatttatcccttaaatgaacaagtattaagggaggttctttctgaagtattgatgtcattttcaaatttttgtttaatgaatattggcactgataatgttagttcccttctattttattgaca

SEQ ID NO: 3296 - DNA, 983 bp, Oryza sativa
tagccgccgccaccaggctgctagggttttcggcaccgagctcgcgccgccgccatcgcacccaccgaaggagggagaggaacccaaagctcggcgccatggtgaacgtgccaaaaactaagaagacttactgtaagaacaaggaatgcaggaagcacaccctacacaaggttacccagtacaagaaaggaaaggatagcctttctgctcaggggaagcgtcgttatgaccgcaagcagtcaggatatggtgggcagacaaagcctgtttttcacaagaaggccaagacaacaaagaagatcgttctgaagctgcagtgccagagctgcaagcactactctcagcacccgatcaagaggtgcaagcactttgaaatcggtggagacaagaagggcaagggaacttcactcttctaagatgctgatattgccctgttccccaattctctgccaggagttagcattaagaatgttcttgtcttgcctttctagtacaagttatatatcctcttgttttcagtcaggtctttttgatacataactacactactagtatgtatgtgatgacaagtgattatcgttgtcacgatcattttgattttcggcgttcccttaggattggctggagatgctgtgtgattgcaacttgtgagtagtccagtcagcttctctgccccatttcactggatcaaaaggatgaaaacctgtcatactgtattgttccaattcttggtttttgactgagtacgtgtgtacgcgtagtactcttacctcgcctaattgatcgtcatattagatgactgcacgaagaccaaggaaagtcatcatattggccttacaatctgagcaaatcttttttccttttcacaatttgtcccaataagttattaaagaccaatgaaaatcatcatatttgccttacaatcttagcaaaccttaattcctttttacagtttgttccaatagtttaccaagtgatgggta

SEQ ID NO: 3297 - DNA, 725 bp, Oryza sativa
tagccgccgccaccaggctgctagggttttcggcaccgagctcgcgccgccgccatcgcacccaccgaaggagggagaggaacccaaagctcggcgccatggtgaacgtgccaaaaactaagaagacttactgtaagaacaaggaatgcaggaagcacaccctacacaaggttacccagtacaagaaaggaaaggatagcctttctgctcaggggaagcgtcgttatgaccgcaagcagtcaggatatggtgggcagacaaagcctgtttttcacaagaaggccaagacaacaaagaagatcgttctgaagctgcagtgccagagctgcaagcactactctcagcacccgatcaagaggtgcaagcactttgaaatcggtggagacaagaagggcaagggaacttcactcttctaagatgctgatattgccctgttccccaattctctgccaggagttagcattaagaatgttcttgtcttgcctttctagtacaagttatatatcctcttgttttcagtcaggtctttttgatacataactacactactagtatgtatgtgatgacaagtgattatcgttgtcacgatcattttgattttcggcgttcccttaggattggctggagatgctgtgtgattgcaacttgtgagtagtccagtcagcttctctgccccatttcactggatcaaaaggatgaaaacctgtcatactgtattgttccaa

SEQ ID NO: 3298 - DNA, 842 bp, Oryza sativa
gtcgcaatccctggagctcgccttcatcatcgcggccgccactcgccgcagcgtgtcgaccagacaaggcagcgcctccgaaaccctagctccccgccttcccctccgcggccgccaaaatggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgtttcgtacaa

SEQ ID NO: 3299 - DNA, 831 bp, Oryza sativa
gaccttctccttcccctccccgccgccactcgccgcagcgtgtcgaccagacaaggcagcgcctccgaaaccctagctccccgccttcccctccgcggccgccaaaatggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagattgtgctgaagctgcaatgccaaagctgcaagcattactcccagcaccccatcaagaggtgcaagcatttcgagattggtggagacaagaagggcaagggaacatctcttttctaaactacctactggatactgaagttgtgggtctattgtgcttcatacttcaatgttattaggaacttaatttaagcagaccatatcatgtattcaagtatcatcgtctgacatttactctagcaaggattggctttctgctgaatcaagttttcttgcttaatgctcgtcgaatccaatgtgatgcatgtctttagatggcactgcaattgtgacttttgtcttatggcagttttatctccctaagtcctcagtgtctgtttttcgttatcttacccgagtttgcaatcctagagcgacccacgtaaacgaattcctgtgacatgaatccctgagaggctagtctgatgaacttccgtttttcagatcgaatttcgtatatggttaactatactatgttttgttcaata

SEQ ID NO: 3300 - DNA, 886 bp, Picea glauca
ggaaggtttctcgtagtgcagtagcggcagctagaattgaaagaagcgcattctctcagagttcgggctgtttatttccttcaatcacaatggtcaacgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttctatcgatcattttacattcttgtttgcatatctgtctgaggacagaagttgtgttgtttattagtagattggtgaagacaaggggaagggaacgtccttttctgaactttcagctatgttccagctttctatcgatcatttttcagctatgttccagctttgtttgcatatctgtccgaggacagaagttttgttgtgttgtttattagtagatagagtcaaaccaactgaagatgccaatttaattttgcctgtctaaaggcctcttgcactttatttataaaacaaaccctcggattcaaattttgcttggttttgttttctggttatttaaccataaaatatttgacatatagtacatgaatttgataaaagaccaggttttagtttacttgcttggttttttattgtattttatttcgagttaaatggaacgaactttcattataacagaa

SEQ ID NO: 3301 - DNA, 915 bp, Picea glauca
tccgggtgcgttatgtaaactctgaaggtttctcgtagtgcagtagcggcagctagaattgaaagaagcgcattctctcagagttcgggctgtttatttccttcaatcacaatggtcaacgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttctatcgatcattttacattcttgtttgcatatctgtctgaggacagaagttgtgttgtttattagtagattggtggagacaaggggaagggaacgtccttttctaaactttcagctatgttccagctttctatcgatcattttacattcttgtttgcatatctgtccgaggacagaagttttgttgtgttgtttattagtagatagagtcaaaccaactgaagatgccaatttaattttgcctgtctaaaggcctcttgcactttatttataaaacaaaccctcggattcaaattttgcttggttttgttttctggttatttaaccataaaatatttgacatatagtacatgaatttgataaaagaccaggttttagtttacttgcttggttttttattgtattgtatttcgagttaaatggaacgaactttcattataacagaagcccttggtttactggca

SEQ ID NO: 3302 - DNA, 639 bp, Panicum virgatum
ggcagctagggttttcggctccgatctcgcgccgccgccaggactctcggaaggacggaggcggaagctacagctcggcagccatggtgaacgttccgaaaaccaagaagacctactgcaagaacaaggagtgcaggaagcacaccctgcacaaggttacccaatacaagaaaggaaaggatagcctctcagctcaagggaagcgtcgttatgaccgcaaacagtcaggatatggtggtcagacaaagccagttttccacaagaaggccaagacaacaaagaagattgtgctgaagctgcagtgccagagctgcaagcactactctcagcacccaatcaagaggtgcaagcacttcgagatcggtggcgacaagaagggcaagggaacctctctcttctaaactgatgataaacttgttctttgcccccaagttgtctgccagaagttaccattaggaatgttctatgttatccttatagtgagatacatcagatgggaacccttatgctttgtatgttcttgagttgttctgttggataaatttggtatgatatttgtacgggaccagatgacgaatatgttttattctgagccagcattattcaggttctcttacatagctagttcttgattctggc

SEQ ID NO: 3303 - DNA, 760 bp, Panicum virgatum
agcggaccttccccacgccgccgccactcgccgcagcttcacgcccggatagggagcaccaccgcaggagcccgagccctcccttccgcagccgccaaaatggtgaatgttcctaagaccaagaagacctactgcaagaacaaggagtgcaggaagcacactctccacaaggtgactcagtacaagaagggtaaggatagcctttctgcccagggaaagcgtcgttatgaccgcaagcagtcaggatatggtggtcagaccaagcccgtcttccacaagaaggccaagaccaccaagaagattgtgctaaagctgcagtgccagagctgcaagcactactcccagcacccaatcaagaggtgcaagcactttgagattggtggagacaagaaggggaagggaacatctcttttctagattgctcgccgcctgtctggatgctgaagttgtggtgtctaccactttttttagagctgtcgtcaaatctcagtgtttctagttcttaaagcggaccatgcttatgtatccaaaagccaatgtctgacatttgctcggagtgttggttgacttttggctaaatgatgttttgtagcttgaatctgttttctgtctttgatttggcagccatcttgtgaagttgcctgaatctgtgcagatgtattgctcgtgtcaacagcttcagcttgcatatagtttgcctgatatgtgtctcttgactgttggcgccttggcacccaatagcaaatcgttctttggtttt

SEQ ID NO: 3304 - DNA, 784 bp, Panicum virgatum
gccactcgccgcagcttcacgcccggatagggagcaccaccgcaggagcccgagccctcccttccgccgccgccaaaatggtgaatgttcctaagaccaagaagacctactgcaagaacaaggagtgcaggaagcacactctccacaaggtgactcagtacaagaagggtaaggatagcctttctgcccagggaaagcgtcgttatgaccgcaagcagtcaggatatggtggtcagaccaagcccgtcttccacaagaaggccaagaccaccaagaagattgtgctgaagctgcagtgccagagctgcaagcactactcccagcaccctatcaagagatgcaagcactttgagattggtggagacaagaaggggaagggaacatctcttttctagattgctcgctgcctgtctggatgctgaagttgtggtgtctaccactttttttagacctgtcgtcaaatattactagtagttcttaaagcggaccatgcttatgtatccaaattccaatgcctgacatttgctaagagtgtttgacttttggctaaatgatgttttgtagcttgaatctgttttctgtcttcgattttggcagccatcatgtgaagttgcctgaatctgtgcagatgtattgggtgctcgtgtcaacagcttctgcttgcatatagtttgcctgatatgtgtctctttgactgttggcgccggcacccaattgcaaagcgttctttggttttgaagttcagaaattttattcaataagaactaccgattaattgcctgtg

SEQ ID NO: 3305 - DNA, 681 bp, Panicum virgatum
ggatcgcagctagggttttcggctctccgatctcgcgccgccgccaggactctcagaagggcggagaggaggaagctacagatcggcagccatggtgaacgttccaaaaaccaagaaaacctactgcaagaacaaggagtgcaggaagcacaccctgcacaaggttacccaatacaagaaaggaaaggatagcctctcagctcaagggaagcgtcgttatgaccgcaaacaatcaggatatggtggtcagacaaagcctgttttccacaagaaggccaagacaacaaaaaagattgtgctgaagttgcagtgccagagctgcaagcactactctcagcacccgatcaagaggtgcaagcactttgagattggtggcgacaagaagggcaagggaacctctctcttctaagctgatgataaacttgttctttgcccccaagttgtctgcccgaagttaccattaggaatgttctatgttatccatatagtgagatacatcgatggcaacccttatgctttgtatctgcatcagctgttctgttggataaatttggtacgatatttgtatgagaccagatgatgaatatgttttatgctgcaagttcttagccagcattgatcgggttctcttacagtggttaagatagttcttaattctaggcaaaataataatttgatttc

SEQ ID NO: 3306 - DNA, 762 bp, Secale cereale
ttttaattatggggtcctatgatggcatgaaatctttgagacctgatgattatccttgtgatgacaaccataagcatgtttctgaggacctaatcgtttgtactagtggttttcttagttacttttttttttacatttgctgaacttgttttagagttaaattttagctattgcagtgtgatctgaatctgtactgttcacgcaaaccttgttcttacaattagtttttgtgcaaatgctatataggtgaacgttccaaaagaccaagaagacctactgcaaaaacaaggagtgcaagaagcacacccttcacaaggtcactcagtacaagaagggtaaagacagtctgtctgcccagggaaagcgccgttatgacaggaagcagtcaggatatggtggtcagaccaagcctgttttccacaagaaggcaaaaaccaccaagaagattgtgctgaagctgcagtgccagagctgcaagcactactcccagcgcgccatcaagcggtgcaagcattttgagatcggtggagacaagaagggcaagggaacatccctcttctagattgctttcacctatctgtaatcattgtggtcaagaactatttctacttgtcgtaatgtttcagtgttatgagttgaatcaatcagaccttgtcatgtatccaaacccctttatctggcatttgagcaaggatcaacatggcagaatgatcttttgtagcttgatgaatcctcttttaatctcaggcattgccgtactgt

SEQ ID NO: 3307 - DNA, 591 bp, Allium cepa
gtcaacgcagatacggggcgtaaaatcaatagtcagccgcgttcctgcttcctaaccctaagctcatcggagttccaaccttagttttgctttgcagccatggttaacgttccaaagacaaagaaaacttactgcaagaacaaggagtgcaagaagcacaccttgcacaaagttactcaatacaagaaagggaaggatagtctttctgctcagggtaagaggcgttatgacaggaagcagtctgggtatggtggacagactaagccggttttccacaaaaaggcaaaaactactaagaagattgtgctcaaattgcagtgtcagagttgcaagcattactcacagaaagcaatcaagagatgcaagcattttgagattggaggagacaaaaagggcaagggaacatctttgtttaaattataaactttgtctatctatgcaacgctactgttatgattaaaatgctgttatgtttaacttctttaaagtctttctaaatttttatttgtattccgttattttagtttcctattatatgtaatatcttagaacaattcctttattttattttagtttcgtatttcttaaccg

SEQ ID NO: 3308 - DNA, 647 bp, Picea glauca
tattttactcaaataaagtccttttgcgctcctctggttctttgttgagcggcgcgcaaggaaagcagagaggaggaggacgacgacgacgaggttatcagcggctccgcgtgtggatcgtagcaatggtcaatgttccgaagaccaagaaaactttttgcaagaacaaagcttgcaaaaagcacactttgcacaaggttactcagtataagaaagggaaggacagcctttctgcccaaggaaaacgcggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttttatcgatcattttacattcttgtttgcatatctgtctgaggacagaagttgtgttgtttattcgtagattggtggagacaaggggaagggaacgtccttttctaaactttcagctatgttccagctttctatcgatcaatttacattcttgttagacatatctgtccgaggacagaagttt

SEQ ID NO: 3309 - DNA, 1230 bp, Amorphophallus konjac
ggggagggggaagactctgggttccggcgccgctaagaaggcgacgtcgagaagcagcaaggccggcctccagttccccgtcggaaggatcgcccgtttcctcaaggccggcaagtacgccgagcgtatcggcgctggcgcccctgtctatctcgccgccgtcctcgagtacctcgcagccgaggtgctggagctggccgggaacgccgcgcgcgacaacaaaaagaccaggatcgtgccgcggcacatccagctcgcggtgaggaacgacgaggagctctcgaagctgctcggcgccgtcaccatcgccagcggcggcgtcatgcccaacatccacaacctcctcctccccaagaagacgggcgccgggtctaagtcttccgccgacgagagctgagctcgcccttatccacattacatggatccttctacatctcccgggggagaagaacattccactgtagtgtttatttatcccgctttttggtttcgcaggtttaaaattttaaatgtgtgtcaaatagttgtgaggttttggcgagctcctcgacctcgtcggagttccctctctgtgaattctttgtaacttatatatcataaaatatgacagagaaagggggtagaagaggtgaatgtaaaagtaaatacaaacacacgatgaaaaagtctgcagattaccacttactgtcgctcgaataataaccatagaacattacattgagagttcgaaatacaaactgaaaaagaaaaggaaaaaaagtctagtaaagcatgatgctcaaaagttggaagagaagacaagatcgtaagagaggcctccgagatgcagcgaataaaataactagaagagtgatgtgccctttcccttcttgtctcctccaatctcaaaatgtttgcatctcttgatagggtgctgagaataatgcttgcagctctggcattgcaacttcagcacaatcttcttggtggtttttgccttcttgtggaaaacaggtttcgtctgtcctccataaccagactgtttcctgtcataccgacgctttccctgaacagagagactatccttccccttcttgtactgtgtgaccttgtgcagggtgtgcttcctgcattccttgtttttgcagtaagtcttctttgtctttggaacgttcaccatgtttgcagaggcttcgtctcccctccggtcgtctggcggctacgagggcgcaggagctgggaacaacgagc

SEQ ID NO: 3310 - DNA, 1419 bp, Oryza sativa
tataaagccgcagacctctctctccttctcctcccccgccgccgccacttgcctccgaaaccctagccgccccctccccgcggccgtgaaaatggtacgcttctccctcctcctcctcctcctcctcctcccctccgccgcacgacgggaagatcgcacgcgtgcttgtcctcgtgccagtccacggctccgcgcgcgccgtctttctcatggtctttctcgatgggtaggatgcgttctttattcatgttgatctgccgtagatggggggatcttgagccggaggagtagctagtttctttgattatgcgttttggggtctagcggattttaacatgagatggtttctctttagcgacatttttttttgttcatgttgatgtccacggtgattgttctagttatgtcatttttatcttcaagacttaaatgctttgaatcgccggtatagaccagattattgtcgtgaagatcgacgtattttccgagctgaccctctgcatgctgaaaattttgtagtgggttatatctagattatatgtgtattgttgtcattcaattagcacttaaacttctgtagcataaacattttcatcatcttcctgtgaggacatcggatgagttcctttttttttctcttcttgttctaaaattgttcggtaatcttgtctggctttgactgatgggctccaatgatggcatgaaatctttgagacctgacattcttgtgatgacaaacataagcatatttcctgaggacccaattgaggtgaacgttcccaagaccaagaagacctactgcaagaacaaggagtgcaggaagcacacccttcacaaggtcactcagtacaagaagggtaaggacagcctgtctgcccagggaaagcgccgttatgaccgtaagcagtcaggatatggtggtcagaccaagcctgttttccacaagaaggcaaaaaccaccaagaagatcgtgctgaagctgcaatgccaaagctgcaagcattactcccagcaccccatcaagaggtgcaagcatttcgagattggtggagacaagaagggcaagggaacatctcttttctaaattgcttgctacctactggatactaaagttgttggtctactgtgcttcaatatttcaatgttattaggagcttatttaagcataccatatcaatgtattcaagtatcatcgtctgacatttactctagcaaggattggctttctgctgaatcaagttttgttgcttaatgctcattgaatccaatgtgatgcatgtgtttatattttgcagcaattttatcttacgacagttctatttcccttagtcctcagtatccctttttttttgttatcttaccagctgtctgttgattagtagttagcaaacatagagcgacccactttaatgacttccc

SEQ ID NO: 3311 - DNA, 631 bp, Sorghum bicolor
tttgtttgacatgttatacaggtgaacgttcctaagaccaagaagacctactgcaagaacaaggagtgcaagaagcacactctccacaaggtgactcagtacaagaagggtaaggatagcctgtctgcccagggaaagcgccgttatgaccacaagcagtcaggatatggtggtcagaccaagcctgtcttccacaagaaggccaagaccaccaagaagattatgctgaagctgcagtgccagagctgcaagcactactcacaacacgcaatcaagaggtgcaagcattttgagattggtggagacaagaagggcaagggaacatctcttttctaagtttatcatcaccaatatgtgtgggtctactactgttctaaagacttttgtcaaatttcaatgttactagtagttctgaaagcagaccattctatgtatccaaattccaatgcctgacatttgctgagtgttggtcgacttttggctaaatgaagttttgtagcatgaatcgtcattgattctgttctgtgttcgattttgttctgccattccctattcgtgttctttgtctaaagcttgattattttacaccgaggatggtgtaggttatgtaactggctaaatggaatcctgt

SEQ ID NO: 3312 - DNA, 644 bp, Sorghum bicolor
tttgtttgacatgttatacaggtgaacgttcctaagaccaagaagacctactgcaagaacaaggagtgcaagaagcacactctccacaaggtgactcagtacaagaagggtaaggatagcctgtctgcccagggaaagcgccgttatgaccacaagcagtcaggatatggtggtcagaccaagcctgtcttccacaagaaggccaagaccaccaagaagattatgctgaagctgcagtgccagagctgcaagcactactcacaacacgcaatcaagaggtgcaagcattttgagattggtggagacaagaagggcaagggaacatctcttttctaagtttatcatcaccaatatgtgtgggtctactactgttctaaagacttttgtcaaatttcaatgttactagtagttctgaaagcagaccattctatgtatccaaattccaatgcctgacatttgctgagtgttggtcgacttttggctaaatgaagttttgtagcatgaatcgtcattgattctgttctgtgttcgattttgttctgccattccctattcgtgttctttgtctaaagcttgattattttacaccgaggatggtgtaggttatgtaactggctaaatggaatcctgtggtgcatataggt

SEQ ID NO: 3313 - DNA, 615 bp, Musa acuminata
atcgatatttcgttgccattgaacgtctcaaagccctaaccccgtccctcataaaaagggatcgaatctgatccggcttttcttcttaggcttcggaggcggcaaccacaaccccaacgctgagctgcaaatatggtgaacgttccaaagacaaagaaaacttactgcaagaacaaagcatgcaagaagcatacacttcacaaggttacacaatacaaaaagggaaaggatagcctttctgttcaagggaagcgtcgttatgatagaaaacagtcaggttatggtggacagacaaagcctgtcttccacaagaaggctaaaacgaccaagaagattgtgttgaagctacaatgccagagttgcaagcattactcgcagcacccaataaagagatgtaagcactttgagattggtggagacaagaaggggaaggggacttctctcttctagtttgtttttgttgatgtttcaccgctctaggtttttttgggaaagactgattgtaatttgttctctgctgattttagtttaaattctaaatgactggaatgacaatgatgtttaacttttgcatgtttatttaattgatgctatctttttgctgcccatattctt

SEQ ID NO: 3314 - DNA, 582 bp, Epimedium sagittatum
ggtgctgggattgccgtgcgactcacagagaaggaaaaacgaaaccctagccgtctttgtacttcagccatggttaacgttcctaaaacaaagaagacatactgcaagaacaaggagtgcaaaaagcacaccctgcacaaggtaacacaatataagaagggcaaggacagccttgctgctcaggggaagcgtcgatacgatcgtaagcagtcaggttatggaggacagaccaagcctgtctttcacaagaaggcgaaaaccacaaaaaagattgtgctgaggcttcagtgtcagagctgcaaacatgtgtctcaacatgctatcaagaggtgcaagcattttgagattggtggagacaagaagggaaagggaacttctctcttttaggtggtgcttttggtttgatctggcaattttgtttaagcattttggaatcctttaagttctctcctgtaatctgttgttccttttctttttttttagctcaagttagtggagataatagttgttattttatttgacgaagacattgaaatgaatgttactttaaggattattaggattaaaatacgatttcgtatt

SEQ ID NO: 3315 - DNA, 644 bp, Epimedium sagittatum
gggggaatttgagaggcggagaagtcagagaagggagtagggcaagttctcgatcttcgaccgcttgcagtcatggtgaatgttccaaagacaaagaaaacttactgcaagaacaaggaatgcaagaagcacaccttgcacaaggtaacacaatataagaaggggaaagatagtcttgctgcccagggaaaacgtcgttatgacaggaagcagtcaggttatggaggacagaccaaacctgtctttcacaaaaaggctaaaactactaagaagattgtgttgaggttgcaatgccagagctgcaaacatgtatcccagcacgctatcaagaggtgcaagcactttgaaatcggtggggacaagaagggaaaaggaacttctctattttagacatttgcttgagttgttgtttcagttttatgcttctctatattacctattttctgtggtcctgtggaaaaccagtgtaggatatgtttgttatcataattttattgttttatgctagacaagaaacctactcctatctaaagatgagttacgagttatgtttcatgcttttgaagattgtatattgttgacaactaggaattggttatatatggtgtgattggattatccagttgaccatacatttctaagtg

SEQ ID NO: 3316 - DNA, 556 bp, Eschscholzia californica
ctccatttacagttctacagtttcagccatggtgaacgttccaaagacaaagaagacatattgcaagaacaaggagtgcaagaagcacactctgcacaaagttactcaatacaagaaaggtaaggacagtcttgcagctcaaggaaaacgtcgttatgatcgcaaacaatcgggttatggaggacaaaccaagcctgtttttcacaaaaaggcgaaaaccacgaagaagattgttttgagacttcagtgtcagagttgcaaacatatgtcccaacatgcaatcaagagatgcaagcattttgagatcggtggagacaagaagggaaagggaacttctctattttagacggtggagacatctacttgtttcttttggcattttattgtttaatgttgaacttgctcttagaattattataccaacaagaagtttcagtgtactgaagtaatcactggatgttttctgtgtttggatatggagatggttttgttttcgttaagattattgtttaaagcgaattagaacttattatatcattttgtttcggagttggcc

SEQ ID NO: 3317 - DNA, 519 bp, Eschscholzia californica
atctacttgcagcagccatggtgaacgtgccgaaaacaaagaagacatactgcaagaacaaggagtgcaagaagcacaccttgcacaaggttacccaatacaagaagggtaaggatagtcttgctgcacaagggaagcgtcgttatgatcgtaaacaatctggttatggaggacaaaccaaacccgtcttccacaagaaggccaagacaacaaagaagattgtgctgaggttgcaatgccaaagctgcaaacatatgtcccagcatgctatcaagcgatgcaagcattttgaaatcggtggagacaagaagggaaagggaacttctctcttttagacgacagatatttcttgttagggttatttatagcattttgtcgtgttgctcgacccttattagttcaagtttttagttgaaaatacatctttgaattctgttcgttgtcttgcttattagtgtagatttagctggtattaaattgtaatggttttatgtctaaaaaagtacgtagggaggtacg

SEQ ID NO: 3318 - DNA, 575 bp, Eschscholzia californica
ctgtagatctctggcgcttcaatcatggtgaacgttccaaagacgaagaagacctactgtaaaaacaaggagtgcaagaaacacaccttgcacaaagttacccaatacaagaagggtaaagatagtcttgcggcacaagggaagcgtcgttatgatcgcaaacaatcaggttatggaggacaaaccaaaccagtctttcacaagaaggccaaaaccaccaagaagattgtgttgaggcttcaatgtcaaagctgcaagcacatgtcgcagcacgcgatcaagcgttgcaagcattttgaaataggtggagacaagaagggaaagggaacttctctcttttagacaacaatagtttcttgttgggagttcttttctttattacatctaagtgtcgtgttattacttttaactgtttgttcacacaaattttgagatggaaaacagtatcctttggttaaattgattctcttacttgtcttattagtcttattagttttgtattgaattacttgtcttctttaattacttactatactaaagtctactattaaacattgtagtttttagttgtttag

SEQ ID NO: 3319 - DNA, 553 bp, Eschscholzia californica
ctgaagaccgcatctctccgttcctccacccacttgcagccatggtgaacgtaccgaagaccaagaagacttactgcaagaacaaggagtgcaagaagcacactttgcacaaggttacccaatacaagaagggtaaggacagtcttgctgcacaagggaaacgtcgttatgatcgcaaacaatctggttatggaggtcagaccaaacccgtcttccacaagaaggccaagactaccaagaagattgttttaaggctgcaatgccagagctgcaagcacatgtcccagcatgcaatcaagcgttgcaagcattttgaaatcggtggagacaagaagggaaagggaacttctctcttttagacaacagttgtttcttgttaggttttcatttcttacttgtattcagtattgtgttgatctactctttttgacagaattttgaagttggaagatacttatggttaaattgaagttaaggtcttgactttttaaacaaaaaaaagtacgtagggtaggacgtaaggacgacacaaggggagtaaggtagcgcaccc

SEQ ID NO: 3320 - DNA, 561 bp, Eschscholzia californica
aaaatctccatttacagttctacagtttcagccatggtgaacgttccaaagacaaagaagacatattgcaagaacaaggagtgcaagaagcacactctgcacaaagttactcaatacaagaaaggtaaggacagtcttgcagctcaaggaaaacgtcgttatgatcgcaaacaatcgggttatggaggacaaaccaagcctgtttttcacaaaaaggcgaaaaccacgaagaagattgttttgagacttcagtgtcagagttgcaaacatatgtcccaacatgcaatcaagagatgcaagcattttgagatcggtggagacaagaagggaaagggaacttctctattttagacggtggagacatctacttgtttcttttggcattttatcgtttagtgttgaacttgctcttagaattattataccaacaagaattttcagtgtactgaattaatcactggatgttttctgtgtttggatatggagatggttttgttttcgttaagattattgtttaaagcgaattagaacttattcaatcattttgtttcggagttggcc

SEQ ID NO: 3321 - DNA, 606 bp, Eschscholzia californica
agtttgcgcatcggaggaacgaaaatctccatttacagttctacagtttcagccatggtgaacgttccaaagacaaaaaagacatattgcaagaacaaggagtgcaagaagcacactctgcacaaagttactcaatacaagaagggtaaggacagtcttgcagctcaaggaaaacgtcgttatgatcgcaaacaatcgggttatggaggacaaaccaagcctgttttccacaaaaaggcaaaaaccacgaagaagattgttttgagacttcagtgtcagagttgcaaacatatgtcccaacatgcaatcaagagatgcaagcattttgagatcggtggagacaagaagggaaagggaacttctctattttagacggtggagacatctacttgtttcttttggcattttatcgtttactgttgaacttgctcttagaattattataccaacaagaatttacagtgtactgaattaatcactggatgttttctgtgtttggatatggagatggttttgttttcgttaagattattgtttaaagcgaattagaacttattcaatcattttgttttggagttggcctacttggtatatcaaataagttag

SEQ ID NO: 3322 - DNA, 508 bp, Carpinus betulus
tctcagcaacaaaaagctgcgctcggtcggatcgtcatcaccatggtgaacgttcctaagaccaagaaaacatactgtaagaacaaggagtgcaagaagcacaccttgcataaggtcacacagtacaagaaaggcaaggatagccttgctgctcaagggaagcgccgttatgatcgcaagcaatcaggttatggagggcagacaaagcctgttttccacaaaaaggccaagacaaccaaaaaaattgtcttgaggttacagtgccagagttgcaaacatgtgtcccagcacgcaattaagaggtgcaaacactttgagattggtggagacaaaaagggaaagggaacttctctcttctgaatgcattgcattgtattgttcttatttttatatcaattttactttttcaattaaatgttggattttgaagacaaatttgcgatagtcgttctgttccttcggatgttggtttagtaggaaaacatcaaagtgattttgaaacactatt

SEQ ID NO: 3323 - DNA, 618 bp, Tropaeolum majus
aagaatttctcaccttattagctttcatcttaaaaaaccctaagattctcaaccctgtgtttcgtccaaattcaagccgcagggaaggaggaacacacctcaatcaaaatggtgaacgtacctaagacaaagaagacatactgcaagaacaaggaatgcaagaagcatactttgcataaggtaacccagtacaagaagggtaaggacagtcttgctgcacaagggaaacgtcgttatgatcgcaagcaatctggttatggtggacagacaaagcctgtctttcacaagaaggccaaaaccactaagaagattgttttgaggcttcaatgccagtcatgcaagcatgtttcacaacatgcaatcaagagatgcaagcatttcgagatcggtggagacaagaagggaaaaggaacttctcttttctagacgcgttgtcgttgtttgctcgctcttctatggttttcaatcttctcagatattttgcttatcttttttaatgtcttaaaactctagattttgaaatgtttaatacaagtgtgttgaccaagttgtatcatgatttaaatcttacatttcttatattcggtctaagtttcttactttattgcagaaatgaag

SEQ ID NO: 3324 - DNA, 562 bp, Tropaeolum majus
tttccaaaccctagaacgagtgaattctgctttattcaaatcccagccgcaaggaggaagaagacagctgattcaaacatggtgaatgtacctaagacaaagaagacatactgcaagaacaaggaatgcaagaagcataccttgcataaggtaacccagtacaagaagggtaaggacagtcttgctgcacaagggaaacgtcgttatgatcgcaagcaatctggttatggtggacaaacaaagcctgtctttcacaagaaggccaaaacaactaagaagattgtgttgaggcttcagtgccagtcatgcaagcatgtttcacaacacgcaatcaagagatgcaagcatttcgaaattggtggagacaagaagggcaagggaacttcacttttctagatggatagtgttttttggtcttgaatggattacattagaacttgttctactgaaactttttatgggcttcaatgtactcatgtttcaattctaatattttgaactctttaatacaaagatgactagtaggatcatgagttatggttaaatttctcactacattcct

SEQ ID NO: 3325 - DNA, 567 bp, Tropaeolum majus
ttgtttggccttcattgcagagttacctgaggaagaagatccagctacaaaatggtgaacgttccaaagactaagaaaacttactgcaagaacaaggagtgcaagaagcacactttgcataaggtcacccaatataagaagggtaaggacagtcttgcagcccaaggaaagcgtcgttatgatcgcaaacaatctggttacggtggacagacaaagcccgtctttcacaagaaggctaagactaccaagaaaattgttttgaggctacagtgccagagctgcaaacatgtttctcaacacgcaatcaagaggtgcaagcattttgaaatcggtggagacaagaagggaaagggaacatctcttttctaagtgcactgttgtcactacttcaatatttcaagtttgttggaattaaagtcaatttcgtttttagggcttgtatttttcttacctaaatcttttggatcaaatttttgttagtttataatggatgttgtcttttggatcataatttaatatcaaatggctattaatatgacatgctttgaatctcttacgaaaaaaaaa

SEQ ID NO: 3326 - DNA, 673 bp, Elaeis guineensis
gatagtctgtctgctcaaggaacgttcaccatcgttgctgctcgcaacgactcggaggggaggggcggggagagaagcgtcgggcgggttgcaacgatggtgaacgttccaaaaacaaagaagacttattgcaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttgaaattggtggagataagaagggcaagggaacgtctctcttctagtgggcttctaccgtttcgggggcgtcacttggttatctgtgtgttctagggaaatgctgatctaaacccattaaatcggcactatatttttgttaaggactttttggtgtttcttaagtttacttggttgtcatgttctagcctataatgattcaggtagtgtgctaaaaccagttcaatgctgatctaaaaaaaaaaaaaaaaaaaactacgtaaagacgtacgaccgaacggacaacgaacctaggggaagtaggag

SEQ ID NO: 3327 - DNA, 545 bp, Elaeis guineensis
gataagcgcgttcagtggattgaaaccctagtcctgaaaccatggtaaacgttccaaaaacaaagaaaacttattgcaagaacaaacagtgccgaaagcacacccttcacaaggttacccagtataaaaagggtaaggatagtctgtctgctcaaggaaagcggcgttatgaccgcaaacagtctggttatggtgggcagaccaagcctgttttccacaagaaggcaaaaacaaccaagaaaattgtgttaaagcttcagtgccagagttgcaagcattattcacagcaccctataaagagatgcaaacatttcgaaattggtggagacaagaaggggaagggaacatctctcttctagttggtatagtagtagaagcatatgttctaggaaaaatttgatctagacccactaagttgtcagtttatattgttatggattttcgatgttcctgaagttttcctggtcagcattcagcttctcacgactttgcatgtcagatgcttaacaaaacaggcttttggaggaatataacctgcaagtaaa

SEQ ID NO: 3328 - DNA, 711 bp, Elaeis guineensis
gtagatcggcttcttcgttccaccggcctgcacagagggaggattctttggggcagtcggaaccctaaccgtagctgcaaccatggtgaacgttccaaagacaaagaagacttactgcaagagcaaagaatgcaggaagcacacccttcacaaggtgacacagtataagaagggtaaagatagtctttctgctcaagggaagcgtcgttatgacagaaagcagtcaggttatggtggacagacaaaacctgtattccacaagaaggcaaaaacaacgaagaaaattgtgctgaagctgcagtgtcagagttgcaagcactattcccagcacccaataaagagatgtaagcattttgagataggcggagacaagaagggaaaggggacatcactcttctgatttgctttatatgccatttgaatgccttatcatttttttggttttgttgaagatgaactggagcaacctttgtattgcaggcaattttgattttgacatgaaaatcatatcaatgttggattgttcattgtcaagaatcagatgtggattctcttttgctgcaatttgtagctagaatttttttaaaatttatcgtctcatgttagatactacttatgagtgatattgtgttttagatgagttcattttgtgtatccattgatggttaattatttttttgcttaattatcagaacaagcatgctgagcgac

SEQ ID NO: 3329 - DNA, 579 bp, Elaeis guineensis
cgactcggaggggaggggcggggagagaagcgtcgggcgggttgcaacgatggtgaacgttccaaaaacaaagaagacttattgcaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttgaaattggtggagataagaagggcaagggaacgtctctcttctagtgggcttctaccgtttcgggggcgtcacttggttatctgtgtgttctagggaaatgctgatctaaacccattaaatcggcactatatttttgttaaggactttttggtgtttcttaagtttacttggttgtcatgttctagcctataatgattcaggtagtgtgctaaaaccagttcaatgctgatctaaacctttaaatactaaaaaaaaa

SEQ ID NO: 3330 - DNA, 515 bp, Elaeis guineensis
cgtcgggcgggttgcaacgatggtgaacgttccaaaaacaaagaagacttattgcaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttgaaattggtggagataagaagggcaagggaacgtctctcttctagtgggcttctaccgtttcgggggctcacttggttatctgtgtgttctagggaatgctgatctaaacccattaaatcggcactatatttttgttaaggtacttttttggtgtttcttaagtttacttggttgtcatgttctagcctataatgattcaggtagtgtgctaaaaccggttca

SEQ ID NO: 3331 - DNA, 500 bp, Elaeis guineensis
aacgatggtgaacgttccaaaaacaaagaagacttattgcaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttgaaattggtggagataagaagggcaagggaacgtctctcttctagtgggcttctaccgtttcgggggcgtcacttggttatctgtgtgttctagggaaatgctgatctaaacccattaaatcggcactatattttgttaaggacttttgttgtttcttaagtttacttggttgtctatgttctagcctataatgattctaggtagtgtgctaaaaccagttca

SEQ ID NO: 3332 - DNA, 574 bp, Elaeis guineensis
tcggaggggaggggcggggagagaagcgtcgggcgggttgcaacgatggtgaacgttccaaaaacaaagaagacttattgcaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttgaaattggtggagataagaagggcaagggaacgtctctcttctagtgggcttctaccgtttcgggggcgtcacttggttatctgtgtgttctagggaaatgctgatctaaacccattaaatcggcactatatttttgttaaggtactttttggtgtttcttaagtttacttggttgtctatgttctagcctataatgtttcaggtagtgtgctaaaccagttcaatgctgatctaaacctttaagtacaaaaaaaa

SEQ ID NO: 3333 - DNA, 484 bp, Oryza sativa
ggtgaacgttcccaagaccaagaagacctactgcaagaacaaggagtgcaggaagcacacccttcacaaggtcactcagtacaagaagggtaaggacagcctgtctgcccagggaaagcgccgttatgaccgaaagcagtcaggatatggtggtcagaccaagcctgttttccacaagaaggcaaaaaccaccaagaagatcgtgctgaagctgcaatgccaaagctgcaagcattactcccagcaccccatcaagaggtgcaagcatttcgagattggtggagacaagaagggcaagggaacatctcttttctaaattgcttgctacctactggatactatagttgttggtctactgtgcttcaatatttcaatgttattaggagcttatttaagcagaccatatcaatgtattcaagtatcatcgtctgacatttactctagcaaggattggctttctgctgaatcaagttttgttgcttaa

SEQ ID NO: 3334 - DNA, 915 bp, Sorghum bicolor
atacccttccaaccttagtcctcgctctcgttatcccggcggcggcggcggcctggaaggcgaaggaggaggagcagtagcagcaggcggcgccgaggagcggcttcccaccccgagcttgtaaccatggtgaacgttcctaagaccaagaagacctactgcaagaacaaggagtgcaggaagcacactctccacaaggttactcagtacaaaaagggtaaggatagcctagctgctcagggaaagcggcgttatgaccgcaagcagtcaggatatggtggtcagaccaagcccgtcttccacaagaaggccaagaccaccaagaagattgtgctgaagctgcagtgccagagctgcaagcactactcgcaacacccgatcaaaaggtgcaagcattttgaaattggtggagacaagaagggcaagggaacgtctcttttctaaatctactagtaacatatttggatgctgaagttgtagggtttatactgttcttaaaactagttctcaaatattgatgttactagtatactagtacttaaagcagaccatgctatgtatccaaattccaaccctgacatctgctttgagtatattgggccgagttttggctaaatgaagttttttagttcgaaccttattgaatctgtctgtttgattttgtgcttgccattctggcatgttatttgagtctagagtttgtaaatttttacagcaaaaatggtcacagataatgttattgcgtggctgaatgggagcagagttaaagactgcacagttctgtttaatgtttctgaatgcaaacgctgccacacgccatcgccatgtgatgttgttgcgacagatttgctttgttgtgtacatttggatcatgaccaaacattgtgcgtaacctggttcgtgcgcaaatctgtg

SEQ ID NO: 3335 - DNA, 618 bp, Picea glauca
atcgcgcttcactcatggttgaaaaggcctccgtgtgccttatgtaaactctgaaggtttctcgtggtgcagtagcggcagctagaattgaaagaagcacattctctcagagttcgggctgtttatttccttcaatcacaatggtcaatgttccgaagaccaagaaaactttttgcaagaacaaagcttgcaaaaagcacactttgcacaaggttactcagtataagaaagggagggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttctatcgatcattttacatttcttgtttgcatatctgtttgaggacagtaagttgtgttgtttattagtagattggtggagaacaaggggagggaacgcccttttgtaaacttctagtctatgttccaagctttctat

SEQ ID NO: 3336 - DNA, 518 bp, Amorphophallus konjac
aaaagaaaccctaacctgttattccaccttccagccgctcgttgttcccagctcctgcgccctcgtagccgccagacgacaggtgcggagacgaagcctctgcaaacatggtgaacgttccaaagacaaagaagacttactgcaaaaacaaggaatgcaggaagcacaccctgcacaaggtcacacagtacaagaaggggaaggatagtctctctgttcagggaaagcgtcggtacgacaggaaacagtctggttatggaggacagacgaaacctgttttccacaagaaggcaaaaaccaccaagaagattgtgctgaagttgcaatgccagagctgcaagcattattctcagcaccctatcaagagatgcaaacactttgagattggaggagacaagaagggaaagggcacctcactcttctagttattttattcgctgcatctcggaggcctctcttacgatcttgtcttctcttccaacttttgagcatcatgctttactagacttttttccttt

SEQ ID NO: 3337 - DNA, 744 bp, Amorphophallus konjac
tcctcccgcgcccccctcagcctccacttcgctcctcgccaccgaggtcaggaccgaaggctgcagctcctgcaaccatggtgaacgttccaaaaacaaagaagacttactgcaagaacaaggaatgcaggaagcacacattgcataaggtcacacaatataagaaggggaaggatagcctttctgttcagggaaagcgccgatatgaccggaagcagtccggttatggaggacaaacaaaacctgtcttccacaaaaaggcaaagaccaccaagaaaattgtgctgaagttgcaatgccagagctgcaagcattactctcaacatccgatcaagaggtgcaagcactttgagattggaggagacaagaaggggaagggaacatcactcttctagctgctccatcggaattttggaggctcccctaaggatcctactgttcttttctggattactatgcagaacttctgtcatgctgggtagatttgtttggatttgttgacattttgactgtcttgtgaaatgtttcatttcagttaccatctctggtacacgatatggaggagcttaaatcctcatcttgcgttttagtgtatctccgcctttccactccgtaacgcaatcacagacttgacagttctggaggatgtaccctctcttacacaacactgtcactgggcaaatggttcgacttgcttgggaatgcgagtgtttagtcctgcaactaaaacacgatcgaactgcg

SEQ ID NO: 3338 - DNA, 673 bp, Amorphophallus konjac
gggtggaaggacgccttgtcgtgtgacctgctctgctcgttcggtcctcttcgccgcctgggtcgaccgctccttcaaccatggtgaacgtcccaaagactaagaaaacttactgcaagaacaaggaatgcaggaagcacaccctgcacaaggtcacccagtacaagaagggaaaagatagtctctctgttcaggggaagcgccggtatgatcggaagcagtctggttatggaggacagacaaaaccagttttccacaagaaggcaaaaaccaccaagaagattgtgctgaagttgcagtgccagagctgcaagcattattcccagcatccaatcaagaggtgcaagcattttgagataggtggagacaagaaaggaaagggaacatctttgttctagttggccttggaattttggacacccactcggatcatcttacccgtgctctcgtttctaaattatttcctaggtttttaagcatggtgattggttctgggacttaggcctgtgacatgttgcccttgttgttttatttaaacatgaattagatgtgtacttttagttcctatgaaaatggaaatgcattgttggctgttatctcttcatataaccatagacctgtaactttgtagcttttaattctgttggttcatccttcacttcttccctcctgt

SEQ ID NO: 3339 - DNA, 523 bp, Chelidonium majus
ggtagctctgtctctccgtctcgttgtcgtgtctccatctacttgcagccatggtgaatgttccaaagacaaagaagacctactgcaagaacaaggagtgcaagaagcacaccttgcacaaggttacccaatacaagaagggtaaggacagtcttgctgcacaagggaagcgtcgttatgaccgcaaacaatcaggttatggaggtcagaccaaacccgtcttccacaagaaggctaagaccaccaagaagattgtcttgaggctccagtgccaaagctgcaagcatatgtcccagcatgcaatcaagaggtgcaagcactttgaaatcggtggagacaagaaaggaaagggaacttctctcttttaggcagcatcagcttctggctagggtctcgtttttttctttcatatttactgttgtgttgctcgacctttttgacgcaattttgagttggaaatacttcttgtttagttaatttgattatcaagctttgtgtttactagtagagattgatatcaatt

SEQ ID NO: 3340 - DNA, 482 bp, Eschscholzia californica
ctgaagaccgcatctctccgttcctccacccacttgcagccatggtgaacgtaccgaagaccaagaagacttactgcaagaacaaggagtgcaagaagcacactttgcacaaggttacccaatacaagaagggtaaggacagtcttgctgcacaagggaaacgtcgttatgatcgcaaacaatctggttatggaggtcagaccaaacccgtcttccacaagaaggccaagactaccaagaagattgttttaaggctgcaatgccagagctgcaagcacatgtcccagcatgctatcaagcgatgcaagcattttgaaatcggtggagacaagaagggaaagggaacttctctcttttagacaacagttgtttcttgttaggttttcatttcttacttgtattcagtattgtgttgatctactctttttgacagaattttgaagttggaagatacttatggttaaattgaagttaaggtcttg

SEQ ID NO: 3341 - DNA, 649 bp, Fagopyrum esculentum
gaggcagtttgagggtttcgtcgaggttgaagatttttaactcagaactcatactgagagatcttccacgatggtgaacgttccaaagacaaagaagacctactgtaagaacaaggagtgcaagaaacacaccttgcacaaggtcacacagtataagaagggaaaagatagtttggccgctcagggaaagcgacgttatgacaggaagcaatctggttatggtggtcagactaagcccgtgttccacaagaaggccaagaccactaaaaagattgtgttgaggttgcaatgccagtcatgcaagcatgtgtcccagcacgccatcaagagatgcaagcattttgaaatcggaggagacaagaagggcaagggaacctctctgttttagagtgtcactgctgctttattctgttttgttttttatgttcaaagtctaagacatttgcaaaaattgttagttgaaaactaaggggcaagttttgatttcattttctcttgttggtaatatggatttagaaggaaaactttcctgtcaatttattatcgaaagttgtggtagtactcttcttgggagatgtttgaaatccatgtttaataatacaatcatgctgtgaagcacggaaaccccagggagtaggggtggagccat

SEQ ID NO: 3342 - DNA, 562 bp, Fagopyrum esculentum
ttgacgctgaagagttctgcagccatggtgaatgtaccaaagacaaagaagacctactgtaagaacaaggaatgcaagaaacacaccctacacaaggtgacccaatacaagaaaggtaaagatagtttggcagcccaaggaaagcgtcgttatgacagaaagcagtctggttatggtggtcaaacaaagcctgtcttccacaaaaaggctaagaccacaaagaagattgtgttgaggctgcaatgccaatcctgcaagcatgtgtctcagcatgccatcaagagatgcaaacattttgagatcggtggagacaagaaggggaagggaacttcgctgttttagagtcttatcaaagaagattatacccttgtcgcgacttgtgtttttttcgggttgcattactggacttgtttttcttcaatgatactctgctatttgcatattgttgggtggtctgaattttttggagcaagattgttatttaaacgacctgtaaaaccatcaagatcagcagctgagcacaacttacttgattttgtgatgcaaaattagtatttataat

SEQ ID NO: 3343 - DNA, 642 bp, Fagopyrum esculentum
gcggcggagcagctctcaactcatacggcaccttgactcctcaacaaatcttcaacaatggtgaacgtccccaagacgaagaagacttactgcaagaacaaggagtgcaagaagcacaccttgcacaaggtgactcagtacaagaagggtaaggatagtttggcagctcagggaaagcgtcgttatgacaggaaacagtcaggttatggtggtcagaccaagccagttttccacaagaaggctaagaccacgaagaagattgtcctgaggctgcaatgccagtcttgcaagcatgtatcacaacatgctatcaagaggtgcaagcattttgagattggaggagacaagaagggcaagggaacctctttgttttaagcctttaggattctattatctgaaatctctctactcttttcttcatcttgtttgttggttgatagcagaaacaaaagctgtgcttatccttatattttttgttggtttgattttggtattattgcgactatgattaatgcaatttcgggcaggcaatttattatagcagaattcaaaacgaattgcaaaaaaaagtaaatgcatacgaattaattgtggtacttccctttcgtcaaacctagttggtttgtaagtaggtaaggtact

SEQ ID NO: 3344 - DNA, 654 bp, Fagopyrum esculentum
agtggtctcgcagacggaagaacttctccatttcggcatttagaggctctgagacccgcagccatggtgaacgttccaaagacaaagaagacctactgcaagaacaaggaatgcaagaaacacacactccacaaggtcacccaatacaagaaaggcaaagatagtttggctgcccagggaaaacgtcgttatgacaggaagcagtctggttatggtggtcagaccaagcccgtctttcacaaaaaggctaagacaacaaagaagattgtgttgaggttgcaatgccagtcctgcaagcatgtatctcagcacgccataaagaggtgcaaacattttgagattggtggagacaagaaggggaagggtacttctttgttttagattgttacaatgggaggagttcatgtgcacttgtcctatgtttttggtagtggtttttggtttcatctccgcactctgttgtatgcactatttgaagatttgcgttatctagcaagaaggctttttatttagacgttattaatatacttgctcaatgttttaacatataagtgtaagttttttgttctatatgtagaattttggttatactcgggcctaaaaacaagtgcacataccaactttttcagtctaatgaaaattgtggatttagac

SEQ ID NO: 3345 - DNA, 558 bp, Festuca arundinacea
ggcacgaggccgcagcagacgcctcctcctagctgacgccaagatggtgaacgttccgaagaccaggaagacctactgcaagaacaaggagtgcgggaagcacacccttcacaaggtcactcagtacaagaagggtaaagatagcctgtctgcccagggaaagcgtcgctatgacaggaagcagtcaggatatggtggtcagaccaagcctgttttccacaagaaggcaaaaaccaccaagaagattgtgctgaagctgcagtgccagagctgcaagcactactcccagcgcgccatcaagaggtgcaagcattttgagatcggtggagacaagaagggcaagggaacatctctcttctaaattgttttcacctatctggagttatggtggtcgacagtatgtcttactatttcgatgttaggagttgaattgaaacagaccttgtcatgtatgcaaactccagtgttccagtttttaagcaaggcttgacttttggctaaatgaagttttgtagcttgaatcctctttcaatctgcataatgacctgttttattctg

SEQ ID NO: 3346 - DNA, 632 bp, Tropaeolum majus
gagtaagaatttctcaccttattagctttcatcttaaaaaaccctaagattctcaaccctgtgtttcgtccaaattcaagccgcagggaaggaggaacacacctcaatcaaaatggtgaacgtacctaagacaaagaagacatactgcaagaacaaggaatgcaagaagcatactttgcataaggtaacccagtacaagaagggtaaggacagtcttgctgcacaagggaaacgtcgttatgatcgcaagcaatctggttatggtggacagacaaagcctgtctttcacaagaaggccaaaaccactaagaagattgttttgaggcttcaatgccagtcatgcaagcatgtttcacaacatgcaatcaagagatgcaagcatttcgagatcggtggagacaagaagggaaaaggaacttctcttttctagacgcgttgtcgttgtttgctcgctcttctatggttttcaatcttctcagatattttgcttatcttttttaatgcttaaaactctagattttgaaatgtttaatacaagtgtgttgaccaagttgtatcatgatttaaatcttacatttcttatattcggtctaagtttcttactttattgcagaaatgaagacagaaataca

SEQ ID NO: 3347 - DNA, 581 bp, Tropaeolum majus
cggccggggatcaaagaggtatttgcttttctattccaaaccctagaacgagtgaattctgctttattcaaatcccagccgcaaggaggaagaagacagctgattcaaacatggtgaatgtacctaagacaaagaagacatactgcaagaacaaggaatgcaagaagcataccttgcataaggtaacccagtacaagaagggtaaggacagtcttgctgcacaagggaaacgtcgttatgatcgcaagcaatctggttatggtggacaaacaaagcctgtctttcacaagaaggccaaaacaactaagaagattgtgttgaggcttcagtgccagtcatgcaagcatgtttcacaacacgcaatcaagagatgcaagcatttcgaaattggtggagacaagaagggcaagggaacttcacttttctagatggatagtgttttttggtcttgaatggattacattagaacttgttctactgaaactttttatgggcttcaatgtactcatgtttcaattctaatattttgaactctttaatacaaagatgactagtaggatcatgagttatggttaaatttc

SEQ ID NO: 3348 - DNA, 568 bp, Tropaeolum majus
tataaattcagcagtgaacgatttctgtcatagttgtttggccttcattgcagagttacctgaggaagaagatccagctacaaaatggtgaacgttccaaagactaagaaaacttactgcaagaacaaggagtgcaagaagcacactttgcataaggtcacccaatataagaagggtaaggacagtcttgcagcccaaggaaagcgtcgttatgatcgcaaacaatctggttacggtggacagacaaagcccgtctttcacaagaaggctaagactaccaagaaaattgttttgaggctacagtgccagagctgcaaacatgtttctcaacacgcaatcaagaggtgcaagcattttgaaatcggtggagacaagaagggaaagggaacatctcttttctaagtgcactgttgtcactacttcaatatttcaagtttgttggaattaaagtcaatttcgtttttagggcttgtatttttcttacctaaatcttttggatcaaatttttgttagtttataatggatgttgtcttttggatcataatttaatatcaaatggctattaata

SEQ ID NO: 3349 - DNA, 554 bp, Elaeis guineensis
tggcggggagagaagcgtcgggcgggttgcaacgatggtgaacgttccaaaaacaaagaagacttattgcaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttgaaattggtggagataagaagggcaagggaacgtctctcttctagtgggcttctaccgtttcgggggcgtcacttggttatctgtgtgttctagggaaatgctgatctaaacccattaaatcggcactatatttttgttaaggactttttggtgtttcttaagtttacttggttgtcatgttctagcctataatgattcaggtagtgtgctaaaaccagttcaatgctgatctaaaccctttaaatc

SEQ ID NO: 3350 - DNA, 624 bp, Elaeis guineensis
tctcgtgccgaattcggcacgagcgcgttcgtccgtgacggagagaggagaaaggggataagcgcgttcagtggattgaaaccctagtcctgaaaccatggtaaacgttccaaaaacaaagaaaacttattgcaagaacaaacagtgccgaaagcacacccttcacaaggttacccagtataaaaagggtaaggatagtctgtctgctcaaggaaagcggcgttatgaccgcaaacagtctggttatggtgggcagaccaagcctgttttccacaagaaggcaaaaacaaccaagaaaattgtgttaaagcttcagtgccagagttgcaagcattattcacagcaccctataaagagatgcaaacatttcgaaattggtggagacaagaaggggaagggaacatctctcttctagttggttatctaggactatagtagtagaagcatatgttctaggaaaaatttgatctagacccactaagttgtcagtttatattgttatggattttcgatgttcctgaagttttcctggtcagcattcagcttctcacgactttgcatgtcagatgcttaacaaaacaggcttttggaggaatataacctgcaagtaaaatttgtttcaac

SEQ ID NO: 3351 - DNA, 546 bp, Elaeis guineensis
  misc_feature (417)..(417): n is a, c, g, or t
  misc_feature (477)..(477): n is a, c, g, or t
  misc_feature (493)..(493): n is a, c, g, or t
gacttcgttcagccggcttgcgtagcgggaggattcttcggagtcgttacccgaaccccagctgcaaccatggtgaacgttccaaagacaaagaagacttactgcaagagcaaagaatgcaggaagcacacccttcacaaggtgacacagtataagaagggtaaagatagtctttctgctcaagggaagcgtcgttacgacagaaagcagtcaggttatggtggacagacgaaacctgttttccataagaaggcaaagaccacgaagaaaattgtgttgaagctgcagtgtcagagttgcaagcattattcgcagcacccaataaagagatgcaagcattttgagataggtggagacaagaagggaaaggggacatcactcttctagtttgctttttagctgccatttcaatagttnggttgaaatttgaaatgagctgtagcagcctttatttttgaggaaatttggattttaacntgtgagaaaagtttcnacattaattttttggtgtcaagattcagatattaattctatcccagagttttc

SEQ ID NO: 3352 - DNA, 690 bp, Phalaenopsis aphrodite
ttcactgtaaccctagcgttctccgtcacccgttttatgctcgcagaaaaccctattcaatttccttagagggttttatcgggagggagtggagacgcgaagatcgattaacctgtagcaatcttcttaggatctgcagcaatggtgaacgtcccaaaaacaaagaaaacctattgcaagaacaaacaatgcaggaagcacacgctgcacaaagttacccaatacaagaagggtaaagatagtctctctgctcaaggaaaacgccgttatgatcggaagcagtctggttatgggggacagaccaagccagttttccacaaaaaggcaaaaactacaaagaagattgttctaaagctgcaatgtcagagttgcaagcacttctctcagcacgccatcaagaggtgcaagcactttgagattggtggagacaagaaggggaagggaacatctctgttctaagtacaccgagttgcttgcctcggttcctgatgcattattatcattattattattattgtttgttaatcatttggaagatgttgggttttatcaatagattttgttaaatgagattttggacctatgattttgcagttagttaatgtttttaactattgggttgtccagactacctaatctcttatgaaaatgttgcatttgcttgggcgactcgggcttaaaaagaaaaaa

SEQ ID NO: 3353 - DNA, 569 bp, Phalaenopsis aphrodite
tggagacgcgaagatcgattaacctgtagcaatcttcttaggatctgcagcaatggtgaacgtcccaaaaacaaagaaaacctattgcaagaacaaacaatgcaggaagcacacgctgcacaaagttacccaatacaagaagggtaaagatagtctctctgctcaaggaaaacgccgttatgatcgaaagcagtctggttatgggggacagaccaagccagttttccacaaaaaggcaaaaactacaaagaagattgttctaaagctgcaatgtcagagttgcaagcacttctctcagcacgccatcaagaggtgcaagcactttgagattggtggagacaagaaggggaagggaacatctctgttctaagtacaccgcctcggttcccgatgcattattatcatcattattattattgtttgttaatcatttggaagatgttgggttttatcaatagattttgttaaatgagattttggacctatgattttgcatttagttaatgtttttaactattgggttgtccagactacctaatctcttatgaaaatgttgcatttgcttgggc

SEQ ID NO: 3354 - DNA, 675 bp, Pinus taeda
cggccgggggaatcgggttaatattcccgaaccgggacatgacggaggacgacgagattactaacgggtctgcatctgcatatgcatcgtagcaatggtcaatgttccgaagaccaagaaaactttttgcaagaacaaagcttgcaaaaagcacactgtgcacaaggttactcagtataagaaagggaaggacagtctttctgctcaagggaaacgacggtatgatcgaaaacaatcaggttatggaggccagacaaaacctgtgtttcacaagaaggcaaaaacaacaaagaagattgtgttgaagctgcaatgtcagtcttgcaagcattattctcaacatgcaatcaagcgttgcaaacattttgagattggtggagacaagaaggggaagggaacctcccttttttaaactttcagctttgttgcagctttatatccatcattttacattcttgttcgcatgtctgtccaaggacagaaattttgttgtgttgtttattagtagatagtcaaccaactgaacatgccaatttaaattttgccttgtcctaatgtctcttgcacttaatttaaagaacaaatccttggattcaaatcttgcctgattatgttctctggttacttcatgataaaactattttttggtccctgaatgtgcaagttttcacatag

SEQ ID NO: 3355 - DNA, 782 bp, Pinus taeda
gccaaaaccctaaaatacagatttttattcgtataaaatccttaccggctcctattagtctttcattgagcggcgagtaacgaaagcacagaggaggacgacgagattactaacgggtctgcatctgcatctgcatcgtagcaatggtcaacgttccgaagaccaagaaaactttttgcaagaacaaagcttgcaaaaagcacactgtgcacaaggttactcagtataagaaagggaaggacagtctttctgctcaagggaaacgaaggtatgatcgaaaacaatcaggttatggaggccagacaaaacctgtgtttcacaagaaggcaaaaacaacaaagaagattgtgttgaagctgcaatgtcagtcttgcaaacattattctcaacatgcaatcaagcgttgcaaacattttgagattggtggagacaagaaggggaagggaacctcccttttttaaaatttcagctttgttgcagctttatatccatcattttacattcttgttcgcatgtctgtccaaggacagaaattttgttgtgttgtttattagtagatagagtcaaccaaccgaagatgccaatttaaattttgcctttgtcgtaatgtctcttgcacttaatttaaagaacaaatccttggattcaaatcttgcttggttatgttctctggttactttatgttaaaactattttttggtccctgaatgtgcaagttttcacatagttgataatgacaatgatggctattgcgttttggaatgtagagatttttatctgtc

SEQ ID NO: 3356 - DNA, 980 bp, Pinus taeda
aaagtgaactgaaggatatccgctagaatatccacccaaataattgatactatgaaatgaacgtcgtaatagaaatgaaatatagaacagagtggaatcaaaatagaaacgagaaacttaaaaaaaacataaattgagacagagaattgcaaatactccaaaacgaaatcatgaagaagaagaacgctacccgcggaaaacagacgaagccgtcgatgcggccgacgccaaagacgacagcgaagtgaaggaggtcagggacatggatttggggagcgatggcgaggacaaggacatgctgggccgagacgaagatgaggacagccagattactagcgggtctgcatctgcatatgcatcgtagcaatggtcaatgttccgaagaccaagaaaactttttgcaagaacaaagcttgcaaaaagcacactgtgcacaaggttactcagtataagaaagggaaggacagtctttctgctcaagggaaacgacggtatgatcgaaaacaatcaggttatggaggccagacaaaacctgtgtttcacaagaaggcaaaaacaacaaagaagattgtgttgaagctgcaatgtcagtcttgcaagcattattctcaacatgcaatcaagcgttgcaaacattttgagattggtggagacaagaaggggaagggaacctcccttttttaaactttcagctttgttgcagctttatatccatcattttacattcttgttcgcatgtctgtctaaacagaaattttgttgtgttgtttattaggagatagagtcaaccaaccgaagatgccaatttaaattttgccttgtcttaatgtctcttgcacttaatttaaagaacaaatccttggattcaaatcttgcttggttatgttctctgtttacttcatgataaaactattttttggtccctgaatgtgcaagttttcacatagttgataatgacatattgcgttttggaaaaaaaa

SEQ ID NO: 3357 - DNA, 672 bp, Pseudotsuga menziesii
cctatcgttaagcaaagaaagcagagaggacgccgaagaggttattagcggctctgtgtctgcatcgtagcaatggttaatgttccgaagaccaagaaaactttttgcaagaacaaagcttgcaaaaagcacactttgcacaaggttactcagtataagaaaggaaaggacagtctttctgcccaaggaaaacgacggtatgatcgaaaacaatcaggttatggaggccaaacaaaaccggtgtttcacaagaaggcaaaaacaacaaagaagattgtgttgaagctgcaatgtcaatcatgcaaacattattctcaacatccgatcaagcgttgcaaacattttgaaattggtggagacaagaaggggaagggaacgtcccttttctaaacgctcagctatgtttcagctttatatcagtcatcttacattcttgtttgcatatctgtctcaggacagaagttttgtagtgttgtttattgttagatagagtcaaccgaggatggcaatttaattctgcctttaaggtctcttgcactttatttataaaacaaatccttggattcaaaggttttttggttactctattaaaactattctttttctgctatttttctagacccaaaatatttgacctatgatactgccgtggatgttatagacaacaggttt

SEQ ID NO: 3358 - DNA, 716 bp, Musa acuminata
acctccgcagcggccgctggacacacatcgctattggccggcggaggagcggaaaccctagccgtaaactgcaaccatggtgaatgttccaaagacaaagaagacctattgtaagaacaaggcatgcaggaagcatactctgcataaggttacccaatacaagaaggggaaagatagtctttccgttcaagggaagcgtcgctacgacaggaaacagtcaggttatggtggacagacaaaacctgttttccacaagaaggcaaaaacgacaaagaaaattgtgttgaagctgcaatgccagagttgcaagcattactcacagcatcccataaagagatgcaaacattttgagattggtggagacaaaaagggcaagggtacgtccctcttctgatctgctgcatttcaccttagaaacttgtaatgttctagaaacgagcagcgagagtagctctgaatgctgttggatttctgtcatctgaggaaggatggatgctgctgtttaacatttgcacgatccatttatttctttgacttctctccttgagatgttgcagtatctttgtgtaactatgtttttgtcaggaggccgaccatcctccgactgaatcaaagctaacattagtttacagaaaactgaaagctatcactcgtcaactaattgcgccccttcgaaggcaatcgatccatcacactgctgacagaatggccacgag

SEQ ID NO: 3359 - DNA, 785 bp, Musa acuminata
atgatggctgagttcgatctagcattcattaggaaagcaaatgagcagctgatcgtgcgatgtaccactccggaagtgaaggcatggggggcagagatcgaacaacctgcactttgttctacatcacttgccgaagggcggctgcgacctcgtccagctcttattgctcttggtcttgggaggcggaaacaccaaccaagcgctgcagtcatggtgaatgttcccaagacaaagaaaacatactgcaagaacaaggcttgcaggaagcacactcttcacaaggttactcagtataagaagggaaaggacagcctttctgttcaagggaagcgacggtatgacaggaagcagtcaggttatggtggacagacgaagcctgtttttcacaagaaggcaaaaaccaccaagaagattgtgttgaagcttcaatgccaaagttgcaagcattattcgcagcatcccataaaaagatgcaagcactttgagattggtggagacaaaaaggggaaggggacttctctcttctagtttgtttttgttgatctctcaatgctgtgtctttctggtttcactgaaaatggtaattctaggtctcaggggaacttgccatacagcttgatgctgtatctttttggtatcactctcaaatggtagttctagtatatgttctccagcgaatttggttcaagtgactgaaatgacaatgttaatttacttatgcttgtggttgagaatggatacttaatatttatgaatatctatgaagtttacttatttggatgcca

SEQ ID NO: 3360 - DNA, 524 bp, Fagus grandifolia
tccattatatatagaagagaagagtctctctctcacttgttcatcaaccggcgccactcagcttcctcagaccggcatcatggtgaacgttccaaagacaaagaagacatactgcaagagcaaggaatgcaagaagcacaccttgcacaaggtaacgcagtacaagaaaggcaaagatagccttgctgctcagggaaagcgccgttacgatcgcaagcaatctggttatggtggtcagaccaagcccgtcttccataagaaggccaagactaccaaaaagattgtgctgcgtttgcagtgtcaaagttgcaagcatatgtctcagcatgcaattaagcgatgcaagcattttgaaattggtggtgacaagaaaggaaaagggacctcgctcttttaagctcacttgtacacacttacaacacaatcgtgttatcttttttcgtggtgtagttctctctctatgttgttttgtgctgatgcaatcgcaggattatatagtttcatgagattgttcctaatttctg

SEQ ID NO: 3361 - DNA, 613 bp, Fagus grandifolia
acttgttcatcaaccggcgccactcagcttcctcagaacggcatcatggtgaacgttccaaagacaaagaagacatactgcaagagcaaggaatgcaagaagcacaccttgcacaaggtaacgcagtacaagaagggcaaagatagccttgctgctcagggaaagcgccgttacgatcgcaagcaatctggttatggtggtcagaccaagcccgtcttccataagaaggccaagactaccaaaaagattgtgctgcgtttgcaatgtcaaagttgcaagcatatgtctcagcatgcaattaagcgatgcaaacattttgaaattggtggtgacaagaaaggaaaagggacctcgcttttttaagctcactcgtacacacttagaacactgtcgtgttatctatttttgtggtgtagttctctctctatgttgttttgtgctgatgcaatcgcagaattatatagtttcatgagattgttcctaatttctgatttaagtttatgttcttgttattttgttgggattatactctgttaccttttataagattttctgcattcttagggattgttttcaacattgttaaaagtatcatatgtagaaagtaagattt

SEQ ID NO: 3362 - DNA, 892 bp, Aristolochia fimbriata
gttcaccttgccgtagttcgcggttcttagggcgtctagccgtagcagcgggcaccgagcagcttggagagagcaaaatggtgaacgttccaaaaacaaagaaaacatattgcaagaacaaagagtgcaagaagcacactttgcacaaggttacccagtacaagaaaggaaaagatagtctcgctgcacaagggaagagacgttatgatcgcaagcaatcaggatatggtggtcaaactaagcccgtctttcacaaaaaggctaagacaaccaagaagattgtgctgaggctacagtgccagagctgcaagcatgtctcccaacatcccattaagcgatgcaaacactttgaaattggaggtgacaagaaagggaagggtacttctctattttaggcgcaacgagtcactgcttcaggttttagttgtttgttccaaatatgtaggacaattgttttttgacaacattctggcgccgtgttaagtaacattatgttgaacagaaactaaggtatccttcgtaagatgtttattttactgatttctcttactatgaattcgtggagcatttgtgccgttgcataattgtcattctaatttctagaatcgcgtgataccttactgcagacatcttcgttgattattcctcaacatttgaaagttatttcactgaatgtctagtttaaagaacaacagatcgctttcataagaaaaaaatttcgaagaataatattaaagaacgagctcaacactgaatgaagaaaagaatcagaagagtgatttaatgaacatttgttgaagtcaatctagggctcgtttccgattttacagtacctggaatcaggaaaggggggatatccttcacgaactcggaaaagaagagcagtctaatg

SEQ ID NO: 3363 - DNA, 1780 bp, Aristolochia fimbriata
atggttggttggttgccttgactggttctacggtcatgaaatgtgtcattgttgggatcgctttcatggctgtctttctctttgttctggtctgagaagaacagccagtgggaatctaccactccaagtagggagaaactggatatgaagatgaatttgtgatttttaagctcttcgcttgctgcagcagtaaaacaagcctggttcagctcccatggatgttgctgcaatgtgtaagagtctacggttttggccttttggggtttagaaatattaatattttgaaccagtgttttaaaaactgaaccgaaccggccaattcaacccggctgaaccagaattggaagccaggtctaagattgggtatactgtcgacggtctatttgatttttaaaacattaggttgaacaaattaaaagattaaattttattcaacaataatttgggtataaaatagcatattaatttggggtattttataccgcatttccgaggagtaactatttataatgttatgtcgcaatctggttggttgtgacacttggtgatccaaaccctaaatgtccactccttgattgggataggtttcaaattttagataattcttatcaatattgggggcaatattgggggcatggcgtggacaaactgcgtctgttttaggataattctcattattattgtgtaaaatttacttagctcctaatttcccaaacgcgtggaccttgtgacatgcaatccctcgtattcaaaatatgggtcgactttatagaacaatgttgggcctgaatcctcatataatgggcctcaattgacccattaatagtttacggagcccatcatcttaactctcccaaatcagcagggatctataacttgtaagcgggaagctgcgcagcgtaaaccctaaccctcattgatctcgtcgcgggagtcggttcctgaacggagacgcaaagatggtgaatgtgccaaaaacaaagaaaacatattgcaagaacaaggagtgtaagaaacacaccttgcacaaggttactcaatataagaaaggaaaggatagtcttgccgctcaaggaaagagacgatatgaccgcaagcagtctggctatggaggtcaaacaaagcctgttttccacaaaaaggcaaagactaccaagaagattgtgctaaggctacagtgccagagctgcaaacacgtctcccagcatcccattaagagatgcaaacatttcgaaatcggtggagacaagaagggcaagggtacttctctattctagatagaaagcatcagagtagtaatgttgcttctgtatgtttttgttaggcaaaatatctgtaactagcgacgagtttacttttgcaattgtccatgaacgcaattttattctgaaggccacagttttgtttagtttgattttggtttttcaattagaacgatgaaaggtcgtaggctgtgtaattcctccagataggttgaggggtacagggttggatacttggattgattttagtgattgctctgtcacagcacgattttctcagaagcctttcaaagaaagaatttggtgggcatctttctttgataactaaataccgtttctgataagaatctactaggaggttgcgctcgatggccgtctgcatctttcactgacaacaatttttggaatcactaattaagaatcagtatttgacggtttctactgtagacaataatgacgggttattgctatctttatttcttacgtttaataaattgatcggttattgctttgactaa

SEQ ID NO: 3364 - DNA, 616 bp, Musa acuminata
gggggacacacatcgctattggccggcggaggagcggaaaccctagccgtaaactgcaaccatggtgaatgttccaaagacaaagaagacctattgtaagaacaaggcatgcaggaagcatactctgcataaggttacacaatacaagaaggggaaagatagtctttccgttcaagggaagcgtcgttacgacaggaaacagtcaggttatggtggacagacgaaacctgttttccacaagaaggcaaaaacgacaaagaaaattgtgttgaagctgcaatgccagagttgcaagcattactcacagcatcccataaagagatgcaaacattttgagattggtggagacaaaaagggcaagggtacgtccctcttctgatctgctgcatttcaccttagaaacttgtaatgttttagaaacgagcagcgagagtagctctgaatgctgttggatttctgtcatctgaggaaggatggatgctgctgtttaacatttgcacgatccatttatttctttgacttctctccttaagatgttgcagtatctttgtgtaactacgtttttgtcaggaggctggccatcctccgactgaatcaaatctaacattagtttaca

SEQ ID NO: 3365 - DNA, 603 bp, Musa acuminata
cactccaattaaaaaaaaagaaagttaacagtcgacggtaccggaaagactcctctctttaaaaataacggccattacggccggggcttaggcttcggaggcggcaaccacaaccccaacgctgagctgcaaatatggtgaacgttcctaagacaaagaaaacttactgcaagaacaaagcatgcaggaagcatactcttcacaaggttacacaatacaaaaagggaaaggatagcctttctgttcaagggaagcgtcgttatgatagaaaacagtcaggttatggtggacagacaaagcctgtcttccacaagaaggctaaaacgaccaagaagattgtgttgaagctacaatgccagagttgcaagcattattcgcagcatccaataaagagatgtaagcactttgagattggtggagacaagaaggggaaggggacctctctcttctagtttgtttttgttgatgtttcaccgttctaggattttttgggaaagactgattgtagtttgttctctgctgattttagcttaaattttaaatgactggaatgacaatgatgtttaacttttgcatgtttatttaattgatgctatctttctg

SEQ ID NO: 3366 - DNA, 653 bp, Musa acuminata
gacggtacataagaaaagcggctgcgacctcgtccggctcttattgctcttggtcttgggaggcggtaacaccaaccaagcgctgcagtcatggtgaacgttcccaagacaaagaaaacatactgcaagaacaaggcttgcaggaagcacactcttcacaaggttacacagtataagaagggaaaggacagcctttctgttcaagggaagcgacgctatgacaggaagcaatcaggttatggtggacagacgaagcctgtttttcacaagaaggcaaaaaccaccaagaagattgtgttgaagcttcaatgccaaagttgcaagcattattcgcagcatcccataaaaagatgcaagcactttgagattggtggagacaaaaaggggaaggggacttctctcttctagtttgtttttgttgatgtctcaatgctgtgtctttctggtttcactgaaaatggtaattctaggtctcaagggaacatggcatacagcttgatgctgtatctttttggtatcactctcaaatggtcgttctagtatatgttctctagcgaatttggttcaagtgactgaaatgacaatgttaatttacttatgcttgtggttgagaatggatacttaatatttatgaatatctatgaagtttactt

SEQ ID NO: 3367 - DNA, 535 bp, Cleome gynandra
agttggtccccaagcgacgaacttcaccggaggagaggaaccttaatacgagccgtgaaaatggtgaacgttccaaagacaaagaagacttactgtaagaacaaggaatgcaaaaagcataccttacacaaggtgactcagtacaagaagggaaaagacagtcttgcagctcaagggaagcgtcgttatgaccgtaagcaatctggttatggtggtcagaccaagcctgtcttccacaagaaggccaagacaacaaaaaagattgttctaaggcttcaatgtcagagttgcaagcatgtctcccagcacccaattaagagatgcaagcactttgagatcggtggagacaagaagggcaagggaacatctctcttctaagccttatttatcttaaaagtttcagttttgcactttttcggaactcgagtcaatctggttttagctctcttgtgattgctttggttctcttaaacttgcatggtggaccatcttgagattgtttttgttatcaatagaaatatgttgttggtgtaac

SEQ ID NO: 3368 - DNA, 609 bp, Cleome gynandra
ttgcgggggatagggagagacgagttgctccgagccgccgaaacccttaccgtaaaggaggagagaagacgataagaaatggtgaacgttccgaagacaaagaagacatactgcaagaacaaggagtgcaagaagcacaccttgcacaaggtgacacagtacaagaagggcaaagacagtcttgctgctcagggaaaacgtcgttatgaccgtaagcaatctggttatggtggtcagaccaagcccgtcttccacaagaaggccaagacaaccaagaagattgtgctaaggcttcaatgccagagctgcaagcatgtgtcacagcacccaatcaagaggtgcaagcactttgagattggaggagataagaagggcaagggaacatccctcttctaagtgtatcatcctctggacaatctttgaactcgcttcaggcttctagttttgacttatatttcctatcttcttatttctcatgttttggatcatatctcaagtgacatcttaagttgtgaaatttgatattttatatcaaatttgtctcgttttatcatgcggttatatatccaaatgaaacaggtgacacagaatcgtaagagttccattgat

SEQ ID NO: 3369 - DNA, 508 bp, Cleome gynandra
tcgctgaagctcatcgagagaagacgagaggaaatggtgaacgttccgaagacgaagaagacatactgtaagaacaaggagtgcaagaagcacaccttgcacaaggtgacacagtacaagaaaggcaaagacagtcttgctgctcagggaaagcgtcgttatgaccgtaagcaatctggttatggtggtcagaccaagcccgtcttccacaagaaggcgaagacaaccaagaagattgtgctgaggcttcaatgccaaagctgcaagcatgtgtcacaacacccaatcaagagatgcaagcactttgagataggaggagacaagaagggcaagggaacatctctcttctaagtgtatcatcttcctctccactatcttagcatggaaacttatagggttgagttacttttcgtgtttcttcttgtgtctgtctgagtattgtcggattttatgtcatggaattggtttgattcataatcaatttcttagtgtttccgagttacacttc

SEQ ID NO: 3370 - DNA, 525 bp, Cleome spinosa
ccgcattcgacgaacttcaccccgagcaacgaggctgaatacgatccgcgaaaatggtgaacgttcccaagacaaagaagacatactgcaagaacaaggaatgcaaaaagcataccttacacaaggtgactcagtacaagaagggaaaagacagtcttgctgctcaggggaagcgtcgttatgatcgtaagcaatctggttatggtggtcagaccaagcccgtcttccacaagaaggccaagacgacgaagaagattgttcttaggcttcaatgtcagagctgcaagcatgtctcccagcatccaatcaagagatgcaagcactttgagatcggtggagacaagaagggcaagggaacatctctcttctaagcaattttatcttcaaaaagtttcatcttttgcacttttcagaactcgaaccaatctgtttaagctctcttgagattaatttgttggtcttaatcttacatgttggagctatcccgagatgggtttgttattgaatagatgtatttttgttgac

SEQ ID NO: 3371 - DNA, 521 bp, Cleome spinosa
aaagcgacgaactttttccggcgcggcgaatctgaatacgatacgcgaaaatggtgaacgttccaaagactaagaagacgtactgcaagaacaaggaatgcaagaagcataccttgcacaaggtgacgcagtacaagaaaggaaaagacagtcttgctgctcaagggaaacgtcgttatgatcgtaagcaatctggttatggtggtcagaccaaacccgtcttccacaagaaggccaagacaacaaagaagatcgtcctaaggcttcaatgccagagctgtaagcatgtttcccagcatcctatcaagaggtgcaagcattttgagatcggtggagacaagaagggaaagggaacatctctcttctaagcccccttctttttttgcagttttcagaactcgaaccaatcggtttttgttgtattgccgccttgaatttacatgtcggaaccataaagtgatggttttgttcttgatatgttttgacgctggcggtgatccataattttcatattcacgtct

SEQ ID NO: 3372 - DNA, 583 bp, Cleome spinosa
aagcgacgaacttcaccggagcagcgaaagttgaatacgatacgcgaaaatggtgaacgttcccaagacaaagaagacgtactgcaagaacaaggaatgcaagaagcatacattgcacaaggtgacccagtacaagaagggaaaagacagtcttgctgctcaagggaaacgtcgttatgatcgtaagcaatctggttatggtggtcagaccaaacctgtcttccacaagaaggccaagacgacgaagaagattgttctaaggcttcagtgccagagctgcaagcatgtctcccagcatccgatcaagagatgtaagcacttcgagatcggtggagacaagaagggcaagggaacatctctcttctaagccagtttttatcttaaaactctcagttctgccctttttcggaactggaatcaatctgctttaaactcttttaagatttgctttgttgctcgtacatgttcaaaccgatcccaggtgattttaatcaatagatttattgtatttggtggatttctttaatatttgtgctccatatgtcaaattgatggaagtttttctttaaattgattgttccaa

SEQ ID NO: 3373 - DNA, 546 bp, Cleome spinosa
tcgggggtggtttgaaaccctaattccggaagagaggcagagcagagccgagagcagccgaagcccctgcgggaaggaagggagaagaagagaggaaatggtgaacgttccgaagacgaagaagacatactgcaagaacaaggagtgcaagaagcacaccttgcacaaggtgacacagtacaagaagggcaaagacagtcttgctgctcagggaaagcgtcgttacgaccgtaagcaatctggttatggtggtcagaccaagcccgtcttccacaagaaggcgaagacaaccaagaagattgtgctaaggcttcaatgccagagctgcaagcatgtgtcacagcacccaatcaagaggtgcaagcactttgagatcggaggagacaagaagggcaagggaacatccctcttctaagcgcgtatcttcctctttgactatcgattgcaccctttggaaacttttagttctcgagtttcttcacctttgatgctgtttctgttctgagaagtgtcaggtcttggatcatatctcaaatgacattttat

SEQ ID NO: 3374 - DNA, 512 bp, Curcuma longa
cgccacgcgggtttcgcacagcactgcggcaacatggtgaatgttcccaagaccaagaagacttactgcaagaacaaagcttgcaggaagcacacccttcataaggttacacagtataagaagggaaaggatagactatctgctcaaggaaagcgccgttatgacaggaaacaatctgggtatggtggtcaaacaaagcctgttttccacaagaaggccaaaacaacaaagaagattgtgttgaaacttcaatgccagagctgcaagcattattcacagcatcccataaaaagatgcaagcactttgagattggaggagacaaaaagggcaaaggaacttctctcttctagtttactttttctctaattctaggttatgttatgttcttattttcattggatatgatagcaatctgatgtcatgagaaccttatttactgtttcatttctctacatttcggtgatgttattttggtgtcattagaaccttatttaaatagttaaatctcaat

SEQ ID NO: 3375 - DNA, 626 bp, Fagopyrum esculentum
acgtcatttaaatttagcaggaggggagtcatttctatcttcctctagcggcggagcagagagaagctctcaactcattattcacctggccacctcaacgcatcttcaacaatggtgaacgtcccgaagacgaagaagacttactgcaagaacaaggagtgcaagaagcacaccctgcacaaggtcactcagtacaagaagggcaaggatagtttggcagcccagggaaagcgtcgttatgacaggaaacagtcgggttatggtggtcagaccaagccagtcttccacaagaaggctaagaccaccaagaagattgtcctgaggctgcaatgccagtcttgcaagcatgtatcacaacattctatcaagaggtgcaagcattttgagatcggaggagacaagaagggcaagggaacctctttgttttaagcctttaggaatctcttgtctgaaatctccctactcttttcttcatcttgtttgttggttgatagcagaaacaaaaggcacacctatccttatatttttgttggtttgattttggtattattgtgactatgagtaatgcaatttcggtcaggcaatttactaagcagaaatcaaaatgagtgaccctaaatgtgtct

SEQ ID NO: 3376 - DNA, 544 bp, Fagopyrum esculentum
gggtttcgtcgaggttcaagattttaactcagggctgatactgagagaccttccacgatggtgaacgttccaaagacaaagaagacctattgtaagaacaaggagtgcaagaaacacaccttgcacaaggtgacacagtataagaagggaaaagatagtttggccgctcagggaaagcgtcgttatgacaggaagcaatctggctatggtggtcagactaagcctgtgttccacaagaaggccaagaccactaaaaagattgtgttgaggttgcaatgccagtcatgcaagcatgtgtcccagcactctatcaagagatgcaagcattttgaaatcggaggagacaagaagggcaagggaacctctctgttttagagtgtcactgatgctttgttttgttctgtttttcatgttcaaagtctagacttttgcaaaaattgttagctgaagactaaggagcaagttttgatttcattttctcttgttggtaatatggatttagaaggaaaactttcctgtcaatttattatccaaagttctttta

SEQ ID NO: 3377 - DNA, 589 bp, Fagopyrum esculentum
atccttaaattgagagcgagcttgtttgccgtctaacctagtggtctcgcagacggaagaacttctccatttcggtgtttagaggctctagagatctgcagccatggtgaatgtaccaaagacaaagaagacctattgcaagaacaaggaatgcaaaaaacacacactccacaaggtcacccaatacaagaaaggcaaagatagtttggctgcccagggaaaacgtcgttatgacaggaagcagtctggttatggtggtcagaccaagcccgtcttccacaagaaggctaagaccacaaagaagattgtgttgaggttgcaatgccagtcctgcaagcatgtatctcagcactccataaagaggtgcaaacattttgagattggtggagacaagaagggcaagggtacttctttgttttagattggtacaatgggaggagttcatgtgctcttgtcctatgtttttggtagtggtttttggtttcatctgcacactttgttgtatgcactgtttgaagatttgcattattctagcatgaaggctttttatttagacgttattaacatacttactcaatgttttaacatt

SEQ ID NO: 3378 - DNA, 697 bp, Fagopyrum esculentum
gaggttaggctgtgcagcgaaagaacttccctgcgctgtggtttgacgttgaagagttctgcagccatggtgaatgttccaaagacaaagaagacctactgtaagaacaaggaatgcaagaaacacaccctacacaaggtgacccaatacaagaaaggtaaagatagtttggcagcccaaggaaagcgtcgttatgacagaaagcagtctggttatggtggtcaaacgaagcctgtcttccacaaaaaggctaagaccacaaagaagattgtgttgaggcttcaatgccaatcctgcaagcatgtgtctcagcactccatcaagagatgcaaacattttgagatcggtggagacaagaaggggaagggaacttcgttgttttagagccttatccaagaagactatacccttgtcgtgtcttgtgttttttcgggttgcgataccggacttgttttcttctatgatactctgctatttgcatattgttggatggcttgaatttttggagcaagattggtatttaaacgacatgtcaaaccatcaagatcagcagctcagcataacgtacttgattttgtggtgcaaaattactccgtagtattttataatacaccatatggtaaaattttcttcggctgtgatcgatggatcattggattggaatgttagataaattcatgtggaagttcgtcttatt

SEQ ID NO: 3379 - DNA, 577 bp, Humulus lupulus
tttttttcattcggtccctctgctcccgttcctctcaggctcgcacatctcaactcggctccggcggcggcggcggctccggctctgttagcagacatggtgaatgttcccaagaccaagaagacttactgcaagaataaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcgttgcaagcattttgagataggaggagacaagaagggaaagggaacttctcttttctaaatttgtgttactatgtcatttttgtttttatggatcttgaaatagagttatgggatatttgttaacctagacatgttgtcatgttaaagatcgattttgtttgttgaactttgtcaatgttattcttcttaaggttccgataagattttaaatgctgtgcttt

SEQ ID NO: 3380 - DNA, 753 bp, Humulus lupulus
aaactgagtagtcttccttctcgattaatttccaatagtagataggctcactcggactctaggaagtgctgaaaggcttgtacatctcaactcggcgggcagctctactagcagacatggtgaacgttcctaagaccaaaaaaacttactgcaagaataaggagtgcaagaagcacacccttcacaaggtgactcaatacaagaagggcaaggatagtcttgctgctcagggaaagcgtcggtatgacaggaaacagtctggttatggaggtcagactaagccagtctttcacaagaaggccaaaaccaccaagaagattgttcttaggctgcagtgccaaggttgcaagcatgtctctcagcacgcaatcaagcgatgcaagcatttcgagataggaggagacaagaagggaaagggaacttctctcttttaaatttgtgttactatgccatttttgtttttatggatcttgaaatagaattatgggatatttgttaacctagacatatgctgtcatgttaaacatcgattttgtttgttgaactttgtcaatgttattattcttaaggttccgagaagtgttttggggttgtgctttcgaaaaaaaaagagaacataatataaaaagagggctatagatggtctaaattttagtctacattagtataacgaaaatgtaaaaagtcataaacaagaaggctgttttcagatcagttccttgcaaaattgtactcaatgagaatgatgggatt

SEQ ID NO: 3381 - DNA, 661 bp, Humulus lupulus
ttttcattcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtcatttttgtttttatggatcttgaaatagagttatgggatatttgttaacctagacatgttgtcatgttaaagatcgattttgtttgttgaactttgtcaatgttattcttcttaaggttctgataagattttaaatgctgtgctttcgccatcatcgatctctgcatctccttctgattctccatcaacgatcactggtaatcctacagaggctcctggtccagctcaaaacg

SEQ ID NO: 3382 - DNA, 514 bp, Humulus lupulus
ttttcattcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtcatttttgtttttatggatcttgaaatagagttatgggatatttgttaacctagacatgttgtcatgttaaagatcgattttgtttg

SEQ ID NO: 3383 - DNA, 529 bp, Humulus lupulus
atttttctatttcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtcatttttgtttttatggatcttgaaatagagttatgggatatttgttaacctagacatgttgtcatgttaaagatcgattttgtttgttgaactttgt

SEQ ID NO: 3384 - DNA, 595 bp, Humulus lupulus
tttttcattcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtcatttttgtttttatggatcttgaaatagagttatgggatatttgttaacctagacatgttgtcatgttaaagaatcgatttgtttgttgaacttgttaatgttattcttcttaaggttctgataagatttaaattagctgtgctttaaaaataaaaaaaaacccag

SEQ ID NO: 3385 - DNA, 513 bp, Humulus lupulus
ttttcattcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtcatttttgttttatggatcttgaaatagagttatgggatatttgttaacctagacatgttgtcatgttaaggatcgattttgtttg

SEQ ID NO: 3386 - DNA, 510 bp, Humulus lupulus
cattcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaattttgtgttgctatgtcatttttgtttttatggatcttgaaatagagttatgggatatttgttaacctagacatgttgtcatgttaaagtatcgattttgtt

SEQ ID NO: 3387 - DNA, 489 bp, Humulus lupulus
actcggactctaggaagtgctgaaaggcttgtacatctcaactcggcgggcagctctactagcagacatggtgaacgttcctaagaccaaaaaaacttactgcaagaataaggagtgcaagaagcacacccttcacaaggtgactcaatacaagaagggcaaggatagtcttgctgctcagggaaagcgtcggtatgacaggaaacagtctggttatggaggtcagactaagccagtctttcacaagaaggccaaaaccaccaagaagattgttcttaggctgcagtgccaaggttgcaagcatgtctctcagcacgcaatcaagcgatgcaagcatttcgagataggaggagacaagaagggaaagggaacttctctcttttaaattgtgttactatgccatttttgtttttatggatcttgaaatagaattatgggatatttgttaacctagacatatgctgtcatgttaaacatcgattttgtttg

SEQ ID NO: 3388 - DNA, 752 bp, Humulus lupulus
cttgattctcatattcttcaggactccatcattaaagagataaatgataactctaatgctggatggactgctgccaggaatgatagattctcaaatttcactgttggccaatttaggaacattcttggagttaaaccaacacctaagcagcagttgagcagtaccccagttataaccattacggccgaaaatttttttcattcggtccctctgctcccgttcctctcaggctcgcacatctcaactcggctccggcggcggcggcggctccggctctgttagcagacatggtgaatgttcccaagaccaagaagacttactgcaagaataaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcgttgcaagcattttgagataggaggagacaagaagggaaagggaacttctcttttctaaatttgtgttaccatgtcatttttgtttttatggatcttgaaatagagttatgggatatttgttaacctagacatgttgtcatgttaaagatcgattttgtttgttgaactttgtcaatgttattcttcttaaggttccgataagatt

SEQ ID NO: 3389 - DNA, 807 bp, Pinus pinaster
acatagactctcctttcgaaccctaaatcccgaggtacagaggcagtgaagaagaagaggaaaaagcataggagcagcaacaacaaacaacaggaggaatcaacaggattgttgaggcggaggcagttcagaaacccaaaatggtgaatgtacctaagacaaagaaaactttctgcaagaataaagcttgcagaaagcacactctgcataaagtaacacagtacaagaaaggaaaggatagtctttctgcacaaggaaagagacgttatgataggaaacaatctggttatggaggtcaaacaaagcctgtctttcacaagaaggccaaaacaacaaagaagattgtgttgaagctgcaatgccagtcttgcaaacattattcccaacatccgatcaagcgatgcaagcactttgaaattggtggggacaagaaaggaaagggcacatctctcttctaggtgcattcgcatcagtggataacaatgtcttcctatccgtggaattgtcaaaacatcagggtgttttggatttgcagttaattcttctgattcaatactttaggttttcttttcatgaatagtttacattgaaatatgtctgccaagtagataatcttgtagcaaattgtcaacaagtatagcaggtaaagctgagcttttataaatagaaccttctgaagctttgaactccactcttaaatattcatagaaaagacatctgcggattttctcagcttatattatgtagtctaaacttaactgatttcatttctgaaatacaaataaactagaatataactgagcttat

SEQ ID NO: 3390 - DNA, 571 bp, Phalaenopsis aphrodite
gttgcctcgtcaagtcgccttaaagcattttgctctcccgattccctttgctagggttttgcggccgcggcagccatggtgaacgtcccgaaaaccaagaaaacctattgcaagaacaaggcctgcaagaagcacaccttgcacaaggtcactcaatacaagaagggtaaggatagtctatcagttcaaggaaagcgtcgttatgatcgaaagcaatctggttacggtgggcagactaagcctgttttccacaagaaggcaaaaaccaccaaaaagattgtgctgaaattgcaatgccaaagttgcaaacatttttctcagcacccaatcaagaggtgcaagcattttgaaattggtggagacaagaagggcaagggaacctctttgttttagatgcattgctttaaattttcatagcatttggtactttcatattgttcatttgctttttgaagaactgctagtaagctatgtttgtgctcatccttttatttttagctgtgaattatttcactatttagtaagataaacttttgaagatttgaacttttagtggtattgatgttcttta

SEQ ID NO: 3391 - DNA, 668 bp, Populus trichocarpa
tcattcacctccatttcctttgcagccgaagtctaccgcttctccgccaacaatggtgaacgttcctaagacaaagaagacctactgcaagaacaaggagtgcaaaaagcacaccttgcacaaggtcactcagtacaaaaaggggaaggatagccttgctgctcagggtaaacgtcgttatgatcgcaagcaatctggttatgggggtcagacaaagccagtgtttcacaagaaggcaaagacaaccaagaaaattgtgttgaggctgcaatgccagtcatgcaaacatgtgtctcagcacccaatcaagaggtgcaagcactttgagattggtggagacaagaagggaaagggaacatctctgttctaagtgcatcattttgttctttcaggataatttttaggtgtgtactgtttctagaactgagaaggcattgtgggataattttgtttgatttgttctgttcaagattatgtattgatgaagtttgaagtcgttgtggaagattgattatgatgttaaccaacgttgcccttgtagtctgcctttgctgcttaatgaaatggacccagtcgtttcttgagtgctgatttggaaaggttccacctcgagaccgctaatcctttcaattctgcatgttaatgtgagtcttgacaggtgaccctga

SEQ ID NO: 3392 - DNA, 604 bp, Populus trichocarpa
aaaagctcttactataaaacgagctcatcacacaatcgcagctctttttgaaaggctttgtttggaacagcagcagcaggaggtaggacagagagctgtctcaccccgtcgttaacaatggtgaacgttcccaagacaaagaagacttattgcaagaacaaggagtgcaaaaagcacactttgcacaaggtcacacagtacaagaaggggaaggatagcctagctgctcaaggaaagcgccgttatgatcgcaaacagtcaggttatggaggtcagaccaagcctgtattccacaagaaggctaaaacgaccaagaagattgtcttgaggttgcaatgccagagttgcaagcacgtgtcccagcaccccatcaagaggtgcaagcactttgagattggtggagataagaagggcaaggggacatcgctgttttagatgcagccctccttttgttttcatgcttctttacattaccttgcatgttacaactcgaaacaatggatgaatgatttgtttagcttggtttgttcaagttttggtgaccatttatcctatcagtaatatttttagcatattccaatttaaatctgctcctttttctgga

SEQ ID NO: 3393 - DNA, 881 bp, Populus trichocarpa
attcattcatctccacttcctttgcagccagagctcttccgcttctccgcctacaatggtgaacgttcctaagactaagaagacctactgcaagaacaaggagtgcaaaaagcacaccttgcacaaggtcactcagtacaaaaaggggaaggatagccttgctgctcaggggaaacgtcgttatgatcgcaagcaatctggttatggaggtcagacaaaaccagtgtttcacaagaaggcaaagacaacaaagaaaattgtgttgaggctgcaatgccaggcatgcaaacacgtgtctcaacacgcaatcaagaggtgcaagcactttgagattggtggagacaagaagggaaagggaacatctctgttttaagtgcatcattttgttctttcaggattacttttaggtgtctactatttctagaaccgagaaggcattatgtgatagttttgttttatttggtttatttaagactttgtatcggtgaagaagtttgaggtcattgtggaatattgattatgatgttaatcaattttgagcttatagtttgccgttgttgcttaacgaaatggacccagtcgtttctttagtgcattcataagaagggaaaacgcagttgctggcttgagaaggggtgagcctcggcagttcataagaactaatgatcttgataaggcagaggaggcgacagttgcaccctcacgcctattatcagtagaactaccattctcttagctgactggctagctaaaactgccaggctcaagcaatgcccttataactgggtttactctcccctgatgtttggtatttattgcttgagatgaattcaacttcatttttcgcttaagtgcagctatagtcagtcaagaaactatgt

SEQ ID NO: 3394 - DNA, 501 bp, Primula obconica
cggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtctatttttgttttatggattcttgaaatagagttatgggatatttgttaacctagacatgttgtcatgttaaagatcgttag

SEQ ID NO: 3395 - DNA, 846 bp, Pseudotsuga menziesii
ctttcaaaccctacatcccgagattcatagacatagtgaagaggggtattgatttccaacgacgaagaagaggagcagcaacagcgggaggattcaccgggactcttgaggcggagtctgttcgaagaccgaaaatggtgaacgtacctaaaacaaagaaaactttctgcaagaataaggcttgcaaaaagcatactttgcacaaagtaacacagtacaagaaaggaaaggatagtctttctgtacaagggaagagacgttatgacaggaaacagtctggttatgggggtcaaacgaagcctgtctttcacaagaaggctaaaacaacaaagaaaattgtattgaagctgcaatgtcagtcttgcaaacattattcccaacatccgatcaagcgatgcaagcacttcgaaattggtggggacaagaaaggaaagggcacatctctgttctaggcgctttcatgccagtggatattgatgtcatcctataaggctatatgtagaactgtcaaaacataagggtgtttatggggatgcagttaattcttccgattcaatacttcaaaatttctttttatgaatggtttacattaaaatatgtctgccaagtagataatcttgtagcaaattgtcaactagtacagtaggaaaaactaagtttttataaatagaagaccttctgaagccttgagttccaccgttgaattatttatacaatataagactttcgtggttttcttggctttcattatctagagtctggacccagctgattttgattcctgagatagaaagaaattagagtataactaagcttgtatttcctttgcagattgtagatttatag

SEQ ID NO: 3396 - DNA, 550 bp, Senecio madagascariensis
agcgtggtcgcggccgaggtacgcgggggctgttaatctcatttttctcccggaattccagccatggtgaacgttcctaagacgaagaagacttactgcaagaacaaggaatgcaaaaagcataccttgcataaggtgacacagtacaagaagggaaaggatagtttggctgctcaaggaaaacgtcgttatgacaggaagcaatctggttatggtggtcagactaagcccgtctttcacaagaaggcaaagaccacgaagaagattgtgctaaggttgcaatgccagagttgcaagcacatgtctcagcacccaattaagaggtgcaagcattttgaaatcggtggagacaagaagggcaagggaacttctcttttctaagcagttttgtgtacttatgtttcagcagttacttatatttttgttttagcagactttttatgttacgtctttaaaatttacaatgcaagtgttctttttgattagtgatgtttttgttattatttgacttaattttcttgtcttttctttacaaatgatgcgtttcatt

SEQ ID NO: 3397 - DNA, 460 bp, Thalictrum flavum
tggtgtgcgactgaaggagatacatatcggcataaaccctagctttcgatctacttacagtcatggttaacgttccaaaaacaaagaagacatactgcaagaacaaggaatgtaagaagcacaccctgcacaaggtcactcaatacaagaaaggaaaggacagccttgcagcccagggaaagcgtcgttatgatcgtaagcagtcaggatatggtggacagactaagcctgtcttccacaagaaggccaagactacaaagaagattgtgttgaggcttcaatgtcagagctgcaaacatgtatcacagcatgcactcaagagatgcaagcattttgagattggtggagacaagaaggggaagggaacttctctcttttagatggggtgttcatttagtatcttcgtcattacttggctgtgttatgttttattgctttatcattatctgatatattaatg

SEQ ID NO: 3398 - DNA, 563 bp, Fagus grandifolia
cgccactcagtcattcagatcatcatggtgaacgttccaaagacaaagaagacatactgcaagagcaaggaatgcaagaagcacaccttgcacaaggtgacgcagtacaagaagggcaaggatagccttgctgctcagggaaagcgccgttacgatcgcaagcaatctggttatggtggtcagaccaagcccgtcttccataagaaggccaagactaccaaaaagattgtgctgcgtttgcaatgtcaaagttgcaagcatatgtctcagcatgcaattaagcgatgcaaacatttcgaaattggtggtgacaagaaaggaaaagggacctcgctttttaagctcacattatcgtgttatttttattgttggttagttttctctaaagaaaatgtttggcaggattatgtagtttaatttctgctttaagtttatgttcgtgttattatgttgggattatacttgctttcctgctaaagaatttgtgcattcttagtgaatgttttcaacattgttaaaggttttcaaatagaagcattggccagtgttgaatggaaaaaaaa

SEQ ID NO: 3399 - DNA, 559 bp, Humulus lupulus
ctgctcccgttcctctcaggctcgcacatctcaactcggctccggcggcggcggcggctccggctctgttagcagacatggtgaatgttcccaagaccaagaagacttactgcaagaataaggagtgcaagaagcacacccttcacaaggtgactcaatacaagaagggcaaggatagtcttgctgctcagggtaagcgtcgttatgaccggaaacagtcccggttatggaggtcagaccaagccagtctttcacaagaaggccaaaaccaccaagaagattgttcttaggctgcagtgccagggttgcaagcatgtctctcagcacgcaatcaagcgttgcaagcattttgagataggaggagacaagaagggaaagggaacttctcttttctaaatttgtgttactatgtctatttttgtttttatggatcttgaaatagagttatgggatatttgttaacctagacatgttgtcatgttaaagatcgattttgtttgttgaactttgtcaatgttattcttcttaaggttccgataagattttaaatgctgtgctt

SEQ ID NO: 3400 - DNA, 437 bp, Humulus lupulus
tttcattcggtccctctgctcccgttcctctcaggctcgcacatctcaactcggctccggcggcggcggcggctccggctctgttagcagacatggtgaatgttcccaagaccaagaagacttactgcaagaataaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaaccaccaagaagattgttcttaggctgcagtgccagggttgcaagcatgtctctcagcacgcaatcaagcgttgcaagcattttgagataggaggagacaagaagggaaagggaacttctctttttctaaatttagtgttactatgtcattttgt

SEQ ID NO: 3401 - DNA, 575 bp, Humulus lupulus
tttcattcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccgggaaacagtccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtcatttttgtttttatggtatcttgaatagagttatgggatatttgttaacctagacatgttgtctatgttaaagatcgattttgtttgttgaactttgtcaatgttattcttcttaaggttctgataagattttaaatgctgtgcttt

SEQ ID NO: 3402 - DNA, 578 bp, Eragrostis curvula
tacgggttgcgcgccagcctaggttatcgttcggctccccgcgtccgcgcacaggagagaaccgcggtcgacagcctggtgaacgtccaaaaccaagaagacctactgcagaacaaggagtgaagaagcacaccctgcacaaagttacgcagtacaagaagggaaaggatagcctttcagctcaagggaagcgtcgttatgaccgcaagcagtcaggatatggagggcagacaaagcctgttttccacaagaaggccaagacaacaaagaagattgtgctgaagctgcagtgccagagctgcaagcactactcccagcacgccatcaagagatgcaagcacttcgaaatcggtggagacaagaagggcaagggaacctctctcttttaatttgatgataggagcccactgtctagttgtaggtcaggagctactgttaaaatgtttcatcttgttccttgtggagatacatcaggtagattatctctgggatagttttgaaccatatgtttccaattagcattagctattttaaaatcttgaaatacatgttcaggcaattgaattctcatattgctg

SEQ ID NO: 3403 - DNA, 411 bp, Elaeis guineensis
aacgatggtgaacgttccaaaaaacaaagaagacttattgcaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttgaaattggtggagataagagggcaagggacgtctctcttctagtgggcttctaccgtttcgggggtcgtcacttggttatctgtgtgttctagggaaatgctgatctaacccattaaatcggcactatatttt

SEQ ID NO: 3404 - DNA, 450 bp, Secale cereale
ctttcagctttcggcggcggcggcgcactcctcgtgttctcacccaggcgcgcactcctcctcctcctccactcgccgtcgtcgtctcggatccgcagccatggtgaacgttccgaagaccaagaagacctactgcaagaacaaggagtgcaagaagcacaccctccacaaggttacccagtacaagaaaggcaaggatagcctttctgctcaagggaagcgtcgttatgaccgcaagcagtctggatatggtggccagacaaagcctgtttccacaagaaggccaagacacaaagaagattgtgctgaagttgcagtgccagagctgcaagcattactcacagcgcgccatcaagaggtgcaagcacttcgaaatcggtggagacaagagggcaagggacatctctcttctaagctgatgatgtcgctgttatgtttagattgttgtgc

SEQ ID NO: 3405 - DNA, 545 bp, Cucurbita pepo
atgtcataccatttggtcgccgatagggttcttctagagctagtaaggaccagaagccgccatggtgaacgttcccaagacgaagaagacttactgcaagagcaaggaatgcaaaaagcataccttgcacaaggttacccagtacaaaaagggtaaggacagtcttgctgcccaaggaaagcgtcgttatgatcgtaaacaatcaggatacggaggccagaccaagcccgtctttcacaagaaggcaaaaactaccaagaagattgtgctgaggttgcaatgccagggttgcaagcatgtgtcacagcatgccattaagagatgcaagcattttgagattggtggagacaagaagggaaagggaacttcactttttagatgctttaacattgtcattcactatatattggtttttagggagccaaaattgtgggtttcttctgccctatgcttttgtttggttattctgatatttgtgaacactttacctgttgaatttgtttaatgcatcagtttattaatggaacaactagctagccacttcc

SEQ ID NO: 3406 - DNA, 499 bp, Cucurbita pepo
agagctagtaaggaccagaagccgccatggtgaacgttcccaagacgaagaagacttactgcaagagcaaggaatgcaaaaagcataccttgcacaaggttacccagtacaaaaagggtaaggacagtcttgctgcccaaggcaagcgtcgttatgatcgtaaacaatcaggatacggaggccagaccaagcccgtctttcacaagaaggcaaaaactaccaagaagattgtgctgaggttgcaatgccagggttgcaagcatgtgtcacagcatgccattaagagatgcaagcattttgagattggtggagacaagaagggaaagggaacttcactttttagatgctttaacattgtcattcactatatattggtttttagggagccaaaattgtgggtttcttctgccctatgctttttgtttggttattctgatatttgtgaacacttttacctgttgaattttgtttaatgcatcagtttataatggaacaacta

SEQ ID NO: 3407 - DNA, 467 bp, Humulus lupulus
tagcagacatgggtgaacgttcctaagaccaaaaaaaacttactgcaagaataaggagtgcaagaagcacacccttcacaaggtgactcaatacaagaagggcaaggatagtcttgctgctcagggaaagcgtcggtatgacaggaaacagtctggttatggaggtcagactaagccagtctttcacaagaaggccaaaaaccaccaagaagattgttcttaggctgcagtgccaaggttgcaagcatgtctctcagcacgcaatcaagcgatgcaagcatttcgagataggaggagacaagaagggaaagggaacttctctcttttaaatttgtgttactatgccatttttgtttttatggatcttgaaatagaattatgggatatttgttaacctagacatatgctgtcatgttaaacatcgattttgtttgttgaactttgtcaatgttattattcttaaggtt

SEQ ID NO: 3408 - DNA, 561 bp, Humulus lupulus
ttcattcggtccctctgctcccgttcctctcaggctcgcacatctcaactcggctccggcggcggcggcggctccggctctgttagcagacatggtgaatgttcccaagaccaagaagacttactgcaagaataaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgcaatcaagcgttgcaagcattttgagataggaggagacaagaagggaagggacttctcttttctaaatttgtgttactatgtcatttttgttttatggatcttgaatagagttatgggatatttgttaacctagacatgttgtcatgttaaagaatcgattttgtttgtttgaactttgttcaatgttattcttcttaaggttccgataagattttaaat

SEQ ID NO: 3409 - DNA, 501 bp, Humulus lupulus
ttttcattcggtccctctgctcccgttcccctcaggctcgcacatctcaactcggctccggcggcggcggcggctccggctctgttagcagacatggtgaacgttcccaagaccaagaagacttactgcaagaacaaggagtgcaagaagcacacccttcacaaggtgactcaatacaagaagggcaaggatagtcttgctgctcagggtaagcgtcgttatgaccggaaacagtaccggttatggaggtcagaccaagccagtctttcacaagaaggccaaaaccaccaagaagattgttcttaggctgcagtgccagggttgcaagcatgtctctcagcacgcaatcaagcggtgcaagcattttgagataggaggagacaagaagggaaagggaacttctcttttctaaatttgtgttgctatgtcattttttgttttatggatcttgaaatagagttatgggatatttgttaacctagacatgttgtcatgttaaag

SEQ ID NO: 3410 - DNA, 495 bp, Lolium multiflorum
ctcattcacgagcgcagttagggttttccgcacagagctcgcgccgccgccaagaacagaccaaggccggaggaagcaacaccgcggtagccatggtgaacgttccaaaaacccggaagacctactgcaagaacaaggagtgcaagaagcacacgcttcacaaagtcactcaatacaagaagggaaaagacagcctctctgcccagggaaagcgtcgttatgacaggaagcagtcgggatatggtggtcagaccaagcctgttttccacaagaaggcaaaaaccactaagaagattgtgctgaagctgcagtgccagagctgtaagcaagcgtgccatcaagaggtgcaagcactttgagatcggtggagataagaagggcaagggaacatctctcttctaaatagctttcacctatctgtagttgtggtggtcaacaacatgtcttatgattttgatgctagaagttaaattataacagaccttgtcacgtatg

SEQ ID NO: 3411 - DNA, 888 bp, Zea mays
caacatgatgcccctaatttgatcaactcacatcgacatgcagtgcctaaactcaatcagagttgggattcactctgtgtgcatcaaacacatacttctagccccatgcccccatgttaaaagtgtttcaattgaccctccaaataataatttatccagatgcctaaagaaagactcttggagatggatatgaaatgttgttttaacatgtgtagtttgtttcacatgttatataggtgaacgttcctaagaccaagaagacgtactgcaagaacaaagagtgcaagaagcacaccgtccacaaggtgactcagtataagaagggcaaggatagcatgtctgcccagggaaagcgtcgttatgaccgcaagcagtcaggacatggtggtcagaccaagcctgtcttccacaagaaggccaagaccaccaagaagattgttctgaagctgcagtgccagagctgcaagcactactcacagcacgccatcaagaggtgcaagcattttgagattggtggagacaagaatggcaagggcacgtctcttttctaagcttcttgtccacctatctggttgttgagttgaagctatgggtctactactactgttctaaaaacctgtcgccaaatttcaattttaacgtagcaatgaaagcagaccatgctatgtatccaaattccaatgtctgacatttgttctggggtgttggtcgacttttggctaaatgaaagttttgtatcttgaatatgttttgtgtttgattttgttttgccattgcctatgtctgttcttgtgccaaaaaagttcgatcatttttacactgaggatggattacataatgtatctgactggatggaatcacgtagaatggacatatgtagttatgtgt

SEQ ID NO: 3412 - DNA, 679 bp, Pinus pinaster
tgagcggcgagtaacgaaagcacagaggaggacgacgagattactaaccggactgcgtccgcatcgtagcaatggtcaatgttccgaagaccaagaaaactttttgcaagaacaaagcttgcaaaaagcacactgtgcacaaggttactcagtataagaaagggaaggacagtctttctgctcaagggaaacgacggtatgatcgaaaacaatcaggttatggaggccagacaaaacctgtgtttcacaagaaggcaaaaacaacaaagaagattgtgttgaagctgcaatgtcagtcttgcaagcattattctcaacatgcaatcaagcgttgcaaacattttgagattggtggagacaagaaggggaaggaacctccttttttaaacttcagctttgttgcagccttatgtccatcattttacattcttgttcgcatgtctgtcgaaggacagaaattttgttgtgttgtttattagtagatagagtcaaccaaccgaagatgccaatttaacttttgcctttgtcttaatgtctcttgcacttaatttaaagaacaaatccttggatccaaatcttgcttggttatgttctccggttactttatgttaaaactatttttcggtccctgaatgtgcaagttttcacatagttgataatgacaatgatggctattgcg

SEQ ID NO: 3413 - DNA, 1809 bp, Pinus taeda
atataagcttagttatattctagtttatctgtatttcagaaatgaaatcagttaggtttagactatataatataagctgagaaaatccgcagacgtcttttctatgaatatttaagagtggagttcaaagcttcacaaggttctatttataaaagctcagctttacctgctatactcgtttacaatttgctacaagattatctacttggcagacatatttcaatgtaaacttttcatgaaaagaaaacctaaagtattgaatcagaagaattaactgcaaatccaaaacaccctgatgttttgacagttctacagataggaagacattgttatccactgatgggaatgcacctagaagagagatgtgccctttcctttcttgtccccaccgatttcaaagtgcttgcatcgcttaatcggatgttgggaataatgtttgcaagactggcattgcagcttcaacacaatcttctttgttgttttggccttcttgtgaaagacaggctttgtttgacctccataaccagattgtttcctgtcataacgtctctttccttgtgcagaaagactatcctttcctttcttgtactgtgttactttatgcacagtgtgctttctgcaagctttattcttgcagaaagttttctttgtcttaggtacattcaccattttgggtttctgaactgactccgcctcaacaatcctgttgactcctgttgtttgttgttgctactcctcttctttttcgttgaactcaaggcagccacaatagccagaagaccatcaacaaattcgaagattacagagacatggtaaaggctaaagccaacaagtcagccaagaagcacccaaggtgcatagcagatggcaacgaactacttcgtttccactgcatcacattctcttgttcactgggtatgaatggattaactaacctatgcaacattccatcctgcaatgtctgcaatatcatccgacatggattctcctcaaaagttgagaatggaaaaggaatttacaccaccgcaagcagtggaaaagcccatgattccattgaggtatcagaggaggatgaatcaaaggataagagagcaatgctagtttgcagagttattgcagggcgggttaacaagtcccaagacccagatgagtgtttcaatggtggatatgattcattagcaggtcaggcaggaatctactctaatctggatgagttatttgtgtttaatcctaaggcagtgcttccttgctttgttgtgatgtataaggtctaaaaaaacagctgactgttttaaccttacgtatactgattggcccatttcttgtgtttggacttattttagttacctgtcatatttgtttgtggttttgtaagcaaccccacagcctgatcttcttgtttgccctcattcattactctaaatcttccattgtaagagatggatgttggtagagtatttgaattctttggacaggttaatacctttagtgtgctgcattatgacttttttaatagtgaccatatattaggaagctgataaagagtgtatagagctggcagcgtcttgctgcaatgtggttcccagtggtttgaagattctcttagagaagagaggattaaaagtgactgttgaatatgcagaggatgtacatgtaattagttgtagaatggataatatatcaatacaaagttgtgttatcaaagacactgatttgtttctccacttgtatatatatactcaaattcctaataaaaggcagggatgattatgttgttttaaatcatgtataagatgcagttgcatccaa

SEQ ID NO: 3414 - DNA, 620 bp, Zostera marina
gaacactaattataaattccaaataaccccaactcaagaccctaaacttaataaaaagtaaacaacacatgcagtaaagcaattctgaacttgaacaccaaacaaaatcagggatgaaaaggaacatgaataaaataggtcaagcaattctgcaccaacaattttcaccaagtcgaatacatagcaaacaaaaattcagataccaatcttaacttcttgatgaaacataaaaggaatatattaaaaaagaggagataattaaaatagagatgtccccttgcctttcttgtctccacctatctcgaaatgcttgcacctcttgataggatgctgtgacatatgcttgcagctctgacattgcaacctcaacacaatcttttttgttgttttagccttcttgtgaaagacaggcttggtctggccaccatatcctgactgcttacgatcgtaacgtcgttttccctgcgcagcaagactgtctttgccttttttgtattgtgtgaccttgtgtagggtatgttttttgcattgcttgttcttgcaatatgtcttcttggtcttaggcacgttaaccataatgtcgccggcaagagaagaaaccctaaacacgatctgaaatc

SEQ ID NO: 3415 - DNA, 628 bp, Amborella trichopoda
tttttctttttgctcattctgagatagtttgggtttccaagttcgcccaagctgagcctttcgttcctctgcaacgcaaaaatggtgaacgttccgaagactaagaagacctactgcaagaacaaggaatgtaaaaaacataccttacataaggttacacaatacaagaaaggcaaggacagcctggctgttcaagggaaaaggcgctatgatcggaagcaatctggttatggaggtcagactaagccagttttccacaagaaggctaaaacaactaagaagattgtgcttaggctgcaatgccagagttgcaaacatgtttctcaacacccaatcaagaggtgcaagcacttcgagattggtggcgacaagaaggggaagggaacctcactattctagtttaggatatttgtcctggcgcgtttgatgctttctttttaatatgaagtaaaccttgtttttttgttagttttgttgaacttcttgttgcttttgaagtcagacagtttctcggtaattcagagaagtctcttggaagatgtagctcattttcggttttcatttgaagatgatgttcaattttatagaagtcaccatagaaattcaaaaaatatgagaaacgaaaaaa

SEQ ID NO: 3416 - DNA, 530 bp, Cannabis sativa
gctcaggtttccctcacccttctcaactcgtcggcggcgtctcctccactagcagacatggtgaacgttcctaagaccaagaagacttactgcaagagcaaggagtgcaagaagcacacccttcacaaggtgactcaatacaagaagggaaaggatagtcttgccgcccagggtaagcgtcgttatgacaggaaacaatccggttacggaggtcagaccaagccagtctttcacaagaaggccaaaactaccaagaagattgtgcttaggcttcagtgccaaggttgcaagcatgtctctcagcacgcaatcaagcgttgcaagcattttgagataggtggagacaagaaaggaaagggaacttctctgttttagatttgtgttactgtgtcatttttgtttttatggatgttgaaatagagttatggggatatttgttaacctagacatatgttgtcatgttaaacatcgattttgtttgttgaacttttgtcaatgttattcttcttaaggttcctattagagttgaa

SEQ ID NO: 3417 - DNA, 578 bp, Papaver somniferum
gctctacctctcgagttgcagccatggtgaatgtgccaaagacaaagaacacatactgcaagaacaaggagtgcaggaagcacactctgcacaaagttactcagtacaagaagggtaaggatagtcttgcagcccagggaaaacggcgttatgatcgcaaacaatctggttatggaggacagaccaagcctgtcttccacaaaaaggcaaaaaccacaaagaagattgtgctaaggcttcagtgtcagagttgcaaacacatgtcccagcacgcaatcaagaggtgcaagcattttgagattggtggagacaagaagggaaagggaacttcacttttctagaagctggagtcgtctacttattgcttgtttcttttcagtgttttggtattagatatgccattgaaacatattctagctggtgtaattttgacttatttctttttagaaagaatatatgctacatagaagaattttgatgtttatgctatggctagtttagactgcaaaatattgggtttgtgtcaactttttaacattgaatagaaacaaagttaatgactaaaaaaaaaaaaaaaa

SEQ ID NO: 3418 - DNA, 617 bp, Papaver somniferum
tttcggtttcttacactttctgaaaccctagaagagctctctcgttccgtcatctactagcagtcatggtgaacgttcccaagacaaagaacacatactgcaagaacaaggaatgcaggaagcacaccctgcacaaggttacccaatacaagaagggtaaggacagtcttgctgcacaaggaaagcgtcgttatgaccgtaaacaatcaggatacggaggacagacaaagcccgtctttcacaagaaggccaagactaccaagaagattgtgttgaggcttcaatgccaaagctgcaagcatatgtctcagcatgctatcaagagatgcaagcattttgaaatcggtggagacaagaagggaaagggaacatctctcttttaggctgctgttgcttatttctaggacttcatcttgcatatctagtgttttgttgttgctcaaccttatttgactcaactttgagtttgaaattacctctactctagtttataaatttttgagcattgtcttttactagtacattgaatgcaagttattagactcaattggtatgcctctcgctcctattctattcttgtgtcctggtgcttaatattgaggttattatattcactg

SEQ ID NO: 3419 - DNA, 831 bp, Picea glauca
acatccccgggttcggagaggcagttaagaggggtattgattttgctattgcggctacttgaattataaggaggaagaagaggaggaacagcaacagcaggagtcaacgggatcgttgaggcggagtctgttcacaaacccaaaatggtgaacgtacctaagacaaagaaaactttctgcaagaataaggcttgcaaaaagcacactttgcataaagtaacgcagtacaagaaaggaaaggatagtcttgctgtacaaggaaagagacgttatgacaggaaacaatctggttatggaggtcaaacaaagcctgtctttcacaagaaggctaaaacaacaaagaagattgtgttgaagctgcaatgccagtcttgcaaacattattcccaacatccgatcaagcgatgcaagcactttgaaattggtggggacaagaaaggaaagggcacatctctcttctaggtgcattgccatcagttgatagcgatgtcttcctacctgtagaactgtcaaaacataagggtgttttatagatgcagttaactctactggttcagtactttaaattttcttttcatgaatactttaccttgaaatatgtctgccaagtagataatctcgtagcaaactgtcaatgagtatagtaggaaaaaccgagtttttgtaaatagaaccttatgaagctttgaaattcactcttaaattattcatagaagatgagacctctgtggatttttctcagcttacattatctagagtataggcctaactgatttttattcgtgaaatagaaagaaattagaatacaactaagcttatatttcctacata

SEQ ID NO: 3420 - DNA, 690 bp, Abies balsamea
aaagcctttccgattcatcgtgttgcattgatcggatagcaaggaaagcagagaggaggacgacgaggtcattagcggctccgcgtctgcatcgtagcaatggtgaatgttccgaagaccaagaaaactttttgcaagaacaaagcttgcaaaaagcacactttgcacaaggttactcagtataagaaaggcaaggacagcctttgtgttcaaggaaaacgacggtatgatcgaaaacaatcaggctatggaggccaaacaaaacctgtgtttcacaagaaggcaaaaacaacaaagaagattgtgttgaagctgcaatgccagtcttgcaaacattattctcaacatccgatcaagcgttgtaaacattttgagatcggtggagataagaagggaaagggaacgtcccttttctaaactttcagctatgttccagctttatatcaaaccattttacattcttgtttgcatatctgtctgagggaataagttttgttatgtcgtttattactagattgagtataccaactgaagatggcaatctaattttgcctttatcttaaggtctcttgcaatttatttataaaacaaacatttggattcaaagcttgcttggttctgttttctggttacgctatgaaaactattcttctgttgtcggccatttttttaaccatgattttaccaatt

SEQ ID NO: 3421 - DNA, 793 bp, Abies balsamea
ggaaaccctacaacacgaggtccaagaggcagtgaagacggtcttcttgttgctattgcggccgtctcgagttcgaggacaaagaagagtaggagcagcagcagcagcaggaggattcagcagtacacttgaggccgaacctgttcagaaagccaaaatggtgaatgtacccaagacaaagaaaactttctgcaagaacaaggcttgcagaaagcacactttgcataaagtaacacagtacaagaaaggaaaggatagtctttccgtacaaggaaagagacgttatgacaggaaacaatctggttatggaggtcaaacgaagcctgtctttcacaagaaggctaaaacaacaaagaagattgtgttgaagctgcaatgtcagtcttgcaaacattattcccaacatccaatcaagcggtgcaagcactttgaaattggtggggataagaaaggaaagggcacatctctcttctaggtgcatttgcgtcagtggatagtgatgccatcatatctgtagaactgtcaaaacataagggtgttttttgtagatgcatttaattcttctgatttaatacttaaattttcttttcatgaatagtttatagtgaaatgtctgccaagtagataatcttgtagcaaactgtcaatgagcatggtatgaaaagtgagtttttaaaactagaaccttccgaagctttgaagtctactgttgaattattcctaaaagataagacttctgtggatttttctcatctcatattatttagagtttattacccaactgattttgggc

SEQ ID NO: 3422 - DNA, 1099 bp, Amborella trichopoda
agccctagcagaacctcgccgcactgtgaaacagcagccgcgaatttcgttgtttttgtgccttaattttattgtggtgctgcttcgctctctgaaaaaatggtcaacgttcctaaaacgaagaaaacttactgcaagaacaaggaatgcaaaaagcataccttgcataaggtcacccagtacaaaaaagggaaggatagccttgctgtccaaggcaagagacgatacgaccgcaagcagtcaggttatggtggtcagacaaaacccgttttccataaaaaggcaaaaacaactaagaagattgtgttgaggctgcagtgtcaatcatgcaagcatgtctctcaacatcccatcaagcgatgcaagcattttgaaatcggtggggacaagaaaggaaagggcacgtctctcttctaaggtggggtatgctgttatctcaagatgtttttctatgttcacatgagcatttgttttctctatcggatcaacggattgtcaaaacggttttagttatacatgagacatctcagactcttcttttgtttgttgtcccactcaattttttttctgggaaatttcaacttcttaaaagttcaatagctatatgaatacagaagagtgtgatgggtactcagcctggttctgagccgaagggaatctgtgattgctttttggagcgacttactatgatttggaatggagtattactaaatatgaaaccagtggggtcaacaggctgggacagccctagaggcctggccacatgccgcaggcccttttggcagatggatggcgttggtccggccttcctatgatttggaatggctttccaaatatgaaaactggggaagcaaggcatacacctctagtgactgtgttacaccaccattattccatagtccattcatggtgatggttggtatatatgatctgcagtttttgatgatgaccgttcacctaaattttgtaaatcaccactaattgtcattaagaatggatggtggatgtaccgtgtaccattagctggtatatgctctacttttgcgaaaactaaatgaaattgcatggggacgttagtaaatatgtatctttttaatgg

SEQ ID NO: 3423 - DNA, 589 bp, Amborella trichopoda
gtgaacagcagccgcgaatttcgttgtttttgtgccttaattttattgtggtgctgcttcgctctctgaaaaaatggtcaacgttcctaaaacgaagaaaacttactgcaagaacaaggaatgcaaaaagcataccttgcataaggtcacccagtacaaaaaagggaaggatagccttgctgtccaaggcaagagacgatacgaccgcaagcagtcaggttatggtggtcagacaaaacccgttttccataaaaaggcaaaaacaactaagaagattgtgttgaggctgcagtgtcaatcatgcaagcatgtctctcaacatcccatcaagcgatgcaagcattttgaaatcggtggggacaagaaaggaaagggcacgtctctcttctaaggtggggtatgctgttatctcaagatgtttttctatgttcacatgagcatttgttttctctatcggatcagcggattgtcaaacggttttagttatacatgagacatctcagactcttctttttgtttgttgtcccactcaattttttttctgggaaatttcaccttcttaaaagttcaatagctatatgaatacaga

SEQ ID NO: 3424 - DNA, 528 bp, Ambrosia trifida
gcggttgttcctctcatctttctattgggtgcctttcaggaagcttttcagccatggtgaacgttcccaagacgaagaagacttactgcaagaacaaggaatgcagaaagcatacattgcataaggtgacccaatacaagaagggaaaagatagtttggctgcacaaggaaagcgtcgttatgacaggaaacaatctggttatggtggtcaaacaaaacccgtgtttcacaagaaggcaaaaactaccaagaagatcgtgctaaggttgcaatgccaaagttgcaagcatatgtctcagcacccaatcaagagatgcaagcattttgaaatcggtggagacaagaagggcaagggaacttcacttttctaagcgatttgttgcacgcttgcagctactattcatattttggttttagcagacttttgtgttttaagatattgaaatttatattgcaagtgcctattttgccttgacacatctgtctagaggaatggtaattttgtgtttttactgtttaaaaagaaaa

SEQ ID NO: 3425 - DNA, 433 bp, Ambrosia trifida
ctaactctgcttgtcttcccatctatcatacggccgttctgttcatcaaagatcttcagccatggttaacgttccaaagactaagaagacttactgcaagaataaggagtgccgaaagcacaccttgcataaggtgacacaatacaagaaggggaaagatagcttggctgctcaagggaagcgtcgttatgacaggaaacaatcaggttatggtggtcaaaccaagcccgtctttcacaagaaggcaaagaccacgaagaagattgtgctgaggctgcaatgccaaagctgcaagcatatgtcccagcacccgatcaagagatgcaagcattttgaaatcggtggagacaagaagggcaagggaacctcacttttctaagtaataatagttatgtgttattttgatacagttaagacctacagattttgcatc

SEQ ID NO: 3426 - DNA, 497 bp, Ambrosia trifida
aggattggtctctcatcctacactacagtttgtgttcattggaaatcttcagccatggttaacgttccaaagacaaagaagacttactgcaagaacaaggagtgcagaaagcacacattgcataaggtgacacagtacaagaagggtaaagatagtttggctgcacaaggaaagcgtcgttatgacaggaaacagtcagggtatggtggtcaaaccaaacccgtctttcacaagaaggctaaaaccactaagaagattgtgctaaggttgcaatgccaaagttgcaagcatatgtcccagcatccaattaagagatgcaaacattttgagattggtggagacaagaagggcaagggaacatcactcttttaggcaatacatgtgttattttaacatatttagacttacaaatgtttcaagtttttatgtaagtttaatgttgcaaactttgaaatggtgttttagattatactctttaaattaaaaaacgaacctat

SEQ ID NO: 3427 - DNA, 369 bp, Ambrosia trifida
cttcagccatggttaatgttccaaagactaagaagacttactgcaagaacaaggagtgccgaaagcataccttgcataaggtgacacagtacaagaaggggaaggatagcttggctgctcaagggaagcgtcgttatgacaggaaacagtcaggttatggtggtcaaaccaagcccgtctttcacaagaaggcgaaaaccacgaagaagattgtgctgaggctgcaatgccaaagctgcaagcatatgtcccagcacccgatcaagagatgcaagcattttgaaatcggtggagataagaagggcaagggaacttcacttttctaagtaataatagttatgtgttattttgatacagttaagacctaca

SEQ ID NO: 3428 - DNA, 535 bp, Ambrosia trifida
agcctcttaaaacatacatacacaccctaatagcgttgtgcggctgtgtgcatctcatctctatctgggtcgacttccagcaacccttcagccatggtgaacgttccgaagacgaagaagacttactgcaagaacaaggaatgcagaaagcataccttgcataaggtgacacaatacaagaagggaaaagatagcttggctgctcagggaaagcgtcgttacgacaggaaacaatctggttatggtggtcaaaccaagcccgtttttcacaagaaggcgaaaacgacaaagaagattgttctaaggttgcaatgccaaagctgcaagcatatgtcccagcacccaattaagagatgcaagcattttgaaatcggcggagataagaagggcaagggaacatctctcttttgatcggttttgtgtaattttgcttcagctactattcttatttgtgttttagcagacgtctcactgttttaagttttcggaacttgtaatgcaagtatctgttttgatttgacatgttgatttgggt

SEQ ID NO: 3429 - DNA, 588 bp, Ambrosia trifida
tagcgttgtgcggctgtgtgcatctcatctccctctgggtcgacttccagcaaccattcagccatggtgaacgttccgaagacgaagaagacttactgcaagaacaaggaatgcagaaagcataccttgcataaggtgacacaatacaagaagggaaaagatagcttggctgctcagggaaagcgtcgttacgacaggaaacaatctggttatggtggtcaaaccaagcccgtctttcacaagaaggcaaaaacgacaaagaagattgtgctaaggttgcaatgccaaagctgcaagcatatgtcccagcacccaattaagagatgcaagcattttgaaatcggtggagataagaagggcaagggaacatctctcttttgatcggttttgtgtaattttgcttcagctactattcttatttttgttttagcagacttctcaatgttttacgttttcggaacttgtaatgcaagtatctgttttgatttgacatgttgatttgggtaatccttgtgtgctttgcaagtccgaacacacctatctttgccaccacataaggcaggagagactgttttgacccaaaaaaaa

SEQ ID NO: 3430 - DNA, 407 bp, Ambrosia trifida
ctacagtttgtgttcattggaaatcttcagccatggttaacgttccgaagacaaagaagacttactgcaagaacaaggagtgcagaaagcacacattgcataaggtgacacagtacaagaaggggaaagatagtttggctgcacaagggaagcgtcgttatgacaggaaacagtcagggtatggtggtcaaaccaagcccgtctttcacaagaaggctaaaaccactaagaagattgtgctgaggttacagtgccaaagttgcaagcatatgtcccagcatccaattaagagatgcaaacattttgagattggtggagacaagaagggcaagggaacttcactcttttaagcaatacttatgtgttattttaatatatttagacttacaaatgtttcaagtttttat

SEQ ID NO: 3431 - DNA, 616 bp, Persea americana
atcttcttggccgaacgcagaatagaagcgatttccatacgtctctgccagttcggagccatggtgaacgttccaaagactaagaagacatactgcaagagcaaggaatgcaggaagcataccctgcacaaggttactcagtacaagaaggggaaggacagtctatctgttcaagggaagcgccgctatgatcggaagcagtctggctatggtggacagacaaaaccggtcttccataagaaggccaagactactaagaaaattgtgctgaggctgcagtgtcagagctgcaagcatgtatctcaacatgcaattaagaggtgcaagcactttgaaattggtggagataagaagggaaagggaacttctcttttctagattggtttttaagctgttatatgttttatctagttagccttgttggttatgttttgttcgcaacttggaatggttgaaaggattactctgagtgttccttatatgactccctagcaccttttttgtgaacctgaaaatctgtttagctgctttcattcgattccaagtgattttagggctttatcttgtgacttaagaaatagcattaaccctctgggatcatcaattttaaaccgtg

SEQ ID NO: 3432 - DNA, 1398 bp, Theobroma cacao
gatccgtgtgatctggtttccttttggcgcgggttcaacgggaagaggaaggttttttcattttcgatttcggatttcgaatttttatcaaaggctcggggggcacgtgagataagcgtgatgtgaacggaaaaagaaattgaaggccggcccgtggcccatggggagcaataaattgggcctgttgcaatttagatttggatcctttcaccgattcgattcataaactggggccagctgttaaaacccggctcttagtctgttataaaaaccctaaccctaacttcgcttatggggttttgctattcatttcttttctgtaacagagcagtttagagcttcggtttctctcccagcattttccacgatggtgaacgttcctaagacaaagaagacctactgtaagaataaggagtgcaagaagcacaccttgcacaaagtcacccaatacaaaaaggggaaggacagtcttgctgctcaaggaaagcgtcgttatgatcgcaaacaatcaggttatggtggacagacaaagccagttttccacaagaaggcaaagactactaagaagattgtgctgaggctacagtgccaggcttgcaagcatgtgtcacaacacccaatcaagagatgcaagcactttgagattggaggggacaagaaaggcaaggggacatctttattctaaatgaatcatttttgtcactatattattgtttcgcacttgttggaactgaagcaagcattgacttttgctgttttcattgcattgttgctaatttggtaatctcattcctaatggtgtctcctaatcaatttgatttgatagtatcagtttttattaggattaaaatttaaatgtcatttatattttctccaagagttctagagacacctgcaagttgattttgctcatattttccacataatcgatttgagatagggaaaggtttctataaacatctggtaaaaatatggcaggcatacttgctttctgtcaaatattaaaataactccataacatcttgtcgctgacaccttcgagaatccattgctttaacaaatcgcattgcttaacatacatcacacgaccaaaagagaaagttatggaagatctcgagggttgtgattggctaatctcattccttggagatcaacaaaagtttgaacatcaagaagtctggaaggaattttgcttgttttatgcggtaaacttgaagattgtgatcgagaatggcaaacatttttcacttgttggcatttaaggccaaagtgttactttgtgcctcagttatgtaggtatcacttggctccagttggctgatgttagccacctatcatgaagaacaggacgctcgtcttgttctggttcttgtagataaataaagatttcctgttcat

SEQ ID NO: 3433 - DNA, 680 bp, Cedrus atlantica
gaggattcaacaagacccttgaggcggtttcttttcagaaacccaaaatggtgaatgtacctaagacaaagaaaactttctgcaagaataaggcttgcagaaagcatactctgcataaagtaacacagtataagaaaggaaaggatagtcttgctgcgcaaggaaagagacgttatgacaggaaacaatctggttatggaggtcaaacaaagcccgtctttcacaagaaggctaaaacaacaaagaagattgtgttgaagctgcaatgtcagtcttgcaaacattattcccaacatccaatcaagcgatgcaagcactttgaaattggtggggacaagaaaggaaagggcacatctctcttctaggtgcatttacatcagtggatattgatgtcatcctgtctgtagaactgtcaaaacataagtgcgtttttaggagacacattcagttattctgattcaatacttgaaattttcttttcatgaatagtttacattgaaatatgtctcccaagtagataatcttgtagcaaattgtcaatgagtatggtaggaaaaagcaagtttctataaatggaacttctggaactttgaaccctaatgttgtcttattcctaaaagatgagacttatgtggatttttctcatcttacgttatctagagattagacccaactgattt

SEQ ID NO: 3434 - DNA, 483 bp, Cucurbita pepo
gttcatagaggtagtgtgaggtccagggcccatcatggtgaacgttcccaagacaaagaagacttactgcaagagcaaggaatgcaaaaagcataccttgcacaaggttacccaatataagaagggtaaggacagccttgctgctcaagggaaacgtcgttacgatcgtaaacaatcaggatatggaggacagaccaagcccgtctttcataagaaggccaaaactacgaagaagattgttctaaggttgcaatgccagggttgcaagcatgtgtcacagcatgccattaagagatgcaagcattttgagattggtggtgacaagaagggaaagggaacttctcttttttagatgcattaacgttgtcattcaccatgttttgctgcctagggagtctaaattgtggtttttatttttgtttgttgctctgatacttgggtacacttttacacgttgaatcttgtttaatgtatcatttgttt

SEQ ID NO: 3435 - DNA, 723 bp, Cucurbita pepo
tggtcggggcaacagatatataactctcgtttcgcctccatttcctactctcccatctgttagggtttttttcgggcaggtctcgtcgacgttcagcagccatggtgaacgttcccaagacaaagaaaacttattgcaaaagcaaggagtgcaagaagcacaccttgcacaaggttacacaatataagaagggaaaggatagtcttgctgcacagggaaagcgtcggtacgatcgcaagcaatcaggatatggaggtcagaccaagcccgtgtttcacaagaaggctaaaactaccaagaagattgtgttgaggctgcaatgtcagggttgcaaacacgtatcccagcacgctatcaagagatgcaagcacttcgaaatcggtggagacaagaaggggaagggaacatctcttttctagatccgttgtctgctcttagcttttgtgatttctttttactaaaatcaattgttatcggagatgttacagcattactctgtttggttcaccaattagttctaaatgtcgtaacaatactatttagcttaagccatcttatctcaatgatcaaatttccaaatttttttgcttttcgtttagttctagatttcgtttagttgttttcaaagaaacttgtgtttgaagtgctttcatagcataaccatttgattattgagaataattattgttagcttacatttagttcaggcaatgatattcatcc

SEQ ID NO: 3436 - DNA, 648 bp, Cucurbita pepo
ccattaattggggttttcgagcaggcctcgccgacgtccagccgtcatggtgaacgttcccaagacaaagaagacttattgcaagagcaaggagtgcaagaagcacaccttgcacaaggtcacacaatataagaaggggaaggatagtcttgctgcacagggaaagcgtcggtacgatcgcaaacaatcaggatatggaggtcagaccaagcctgtgtttcacaagaaggcaaaaactaccaagaagattgtgttgagactgcaatgccaaggttgcaaacacgtatcccagcacgctatcaagagatgcaagcacttcgaaatcggtggagacaagaaggggaagggaacttctcttttctagacccttcatcagttttatcttttgtcatttcttttcgtaagatcagttatggagattttgcagcattactctgttttgttcatgaattagctctacatgtcccaacgatactatttagctgaaactttctcatatttattgttgaattgtcaaagttttgatgctcttcgtttgatgtgttcagagtcgtttctcatagaaacttgttttgcatattcacatgatgaatcggtcctaactttccaaattatttttttcagtacaacaaagttggggtgttttac

SEQ ID NO: 3437 - DNA, 656 bp, Cucurbita pepo
tttttcgggccggtctcgtagacgttcagcagccatggtgaacgttcccaagacaaagaaaacttattgcaaaagcaaggagtgcaagaagcacaccttgcacaaggttacacaatataagaagggaaaggatagtcttgctgcacagggaaagcgtcggtacgatcgcaagcaatcaggatatggaggtcagaccaagcccgtgtttcacaagaaggctaaaactaccaagaagattgtgttgaggctgcaatgtcagggttgcaaacacgtatcccagcacgctatcaagagatgcaagcacttcgaaatcggtggagacaagaaggggaagggaacatctcttttctagatccgttgtctgctcttagcttttgtgatttctttttactaaatcaattgttatcggagatgttacagcattactctgtttggttcaccaattagttctaaatgtcgtaacaatactatttagcttaagccatcttatctcaatgatcaaatttccaaatttttttgtctttcgtttagttctagattcattagttgttttctaaagaaacttgtgtttgtaagtgctttcatagcataaccatttgtattattgagaataattattgttagcttacatttagttcaggcaatgatattcatcc

SEQ ID NO: 3438 - DNA, 533 bp, Euphorbia peplus
atatcgctgctgtaatcatctcgtggtttccttgaggaagataagcataatggtgaacgttcctaaaacaaagaaaacctactgcaagagcaaggaatgcaagaagcacaccttgcataaggttacacaatacaagaaagggaaagattctctttctgcacaagggaaaagacgttatgatcgcaagcagtcaggatatggtgggcagactaagcctgtttttcacaagaaggctaaaaccaccaagaagatcgttctgaggctgcaatgtcaaggctgcaagcatgtgtctcagcatccaattaagaggtgcaagcattttgaaattggtggagacaagaagggcaagggaacttctcttttctagacacaaatatgtattcagatgttgttgattttgttcaactgctatgtttgaggcaaaccggatctagaatttttgttgactttagttttctttttaatcatgttgtgattgctagacatctactgcatgtttattacgtgatgactttaattgcaaatttagattt

SEQ ID NO: 3439 - DNA, 516 bp, Zingiber officinale
  misc_feature (120)..(120): n is a, c, g, or t
  misc_feature (475)..(478): n is a, c, g, or t
  misc_feature (480)..(480): n is a, c, g, or t
tggtgaacgttcccaagacaaaaaaaacctactgcaagaataaagcttgcaagaaacacaccctccacaaggtcacacaatacaagaagggaaaagataggttgtcagctcaaggaaagngccgttatgacaggaaacagtcaggttatggtggacagacgaagcctgttttccacaaaaaggcaaaaacaaccaagaagattgtgttgaagctgcaatgccagagttgcaaacactactctcagcatccgataaagaggtgcaagcattttgagattggcggagacaaaaaggggaagggaacctcactcttctagttctgtcttttggacattttatgcaattttcaacttcacttataatggtagatctagtttgttattggagatcttgatgctagttattcgacaatttatttgtccttgcttgacatcatgaatgaacaagtaaaacgagtattaagttgccttttatnnnncntgtcttttatgatataaaagaatgtacttgcttttc

SEQ ID NO: 3440 - DNA, 579 bp, Ipomoea batatas
acgggccgctttaaagtactcgtgaagttggttgcagaacggcagtctcgtttagtctctcccaccctcaaccatggtgaacgttccaaagactaagaagacttactgcaagtccaaggagtgcaaaaagcacaccttgcacaaggttactcaatacaagaaaggaaaggattcccttgctgctcaaggaaagcgtcgttatgatcgcaagcagtctggttatggtggacagaccaagccagtgttccacaaaaaggctaagaccacaaagaagattgtgttgagattgcaatgccaagggtgcaagcatgtttcccagcatgcaatcaagagatgcaagcattttgagattggtggggacaagaagggaaagggaacatcccttttctaatttggaaatcagaacaattcgaatgttcttattttgttatggttataccccagttgaattttcccatggcttgggatttagttgtagcaaattgaatgccatgcccatgttctttgatacttattatgacagttattatctgtgtttcaactttcaagatctaaatatagttttgttattgctgtttc

SEQ ID NO: 3441 - DNA, 564 bp, Ipomoea batatas
ttacggccggggatatttctgcggcatttagctgaactgcataagctttccctactctgacctcttgccgtcaaccatggtgaacgttccaaagaccaagaagacatactgcaagtctaaggagtgcaagaagcacaccttgcataaggttactcagtacaaaaaaggaaaggatagtcttgctgctcaaggaaagcgtcgttatgatcgcaagcaatctggttatggtggacagaccaagcctgtcttccacaaaaaggccaagaccacaaagaagattgtcctgagattacaatgccagggatgcaagcatgtttcacaacatgcaatcaagcgttgcaagcattttgagattggtggagacaagaaggggaagggaacatctctcttttaaattgcaagttttgggaaatcagatgttttttttttcctttgtgctatgtcatcatggttgtttaagtcaaacaatttagctttgctgattttgttggttccattgtaatggtcagagttttgtagttgttgacgtttatcatgattgttattctattctaattttgtgga

SEQ ID NO: 3442 - DNA, 597 bp, Ipomoea nil
ggctctcttgagtctcggctgagggtttccggaagttggtctgcagaacggcaatctcgtttagtctctcccaccctcaaccatggtgaacgttccaaagactaagaagacatactgcaagtccaaggagtgcaagaagcacaccttgcacaaggttactcaatacaagaaaggaaaggattcccttgctgctcaaggaaagcgtcgttatgatcgcaaacagtcaggttatggtggacagaccaagccagtgttccacaaaaaggctaagaccacgaagaagattgtgttgagattgcaatgccaagggtgcaagcatgtttcccaacatgcaatcaagagatgcaagcattttgagattggtggggataagaagggaaagggaacctcccttttctaatttggaaatcagaacaatgcaaatgttcttattttgttatggttataccccagttgaattttcccatggcttgggatttagttgtagcaaattgaatgccatgcccatgttctttgatgcttattatgacagttattatctgtgtttcaactttcaagatctaaatatagttttgttattgctgtttcaaaaaaaaa

SEQ ID NO: 3443 - DNA, 537 bp, Ipomoea nil
gtcgagaaccgatatttttgcggcatttaggtgaactgcataagctttccctactctgacctcttgccgtcaaccatggtgaacgttccaaagaccaagaagacatactgcaagtccaaggagtgcaagaagcacaccttgcataaggttactcagtacaaaaaaggaaaggatagtcttgctgctcaaggaaagcgtcgttatgatcgcaagcaatctggttatggtggacagaccaagcctgtcttccacaaaaaggccaagaccacaaagaagattgtcttgagattgcaatgccagggatgcaagcatgtttcacaacatgcaatcaagcgttgcaagcattttgagattggtggagacaagaaggggaagggaacatctctcttttaaattgcaagttttgggaaatcagatgttttttttttcccctttgtgctatgtcatcatggttgtttaagtcaaacaatttagctttgcagattttgttggttccattgtaatggtcagagttttgtagttgacgtttatcatgat

SEQ ID NO: 3444 - DNA, 627 bp, Mimulus guttatus
acaaatatcagccgttcattagggtttcacattcacagtgcattttggagcaaacgttttctgagccgcagccatggtgaacgtaccaaagacaaagaagactttctgcaagtcgaaggagtgcaaaaagcacaccctgcacaaggttacccagtacaagaagggtaaagacagcttagctgctcaggggaagaggcgttatgaccgcaagcaatctggttatggtggtcagaccaagcctgttttccacaagaaggctaagacaactaagaagattgtgttgaggctgcagtgccagagctgcaagcatatgtcccagcacgcgatcaagaggtgcaagcatttcgagattggtggggacaagaaaggaaagggaacttcgctgttttaagtgcatctgttcggaaattggaactattggctttttgcatcgttttgttgaactatggaaatgttcttgctgttttagatttatgtttgttgaaatctcggatatcgtataactcggttttgtgtttactttattggattatgatttattttcagtagttaattaacgtcgtcactttacagttctcatctctcacaatatattgcaaggttacttaggctgtttttatgtggtct

SEQ ID NO: 3445 - DNA, 577 bp, Carica papaya
aatttataagttcgagcctgctcctgctctggtctgcttctccggacatcgagaagaacgagaaagcaaagcaaaatggttaacgttccgaagacgaagaagacatactgcaagagtaaggagtgcaagaagcacaccttgcacaaggtaacacagtacaagaaggggaaggacagtcttgctgctcagggaaagcgccgttatgaccgcaagcaatctggatatggtgggcagaccaagcccgtctttcacaagaaggccaagactaccaagaagattgtgttgaggcttcaatgccagagttgcaagcatgtgtcccagcacccaatcaagaggtgcaagcacttcgaaatcggtggagacaagaagggcaagggaacttctctgttctaaatctttttttctctggaaattttcatttttgctcatttgtcagaacttaaaagctagtacggataatctgtttttcacattttgtgttgttgattcaagattatgagttgttatggaaacagttattacgatatcgaaatcagttgacttctaggttttataatttgatggcattgggaattgg

SEQ ID NO: 3446 - DNA, 405 bp, Pisum sativum
caatggtgaacgttccaaagacgaagaaaacatactgcaaaaacaaggagtgcaagaagcacaccttacacaaagttacccaatacaaaaagggtaaagacagcattgctgctcaaggaaagcgtcgttatgatcgcaaacaatctggttatggtggacagaccaagcccgtctttcacaaaaaggctaaaacaactaagaaaattgtcttgaggcttcagtgtcaaggctgcaaacatgtttcccaacacgccattaagaggtgcaagcattttgaaattggtggtgataagaagggaaagggaacatctctgttttaggtggtggattagaattttacagtttaactgtgtttttctattgttcaaatccctgtctttttgattttgcagttgttgtttgaga

SEQ ID NO: 3447 - DNA, 542 bp, Pisum sativum
tttttcacggcgcacaacttcatcttccagatccgatccacgcgccgccaccatggttaacgttccgaagaccaagaagacctactgcaagaacaaggaatgcaagaagcacacactccacaaagttacccaatacaagaagggtaaggacagtatcgccgctcaagggaaacgtcgttacgatcggaaacagtccggttatggtggtcagactaagcctgtcttccacaagaaggctaaaaccactaagaaaattgttctgaggttgcaatgccagggatgcaaacatgtctctcaacatgccatcaagaggtgcaagcattttgagattggtggagacaagaaaggaaaaggaacatcactcttctagatggagaattaggatttgctgttttattgttatatttcctatgttggaatatgttttgttggattattgatttctgatagatatattttgttatttgaaatacttattgttattgactagtgaaagctattgctattatcaagttatctatcgatctgttgttgttttctct

SEQ ID NO: 3448 - DNA, 518 bp, Papaver somniferum
cagagaagctctctcgttccgtcatctactagcagtcatggtgaacgttcccaagacaaagaacacatactgcaagaacaaggaatgcaggaagcacaccctgcacaaggttacccaatacaagaagggtaaggacagtcttgctgcacaaggaaagcgtcgttatgaccgtaaacaatcaggatatggaggacagacaaagcccgtctttcacaagaaggccaagactaccaagaagattgtgttgaggcttcaatgccaaagctgcaagcatatgtctcagcatgctatcaagagatgcaagcattttgaaattggtggagacaagaagggaaagggaacatctctcttttaggctgctgttgcttatttctaggacttcatcttgcatatttagtgttttgttgttgctcaaccttatttgactcaattttgagtttgaaattacctctactcttagtttataaattttcgagcattgtcttttactagtacattgaatgcaagttattagactc

SEQ ID NO: 3449 - DNA, 482 bp, Salvia sclarea
ctactagaccttggctgtcactcagacggctgaacttgcaggaaacctaatcacactttcccagtgctcctctctccgccgcagccatggtgaacgttccgaaaaccaagaagacttactgcaagtcgaaggaatgcaagaagcacaccttgcacaaggtcacccaatacaagaagggtaaggacagcttagctgctcaggggaagcgtcgttatgaccgcaagcagtcaggttatggtggccagaccaagcctgtcttccacaagaaggctaagaccacaaagaagattgtgctgaggttgcagtgccagggttgcaagcatgtttcccagcacgcgatcaagaggtgcaagcactttgaaattggtggagacaagaagggcaaaggaacatccctcttctaagcttatcatttcttgttcttttgtgatcttggttttgacatttttggttggctttcgcagtgagtgacaggctagtag

SEQ ID NO: 3450 - DNA, 1055 bp, Picea glauca
ggaaacatggactctcctttcaaaccctacatccccgggttcggagaggcagttaagaggggtattgattttgctattgcggctacttgaattataaggaggaagaagaggaggaacagcaacagcaggagtcaacgggattgttgaggcggagtctgttcacaaacccaaaatggtgaacgtacctaagacaaagaaaactttctgcaagaataaggcttgcaaaaagcacactttgcataaagtaacgcagtacaagaaaggaaaggatagtcttgctgtacaaggaaagagacgttatgacaggaaacaatctggttatggaggtcaaacaaagcctgtctttcacaagaaggctaaaacaacaaagaagattgtgttgaagctgcaatgccagtcttgcaaacattattcccaacatccgatcaagcgatgcaagcactttgaaattggtggggacaagaaaggaaagggcacatctctcttctaggtgcattgccatcagttgatagcgatgtcttcctacctgtagaactgtcaaaacataagggtgttttatagatgcagttaactctactggttcagtactttaaattttcttttcatgaatactttaccttgaaatatgtctgccaagtagataatcttgtagcaaactgtcaatgagtatagtaggaaaaactgagtttttgtaaatagaaccttatgaagctttgaaattcactcttaaattattcatagaagatgagacctctgtggatttttctcagcttacattatctagagtataggcctaactgatttttattcgtgaaatagaaagaaattagaatacaactaagcttatatttcctacatagattctgatttctgtcctggacatttatgtttgttgatttttgttgtatgtcttatcatctgttgctgagaaaaaacatgtgagatctccttcatgagtcttagtatatgattggggaaagctaaaacgccatgtccttacaaaccttgtattctgcctcccaagtttaaaaatctttctatgaagttagaagcag

SEQ ID NO: 3451 - DNA, 1098 bp, Picea glauca
  misc_feature (1013)..(1013): n is a, c, g, or t
ttaattaaattaatccccccccccccgaaacatggactctcctttcaaaccctacatccccgggttcggagaggcagttaagaggggtattgattttgctattgcggctacttgaattataaggaggaagaagaggaggaacagcaacagcaggagtcaacgggatcgttgaggcggagtctgttcacaaacccaaaatggtgaacgtacctaagacaaagaaaactttctgcaagaataaggcttgcaaaaagcacactttgcataaagtaacgcagtacaagaaaggaaaggatagtcttgctgtacaaggaaagagacgttatgacaggaaacaatctggttatggaggtcaaacaaagcctgtctttcacaagaaggctaaaacaacaaagaagattgtgttgaagctgcaatgccagtcttgcaaacattattcccaacatccgatcaagcgatgcaagcactttgaaattggtggggacaagaaaggaaagggcacatctctcttctaggtgcattgccatcagttgatagcgatgtcttcctacctgtagaactgtcaaaacataagggtgttttatagatgcagttaactctactggttcagtactttaaattttcttttcatgaatactttaccttgaaatatgtctgccaagtagataatctcgtagcaaactgtcaatgagtatagtaggaaaaaccgagtttttgtaaatagaaccttatgaagctttgaaattcactcttaaattattcatagaagatgagacctctgtggatttttctcagcttacattatctagagtataggcctaactgatttttattcgtgaaatagaaagaaattagaatacaactaagcttatatttcctacatagattctgatttctgtcctggacatttatgtttgttgatttttgttgtatgtcttatcatctgttgctgagaaaaaacatgtgagatctccttcatgagtcttagtatatgattggggaaagctaaaacnccatgtccttacaaaccttgtattctgcctcccaagtttaaaaatctttctatgaagttagaagcagaaaaaaattgaaaattct

SEQ ID NO: 3452 - DNA, 659 bp, Tamarix hispida
  misc_feature (38)..(38): n is a, c, g, or t
  misc_feature (41)..(41): n is a, c, g, or t
  misc_feature (495)..(495): n is a, c, g, or t
ggggaacacaacttcagttgccacctatactcacgcantcnagcaatcaaaaaccctacgcccggaaggataagggggcggccggtgaggaacacaggggacgaaatactgaattcctccagctgcagccatggtgaacgttccaaagaccaagaagacgtactgcaagaacaaggactgtaagaagcacacactccacaaggtaactcaatacaaaaagggtaaagatagtttggctgctcagggaaagcgtcgttatgataggaagcaatctggttatggtggtcagaccaagcccgtcttccacaagaaggctaagaccacaaagaagattgtgttgaggttgcaatgccaatcttgcaagcatgtgtctcagcaccccatcaagagatgcaagcactttgagattggcggagacaagaagggaaaaggaacatctctgttttagagtccaagtacaattgtaacagctgtttcaagtgctactgttcatcntcttagttttgttggtctttgtgctgctattagaatttcgaacagttggggtatgttactctgtttgcctagtggaaatgtttttttaatgaagatgttcaacctcgccttggtcttatcaatttgagcttttatatagagtaattttcctcctttgtgcccag

SEQ ID NO: 3453 - DNA, 560 bp, Solanum lycopersicum
tcttcacacatcaaagggttattcaacggcgtcagtcttctctgctatttcggttccattctccgccggcgacaatggtgaacgttcctaagacgaagaagacttactgcaagtccaaggagtgcaagaagcacaccttgcataaggtgacgcaatacaagaagggaaaagatagcttagctgctcaaggaaagcgtcgttatgatcgcaagcagtcaggttatggtggacagacaaaacctgtctttcacaaaaaggcaaagaccacaaagaagattgtcttgaggttgcaatgccaaagttgcaaacatatgtcgcaacacccaatcaagaggtgcaagcattttgagattggcggagacaagaaaggaaaaggaacatctcttttttagattgcttgtgaagcagaatttgatctctctcttctgttctttcactgttcggatattttgttatattgaaggtagttcaggagcttctgttatccaattcatcattattatgtgttcaatcagtgatattatcaggagatgaaatgaatatttcaagtttttgattta

SEQ ID NO: 3454 - DNA, 579 bp, Triphysaria pusilla
aataatctcccacctaggtttttgcagaaaaaccgtatctaagcttaccagcattcctacctccaccgttagccatggtgaacgttccaaagacaaagaagactttctgcaagtctaaggaatgcaaaaagcataccttgcacaaggttacccagtacaagaagggtaaagattcccttgctgcacagggaaagcgtcgttatgaccgtaagcagtccggttatggtggccagaccaagcctgtcttccacaagaaggctaaaaccacaaagaaaattgtgttgaggctgcagtgccagagctgcaaacatatgtcccagcacgctatcaagaggtgcaagcattttgagattggtggggacaagaagggcaaagggacatctcttttctaaatgttattttcattttttgttgggattttacttttttattgtgttcatgctaaatactagattgaattgaagcttgaagtttgcaaactcagtatcttgttttagtattgactttctgttctcctttgatttgcttattacaccaattttatcaagctcttggatgataaatgcaattacattttgt

SEQ ID NO: 3455 - DNA, 596 bp, Triphysaria pusilla
cttccttagtcttgaaaccctaacctttctctcacggctacaataatctcccacctaaggttttgcagaaaaccgtattgacgcctcccagcattcctacctccaccgacagccatggtgaacgttccaaagacaaagaagactttctgcaagtcaaaggaatgcaaaaagcacaccttgcacaaggttacccagtacaagaagggtaaagattcccttgctgcacagggaaagcgtcgttatgaccgtaagcagtccggttatggtggtcagactaagcctgtcttccacaagaaggccaaaaccacaaagaagattgtgctgaggctgcaatgccagagctgcaaacatatgtcccagcacgctatcaagaggtgcaagcattttgagattggtggagacaagaagggcaaagggacatctcttttctaaatgttattttcatttcttgctgggatattacttttttgttgtgttcatgctaaatactagattgaatttgaagcttgaagtttgcaaactcagtatcttgttttagtattgactttctgttctcctttgtttggcttactacaccaattttgtcaagcccttgg

SEQ ID NO: 3456 - DNA, 554 bp, Triphysaria pusilla
gcagaaaatttatcacacttcccagtctcaccactccgccgcagcaatggtgaacgttccaaagacgaagaagactttctgcaagtcaaaggagtgcaaaaagcacaccctgcacaaggtcacacagtacaaaaagggcaaggatagccttgctgctcagggaaagcgtcgttatgatcgcaagcagtctggttatggtggtcagaccaagcccgttttccacaagaaggccaagacaacaaaaaagattgtgctgaggttgcagtgccagagttgcaaacattcttcccagcatgctatcaagaggtgcaagcattttgagattggtggagataaaaagggaaaaggaactagtcttttctgagtgtggacctgggaaattagaacttgttgttttgtttttcttttgggaatttattttgacattttcatctgttcctgctaaatactatgttgaatttgaagtttcaattttggaatttcgtcaagtatttggatgttatttttaactagttagtgctatctatttttggtttataacaccatatttgtca

SEQ ID NO: 3457 - DNA, 636 bp, Zostera marina
gatataaaatcgcgtttagggtttctgtggcattgtagcggcggcgaggcgacacgatggttaacgtacccaagacgaagaagacatattgcaaaaacaagcaatgcaagaaacacaccctgcacaaggtcacgcaatataagaaaggtaaagatagtcttgctgctcagggaaaaaggcgttatgaccgtaaacagtctgggtatggtggacagacaaagcctgtttttcacaagaaggctaaaacaacgaagaaaattgtgttgaggttgcagtgtcaaagctgtaaacatatgtcgcagcatcctatcaagaggtgcaagcattttgagattggtggagataagaaaggcaagggaacgtcactgttttaatcgtcttctctttttattattttccttatgtttggttaagaccggttcttgatttttttttgatgtcttttcaatagcatttaaaattggtgttacagaattacttaagctattttattcaagttacctttcgttttaaagttcgtttgctattgatgtattattttacttagttagggttttagtgctttgattaaggattttgaaatttataattcgttttgaaacagccttctgaaagaaaacttatatttatagtatt

SEQ ID NO: 3458 - DNA, 630 bp, Brassica juncea
tttggcagcggacgacaacgacggcacgagtttcaccgaagatcgaaaatggtgaacattccaaagactaagaagacttactgtaagaacaaggaatgcaagaagcataccttgcacaaggttacccagtacaagaagggtaaagacagtcttgctgcccaaggaaagcgtcgttatgaccgcaagcaatctggatatggtggtcagaccaaacccgtctttcacaagaaggctaagacgaccaagaagattgtgctgaggctccagtgccaaacctgcaagcatttctctcaacactcaattaagaggtgcaagcactttgagattggtggggacaagaagggaaaaggaacatccctcttttaagttgttacttcttatctactttttatcttttgttggtacttgtcttgctaagacattcacttacattttgaatcttccagaaatggtttatggacctatgatctttttaatacattcgtatgagatattgtaaacttagttacatccctagtggtgattttgaatctaaagtcctgaaaatgcatatatttgtaggttgagaaccaccattggggttgcttttagtatggtcctccaccttattaaattccaatagaagcttcc

SEQ ID NO: 3459 - DNA, 456 bp, Brassica juncea
acacaatcttcacccgagagagaagagagagatcagagtagcgaaaatggtgaacattccaaagacaaagaagacatactgcaagaacaaggagtgcaagaagcacacattgcacaaggttacccaatacaaaaagggtaaagacagtctcgccgctcaaggaaagcgtcgttatgaccgtaagcaatccggttacggtggtcagaccaagcctgtcttccacaagaaggctaagaccacgaagaagatcgtcctcaggcttcagtgccagacttgcaagcacttttcgcagcactcaatcaagaggtgcaagcattttgagatcggtggagacaagaagggcaagggaacatctcttttctaagctgttctgatcttaatttgttacaagtttgtcatcttgattccatctgttttagctctcgtacaagattgtcccttatctttggttgttaa

SEQ ID NO: 3460 - DNA, 524 bp, Brassica juncea
agacgacggcacacacgcttcaccggagatttcagaggagcgaaaatggtgaacattcccaagacaaagaaaacttactgcaagaacaaggaatgcaagaaacataccttgcacaaggttacccaatacaagaagggtaaagacagtcttgctgctcaaggaaagcgtcgttatgaccgtaagcaatctggttatggtggtcagaccaagcctgtcttccacaagaaggctaagaccacgaagaagattgtcttgaggcttcagtgccaaacctgcaagcacttctctcagcactcgatcaagaggtgcaagcattttgaaatcggtggagacaagaagggcaagggaacatcacttttctaagctggtctcatattgagctttacaagttttgtacttcgtcggatctttgatttcatctctgtttttagctctcgtataagattgtttctcatccttgcttgttgactctaatactttgtatcatcaagatatggtttttcttttatcattgcactcatcag

SEQ ID NO: 3461 - DNA, 559 bp, Brassica juncea
aagcttcacccgtgatatcagagtagcgaaaatggtgaacattccgaagacaaagaagacttactgcaagaacaaggaatgcaagaagcataccttgcacaaggtcacccaatacaagaagggtaaagacagtctcgctgctcaagggaagcgtcgttatgaccgtaaacaatccggttatggtggtcagactaagcctgtcttccacaagaaggctaagaccacgaaaaagattgtcctgaggcttcagtgccaaacctgcaagcacttttctcagcactccatcaagaggtgcaagcattttgagatcggtggagacaagaagggcaagggaacatcacttttctaagctggtcttatcttaagctttacaagttttgtacttcgtgggatcttgatttcatctgtttttagctttcgtataagattgtttctcatctttgcttgttaactctatattttgtatcatcaagatctagttttcttgtttatcgttgcacttgatcagtctatactatcaaagtaaaacttacaatccagttttaaatcgatgatttca

SEQ ID NO: 3462 - DNA, 363 bp, Brassica juncea
ttcaccgaagagcgaaaatggtgaacattcccaagacaaagaagacttactgcaagaacaaggaatgcaagaagcatacattgcacaaggtcacccagtacaagaagggtaaagacagtcttgctgcccaaggtaaacgtcgttatgaccgcaaacaatccggttacggtggtcagaccaagcccgtcttccacaagaaggccaagacaaccaagaagattgtcttgaggctccagtgccaaacatgcaagcatttctctcaacactcgattaagaggtgcaagcactttgagattggtggagacaagaagggaaaaggaacatctctcttttaagttatttcctcttatctactttcttttt

SEQ ID NO: 3463 - DNA, 662 bp, Brassica juncea
gtgttccttacggttgtttggcagctgacgacgacggcgcgaacttcaccgaagatccaaaatggtgaacattccgaagactaagaagacttactgtaagaacaaggaatgcaagaagcataccttgcacaaggtcacccagtacaagaaaggtaaagacagtcttgctgcccagggtaaacgtcgttatgaccgcaaacaatccggttacggtggtcagaccaagcccgtcttccacaagaaggctaagacaaccaagaagattgtcttgaggctccagtgccaaacatgcaagcatttctctcaacactcgattaagaggtgcaagcactttgagattggtggagacaagaagggaaaaggaacatccctcttttaagttgtttcttcttatctactttttatattttgttggtacttgtcttgctaagacattcacttacattttgaatcttccagaaatggtttatggacctatgatctttttaatacattcgtatgagatattgtaaacttagttacatccctagtggtgattttgaatctaaagtcctgaaaatgcatatatttgtaggttgagaaccaccattggggttgcttttagtatggtcctccaccttattaaattccaatagaagcttccacagatgcaacttcacagc

SEQ ID NO: 3464 - DNA, 2247 bp, Brassica rapa
actataaattctgtttctttaaccttatccttcgttggctagcagacgacggcacacgcgcttcaccggagatttcagaggagcgaaaatggtgaacattcccaagacaaagaaaacttactgcaagaacaaggaatgcaagaaacataccttgcacaaggttacccaatacaagaagggtaaagacagtcttgctgctcaaggaaagcgtcgttatgaccgtaagcaatctggttatggtggtcagaccaagcctgtcttccacaagaaggctaagaccacgaagaagattgtcttgaggcttcagtgccaaacctgcaagcacttctctcagcactcgatcaagaggtgcaagcattttgaaatcggtggagacaagaagggcaagggaacatcacttttctaagctggtctcgtcttgagctttttacaagttttgtacttcgttggatcttgatttcatctgttttagctctcgtataagattgtttctcatccttgcttgttgactctaatattttgtatcatcaagatatggtttttctttttatcattgcactcatcagtcagtacaatcaaagtaaaacttacagtacagtttttaatcgatgatttcagtacacaagacatgatactcatttcattgtaaagtacttccatttgtactaaactcatgtgctggttgtagcagaacataaattaatcaaaaaccccattgaacttaaacaaaattgtctaattttagctttaagttaattcaatgcagttttggtttcactaagcatgactgacattcacttcattataaaatacttctataatcaacgttcaaacgatgtgtacaaaactcataggggtcataaggctgctgcaacaagcagaaagtgcttggatctttacatgtcaaacctccttttgaattaagcaatgacaaagaccctaagttcacctctatccccacgagttatgcgcatgttctcatcaacataggtgacttcaaaatctccagttccagggttagacggtggcctgaaactatcgggaagcctcgggatctcaaacggaggaatctgcgctaagtttcccgatgtcttcacagttgttttctcaaatgtgatcttgatcttgcaagtacctgttctcccatcaagagtcttaacacatcactaatctactatatacaatgcaagtaaacataaagccagagaggaaggaagacacaaacctaagagttcgaatttgtgtgccagtgttgcagtggcttccagaggaggaaacggccaaggagctcctaactccacttcggcaatgttatcgaaatctttgctaaacacatcaatcctctgaaacacctacagttttcaatagagactatatgtattacaaaaaaaaactctctttctactcaaggaaggtgagattaccaaaaagctagagtctttgctcatcagaactcaagcttcaaccacaagtactaatgatagatcaggcaatccacaaaagctcctaagtaataaaaaaacatggctttctactcgaggcaggtgacataaacaaaaagctagagtcttggctcatgatgatagactcaaagagcataatacctggccaagagtgacgggaatcaagcgaccagtggggagtccaggacggctaccacccaaagagcgagaagagaaggcgctgctatacagcagcctccacttcccttgaagtttgtcaagatcattggttagatccacaggcccaccagcggcttcaagtagtttagcagcggcctcagctctttgtagatcatctacactcgccacaagtcctctgttcaaacctgaaaccacgctcttaatttgagtttcagcgattcgattccctccttatctcccgatgtctccggttcgcgaaaggacacctcgccgacggttgagttcacgacgaggcttctcctctcaggtattgtgaagctcaaacgagacgatctgggggtagcgatgagcaccggcgaggaggagatcgagcgtctgacggagccgcatgacggaggagagcggttgttggagagacgcgctggtgaggagagagcagaagaagccgccatgggagaaaagtttctagaggaggaagaagcatctatacaaaagaatctctctttggcttctcgtttattattattagtttgtgatttgcgaagcgacacgagtggagcgcgcaagctgtcacgttttctatgtacgtgtgtgtgtatctaca

SEQ ID NO: 3465 - DNA, 659 bp, Brassica rapa
aaactttgttcttttagattttttgtttttttttttttggcagcggaggacggcgacggcaggagctttcaccgaagagcgaaaatggtgaacattcccaagacaaagaagacttactgcaagaacaaggaatgcaagaagcatacattgcacaaggtcacccagtacaagaagggtaaagacagtcttgctgcccaaggtaaacgtcgttatgaccgcaaacaatccggttacggtggtcagaccaagcccgtcttccacaagaaggccaagacaaccaagaagattgtcttgaggctccagtgccaaacatgcaagcatttctctcaacactcgattaagaggtgcaagcactttgagattggtggagacaagaagggaaaaggaacatctctcttttaagttatttcctcttatctactttctttttcttgttactgtcttgcttcgatacttgaatacattttgaatcttccagaaatgcctatggtgttcaatttagatgacattgtcgtatgaaatatcttttagtttcgtgaacctttctttctacacgcgtttgatgtttaaattttcacgacatcatattacaaaccaaacccatctaattagagatttactcttgtaccgattttgcaagttagactcatttttgccgc

SEQ ID NO: 3466 - DNA, 684 bp, Brassica rapa
gtcgttttagatagggtttactataagttgtgtttctttggctagcggacgacgacggcacacaagcttcattcaaggtcagccgagcgaaaatggtgaacattccaaagacaaagaagacatactgcaagaacaaggagtgcaagaagcatacattgcacaaggtgacccaatacaagaaaggtaaagacagtctcgctgctcaaggaaagcgtcgttatgaccgtaagcaatctggttatggtggtcagaccaagcctgtcttccacaagaaggctaagaccacgaagaagattgtcttgaggcttcaatgccaaacctgcaagcacttttctcagcattcaatcaagaggtgcaagcattttgagatcggtggagacaagaaggggaagggaacatctcttttctaagttggtcttgtcttaactttttgcaagttttgttactcatgtcggatcatgattccatctgttttagctctcgtataagataatcccatctttgcttgttaaagatatggtttgactctttatcattgcacttcttagtcaatacaatataactcgcaaaccatatttcgttttagtctcggttttgctcaaaatcagcgaaagcttcgtttaggcctggttaggctggcaaaaaaccccaaaatctgaaaagtcgaattcgatccgaaaaaat

SEQ ID NO: 3467 - DNA, 657 bp, Brassica rapa
ataaccccaacctagtgttccttacggttgtttggcagctgacgacgacggcgcgaacttcaccgaagatccaaaatggtgaacattccgaagactaagaagacttactgtaagaacaaggaatgcaagaagcataccttgcacaaggtgacccagtacaagaagggtaaagacagtcttgctgcccaaggaaagcgtcgttatgaccgcaagcaatctggatatggtggtcagaccaaacccgtcttccacaagaaggctaagacaaccaagaagattgtgctgaggctccagtgccaaacctgcaagcatttctcccaacactcaattaagaggtgcaagcactttgagattggtggagacaagaagggaaaaggaacatccctcttttaagttgttacttcttatctactttttatcttttgttggtacttgtcttgctaagacattcacttacattttgaatcttccagaaatggtttatggacctatgatctttttaatacattcgtatgagatattgtaaacttagttacatccctagtggtgattttgaatctaaagtcctgaaaatgcatatatttgtaggttgagaaccaccattggggttgcttttagtatggtcctccaccttattaaattccaatagaagcttcc

SEQ ID NO: 3468 - DNA, 619 bp, Bupleurum chinense
ctctgcatcttgtcaacatctctcttcgctacgcttcagccatggtgaatgtaccgaagacaaagaagacatactgcaagtctaaggaatgcaggaagcatactttgcacaaggtgacacaatataagaaaggaaaggacagcttggctgcccaaggaaagaggcgttatgatcgcaaacagtctggttatggtggacaaacaaagcccgttttccacaaaaaggcaaaaactaccaaaaagattgtcttgaggctgcaatgccagagctgcaaacatatgtcacagcatcctatcaagaggtgcaaacattttgaaattggtggagacaagaaagggaagggaacctctctgttttagatgtgtggttacaaactatcttttaagttactgtattttctcttttcagacatgttttagttacattttgttgttagttgcagtaatgttacattggtttttgatgacatattaatagattcatatcgtttttgtttgtcatatgatgaatgatttagttcgacattaacttgcctgtgcagatcgaggcaagcatgtaaaattcttgattgtgactcaacctacttaaatgtggagttaatcaagctgaatttgaaccg

SEQ ID NO: 3469 - DNA, 470 bp, Bupleurum chinense
tgcaattcttctctgcatcttgtcaatatctctcttcgctacgcttcagccatggtgaatgtaccgaagacaaagaagacatactgcaagtctaaggaatgcaggaagcatactttgcacaaggtgacacaatataagaaaggaaaggacagcttggctgcccaaggaaagaggcgttatgatcgcaaacagtctggttatggtggacaaacaaagcccgttttccacaaaaaggcaaaaactaccaaaaagattgtcttgaggctgcaatgccagagctgcaaacatatgtcacagcatcctatcaagaggtgcaaacattttgaaattggtggagacaagaaagggaagggaacctctctgttttagatgtgtggttacaaactatctttcaagttactgtattttctctttccagacatgttttggttacattttgttgttagttgcagtaatgttacattggtttt

SEQ ID NO: 3470 - DNA, 531 bp, Cicer arietinum
taaaacttcgtctttcagatccggatccacgcgccgccatcatggtgaacgttccaaagacgaagaagacatactgcaagagcaaggagtgcaagaagcacacactccacaaagtgactcaatacaagaagggtaaggatagcatcgccgctcaaggtaagcgtcgttacgatcgcaaacagtccggttatggtggtcagactaagcccgtcttccacaagaaggctaaaaccactaagaaaattgttctgaggctgcaatgccaaggttgcaagcatgtttcccaacatgctatcaagaggtgcaagcactttgagattggtggtgacaagaagggcaagggaacttctcttttctaggtggagaattaggatttattactgttttgatgtgttattttccgtgttgggatgttttgtttctctatggatttctcatagctatattttattatttggaatacttttttgtgattgacaagtgaaaactattgctaatatcaatcagtacttgtttttgttacttgagtac

SEQ ID NO: 3471 - DNA, 400 bp, Cicer arietinum
aactcaacgctacaatggttaacgttccaaagacaaagaaaacatactgcaaaagcaaggaatgcaagaagcataccttacacaaagttacccaatacaaaaagggtaaagatagcatcgctgctcagggaaagcgtcgttatgatcgcaaacaatctggttatggtggtcagactaaacctgtttttcacaaaaaggccaaaaccactaagaaaattgtcttgaggcttcagtgtcaaggttgcaaacatgtttctcaacatgctattaagaggtgcaagcactttgagattggtggtgataagaagggaaaaggaacgtctctattttagttgcagaattagaattctgcattttcaatgtgttttctattgtacccatctttggcttttaattttgc

SEQ ID NO: 3472 - DNA, 637 bp, Catharanthus roseus
tagtggatccaaagaattcggaactggattaacgccgctcacaccacaagagccgacctcgcagaatcacttgcgttgtcaaaatggttaacgttcccaagacaaagaaaacatactgcaaatcaaaggaatgcaaaaagcataccttgcacaaggttacccaatataagaaggggaaggatagcctggctgctcaggggaagcgtcgttatgatcgcaagcaatcaggatatggtggacagactaaacccgttttccacaagaaggcaaaaaccacaaagaagattgtcctgaggctacaatgtcagggttgcaagcatgtttcacagcatccaatcaagaggtgtaagcattttgagattggtggagacaagaagggaaagggaacctctcttttctaggaagctgggtgtcaatgtttaattgctattttatctcatgttttagtttcatatatgcttttggatttgaaatacaatcaaggaacattttatctttaatgggtgttacatagaagttggctttgtagccttctcttttgttcctcatttacccatttgcaattttgtatcaactctaaatgaccttgttggtatcttagaaattatgcataatatggtggaatgattcattcaat

SEQ ID NO: 3473 - DNA, 728 bp, Catharanthus roseus
actagtggatccaaagaattcggcacgaggctgcagcggcgctctcttccgctctttctctctaccggcaagtgacaccactctctctccctccctctgagcgaaaatggttaacgttcctaaaacaaagaagacttattgcaagtctaaggagtgcaaaaagcacaccttgcacaaggttacccaatacaagaagggaaaagatagtttggctgctcaaggaaagcgccgttatgaccgcaagcagtcaggttatggtggtcagaccaaacctgtgtttcacaagaaggcaaaaaccacaaagaagattgtgttgaggcttcaatgccagggttgcaaacatgtatcacagcaccctattaagaggtgcaagcattttgagattggaggagataagaagggaaagggaacctcccttttttaagaagctgggcactggttttcaattgctgttttatctgtgttacattctatttttttatgtttgttcatctagatcaaatgactgacagatgtttatggcagaatgaatcttcagatttttatttttattgagttttcgctctatggtttctaattgcattcaatatttgtgttaaacttaatttaattagcttctgtagattgaatgccatcatttcttgttagttgtccatagatgaagatgaatttcttttgtaccaagattgggttaagtgtcaagaaaaacttggtattctcctcgtgcc

SEQ ID NO: 3474 - DNA, 539 bp, Helianthus annuus
accctaaaaactggtggttcctctctgtctcactcatccggcaggttggttcatcggagatcgtcggccatggttaatgttccaaaaactaagaagacttactgcaagaacaaggaatgcagaaagcacacattgcacaaggtgacacagtacaagaagggtaaagatagtttggctgcacaagggaaacgtcgttatgacaggaaacagtcaggatatggtggtcaaaccaagcccgtctttcacaagaaggctaaaaccaccaagaagattgtgctaaggttgcaatgccaaggttgcaagcatgtgtcccagcatccaattaagaggtgcaaacattttgaaattggtggagacaagaagggcaaaggaacatcacttttttaagcaatattcatgtgttattttagtatgtttagacctatatatgtttcaagtttttatgcaggtttaatgttgcaaactttaaaatttgtgtttaaggttttattttgtttatctaattaaaaacaaatttatatatattctggttaggccat

SEQ ID NO: 3475 - DNA, 495 bp, Helianthus annuus
cagccatggtgaacgttccgaagaccaagaagacttactgcaagaacaaggaatgcagaaagcataccttgcataaggtgacacagtacaagaagggcaaagatagcttggctgcacagggaaaacgtcgttacgacaggaaacaatctggttatggtggtcaaactaagcccgtctttcacaagaaggcaaaaaccacgaagaagattgtgctaaggttgcaatgccaaggctgcaagcatgtctcacagcacccaatcaagagatgcaagcattttgaaattggtggagataagaagggcaagggaacatctctcttttgatcagttttgtgtaattttgttgcagcagctactattctttctttttgttgtagcagactattaactgttttaagtttctgaaacttgtaatgcaagtatctgttttgattttacgtgttgatttcggcttgtgtgatttatctggtgttcggttattctatggattaaaatg

SEQ ID NO: 3476 - DNA, 440 bp, Helianthus annuus
tcatccggcaggttggttcatcggagatcgtcagccatggttaatgttccaaaaactaagaagacttactgcaagaacaaggaatgcagaaagcacacattgcataaggtgacacagtacaagaagggtaaagatagtttggctgcacaagggaaacgtcgttatgacaggaaacagtcaggatatggtggtcaaaccaagcccgtctttcacaagaaggctaaaaccaccaagaagattgtgctgaggttgcaatgccaaggttgcaagcatgtgtcccagcatccaattaagaggtgcaaacattttgaaattggtggagacaagaagggcaaaggaacatcacttttttaagcaatatttatgtgttattttactatgtttagacctatatatgtttcaagtttttctgcaagtttaatgttgcaaactttaaaatt

SEQ ID NO: 3477 - DNA, 481 bp, Helianthus annuus
tgcggctctgcatctcatctctctcggtagacgttcaggaactctgcagccatggtgaacgttccgaagacgaagaagacttactgcaagaacaaggaatgcagaaagcataccttgcataaggtgacacagtacaagaagggcaaagatagcttggctgcacagggaaaacgccgttacgacaggaaacaatctggttatggtggtcaaactaagcccgtctttcacaagaaggcgaaaaccacgaagaagattgtgctaaggttgcaatgccaaggctgcaagcatgtctcgcagcacccaatcaagagatgcaagcattttgaaattggtggagataagaagggcaagggaacatctctcttttgatcagttttgtgtaattttgttgcagcagctactattctttctttttgttgtagcagacttctcactcttttaagttttccaaacttgtaatgcaagtatctgttttgatttt

SEQ ID NO: 3478 - DNA, 434 bp, Helianthus annuus
cagccatggtgaacgttccgaagaccaagaagacttactgcaagaacaaggaatgcaggaagcataccttgcataaggtgacacagtacaagaaaggcaaagatagcttggctgcacaaggaaaacgtcgttacgacaggaaacaatctggttatggtggtcaaactaagcccgtctttcacaagaaggcaaaaaccacgaagaagattgtgctaaggttgcaatgccaaggctgcaagcatgtctcgcagcacccaatcaagagatgcaagcattttgaaattggtggagataagaagggcaagggaacatctctcttttgatcagttttgtgtaattttgttgcagcagctactattctttctttttgttgtagcagactattcacttttttaagttttccaaacttgtaatgcaagtatctgtttttattt

SEQ ID NO: 3479 - DNA, 464 bp, Helianthus annuus
cagccatggtgaacgttccgaagaccaagaagacttactgcaagaacaaggaatgcagaaagcataccttgcataaggtgacacagtacaagaagggcaaagatagcttggctgcacaaggaaaacgccgttacgacaggaaacaatctggttatggtggtcaaactaagcccgtctttcacaagaaggcaaaaaccacgaagaagattgtgctaaggttgcaatgccaaggctgcaagcatgtctcgcagcacccaatcaagagatgcaagcattttgaaattggtggagacaagaagggcaagggaacttcacttttttaagcagtttgttgcaggcttgcagctactattcatatttttgttctagcagactttttatgttttttgaaatttatattgcaagagcctgtttagctttgcttttgacacatctgcctggagaaatgaaaatcttgtgttatt

SEQ ID NO: 3480 - DNA, 507 bp, Helianthus annuus
tacggcggctcttcatctcatcctctcggtcaaatttcagtagctcttcagccatggtgaacgttccaaagacgaagaagacttactgcaagaacaaggaatgcagaaagcataccttgcataaggtgacccaatacaagaagggaaaagatagtttggctgcacaaggaaagcgtcgttatgacaggaaacaatccggttatggtggtcaaaccaaacccgtctttcacaagaaggcaaaaaccacaaagaagattgtgctaaggttgcaatgccaaggttgtaagcatgtttctcagcacccaattaagagatgcaagcattttgaaattggtggagacaagaagggcaagggaacttcacttttttaagcagtttgttgcaggcttgcagctactattcatatttttgttctagcagactttttattgtttttgtaattatattgcaagagccttttagtcttttgtacacatctgcctggagaaatgaaaatcttgtgttatt

SEQ ID NO: 3481 - DNA, 543 bp, Eutrema halophilum
gttttcggcagcggacgacgacggcacgagcttcaccgaagagcgaaaatggtgaacattcccaagactaagaagacttactgcaagaacaaggaatgcaagaagcataccttgcacaaggtgacccagtacaagaagggtaaagacagtcttgctgcccagggaaaacgtcgttatgaccgtaaacaatctggttatggtggtcagaccaagcccgtcttccacaagaaggctaagacaaccaagaagattgtcctgaggctccaatgccaaacatgcaagcatttctctcagcactcgattaagaggtgcaagcacttcgagattggtggagacaagaagggaaaaggaacatctctcttttaagttgtttttatttctacttttcctttttgtatggtactgtcttgcttcgatactcaaaatacattttgaatctctcggaaatgcttgtggtgtttaatttaataggacatggtcgtatggaatatctttttattttgtgaaaaccaatctttgttcacaagattcttgtgaagtttt

SEQ ID NO: 3482 - DNA, 651 bp, Eutrema parvulum
aaacacacttataagctttgttcctttaggttgtttgtggtttttttggcagcggacgacgacggcacgagcttcaccgaagagcgaaaatggtgaacattcccaagactaagaagacttactgtaagaacaaggaatgcaagaagcataccttgcacaaggtgacccaatacaagaagggtaaagacagtcttgctgcccaaggaaagcgtcgttatgaccgcaaacaatctggttatggtggtcagaccaagcccgtcttccacaagaaggctaagacaaccaagaagattgtcttaaggctccaatgtcaaacctgcaagcatttctctcaacactcaattaagaggtgcaagcattttgagattggtggagacaagaagggaaaaggaacatctctcttttaagttgtttcctctatctactctttttttgtttggtactgtcttgcttcgataccaaaaatacattttgaatcttccagagatggttataatgtttaatctagatgacattttcgtatggattttgtgaacctatctttcttcatgagtttgctgtttaagttcctttacatcttgtgacaaatctaagtatccagaaaagagtgtttacttctgtaccgatctcaatgtcagattcgtttatgcc

SEQ ID NO: 3483 - DNA, 597 bp, Antirrhinum majus
  misc_feature (22)..(22): n is a, c, g, or t
  misc_feature (596)..(596): n is a, c, g, or t
cttaagggttttcgaacggcantttgcagtaaaacttcaatctcaccctccgggcttccctttatcgccattagccatggttaacgttccaaaaacaaagaaaactttctgcaagtcgaaggagtgcaaaaagcacactttgcataaggtgacacaatacaagaagggcaaggatagtctagccgcacaagggaagcgtcgttatgaccgcaagcagtccggttatggtggtcagaccaagcctgtcttccacaagaaggcaaaaacgacaaagaagattgtgttgaggctacaatgccaaggctgcaaacacgtctcccagcacgctatcaagaggtgcaagcactttgaaattggtggagataagaaggggaaaggaacttctctcttttaagtgcgcttggaattgcaagtttttgggtttcttgcgtattggatatgttcttctctgttttatcagaatactgaatgaaatagcagactgtatttggacaatttcatttcataatctctaattatcatcaactttatatcaacctacctttagacatcatgtgcattgatgactgtgaatctgttggattgccattgaggana

SEQ ID NO: 3484 - DNA, 566 bp, Antirrhinum majus
tctccgtccccgcccttctccgccgtcaacaatggttaacgttccaaagacgaagaagactttttgcaagtcgaaagagtgcaaaaagcacactttacacaaggtgacacagtacaagaagggcaaagatagtttggctgctcaggggaagcgtcgttatgatcgcaagcagtctggttatggtggtcagaccaagcccgtcttccacaagaaggcgaaaactacgaagaagattgtgctgaggctgcagtgccagggttgcaaacatgtttcccagcacgcgatcaagaggtgcaagcattttgaaatcggtggagataagaaggggaaaggaacatctctcttttaagcttgttaggagttggagcttttgtttgattgcgttgtggatttgttcttctctgaattttgagatcgagaatcagttgtgtagctcagtttagacaaattcctttgtgtgagctcacatctgtcagtcttgtagtttatacactcctttatattggttcagttttgacaatgataattatgggtctggttggattaccattgttttaccctcgtgc

SEQ ID NO: 3485 - DNA, 595 bp, Antirrhinum majus
cgggtttaacatcgcatttttgaagaaactccaatcccaatctcactgcaccgcaagacgttaccatggtgaacgttccgaagacaaagaaaaccttctgcaaatcgaaggagtgcaagaagcacaccttgcacaaggttacacagtacaagaagggtaaagatagcttagctgctcagggaaagagacgttatgatcgcaagcagtctggttacggtggtcagaccaagcccgtctttcacaagaaggcaaaaaccacaaagaagattgtcctgaggcttcagtgccaggggtgcaaacatgtttcccagcatgctatcaagaggtgcaagcattttgagatcggtggagataagaagggaaaaggaacttccctcttctaagtgatagggttgtcctttgctgttttagttgaatattatatgaaatatcagacgttgtgctacttaattttgtttttcagtattgaagtttgtttcattgtgcacttttactagttgaaaaatttgccgccttcaatcatttaatctgtgttaataccgatgtggcttgcaaagttaattgctatttattcccaatgcaatgcttgacgcaa

SEQ ID NO: 3486 - DNA, 517 bp, Antirrhinum majus
  misc_feature (514)..(514): n is a, c, g, or t
gaaccctagttccctccgcccttagcaatggttaatgttccgaagacaaagaagactttttgcaagtcgaaggagtgcaaaaagcacaccttgcataaggtgacacagtacaagaagggcaaagatagtttagccgctcaagggaaacgtagatatgaccgcaagcaatcgggttatggtggtcagaccaagcctgtcttccacaagaaggcaaaaactacaaagaaaattgtgctgaggctgcaatgccagggatgcaaacatgtttcccagcacgccatcaagaggtgcaagcattttgaaattggtggagacaagaaaggaaaaggaacttctctcttctaagtgcgctctattaccgacttttttgttcttcccttgtgtatttgtctttctgtttttagcatattgtttagataaaacatcagacatgccattcagttcagacagatttctttttgtaagatttatatcagattgctctacctacaactccagatgatatgcttcagtngct

SEQ ID NO: 3487 - DNA, 566 bp, Malus domestica
ggtttagccgagagcccgtttctgctctaccgctcagtcatctccttacgaacccgccgtcgccatggtgaacgttccgaaaacaaagaagacctactgcaagagcaaggagtgcaaaaagcacaccttgcacaaggttacccaatacaagaaaggaaaggatagcctcgctgctcagggaaagaggcgttatgatcgtaagcagtcaggttatggaggtcagaccaaaccagtgttccacaagaaggcaaaaacgaccaagaagattgttctgaggctccaatgccagggttgcaagcatgtgtcccagcacccgatcaagaggtgcaagcatttcgagattggtggagacaagaaggggaagggaacctctcttttctaaatttactgcttctgatagatattgtgttacttttctatcttgttggagctttaaagcaaatatcgtggctttaaccgtccctattattagttttctgttaaactgcagattgttcttgacgatctttttccgactttgaattgatattagagtttctgttttaaatcgatatggcattttgata

SEQ ID NO: 3488 - DNA, 622 bp, Malus domestica
acaagcttcagctgctcatttctgtatcgacgccgcggcaaatccaccatggtgaacgttcccaagacaaagaagacctactgcaagagcaaggagtgcaagaagcacaccttgcacaaggtcacacaatacaagaagggcaaggatagtcttgctgctcagggaaagcgtcgttacgatcgcaagcagtctggttatggtgggcagacaaaaccagtcttccacaagaaggcaaagactactaagaagattgtgctgaggctccaatgccagggttgcaagcatgtatcccagcacccgatcaagaggtgcaagcactttgaaatcggtggagacaagaaggggaagggaacatcgctgttttgaatgcattgttttggctgtactgttatgttacgaatgttgttgaagcttcaaagcaaatatggatgaattgtttcaagtttttgttagttttacgttaaacgtcgatgcgtttgtgacactaattttaactatcagttgagattgagattagagtaccaatgcagccttcgccttgattcctactgtttatgtttcaatttgcattcatgtagaagttgctcttccgttttaatttaatttgttaacagtgaaggtt

SEQ ID NO: 3489 - DNA, 468 bp, Arnica chamissonis
tctcggtcgacttgcagaagctctgtagccatggtgaatgttcctaagaccaagaagacttactgcaagaacaaggaatgcagaaagcataccttgcataaggtgacacaatacaagaagggaaaagatagcttggctgcacaaggaaagcgtcgttatgacaggaaacaatctggttatggtggtcaaacaaaacccgtgtttcacaagaaggcaaaaaccacaaagaagattgtgctaaggttgcaatgccaaggctgcaaacacgtctctcagcacccaattaagcgatgcaagcatttcgaaatcggtggagacaagaagggcaagggaacttctcttttctgagcaatttgttgcaggcttgcatctactatctatatttttgttttagcagacttgtcagttttaagttttgaaatatatattccaagcacctattttgctttgacacatttctgggttaat

SEQ ID NO: 3490 - DNA, 524 bp, Brassica juncea
gcggacgacaacgacggcacgagtttcaccgaagatcgaaaatggtgaacattccaaagactaagaagacttactgtaagaacaaggaatgcaagaagcataccttgcacaaggttacccagtacaagaagggtaaggacagtcttgctgcccaaggaaagcgtcgttacgaccgcaagcaatctggatatggtggtcagaccaaacccgtctttcacaagaaggctaagacgaccaagaagattgtgctgaggctccagtgccaaacctgcaagcatttctcccaacactcaattaagaggtgcaagcactttgagattggtggggacaagaagggaaaaggaacatctctcttttaaattgtttcctctcgatctacttttttttttaatcttttgttgtctcgcttggacatgggaatacattttgagtcttcaagaaatgattatggacctattgatcttttaattaaaaggacattgtcgtatgcgagatattgtgaacctagttactacagacaataa

SEQ ID NO: 3491 - DNA, 507 bp, Brassica juncea
gactataaattttgttatctttcagttcgcggacgccgtcacacaatcttcacccgagagagagatcagagtagcgaaaatggtgaacattccaaagacaaagaagacatactgcaagaacaaggagtgcaagaagcacacattgcacaaggttacccaatacaaaaagggtaaagacagtctcgccgctcaaggaaagcgtcgttatgaccgtaagcaatccggttacggtggtcagaccaagcctgtcttccacaagaaggctaagaccacgaagaagatcgtcctcaggcttcagtgccagacttgcaagcacttttcgcagcactcaatcaagaggtgcaagcattttgagatcggtggagacaagaagggcaagggaacatctcttttctaagctgttctgatcttaatttgttacaagtttgtcatcttgattccatctgttttagctctcgtacaagattgtcccttatctttggttgttaactctatattttgatacat

SEQ ID NO: 3492 - DNA, 571 bp, Brassica juncea
cgcggggataaccccaacctagtgttccttacggttgtttggcagctgacgacgacggcgcgaacttcaccgaagatccaaaatggtgaacattccgaagactaagaagacttactgtaagaacaaggaatgcaagaagcataccttgcacaaggtgacccagtacaagaagggtaaagacagtcttgctgcccaaggaaagcgtcgttatgaccgcaagcaatctggatatggtggtcagaccaaacccgtcttccacaagaaggctaagacaaccaagaagattgtgctgaggctccagtgccaaacctgcaagcatttctctcaacactcaattaagaggtgcaagcactttgagattggtggagacaagaagggaaaaggaacatccctcttttaagttgtttgctcttatctactttttttttttttggtttgttactactctcttgcttcgatacttgaatacattttggatctttcagaaatggttatggggtttaatttagacaactttttcgtatggaattttctatcttttaatatcgtgaatctttcagatcggaagagc

SEQ ID NO: 3493 - DNA, 583 bp, Brassica juncea
gtctagcagacgacggcacacaagcttcaccggagagttcagaagagcgaaaatggtgaacattcccaagacaaagaagacatactgcaagaacaaggaatgcaagaagcataccttgcacaaggtcacccaatacaagaagggtaaagacagtctcgctgctcaaggaaagcgtcgttatgaccgtaagcaatccggctatggtggtcagactaagcctgtcttccacaagaaggctaagaccaccaagaagattgtcctgaggcttcagtgccaaacctgcaagcacttttctcagcactccatcaagaggtgcaagcattttgagatcggtggagacaagaagggcaagggaacatcacttttctaagctggtctcatattgagctttacaagttttgtacttcgtcggatctttgatttcatctctgtttttagctctcgtataagattgtttctcatctttgcttgttaactctatattttgtatcatcaagatctagttttcttgtttatcgttgcacttgatcagtctatactatcaaagtaaaacttacaatccagttttaaatcgatgatttca

SEQ ID NO: 3494 - DNA, 519 bp, Brassica juncea
cgcagagtacgcgggggcggacgacggcacacaatcttcacccgagagagagatcagagtagcgaaaatggtgaacattccaaagacaaagaagacgtactgcaagaacaaggaatgcaagaagcacacattgcacaaggttacccaatacaaaaagggtaaagacagtctcgccgcccaaggaaagcgtcgttatgaccgtaagcaatctggttacggtggtcagaccaagcctgtcttccacaagaaggccaagaccacgaagaagattgtcttgaggcttcagtgccaaacctgcaaacacttttctcagcactcgatcaagaggtgcaaacattttgagatcggtggagacaagaagggcaagggaacatctcttttctaagctgttgtcgtcgtctgttttctatttcgtttggatcttgattccatctgttttagccctcgtataagattgtcccctcatctttggttgtcactctatattttgaatcatctagacatgattttgctgttttt

SEQ ID NO: 3495 - DNA, 577 bp, Brassica juncea
agtacgcgggggttggctagcagacgacggcacacacgcttcaccggagatatcagaggagcgaaaatggtgaacattcccaagacaaaaaagacttactgcaagaacaaggaatgcaagaaacataccttgcacaaggttacccaatacaagaagggtaaagacagtcttgctgctcaaggaaagcgtcgttatgaccgtaagcaatccggttatggtggtcagactaagcctgtcttccacaagaaggctaagaccacgaagaagattgtcttgaggcttcagtgccaaacctgcaagcacttctctcagcactcgatcaagaggtgcaagcattttgaaatcggtggagacaagaagggcaagggaacatcacttttctaagctggcctcgtcttgagctttttacaagttttgtacttcgttggatcttgatttcatctgttttagctctcgtataagattgtttctcatccttgcttgttgactctaatattttgtatcatcaagatatggtttttctttttgtcattgcgctcatcagtcaatacaatcaaagtaaaacttacagtccaaa

SEQ ID NO: 3496 - DNA, 392 bp, Brassica juncea
gggttcgcggacgacggcacacaatcttcacccgagagagagatcagagtagcgaaaatggtgaacattccaaagacaaagaagacatactgcaagaacaaggagtgcaagaagcacacattgcacaaggtgacccaatacaagaaaggtaaagacagtctcgctgctcaaggaaagcgtcgttatgaccgtaagcaatctggttacggtggtcagaccaagcctgtcttccacaagaaggctaagaccacgaagaagatcgtcctcaggcttcagtgccagacttgcaagcacttttcgcagcactcaatcaagaggtgcaagcattttgagatcggtggagacaagaagggcaagggaacttctcttttctaagctgttctgatcttaat

SEQ ID NO: 3497 - DNA, 460 bp, Brassica juncea
gcgaaaatggtgaacattcccaagacaaagaagacttactgcaagaacaaggaatgcaagaagcatacattgcacaaggtcacccagtacaagaagggtaaagacagtcttgctgcccaaggtaaacgtcgttatgaccgcaaacaatccggttacggtggtcagaccaagcccgtcttccacaagaaggccaagacaaccaagaagattgtcttgaggctccagtgccaaacatgcaagcatttctctcaacactcgattaagaggtgcaagcactttgagattggtggagacaagaagggaaaaggaacatctctcttttaagttatttcctcttatctactttctttttcttgttactgtcttgcttcgatacttgaatacattctgagtcttcctgaaatgcttatggtgttcaatttagatgacattgtcgtatgaaatatcttttagtttcgtg

SEQ ID NO: 3498 - DNA, 507 bp, Brassica juncea
gttggttaagattgtatgtggtttcttttttggcagcggaggacggcgacggcacgaggcgaaaatggtgaacattcccaagactaagaagacttactgcaagaacaaggaatgcaagaagcataccttgcacaaggtcacccagtacaagaaaggtaaagacagtcttgctgcccagggtaaacgtcgttatgaccgcaaacaatccggttacggtggtcagaccaaacccgtcttccacaagaaggctaagacaaccaagaagattgtcttgaggctccagtgccaaacatgcaagcatttctctcaacactcgattaagaggtgcaagcactttgagattggtggagacaagaagggaaaaggaacatctctcttttaagttatttcctcttatctactttctttttcttgttactgtcttgcttcgatacttgaatacattttgaatcttccagaaatgcctatggtgttcaatttagatgacattgtcgtatgaaatatctt

SEQ ID NO: 3499 - DNA, 531 bp, Brassica juncea
gacaacacaatcttcacccgagagagagagagagatcagagtagcgaaaatggtgaacattccaaagacaaagaagacatactgcaagaacaaggaatgcaagaagcacacattgcacaaggttacccaatacaaaaagggtaaagacagtctcgccgctcaaggaaagcgtcgttatgaccgtaagcaatctggttacggtggtcagaccaagcctgtcttccacaagaaggctaagaccacgaagaagattgtcttgaggcttcagtgccaaacctgcaagcacttttctcagcactcgatcaagaggtgcaaacattttgagatcggtggagacaagaagggcaagggaacatctcttttctaagttggtcgtgtcttaaactttttctttgcaagttttgttacttgtgtcggctcatgattccatctgttttagctctcgtataaaagattatcccatctttgcttgttaaagatatggtttggctctttatcattgcacttcttaatcaatacgatatctcgcaa

SEQ ID NO: 3500 - DNA, 553 bp, Brassica juncea
gcagacgacggcacacacgcttcaccggagatttcagaggagcgaaaatggtgaacattcccaagacaaagaaaacttactgcaagaacaaggaatgcaagaaacataccttgcacaaggttacccaatacaagaagggtaaagacagtcttgctgctcaaggaaagcgtcgttatgaccgtaagcaatctggttatggtggtcagaccaagcctgtcttccacaagaaggctaagaccacgaagaagattgtcctgaggcttcagtgccaaacctgcaagcacttctcccagcactcgatcaagaggtgcaagcattttgaaatcggtggagacaagaagggcaagggaacatcacttttctaagctggcctcgtcttgagctttttacaagttttgtacttcgttggatcttgatttcatctgttttagctctcgtataagattgtttctcatccttgcttgttgactctaatattttgtatcatcaagatatggtttttctttttgtcattgcgctcatcagtcaatacaatcaaagtaaaacttacagt

SEQ ID NO: 3501 - DNA, 521 bp, Brassica oleracea
ggttttttttttgggcagcggaggacgacgacggcaggagcttgcaccgaagagcgaaaatggtgaacattcccaagactaagaagacttactgcaagaacaaggaatgtaagaagcataccttacacaaggtcacccagtacaagaagggtaaagacagtcttgctgcccagggtaaacgtcgttatgaccgcaaacaatccggttacggtggtcagaccaagcccgtcttccacaagaaggccaagactaccaagaagattgtcttgaggctccagtgccaaacatgcaagcatttctctcagcactcaattaagaggtgcaagcactttgagattggtggagacaagaagggaaaaggaacatctctcttttaagttatttcctcttatctactttctttttgttggtactgtcttgcttcgatacttgaatacattttgaatcttccagaaatgcttatggtgttcaatttagatgacattgtcgtatgaaatatcttttagtttcgtgaaccttcc

SEQ ID NO: 3502 - DNA, 572 bp, Brassica oleracea
ggttcgcggacgacggcacacaatcttcacccgagagagagatcagagtagcgaaaatggtgaacattccaaagacaaagaagacgtactgcaagaacaaggaatgcaagaagcacacattgcacaaggttacccaatacaaaaagggtaaagacagtctcgccgcccaaggaaagcgtcgttatgaccgtaagcaatctggttatggtggtcagaccaagcccgtcttccacaagaaggctaagaccacgaagaagattgtcctcaggcttcagtgccaaacttgcaagcacttttcgcagcactcaatcaagaggtgcaagcattttgagatcgggggagacaagaagggcaaggggacatctcttttctaagctattgttctcgtctttattgttacaagttttctatttcgtttaggatcttgattccatctgttttagccctcgtataagattggcccctcatcttttgttgtcactctatattttgaatcatctagacatgattttgctgtttttctttgcacttaaaaatggttacttatgagatatttgcctcgtttcccgaca

SEQ ID NO: 3503 - DNA, 558 bp, Brassica oleracea
gtttggcagcggacgacgacggcaccgagcttcaccgaatatcaaaaatggtgaacattcctaagactaagaagacttactgtaagaacaaggaatgcaagaagcacactttgcacaaggtgacccagtacaagaagggtaaagacagtcttgctgcccaaggaaagcgtcgttatgaccgcaagcaatctggatatggtggtcagaccaaacccgtcttccacaagaaggctaagacaaccaagaagattgtgctgaggctccagtgccaaacctgcaagcatttctctcaacactcaattaagaggtgcaagcactttgagattggtggagacaagaagggaaaaggaacatccctcttttaagttgtttcctcttatctattttttttcatcttttgttggtacttgtcttggtaagacattcacttacattttgaatcttccagaaacggttatggacctatgatcttttcaatacattcgtatgagatattgtaaacctagttacattttatgcctatacatccctaatggtgattttgaatctaaagttctc

SEQ ID NO: 3504 - DNA, 505 bp, Brassica oleracea
gacggcacacaagcttcattcaaggtcagacgagcgaaaatggtgaacattccaaagacaaagaagacatactgcaagaacaaggaatgcaagaagcatacattgcacaaggtgacccaatacaagaaaggtaaagacagtcttgctgctcaaggaaagcgtcgttatgaccgtaagcaatctggttatggtggtcagactaagcctgtcttccacaagaaggctaagaccacgaagaagattgtcttgaggcttcagtgccaaacctgcaagcacttttctcagcattcgatcaagaggtgcaagcattttgagataggtggagacaagaaggggaagggaacatctcttttctaagttggtcttgtcttaactttttgcaagtattgttacttatgtcggatcatgattccatctgttttagctctcgtaaaagataatcccatctttgcttgttaaagatatggtttggctctttatcatttcacttctttgtcaataccag

SEQ ID NO: 3505 - DNA, 572 bp, Brassica oleracea
ggttggctagcagacgacggcacaacacgcttcaccggagatttcagaggagcgaaaatggtgaacattcccaagacaaagaagacatactgcaagaacaaggaatgcaagaagcataccttgcacaaggttacccaatacaagaagggtaaagacagtcttgctgcccaaggaaagcgtcgttatgaccgtaaacaatccggttatggtggtcagactaagcctgtcttccacaagaaggctaagaccacgaagaagattgtcttgaggcttcagtgccaaacctgcaagcacttctctcagcactcgatcaagaggtgcaagcattttgagatcggtggagacaagaagggaaagggaacatcacttttctaagctggtctcgtcttgagctttttacaagttttgtacttcgttggatcttgatttcatctgttttagctctcgtataagattgtttctcatccttgcttgttgactctaatattttgtatcatcaagatatggtttttctttttatctttgcactcatcagtcaatacaatcaaagtaaaacttaacgtccagttttt

SEQ ID NO: 3506 - DNA, 524 bp, Brassica rapa
gggctagcagacgacggcacacacgcttcaccggagatttcagaggagcgaaaatggtgaacattcccaagacaaagaaaacttactgcaagaacaaggaatgcaagaaacataccttgcacaaggttacccaatacaagaagggtaaagacagtcttgctgctcaaggaaagcgtcgttatgaccgtaagcaatctggttatggtggtcagaccaagcctgtcttccacaagaaggctaagaccacgaagaagattgtcttgaggcttcagtgccaaacctgcaagcacttctctcagcactcgatcaagaggtgcaagcattttgaaatcggtggagacaagaagggcaagggaacatcacttttctaagctggtctcgtcttgagctttttacaagttttgtacttcgttggatctttattttatctgttttagctctcgtataagattgtttctcatccttgcttgttgactctaatactttgtatcatcaagatatggtttttctttttatcaaaaaaa

SEQ ID NO: 3507 - DNA, 637 bp, Brassica rapa
  misc_feature (607)..(611): n is a, c, g, or t
  misc_feature (615)..(615): n is a, c, g, or t
  misc_feature (618)..(618): n is a, c, g, or t
  misc_feature (620)..(621): n is a, c, g, or t
  misc_feature (623)..(627): n is a, c, g, or t
  misc_feature (630)..(634): n is a, c, g, or t
ggggaagggaggagggtgaaggtgaaggaaatgtctgatgcggcgaggaaggctgtgatggatggaggatcgtcttctgtggcgacagctcggttcattgatgaattggcggaggacggcgacggcaggagctttcaccgaagagcgaaaatggtgaacattcccaagacaaagaagacttactgcaagaacaaggaatgcaagaagcatacattgcacaaggtcacccagtacaagaagggtaaagacagtcttgctgcccaaggtaaacgtcgttatgaccgcaaacaatccggttacggtggtcagaccaagcccgtcttccacaagaaggccaagacaaccaagaagattgtcttgaggctccagtgccaaacatgcaagcatttctctcaacactcgattaagaggtgcaagcactttgagattggtggagacaagaagggaaaaggaacatctctcttttaagttatttcctcttatctactttctttttcttgttactgtcttgcttcgatacttgaatacattttgaatcttccagaaatgcctatggtgttcaatttagatgacattgtcgtatgaaatatcttttagtttcgtgaannnnncttnaantnnannnnnaannnnnagc

SEQ ID NO: 3508 - DNA, 537 bp, Brassica rapa
ataaccccaacctagtgttccttacggttgtttggcagctgacgacgacggcgcgaacttcaccgaagatccaaaatggtgaacattccgaagactaagaagacttactgtaagaacaaggaatgcaagaagcataccttgcacaaggtgacccagtacaagaagggtaaagacagtcttgctgcccaaggaaagcgtcgttatgaccgcaagcaatctggatatggtggtcagaccaaacccgtcttccacaagaaggctaagacaaccaagaagattgtgctgaggctccagtgccaaacctgcaagcatttctcccaacactcaattaagaggtgcaagcactttgagattggtggagacaagaagggaaaaggaacatccctcttttaagttgttacttcttatctactttttatcttttgttggtacttgtcttgctaagacattcacttacattttgaatcttccagaaatggtttatggacctatgatctttttaatacattcgtatgagatattgtaaacttagttaca

SEQ ID NO: 3509 - DNA, 543 bp, Brassica rapa
gggctagcggacgacgacggcacacaagcttcattcaaggtcagccgagcgaaaatggtgaacattccaaagacaaagaagacatactgcaagaacaaggagtgcaagaagcatacattgcacaaggtgacccaatacaagaaaggtaaagacagtctcgctgctcaaggaaagcgtcgttatgaccgtaagcaatctggttatggtggtcagaccaagcctgtcttccacaagaaggctaagaccacgaagaagattgtcttgaggcttcaatgccaaacctgcaagcacttttctcagcattcaatcaagaggtgcaagcattttgagatcggtggagacaagaaggggaagggaacatctcttttctaagttggtcttgtcttaactttttgcaagttttgttactcatgtcggatcatgattccatctgttttagctctcgtataagataatcccatctttgcttgttaaagatatggtttgactctttatcattgcacttcttagtcaatacaatataactcgcaaaccaaaaaaaaa

SEQ ID NO: 3510 - DNA, 630 bp, Brassica rapa
gtaagcaacgtatcgttcgcggacgacggcacacaatcttcacccgagagagagagagatcagagtagcgaaaatggtgaacattccaaagacaaagaagacgtactgcaagaacaaggaatgcaagaagcacacattgcacaaggttacccaatacaaaaagggtaaagacagtctcgccgcccaaggaaagcgtcgttatgaccgtaagcaatctggttatggtggtcagaccaagcctgtcttccacaagaaggctaagaccacgaagaagattgtcctcaggcttcagtgccaaacttgcaagcacttttcgcagcactcaatcaagaggtgtaagcattttgagatcggtggagacaagaagggcaagggaacatctcttttctaagctgttgtcatcgtcttaattgttacaagttttctatttcgtttggatctgattccatctgttttagccctcgtataagattgtcccctcatctttggttgtcactctatattttgaatcatctagacatgattttgctgtttttctttgcacttgaaatggttacttttgagatatttgcctcgtttcccgacaatgcaagccaaaggccagagaggaagaagccaacctaatatttg

SEQ ID NO: 3511 - DNA, 462 bp, Brassica rapa
ggcggacgacggcacacaatcttcacccgagagagagagagagagatcagagtagcgaaaatggtgaacattccaaagacgaagaagacgtactgcaagaacaaggaatgcaagaagcacacattgcacaaggttacccaatacaaaaagggtaaagacagtctcgccgcccaaggaaagcgtcgttatgaccgtaagcaatctggttatggtggtcagaccaagcctgtcttccacaagaaggctaagaccaccaagaagattgtcctcaggcttcagtgccaaacttgcaagcacttttcacagcactcaatcaagaggtgcaagcattttgagatcggtggagacaagaagggcaagggaacatctcttttctaagcttttgtcgtcgtctgttttctgtttcgtttggatcttgattccatctgttttagccctcgtataagattgccccctcatcgt

SEQ ID NO: 3512 - DNA, 581 bp, Brassica rapa
gtttggcagctgacgacgacggcgcgaacttcaccgaagatccaaaatggtgaacattcctaagacaaagaagacttactgtaagaacaaggaatgcaagaagcataccttgcacaaggtgacccagtacaaaaagggtaaagacagtcttgctgcccaaggaaagcgtcgttatgaccgcaagcaatctggatacggtggtcagaccaaacccgtcttccacaagaaggctaaaacaaccaagaagattgtgctgaggctccaatgccaaacttgcaagcatttctctcaacactcaattaagaggtgcaagcactttgagattggtggagacaagaagggaaaaggaacatctctcttttaagttgcttcctcctatctactttttatcttttgttcgtacttgtctttgcttggacatccgaatacattttgaatcttccagaaatggttatggacctatgatctttttaatacattcgtatgagatattgtaaaactagttacaacaggcataaatgagttccatttatgcctatacatccctaatggtgattttcaatctaaagttctcaaaatgc

SEQ ID NO: 3513 - DNA, 596 bp, Bruguiera gymnorhiza
gagggtgcgcggtgctctttcccactctttcccacttcgtcgcgaacaatggtgaacgttccgaagacaaagaagacttactgcaaaagcaagcagtgcagaaagcacactttgcacaaggttacgcagtataagaaggggaaggatagcctttctgctcaggggaagcgtcgttatgatcggaagcaatcaggttatggagggcagacaaagccagttttccacaagaaggcaaaaactaccaagaagattgtgttgaggcttcagtgccagagctgcaagcatgtttcccaacaccccatcaagaggtgcaagcactttgagattggtggagacaagaagggcaagggaacatcactattttaagtgtgtgtgcttgtagttttgcgtattcaactttcgtaattggttttcaaccccatcaactgttatgcggtcattttgatttcatttggtttgtcttaagtttcaaggactattatagtacattgtagaagatcatgcagtttatgctttctgttcttggtaagtttttaccgacattatagcatctttgatacggcgattggtatctcctaagtcatataattcagaat

SEQ ID NO: 3514 - DNA, 600 bp, Brassica napus
tttttttttgggcagcggaggacgacgacggcgggagctttcaccgaagagcgaaaatggtgaacattcccaagactaagaagacttactgcaagaacaaggaatgtaagaagcataccttacacaaggtgacccagtacaagaagggtaaagacagtcttgctgcccagggtaaacgtcgttatgaccgcaagcaatccggttacggtggtcagaccaagcccgtcttccacaagaaggccaagacaaccaagaagattgtcttgaggctccagtgccaaacatgcaagcatttctctcagcactcaattaagaggtgcaagcactttgagattggtggagacaagaagggaaaaggaacatctctcttttaagttatttcctcttatctactctctttctgttggtactgtcttgcttcgatacttgaatacactttgaatcttccagaaatgcttatggtgttcaatttagatgactttgtcgtatgaagtatcttttagttccgtgaacctttctttctacacgcgttcgatgttttaattttcacgatatcttattattacaaacaaaccatctaagtagagaaattgtttactc

SEQ ID NO: 3515 - DNA, 527 bp, Brassica napus
ccggcaccgagcttcaccgaatagcaaaaatggtgaacattcctaagactaagaagacttactgtaagaacaaggaatgcaagaagcacactttgcacaaggtgacccagtacaagaagggtaaagacagtcttgctgcccaaggaaagcgtcgttatgaccgcaagcaatctggatatggtggtcagaccaaacccgtcttccacaagaaggctaagacaaccaagaagattgtgctgaggctccagtgccaaacctgcaagcatttctctcaacactcaattaagaggtgcaagcattttgagattggtggagacaagaagggaaaaggaacatccctcttttaagttgttacctctttatcaatttttttcatcttttgttggtactcgtcttgctaagacattcacttacattttgaatcttacagaaatggttatggacctacgatcttttcaatacattcgtatgagatattgtacacctagttacatttatgcctatacatccctaatggtgattttgaa

SEQ ID NO: 3516 - DNA, 503 bp, Brassica napus
cttcaccggagatatcagaggagcgaaaatggtgaacattcccaagacaaaaaagacttactgcaagaacaaggaatgcaagaaacataccttgcacaaggttacccaatacaagaagggtaaagacagtcttgctgctcaaggaaagcgtcgttatgaccgtaagcaatccggttatggtggtcagactaagcctgtcttccacaagaaggctaagaccacgaagaagattgtcttgaggcttcagtgccaaacctgcaagcacttctcccagcactcgatcaagaggtgcaagcattttgaaatcggtggagacaagaagggcaagggaacatcacttttctaagctggcctcgtcttgagctttttacaagttttgtacttcgttggatcttgatttcatctgttttagctctcgtataagattgtttctcatccttgcttgttgactctaatattttgtatcatcaagatatggtttttctttttgtcattgcgctcat

SEQ ID NO: 3517 - DNA, 626 bp, Brassica napus
ataatagaagtgctccctgcaggtaccggtccggatttgccgagtcgacaccacgcgtccgcggcacacaatcttcacccgagagagagatcagagtagcgaaaatggtgaacattccaaagacaaagaagacgtactgcaagaacaaggaatgcaagaagcacacattgcacaaggttacccaatacaaaaagggtaaagacagtctcgccgctcaaggaaagcgtcgttatgaccgtaagcaatctggttatggtggtcagaccaagcccgtcttccacaagaaggctaagaccacgaagaagattgtcctcaggcttcagtgccaaacttgcaagcacttttcgcagcactcaatcaagaggtgcaagcattttgagatcgggggagacaagaagggcaaggggacatctcttttctaagctattgttctcgtctttattgttacaagttttctatttcgtttaggatcttgattccatctgttttagccctcgtataagattgtcccctcatcttttgttgtcactctatattttgaatcatctagacatgattttgctgtttttctttgcacttaaagatggttacttttgagatatttgcctcgtttcccgacaatgcaa

SEQ ID NO: 3518 - DNA, 620 bp, Brassica napus
acgggtccacccacgcgtcttcgaacgcgtggacggcacacaatcttcacccgagagagagatcagagtagcgaaaatggtgaacattccaaagacgaagaagacgtactgcaagaacaaggaatgcaagaagcatacattgcacaaggttacccaatacaaaaagggtaaagacagtctcgccgcccaaggaaagcgtcgttatgaccgtaagcaatctggttatggtggtcagactaagcctgtcttccacaagaaggctaagaccacgaagaagattgtcctcaggcttcagtgccaaacttgcaagcacttttcgcagcactcaatcaagaggtgtaagcattttgagatcggtggagacaagaagggcaagggaacatctcttttctaagctgttgtcatcgtcttaattgttacaagttttctatttcgtttggatctgattccatctgttttagccctcgtataagattgtcccctcatctttggttgtcactctatattttgaatcatctagacatgattttgctgtttttctttgcacttgaaatggttacttttgagatatttgcctcgtttcccgacaatgcgagccaaaggccagagtctctttgacg

SEQ ID NO: 3519 - DNA, 655 bp, Brassica napus
ggcacacacgcttcaccggagatttcagaggagcgacaatggtgaacattcccaagacaaagaagacatactgcaagaacaaggaatgcaagaagcataccttgcacaaggttacccaatacaagaagggtaaagacagtcttgctgcccaaggaaagcgtcgttatgaccgtaaacaatccggttatggtggtcagactaagcctgtcttccacaagaaggctaagaccacgaagaagattgtcttgaggcttcagtgccaaacctgcaagcacttctctcagcactcgatcaagaggtgcaagcattttgagatcggtggagacaagaagggaaagggaacatcacttttctaagctggtctcgtcttgagctttttacaagttttgtacttcgttggatcttgatttcatctgttttagctctcgtataagattgtttctcatccttgcttgttgactctaatattttgtatcatcaagatatggtttttctttttatctttgcactcatcagtcaatacaatcaaagtaaaacttaaacgtccaagaaaaagcaacctagtggtctgggagcctgcccgggcggggccggggcgtggtgcgcttcgggggggctgtcttaggggattcagctttatcttggcttgcgtgga

SEQ ID NO: 3520 - DNA, 627 bp, Brassica napus
cttttgtttttgcttttcttactgaacaaagacaatggagatattacttaacaaaatacaaagggagtggggttttttggcagctgacgacgacggcgcgaacttcaccgaagatccaaaatggtgaacattcctaagacaaagaagacttactgtaagaacaaggaatgcaagaagcataccttgcacaaggtgacccagtacaaaaagggtaaagacagtcttgctgcccaaggaaagcgtcgttatgaccgcaagcaatctggatacggtggtcagaccaaacccgtcttccacaagaaggctaaaacaaccaagaagattgtgctgaggctccaatgccaaacttgcaagcatttctctcaacactcaattaagaggtgcaagcactttgagattggtggagacaagaagggaaaaggaacatctctcttttaagttgcttcctcctatctactttttatcttttgttcgtacttgtctttgcttggacatccgaatacattttgaatcttccagaaatggttatggacctatgatctttttaatacattcgtatgagatattgtaaaactagttacaacaggcataaatgagttccatttatgcctatacatccctaatggt

SEQ ID NO: 3521 - DNA, 570 bp, Brassica napus
ggtgtttgatagggtttactataagttgtgtttcttttgctagcggacgacgacggcacacaagcttcattcacggtcagacgagcgaaaatggtgaacattccaaagacaaagaagacatactgcaagaacaaggaatgcaagaagcatacattgcacaaggtgacccaatacaagaaaggtaaagacagtctcgctgctcaaggaaagcgtcgttatgaccgtaagcaatctggttatggtggtcagactaagcctgtcttccacaagaaggctaagaccacgaagaagattgtcttgaggcttcagtgccaaacctgcaagcacttttctcagcattcgatcaagaggtgcaagcattttgagataggtggagacaagaaggggaagggaacatctcttttctaagttggtcttgtcttaactttttgcaagtattgttacttatgtcggatcatgattccatctgttttagctctcgtataagataatcccatctttgcttgttaaagatatggtttggctctttatcatttcacttctttgtcaataccatataactcgcaaatc

SEQ ID NO: 3522 - DNA, 509 bp, Brassica napus
ggcacacaagcttcattcaaggtcagccgagcgaaaatggtgaacattccaaagacaaagaagacatactgcaagaacaaggagtgcaagaagcatacattgcacaaggtgacccaatacaagaaaggtaaagacagtctcgctgctcaaggaaagcgtcgttatgaccgtaagcaatctggttatggtggtcagaccaagcctgtcttccacaagaaggctaagaccacgaagaagattgtcttgaggcttcaatgccaaacctgcaagcatttttctcagcattcaatcaagaggtgcaagcattttgagatcggtggagacaagaaggggaagggaacatctcttttctaagttggtcttgtcttaactttttgcaagttttgttactcatgtcggatcatgattccatctgttttagctctcgtataagataatcccatctttgcttgttaaagatatggtttgactctttatcattgcacttcttagtcaatacaatataactc

SEQ ID NO: 3523 - DNA, 475 bp, Brassica napus
gcggacgacgccggcaccgagcttcaccgaatagcaaaaatggtgaacattcctaagactaagaagacttactgtaagaacaaggaatgcaagaagcacactttgcacaaggtgacccagtacaagaagggtaaagacagtcttgctgcccaaggaaagcgtcgttatgaccgcaagcaatctggatatggtggtcagaccaaacccgtcttccacaagaaggctaagacaacaaagaagattgtgctgaggctccagtgccaaacctgcaagcatttctctcaacactcaattaagaggtgcaagcactttgagattggtggagacaagaagggaaaaggaacatccctcttttaattttttcatcttttgttggtactcgtcttgctaagacattcacttacattttgaatcttccagaaatggttatggacctacgatcttttcaatacattcgtatgagatattgtacacc

SEQ ID NO: 3524 - DNA, 515 bp, Brassica napus
gacggcgcgaacttcaccgaagatccaaaatggtgaacattccgaagactaagaagacttactgtaagaacaaggaatgcaagaagcataccttgcacaaggtgacccagtacaagaagggtaaagacagtcttgctgcccaaggaaagcgtcgttatgaccgcaagcaatctggatatggtggtcagaccaaacccgtcttccacaagaaggctaagacaaccaagaagattgtgctgaggctccagtgccaaacctgcaagcatttctcccaacactcaattaagaggtgcaagcactttgagattggtggagacaagaagggaaaaggaacatccctcttttaagttgttacttcttatctactttttatcttttgttggtacttgtcttgctaagacattcacttacattttgaatcttccagaaatggtttatggacctatgatctttttaatacattcgtatgagatattgtaaacttagttacatccctagtggtgattttgaatcta

SEQ ID NO: 3525 - DNA, 639 bp, Catharanthus roseus
agaaatcaactgaagttggggtttcccggaactgcattaacgccgctcacaccacaagagccgacctcgcagaatcacttgcgttgtcaaaatggttaacgttcccaagacaaagaaaacatactgcaaatcaaaggaatgcaaaaagcataccttgcacaaggttacccaatataagaaggggaaggatagcctggctgctcaggggaagcgtcgttatgatcgcaagcaatcaggatatggtggacagactaaacccgttttccacaagaaggcaaaaaccacaaagaagattgtcctgaggctacaatgtcagggttgcaagcatgtttcacagcatccaatcaagaggtgtaagcattttgagattggtggagacaagaagggaaagggaacctctcttttctaggaagctgggtgtcaatgtttaattgctattttatctcatgttttagtttcatatatgcttttggatttgaaatacaatcaaggaacattttatctttaatgggtgttacatagaagttggctttgtagccttctcttttgttcctcatttacccatttgcaattttgtatcaactctaaatgaccttgttggtatcttagaaattatgcataatatggtggaatgattca

SEQ ID NO: 3526 - DNA, 534 bp, Castanea mollissima
cttatctgaaagcgcctccacaccgcaaatcgtagcaaccatggtgaacgttcctaagacaaagaagacatactgcaagagcaaggagtgcaggaagcacaccttgcataaggttacacagtacaagaagggcaaggatagtcttgctgctcagggaaagcgccgctatgaccgcaagcaatctggttatggaggacagaccaaaccagtcttccacaaaaaggcaaagactacgaagaagattgtgctaaggttgcagtgccagagctgcaagcacatgtcacaacatccaattaagcgctgcaaacactttgaaattgggggtgataaaaaaggcaaggggacctctcttttctagatgcgttctgttggttgtattttatgttgctttacttatcaatcttgttggagcttgaaagctaaaattggataattattcagttttgtttcttagtctaattttgtagtggaacagcaagttttttctgatcaccatttatgattactgttatggtttgactgtttgagattaaa

SEQ ID NO: 3527 - DNA, 573 bp, Cicer arietinum
gattagcgtggtcgcgacggcagcacaaaacttcgtctttcagatccggatccacgcgccgccatcatggtgaacgttccaaagacgaagaagacatactgcaagagcaaggagtgcaagaagcacacactccacaaagtgactcaatacaagaagggtaaggatagcatcgccgctcaaggtaagcgtcgttacgatcgcaaacagtccggttatggtggtcagactaagcccgtcttccacaagaaggctaaaaccactaagaaaattgttctgaggctgcaatgccaaggttgcaagcatgtttcccaacatgctatcaagaggtgcaagcactttgagattggtggtgacaagaagggcaagggaacttctcttttctaggtggagaattaggatttattactgttttgatgtgttattttccgtgttgggatgttttgtttctctatggatttctcatagctatattttattatttggaatacttttttgtgattgacaagtgaaaactattgctaatatcaatcagtacttgtttttgttacttgagtaccttgaatgattttaata

SEQ ID NO: 3528 - DNA, 399 bp, Cicer arietinum
gattagcgtggtcgcggccgaggtctcaactcaacgctacaatggttaacgttccaaagacaaagaaaacatactgcaaaagcaaggaatgcaaaaagcataccttacacaaagttacccaatacaaaaagggtaaagatagcatcgctgctcagggaaagcgtcgttatgatcgcaaacaatctggttatggtggtcagactaaacctgtttttcacaaaaaggccaaaaccactaagaaaattgtcttgaggcttcagtgtcaaggttgcaaacatgtttctcaacatgctattaagaggtgcaagcactttgagattggtggtgataagaagggaaaaggaacgtctctattttagttgcagaattagaattctgcattttccatgtgtttttcta

SEQ ID NO: 3529 - DNA, 462 bp, Cirsium arvense
catcctctcggtcaaatttcagtagctcttcagccatggtgaacgttcccaagacgaagaagacttactgcaagaacaaggaatgcagaaagcataccttgcataaggtgacccaatacaagaagggaaaagatagtttggctgcacaaggaaagcgtcgttatgacaggaaacaatccggttatggtggtcaaaccaaacccgtctttcacaagaaggcaaaaaccacaaagaagattgtgctaaggttgcaatgccaaggttgcaagcatgtttctcagcacccaattaagagatgcaagcattttgaaattggtggagacaagaagggcaagggaacttcacttttttaagcagtttgttgcaggcttgcagctactattcatatttttgttctagcagactttttatgtattttgaaatttatattgcaagagccttttagcttttgacacatctgcc

SEQ ID NO: 3530 - DNA, 576 bp, Trifolium pratense
cttctttcttcaaccttcttcgtttgtccagccacccgatctcaaaccccactccgccacaatggtgaacgttccaaagacaaagaaaacatactgcaaaagcaaggagtgcaagaagcacaccttacacaaagttacccaatacaaaaagggtaaagacagtatcgctgctcagggaaaacgtcgttatgatcgcaaacaatctggttatggtggacagaccaagcctgtttttcacaaaaaggctaaaactactaagaaaattgtgttgaggcttcagtgtcaaggttgcaaacatgtttctcaacatgctattaagaggtgcaagcactttgagattggtggtgacaagaagggaaaaggaacatctctgttttaggtggaaaaagttagaattttgcagtttcactgtgtttttcttttgtcctatccatctttggtttattaattttgcagaaatactttgtgtttgagatttttgttctgatatttctaatgactactggtttattactttacttgattttttgcaatgccaccatgttttcgttcattctgctatattgttttgttgga

SEQ ID NO: 3531 - DNA, 708 bp, Coffea canephora
agggttttctcagacggcataatcccaaattcccagagctcactcttgtgcgtcctctctccgccgtccaaaatggttaacgttccaaagacaaagaagacatactgcaaatccaaggagtgcaaaaagcacaccttgcacaaggttacacagtataagaaagggaaggatagtcttgctgctcagggaaagcgtcgttatgatcgcaaacaatcaggttatggtggacagaccaagcccgtcttccacaaaaaggccaaaactacaaagaagattgtgctaaggctgcaatgccagggttgtaagcacgtttcacagcaccctatcaagaggtgcaagcactttgaaattggtggtgataagaagggaaaggggacctctctgttctaagaagctggagaatgccgttggaatgcttttgttttgtaatctttcattttgttcgactattttagaatatttatcatcttatatggatttgacgttaagctgttctagcaagtattgagttgtttgtggaggatggttcaactcagtcctttgtccgctatgattcatgatcagtgattttaggcttcttctcgtgtgtttgctttaggccaattgtatggttcatagttgtagtccttcctgcgcatgcttcgtcggcgtgggagttggattctctctctttcggggatataattgctggtaatataaagtcgttga

SEQ ID NO: 3532 - DNA, 548 bp, Conyza canadensis
ggtgccgtttgcctgaaaccctatcgcctctttctttgcttgccattttctatagctcgtcaccatggttaatgtacccaagacaaagaagacctactgcaaaaacaaggagtgcaggaagcacactttgcacaaggtgactcaatataagaagggaaaagatagcttggccgcccaagggaaacgtcgttatgacaggaaacagtctggttatggtggtcagacaaagcctgtgtttcacaagaaggcaaaaacaaccaagaagattgtgttaaggttgcaatgccaaggttgcaagcatgtttcccagcaccccattaagaggtgcaagcattttgaaattggtggagacaagaagggcaagggaacctctcttttctaagcagttattgtacttggctttctgctatgcgatatttttggcagacctttaatgtaatctctctttcaggtttacaatgcaagtatgtaatgactatgggaattttgcttgtttttcttactgaatttgatacttttaaacgtaaaatcaaatctgtgtttgagtc

SEQ ID NO: 3533 - DNA, 655 bp, Solanum melongena
ctttcgatcggcaccagctgaacggcgactgtgctctctgctatttctgtctaactctcggcgtgcgaaaatggtgaacgttcctaagacaaagaagacctactgcaagtccaaggagtgcaaaaagcacaccttgcataaggtcacacaatacaagaaagggaaagatagcttggctgctcagggaaagcgtcgttatgacaggaaacagtcaggttatggtggtcagacaaagcctgtcttccacaaaaaggctaagaccacaaagaagattgtgttgaggttgcaatgccaaggttgcaaacatgtttcacagcacccaatcaagaggtgcaagcattttgaaattggtggggacaagaaaggaaagggaacctctcttttctagattgcctgtgaagtcaccaagaacttcctttttttgccttctcttatgttgcaatgttgaacttttggttattttggatattggttctttgtgttacaatgtcttccaatagatgattttgcattatgatagttgtatggaggtcctatctatattctagttttttttgatagtatggttactttttaagtaattgagtttgaagccattgggatgcagttctgacgtttattgatataatagtaatgtctctacaaggattgctct

SEQ ID NO: 3534 - DNA, 641 bp, Solanum melongena
cagggtttctggacgctagcagagcaaaggtgttttctccttcctgcttcgactcagtcatcgacaatggtgaacgttccaaaaactaagaagacatactgcaagtcgaaggaatgcaaaaagcacactttgcataaagtaacacagtacaagaaaggaaaagatagcctagcagctcaagggaagcgtcgttatgatcgcaagcagtctggttatggtgggcaaacaaaacccgtcttccacaagaaggccaaaactaccaagaagattgtgctaaggttgcaatgccaaggatgcaaacatgtgtctcaacacccaatcaagaggtgcaagcactttgaaatcggtggagataagaagggaaaaggaacttctctgttttaagtggcgagttcagagagatgctatcgtttacttttgtattatgttgtccttttttctcaagtgatgtagctcaacagtgtttctttcgcttgatgaacaacttaagtttgttgcaaaattctcttcttttgagttttaaattaagatctcagctatatttttttctttgcttctcattcaattttcacttgggatgaaatttatttgaatactcgaaacgttgaaacttccattctatttggtgctctttccttccg

SEQ ID NO: 3535 - DNA, 670 bp, Solanum melongena
atcttcacacatcaaagctttattcagtcaatcttctctgccatttcggttccatctccgccggcgacaatggtgaacgttcctaagacgaagaagacctactgcaagtccaaggagtgcaagaagcacaccttgcataaggttacacaatacaagaagggcaaagatagcttagctgctcagggaaagcgtcgttatgatcgtaagcaatcaggttatggaggacagacaaaacctgtcttccacaaaaaggcaaagaccacaaagaagattgtcttgagattgcaatgccaaggttgcaaacatgtgtctcagcacccaatcaagaggtgcaagcattttgagattggcggggataagaaaggaaaaggaacctctcttttctagattgcttgtgatgcagaatttgatatttctcctgttctattcactgttcagatatttttgttatattgaatgtagtcaaggagtttatattatcgattcgtgattaattatgtgctccgtcagtgattatcggaagatgaaatgaatatttccagttttcgatttagcgttttgataagtcttgttgatgcaatgataggcaattctgttctactgccatactgtccttggctccatcaatttgtacaatggtgttatattgtaggcttaacaacttgaaaat

SEQ ID NO: 3536 - DNA, 488 bp, Euphorbia peplus
cgcggatctttgctcttctgtctatagggttgttggaggccaagcacaatggtgaacgttcccaagactaagaaaacttactgtaaaagcaaggaatgccgcaagcacaccttgcacaaggttactcagtacaagaaaggaaaggatagcctatcagctcaggggaaaaggcgttatgatcgcaaacagtcaggatatggtgggcagacaaagcctgtgttccacaagaaggctaaaaccacaaaaaagatcgttctgaggctgcaatgccaaggctgcaagcatgtctcacagcatccaattaagaggtgcaaacattttgagatcggtggagacaagaagggcaagggaacttcactcttttagatgcaggttttttcaaatgtttttgatgtacttgttgaactcttctccaggagctggattaaatctagaattatcttcctcattttctttcttttagttgattgctagacatgttaatggta

SEQ ID NO: 3537 - DNA, 514 bp, Flaveria ramosissima
acggctctcggcatttctgttcaccggagatcttcaaggcttcaaccatggttaatgttccaaagactaagaagacttactgcaagaacaaggaatgccgaaagcacacattgcataaggtgacacagtacaagaagggaaaagatagtttggctgctcaaggaaagcgccgttatgacaggaagcagtcaggttatggtggtcagactaagcccgtctttcacaagaaggcgaaaactacaaagaagattgtgctgaggctgcaatgccaaggttgcaagcatgtgtcccagcacccaatcaagagatgcaagcatttcgagattggtggagacaagaagggcaagggaacgtcacttttctaagttataggtatgggtcactttttcatttatagacttacggatgttgcatctccttcaagtttttgtgcttgtttgtattttcttgacacacttgagtattttactgtattgagtgaattttgcattgaaagtagattaaaatgtaggtt

SEQ ID NO: 3538 - DNA, 518 bp, Flaveria ramosissima
tcgctttgcggctcattttctctcgatcgacttcaggaaccctgtagccatggtgaacgttcctaagaccaagaagacctactgcaagaacaaggaatgcagaaaacataccttgcataaggttacacaatacaagaagggaaaagatagcttggctgcacaaggaaagcgtcgttacgacaggaaacaatctggttatggtggtcaaacaaaacccgtgtttcacaagaaggcaaaaaccacgaagaagattgtgctaaggttgcaatgccaaggctgcaagcatgtctcccagcacccaatcaagagatgcaagcattttgaaatcggtggagacaagaagggcaagggaacatctcttttctgagcaattgttgcagggttacttgcagctactatatcgtttttacttttgttttagcagactattcaggtttaagtgtttgaaatttgtattccaagggcctatttgttttgacacatctgtctggagaaatgaaagccttgtcattaacatg

SEQ ID NO: 3539 - DNA, 502 bp, Flaveria ramosissima
ctaataattcatatatttgtgcggctgtcaatctcatatctttcggtcgattttcaggagctcttcaaccatggttaacgttccaaagaccaagaagacttactgcaagaacaaggaatgccgaaagcataccttgcataaggtgacgcagtacaagaaggggaaagacagcttggctgcacagggaaagcgtcgttatgacaggaaacaatccggttatggtggtcaaaccaagccagtgtttcacaagaaggcaaaaaccaccaagaagattgtgctaaggttgcaatgccaaggctgcaagcatgtctcccagcacccaatcaagagatgcaagcattttgaaattggtggagataagaagggcaagggaacatctctcttttgatcagttttgtgtaattttgttgcaggtactatctttatttttgttgtagcagacttctcactgtttaagtttttgaaacttgtaatgcaagtatccgttttgatttgagtattt

SEQ ID NO: 3540 - DNA, 496 bp, Flaveria ramosissima
tgcggctcatctttctctcgatcgacttcaggaactctgtagccatggtgaacgttcctaagaccaagaagacctactgcaagaacaaggaatgcagaaaacataccttgcataaggttacacaatacaagaagggaaaagatagcttggctgcacaaggaaagcgtcgttacgacagaaaacaatctggttatggtggtcaaacaaaacccgtgtttcacaagaaggcaaaaaccacaaagaagattgtgctaaggttgcaatgccaaggctgcaagcatgtctcccagcacccaatcaagagatgcaagcattttgaaattggtggagacaagaagggcaagggaacatctcttttctgagcaatttgttacaggcttgcttgcagctactatatcgttatttttttgtttagcagaccattcaggtttttaagtgtttgaagtttgtattgcaagggcctattttgtttttgtacacatctgtctggagaaat

SEQ ID NO: 3541 - DNA, 389 bp, Flaveria ramosissima
cttcaaccatggttaatgttccaaaaactaagaagacttactgcaagaacaaggaatgccgaaagcacacgttgcataaggtgacacagtacaagaagggaaaagatagtttggctgctcaaggaaagcgccgttatgacaggaagcagtcaggttatggtggtcagactaagcctgtctttcacaagaaggcgaaaactacaaagaagattgtgctgaggctgcaatgccaaggttgcaagcatgtgtctcagcatccaatcaagagatgcaagcatttcgagattggtggagacaagaagggcaagggaacttcacttttctaagtaatagttatgtgtcacttttatataatagacttacagatgttgcatctctttcaagttttt

SEQ ID NO: 3542 - DNA, 430 bp, Flaveria ramosissima
ctctcggtcgacttcaggaactctctaacaatggtgaacgttcctaagaccaagaagacctactgcaagaacaaggaatgcagaaaacataccttgcataaggttacacaatacaagaagggaaaagatagcttggctgcacaaggaaagcgtcgttacgacaggaaacaatctggttatggtggtcaaacaaaacccgtgtttcacaagaaggcaaaaaccacaaagaagattgtgctaaggttgcaatgccaaggctgcaagcatgtctcccagcacccaatcaagagatgcaagcattttgaaatcggtggagacaagaagggcaagggaacatctcttttctgagcaatttgttgcaggcttgcttgcagctactatatcgtatttttttttgttttgcagactattcaggtttaagtgtttgagg

SEQ ID NO: 3543 - DNA, 438 bp, Flaveria ramosissima
atggttaacgttccgaagaccaagaagacctactgcaagaacaaggaatgcagaaagcataccttgcataaggtgacacagtacaagaagggtaaggacagcttggctgcacagggaaaacgtcgttatgacaggaaacaatctggttatggtggtcaaactaagcccgtgtttcacaagaaggcaaaaaccaccaagaagattgtgctaaggttgcaatgccaaggctgcaagcatgtctcccagcacccaatcaagagatgcaagcattttgaaattggtggagataagaagggcaagggaacatctctcttttgatcaattttgtgtaattttgttgcaggtactatctttatttttgttgtagcagacttttcactgtttaagtttttgaaacttgtaatgcaagtatccgtttttatttgagtatttgacata

SEQ ID NO: 3544 - DNA, 529 bp, Flaveria ramosissima
gcaatcttaagaaccctagtatcgcactgcggctcatctttctctcgatcgacttcaggaactctgtagccatggtgaacgttcctaagaccaagaagacctactgcaagaacaaggaatgcagaaaacataccttgcataaggttacacaatacaagaagggaaaagatagcttggctgcacaaggaaagcgtcgttacgacaggaaacaatctggttatggtggtcaaacaaaacccgtgtttcacaagaaggcaaaaaccacaaagaagattgtgctaaggttgcaatgccaaggctgcaagcatgtctctcagcacccaatcaagagatgcaagcattttgaaatcggtggagacaagaagggcaagggaacatctcttttctgagcaatttgttgcaggcttgcttgcagctactatatcgtaattttttgtttttagtcagactattcaggtttaaggtgtttgtaagtttgttattgcaagggccgtattttgtttttgtacacatctgtctggagaaatag

SEQ ID NO: 3545 - DNA, 456 bp, Flaveria ramosissima
tcaaccatggttaatgttccaaagactaagaagacttactgcaagaacaaggaatgccgaaagcacacactgcataaggtgacacagtacaagaagggaaaagatagtttggctgctcaaggaaagcgccgttatgacaggaagcagtcaggttacggtggtcagactaagcccgtgtttcacaagaaggcgaaaactacaaagaagattgtgctgaggctgcaatgccaaggttgcaagcatgtgtcccagcacccaatcaagagatgcaagcatttcgagattggtggagacaagaagggcaagggaacctcacttttctaagttatagctatgcgtcaccttttcatatttagacttacggatgctgcatctccttcaagtttttgtgcttgtttgtattttcttgacacacttgagtattttactgtattgagtgaattttgcattaaaagt

SEQ ID NO: 3546 - DNA, 422 bp, Flaveria ramosissima
tgtgcggctgtcaatctcatctctttcggtcgattttcaggagctcttcaaccatggttaacgttcctaagaccaaaaagacttactgcaagaacaaggaatgccgaaagcataccttgcataaggtgacgcagtacaagaaggggaaagacagcttggctgcacaaggaaagcgtcgttatgacaggaaacaatccggttatggtggtcaaaccaagccagtgtttcacaagaaggcaaaaaccactaagaagattgtgctaaggttgcaatgccaaggctgcaagcatgtctcccagcacccaatcaagagatgcaagcattttgaaattggtggagataagaagggcaagggaacatctctcttttgatctagtttgtgttaattttgttgctaggtactattcttttatttttgttgt

SEQ ID NO: 3547 - DNA, 446 bp, Flaveria ramosissima
tgcggctcttctttctctcgatcgacttcaggaactctgtagccatggtgaacgttcctaagaccaagaagacctactgcaagaacaaggaatgcagaaaacataccttgcataaggttacacaatacaagaaaggaaaagatagcttggctgcacaaggaaagcgtcgttacgacaggaaacaatctggttatggtggtcaaacaaaacccgtgtttcacaagaaggcaaaaaccacaaagaagattgtgctaaggttgcaatgccaaggctgcaagcatgtctcccagcacccaatcaagagatgcaagcattttgaaatcggtggagacaagaagggcaagggaacatctcttttctgagcaatttgttgcaggattacttgcagctactatatcgttatttttttttgttttgctatactattctaggtttaagtgtttgag

SEQ ID NO: 3548 - DNA, 353 bp, Flaveria ramosissima
cggagatcttcagccatggttaatgttccaaagactaagaagacatactgcaagaacaaggagtgcagaaagcacaccttgcataaggtgacacaatacaagaagggaaaagatagtttggctgcacaagggaagcgtcgttatgacaggaaacagtcggggtatggtggtcaaaccaagcctgtttttcacaagaaggctaagaccaccaagaagattgtgctgaggttgcaatgccaaggctgcaagcatgtgtctcagcacccaattaagagatgcaaacattttgagattggtggagacaagaagggcaagggaacttcactcttttaagcattgttttatatatgtag

SEQ ID NO: 3549 - DNA, 536 bp, Flaveria ramosissima
cctgtggagccttaaagcgaaccacgagccatcggtagaaccctagtaacgcagtgcggctgatcgtctcatctttccctcggtcatagccatggtgaacgttcctaagacaaagaagacctactgcaagaacaaggaatgcagaaaacataccttgcataaggttacacaatataagaagggaaaagatagcttggctgcacaaggaaagcgccgttacgacaggaaacaatctggttatggtggtcaaacaaaacccgtgtttcacaagaaggcaaaaaccacgaagaagattgtgctaaggttgcaatgccaaggctgcaagcatgtctcccagcacccgatcaagagatgcaagcactttgaaatcggtggagacaagaagggcaagggaacatctcttttctgagcaatttgttgcaggcttgcttgccgctactatatcgtatttttgttttagcagacttttcaggtttaagtgtttgaaatttgtattgcaagggcctattttgtttttgacacatctgtctggagaa

SEQ ID NO: 3550 - DNA, 609 bp, Linum usitatissimum
ggttcaacattttttgtcctagcctggacacagagctttcttgcttagtcgcagccatggtgaacgtaccaaagacaaagaagacgtattgcaagagcaaggagtgcaaaaagcacaccttgcataaggttacacagtataaaaagggaaaggatagtctggctgcccaaggaaagcgtcgttatgaccgcaaacagtcaggttatggaggtcaaaccaagcctgtctttcacaagaaggctaaaactacaaagaagatcgtgttgaggttacaatgccaaggttgcaagcacgtctcccagcatccaatcaagaggtgcaagcactttgagattggaggtgacaagaaggggaaaggaacgtctctcttttaaatcaatacaattgtttaccttgttattgtgcttcattgttactatctcctccttatggagtcctgctaacttggcattttgtctagttttgttacctattgaaatggttttgaaggttgtagtgtgtaattctctactgctctaagtttcaacagagtttatactgcccagaatatttgcacctgcaattgagcgtggttgcgtcatacccaacctagctagcagttttcagttt

SEQ ID NO: 3551 - DNA, 729 bp, Linum usitatissimum
gttcgccgctggctctggattgtcgttgcatctcacagagagcacccaagctgcaactccgccggcaacaatggtgaacgttcccaagacgaagaagacctactgcaagagcaaggagtgcaagaagcacactctacacaaggtcacccagtacaagaagggtaaggatagtcttgctgctcagggaaagcgtcgttatgaccgcaaacaatccggttatggtggtcagaccaagcctgtcttccacaagaaggcaaagaccacaaagaagattgtcctgaggctgcaatgccaaggatgcaagcatgtctctcagcacccaatcaagagatgcaagcacttcgagatcggtggagacaagaagggcaagggaacatctctgttctaaatgcagttcatctgtttttctcgtttgttgttctattagttgaactttgaagactttagttagtattttctgaactctgtaactgttggtttttgatcgaatttgcctttgttattctcagttgaactagactgttttatcatacgaatattgccagtggcgtttaggcttggtttcagttccttattatcaaccttaagttaggtattgttgatcaaaatattctattgggttagtaggtttaagtgagagtcaactggtctgcgagcttcgaaagtgttgttccggcctgcctaggccccccagtgttaagatttgtgcatcatggcaaatttttggta

SEQ ID NO: 3552 - DNA, 639 bp, Linum usitatissimum
ggttctcgttcgccgctggctctggattgtcgttgcatctcacggagagcacccaagcagcaactccgccggcaacaatggtgaacgttcccaagacgaagaagacctactgcaagagcaaggagtgcaagaagcacactctgcacaaggtcacccagtacaagaagggtaaggatagtcttgctgctcagggaaagcgtcgttatgaccgcaaacaatctggttatggtggtcagaccaagcccgtcttccacaagaaggcaaagactacgaagaagattgtcctgaggctgcaatgccagggatgcaagcatgtgtctcagcacccaatcaagagatgcaagcacttcgagattggtggagacaagaagggcaagggaacatctctgttctaaatgcagttcatctgttttttttttctcgtttgttgttctattagttgaactttgaagacttaagttagtatttgctgagctctgtaactgttggttatgatcgaatttgccttgttatttagttaagctagactgttttatcatacgaattcgtttcttcccttaaccaattcgcttcttcctctttcggtcttgtatggtttgctacattgtgatcttgaagttctggagtaaaatggtggcg

SEQ ID NO: 3553 - DNA, 669 bp, Linum usitatissimum
gagctttctcgcttagtcgcagccatggtgaacgtaccaaagacaaagaagacgtattgcaagagcaaggagtgcaaaaagcacaccttgcataaggttacgcagtataaaaagggaaaggatagtctggctgcccaaggaaagcgtcgttatgaccgaaagcaatcaggttatggaggtcaaaccaagcctgttttccacaagaaggctaaaactacaaagaagatcgtgttgaggcttcaatgccaaggttgcaagcacgtgtcccagcacccaatcaagaggtgcaagcactttgagattggaggtgacaagaaggggaaaggaacttctctcttttaaatcaatagcttggtattgtgtttcattgttactattctaccttgcttatggagtcctgctaacttggcatttatctttgtctagttttgttactattgagatggttttgaaggttgtagtctgtaattctctactgccttatctttcaatagagttggttaatactgcccagaatattttcaccctgcaattgagcgtggttccgaaaacaattacctggttgtgttatacccgaccaagctagcagttatcagtttttttgcctctgtactggtttagggttgcatgtactttgttcgtttcatttgcctttcctccctgttttcc

SEQ ID NO: 3554 - DNA, 554 bp, Linum usitatissimum
tcagcacatctggatttatcgtttgtacaccgagggttccaatctctccaagctccaactccgccgttaacgatggtgaacgttccaaagacaaagaagacctactgcaagagcaaggagtgcaagaagcacactctgcacaaggtcactcagtacaagaagggtaaggatagtctggcagctcaaggaaagcgccgttatgatcgcaaacaatctggttatggaggtcaaaccaagcctgttttccacaagaaggcaaaaaccacgaagaagattgttctgaggctccagtgccaaggatgcaagcatgtgtctcagcacccaatcaagaggtgcaagcattttgagataggcggagacaagaaggggaagggaacatctctgttctagatagatgcaagttgtcggctgtttttgttatcgttctgttagtggaactgtaaggtcatgtttagtatatgtgaacttggttggtgattgttggttaatcgaagaagattgctttggtgttctgttaaagtatagggtctgagtcttgcattcagagcttgaga

SEQ ID NO: 3555 - DNA, 635 bp, Linum usitatissimum
gacagaacgggcctaggattaaagaaacccgatttcgaatcgaagctaaatattaccccctaaccctagtttcccccattccttcagcacatctggatttatcgttgtacaccgagggttccagtctcttcccccaactccgccgttaacgatggtgaacgttccaaagacaaagaagacctactgcaagagcaaggagtgcaagaagcacactctgcataaggtcactcagtacaagaagggtaaggatagtcttgcagctcaaggaaagcgccgttatgatcgcaaacaatctggttatggaggtcagaccaagcctgttttccacaagaaggcaaaaaccacgaagaagatcgttttgaggctccagtgccaaggatgcaagcatgtgtctcagcacccaatcaagaggtgcaagcattttgagataggcggagacaagaaggggaagggaacatctctgttctagatagatgcaacttgtcggctgtttttgttatcgttctgttagtggaactgtaaggtcatgttcagtgtttgtgaacttaattacacttgaattttctggtatccttttctgtgggggaatatgttatcatgtcatagcacctcttatttaagccttagtcatcaag

SEQ ID NO: 3556 - DNA, 642 bp, Linum usitatissimum
ggttcgccgctggctctggattgtcgttgcatctcacagagagcacccaagctgcaactccgccggcaacaatggtgaacgttcccaagacgaagaagacctactgcaagagcaaggagtgcaagaagcacactctacacaaggtcacccagtacaagaagggtaaggatagtcttgctgctcagggaaagcgtcgttatgaccgcaaacaatccggttatggtggtcagaccaagcctgtcttccacaagaaggcaaagaccacaaagaagattgtcctgaggctgcaatgccaaggatgcaagcatgtctctcagcacccaatcaagagatgcaagcacttcgagatcggtggagacaagaagggcaagggaacatctctgttctaaatgcagttcatctgtttttctcgtttgttgttctattagttgaactttgaagactttagttagtattttttgaactctgtaactgttggtttttgatcgaatttgcctttgttattttcagttgaactagactgttttatcatacgaatattgccagtggcgtttaggcttggtttcagttccttattatcaaccttaagttaggtattgttgatcaaaatattttattgggttagtaggtttaagtgagagt

SEQ ID NO: 3557 - DNA, 646 bp, Linum usitatissimum
ggttcgccgctggctctggattgtcgttgcatctcacggagagcacccaagcagcaactccgccggcaacaatggtgaacgttcccaagacgaagaagacctactgcaagagcaaggagtgcaagaagcacactctgcacaaggtcacccagtacaagaagggtaaggatagtcttgctgctcagggaaagcgtcgttatgaccgcaaacaatctggttatggtggtcagaccaagcccgttttccacaagaaggcaaagactacgaagaagattgtcctgaggctgcaatgccagggatgcaagcatgtgtctcagcacccaatcaagagatgcaagcacttcgagattggtggagacaagaagggcaagggaacatctctgttttaaatgcagttcatctgttttttttttctcgtttgttgttctattagttgaactttgaagacttaagttagtatttgctgagctctgtaactgttggttatgatcgaatttgccttgttatttagttaagctagactgttttatcatacgaattcgtttcttcccttaaccaattcgcttcttcctctttcggtcttgtatggtttgctacattgtgatcttgaagttctggagtaaaatggtggcgagacatctgtttg

SEQ ID NO: 3558 - DNA, 464 bp, Fraxinus spp
gaatttcgcatccacgctcttcgtctctgatcagctgccatggtgaatgttccaaagacaaagaagacttactgcaaatccaaggagtgcaaaaagcacaccttgcacaaggttacccagtacaagaagggaaaagatagcttagctgctcaggggaagcgtcggtatgatcgcaagcaatcaggttatggtggacagaccaagcccgtcttccacaagaaggcgaaaacgactaagaagattgtgctgaggctgcaatgccagggctgcaagcacgtttctcagcatccaatcaagaggtgcaagcattttgagattggtggagataagaagggaaaaggaacttctcttttctaagcatcacctggttatggaacttgaaacacctctcttttacctttttctgggacttggaagtttaattttttgtttatttagctgagacgttattaccaagtaatgca

SEQ ID NO: 3559 - DNA, 577 bp, Fraxinus spp
agcatcgagccaatcggttttcgtctctatctgccatcatccatggtgaacgttccaaagacaaagaagacctactgcaaatccaaggagtgcaaaaagcacaccttgcataaggttacgcagtacaagaagggtaaagatagtttagctgctcaagggaaacgtcgatatgatcgcaagcagtcgggttatggtggacagaccaagcctgtcttccacaagaaggcaaaaacaacaaagaagattgttctgaggttgcaatgccagggctgcaagcatgtatcccaacacccaattaagaggtgcaagcattttgagattggtggagacaagaaaggaaagggaacctcacttttctaggcgtgctttcaaggaaactgaaatgtctttcatttgttttgttattgttaactttacttctagcagactatttttactaaattattagctgaaaatttgacagaatcttgtgtcagccttgaattttgatgttgaaattctttttctcatgttggactattttggcctgatgaaaaaagctgtatttcgatcccaatgacgaacatatgataatttt

SEQ ID NO: 3560 - DNA, 520 bp, Fraxinus spp
agacggaattttgcggatctgtgtttcaacttaatcgttgctctctaccgcaacaatggtgaacgttccaaagacaaagaagacctactgcaaatccaaggagtgtaaaaagcacaccttgcacaaggttacacaatacaagaagggtaaagacagtttagctgcgcaagggaaacgtcgttatgatcgcaagcagtcaggttatggtggacagaccaagcctgtcttccacaagaaggcaaaaacaacaaagaagattgtgctaaggttgcaatgccagggctgcaagcatgtatcccagcatccaattaagaggtgcaagcattttgagattggtggagacaagaaaggaaagggaacctctcttttctaggcgtgctttcaaggaaactgaaatgtcttttatttgttttgttatgtcaagtttacatccaacagaccaattttactaaaatattagcagaattatttgccagcatgttgtttcatctttgaatttgatgttgaaatttagtattct

SEQ ID NO: 3561 - DNA, 547 bp, Guizotia abyssinica
aagaccgctggttcctaaatcctctctctcggcaggtgggttcatcggagatcttcagccatggttaatgttccaaagactaagaagacttactgcaagaacaaggaatgcagaaagcacactttgcataaggtgacacagtacaagaagggaaaagatagtttggctgctcaagggaagcgtcgttatgacaggaaacagtcgggttatggtggtcaaaccaagcctgtctttcacaagaaggcaaaaactacaaagaagattgtgttgaggttgcaatgccagggttgcaagcatgtgtcgcagcacccgatcaagagatgcaagcattttgagattggtggagacaagaagggcaaaggaacttcacttttctaagcgataattatgtgttacttttatttagacttgcaaacagttgtcatatctttttcaagtttttatgcaagtttgtgtttgcttgcccattttagttttctgttgtaaggaggagtctgtgttgcgttacaagttgatgaaaatatgtggtttggtgccttcaagttgg

SEQ ID NO: 3562 - DNA, 612 bp, Mesembryanthemum crystallinum
gcctcgtgccgaattcggcacgaggctgctatctccatttttcagggttttcccatctctcgccgctcttcgtcaccatggtgaacgtacccaagattaagaagacttactgcaagaacaaggagtgcaagaagcacaccacccacaaagtgacccaatacaagaaggggaaggatagtttggcagctcaaggaaagagacgttatgacaggaagcagtcaggatatggtggtcagacaaagcctgtctttcacaagaaggccaagactaccaagaagattgtgttgaggctacaatgccaatcatgcaagcatgtgtcacagcaccccatcaagcgatgcaagcactttgagattggtggagacaagaagggcaagggaacttctctgttttagttgtgcttcgagaacagtattcagtgttcggtttttttgttacctctagcttgttttgtcctgcacttgctaaaatactattgttaaaactcgagcaatttttgttatagaacggctagacttctttagccgtcttttgtttctttcgacctttacctaattagaggctggcttaatattatttgggtttttatgagtactacaaatggtgcttagt

SEQ ID NO: 3563 - DNA, 681 bp, Mesembryanthemum crystallinum
gattccttgcgggcctactcactgcctggtccatggaagggaattgataaaaccctagcccgcaacatcaccctttcgcctcgtgccgaattcggcacgaggcttaccagtgctttgcttctcttcctcagctgctgctatcttcaccatggtgaacgtacccaagataaagaagacttactgcaagaacaaggagtgcaagaagcataccacccacaaagtgacccaatacaagaaggggaaggatagtttggcagctcagggaaagagacgttatgacaggaaacagtcaggatatggcggtcagacaaagcccgtcttccacaagaaggccaagaccacaaagaagattgtgttgaggctacaatgccaatcatgcaagcatgtgtcacagcaccccatcaagcgttgcaagcactttgagattggtggagacaagaagggcaagggaacttctctgttttagttggagcttgggaaggagtattcagtatttgggtttttttgttacctctagcttgttttgtcctgtacttcctaaaatattattgttaaaactcgagcaatttttgttatagaacggttaatattagaggctggcttaatattatttgggtttttcagagtactacaaattgtatggttgtgatttactagttactctggtgcatcccttgctgt

SEQ ID NO: 3564 - DNA, 584 bp, Ipomoea nil
gagtttgtgcagctcaactttgatacaagtgtttttctcaccttcaagtcggcaaaaatggtgaatgttccgaaaacaaaaaagacatattgcaaatccaaggagtgcagaaagcacacattgcacaaggtcacccaatacaagaaggggaaagatagccttgctgctcaggggaagcgccgttatgatcgcaaacagtcaggttatggaggacagaccaaacctgtattccacaagaaagcaaaaacaaccaagaagattgtgttgaggttgcagtgccaaggctgcaaacatgtttcacaacatgcgatcaagaggtgtaagcattttgagattggcggtgacaagaaaggaaagggcacatctctattttaagattgacatcagtgaaatgaaatggtatcaaatgttttcaagtgtatgcccacaaaactatgcttattggcatattctcctggattattttgaaaaatgcatagtatatatgtgttttgaggtctaaattctgagtgagtggttggaattgtataattcttaagaagttgtggagttttatgattcaaagctgtttgatcattcattcc

SEQ ID NO: 3565 - DNA, 503 bp, Lactuca sativa
aaaaatctattatcgcctcttcagagaaagtcgtccaccatggtgaatgttcctaaaacaaagaagacttactgcaagtcaaaggagtgcaagaagcacaccttacataaagtaacacaatacaagaagggcaaagatagtttggctgcacaaggaaaacgtcgttatgatagaaaacagtctggttatggtggtcagacaaagcctgtctttcacaaaaaggctaaaaccaccaagaaaattgtcctaaggcttcaatgtcaaggttgcaagcatgtctcacaacacccgattaagagatgcaaacattttgagattggtggtgacaaaaagggcaagggaacttccctattttaagcagttttgattgcaagtatgcaatatatttttggcagacttttcgatgttattttttttcttgtttacaatgcaagaatgtaatgacttcacagattttgattgtattttcgtttatttaacttggactactctttaaaggaatg

SEQ ID NO: 3566 - DNA, 492 bp, Lactuca sativa
aaaaaacctgttatcgcctcttcagagaaactcgtccaccatggtgaatgttcctaaaacaaagaagacttactgcaagtcaaaggagtgcaagaagcacaccttacataaagtaacacaatacaagaagggcaaagatagtttagctgcacaaggaaaacgtcgttatgatagaaaacagtctggttatggtggtcaaaccaaacccgtttttcacaaaaaggcaaaaaccaccaagaaaattgttctaaggcttcaatgccaaggttgcaagcatgtctcacagcacccgattaagaggtgcaaacattttgagattggtggtgacaaaaagggaaagggaacttctctattttaagcagttatgcatcatttttggctggctttttcagtgttatcttttttcttgtttacaatgcaagaatgtaatgacttcacagattttggattgtattttcttttatttaacttggactactgtttaaagtaatg

SEQ ID NO: 3567 - DNA, 661 bp, Liriodendron tulipifera
gtttctgagagcgcccaaaaccctaaccttagatctcggcccctccttcctcttccatccgcagcaatggtgaatgtgccgaaaacaaagaagacctactgtaagaacaaggaatgcaggaagcacaccctgcataaggttacacaatataagaaggggaaggacagtctcgccgttcaagggaagcgtcggtacgatcggaagcagtcgggttatggaggacagaccaaacctgtcttccacaagaaggcgaaaactaccaagaagattgtgctgaggctgcaatgccagagctgcaagcatgtctcccaacacccaattaagagatgcaagcactttgagataggtggagataagaaggggaagggaacatctctgttctaatttggcttctcgacggaaggcattttggtacggtttttgctgtattttttatgccgaagtagatggcatgtgtggcaagagttctcaaagtactactatccagtgcctttttcttttttcgtttgtctcttttttttggtttttagattttgccaatgaatgcttatttgatattgaagtagtacattaaacatatgtttgtttagaagatattcgcagtttacttaaattggcttcttgaatgaagaaactgctctccgagcctgccaaaaaaaaa

SEQ ID NO: 3568 - DNA, 524 bp, Liriodendron tulipifera
ccaagctgaatctctcgctgcttcctgaggatcgattgcagacagaagcgtctctcacccaaagggcaaaaatggtgaacgttcctaagacaaagaaaacgtattgcaagaacaaagaatgccggaaacacaccttacataaggttactcagtacaagaaaggaaaggatagccttgctgtccaaggcaagagacggtatgatcggaagcaatcaggttatggaggacagacgaagcctgtcttccacaaaaaggccaagacaacaaagaagattgtgctaaggctacagtgccaaagctgcaaacatgtctcccagcatcccatcaagcgatgcaagcacttcgaaattggcggggacaagaaaggaaaaggaacgtctcttttctaggtctattctatatgtgatgcagaactcctcctttttaggcagtatgcccgttcacattggatatttgtagtcttatcattagctttgtttgtggaaattaatttgcagtagtggatttggatttggatttgaacc

SEQ ID NO: 3569 - DNA, 634 bp, Lotus japonicus
atagccattaaatcactcgcattgccctttcacagtctcattttcgcgcggcgcacatcaaacactagctccaccgattccgatccgcggccgccaccatggtgaacgttccaaagacgaagaagacctactgcaagagcaaggagtgcaagaagcacactcttcacaaggttacccagtacaagaagggtaaggacagcattgctgctcaggggaagcgtcgttatgatcggaagcaatctggttatggtggtcagaccaagcctgtcttccacaagaaggctaaaaccaccaagaaaattgtgctgaggctgcaatgccagggttgcaagcatgtttcccagcatgctatcaagaggtgcaagcactttgaaattggtggtgacaagaagggcaagggaacatctctgttttaggtggacaattagggtttgcagttgtttatgtattcgaagtatctggatgttttgtttctctggatttttggtagctatattttgaattttacaataccccttgtgtttcagaagtgaaaactattgctagtagtcattgtcaattattccttgttatgtgaatgattgcaacaatcttttatctttagaacctttatattctaatgtctgagttattt

SEQ ID NO: 3570 - DNA, 504 bp, Lotus japonicus
gtttcttcctttgctcaatcgatcttcaatttcgccgccgcaatggtgaacgttccgaagacgaagaagacctactgcaagagcaaggagtgcaagaagcataccctgcacaaggttacccaatacaagaagggtaaagatagcattgctgctcaggggaagcgtcgttatgaccgcaagcaatctggttatggtggacagaccaagcctgttttccacaaaaaggcaaaaactaccaagaagattgtgttgaggttgcagtgtcagggctgcaaacatgtttcccagcatgctatcaagaggtgcaagcactttgagattggtggtgacaagaagggaaaaggaacctctctgttctaggtgttcaactactaccattttgcagttttccgatttgtttttcgcccattttgctttccatttggctggctttttagtcttgcagaaatactgtgtttgagaaatgttttaaatatcaatggatgatttctcctttttgtcata

SEQ ID NO: 3571 - DNA, 498 bp, Medicago truncatula
cttcgtttgcccagccgagccgatctcaaaccaccttgcaacaatggtgaacgttccaaagacaaagaaaacctactgcaaaagcaaggagtgcaagaagcacaccttacacaaagtcacccaatacaaaaagggtaaggattccatcgctgctcagggaaaacgtcgttatgaccgtaaacaatctggttatggtggacagaccaaacccgtctttcacaaaaaggcaaaaactactaagaaaattgtgctgaggcttcagtgtcaaggttgcaaacatgtttcacaacacgcaattaagaggtgtaagcactttgagattggtggtgacaagaagggaaaaggaacatctctgttttaggtggaaaattacaagaattttgcagttttactgtgtttttcttttgtacccatctttcgatttttaattttgcagaaatactctgttattagactattgttttaatatttctaatggatggttattttacttttctt

SEQ ID NO: 3572 - DNA, 519 bp, Medicago truncatula
gcttgcttcgtttgcccagccgagccgatctcaaaccaccttgcaacaatggtgaacgttccaaagacaaagaaaacctactgcaaaagcaaggagtgcaagaagcacaccttacacaaagtcacccaatacaaaaagggtaaggattccatcgctgctcagggaaaacgtcgttatgaccgtaaacaatctggttatggtggacagaccaaacccgtctttcacaaaaaggcaaaaactactaagaaaattgtgctgaggcttcagtgtcaaggttgcaaacatgtttcacaacacgcaattaagaggtgtaagcactttgagattggtggtgacaagaagggaaaaggaacatctctgttttaggtggaaaattacaagaattttgcagttttactgtgtttttcttttgtacccatctttcgatttttaattttgcagaaatactctgttattagactattgttttaatatttctaatggatggttattttacttttcttaaaaaaaaaaaaaaaa

SEQ ID NO: 3573 - DNA, 605 bp, Medicago truncatula
gcattgcttcatcgttccattttcactgcgcacaaaacttcatcctctcagatccaatctacgtgccgtcaccatggtgaacgttccaaagacgaagaaaacctactgcaagagcaaggaatgcaagaagcatacacttcacaaggttacccaatacaagaagggtaaagatagcatagctgctcaaggtaagcgtcgttacgatcgcaaacagtccggttatggtggtcagactaagcccgtcttccacaagaaggcaaaaaccaccaagaaaattgttctgaggttgcaatgccaaggttgcaagcatgtttctcaacatgcaatcaagaggtgcaagcattttgagattggtggtgataagaagggcaaaggaacttctctcttctaggtggagaattaggatatgttgttttgatgttttattttccattgttgttgaaatgttttggttctcttatggatttctgatagatatattttgttatttgaaatatctttgtgattgacaagtgaaagctctgttgctgttatcaattagtacttgtttacattccttaaattcctttgatgattttaaaaatctttatcattttggcttgcat

SEQ ID NO: 3574 - DNA, 621 bp, Medicago truncatula
ataaaacacaaagcattgcttcatcgttccattttcactgcgcacaaaacttcatcctctcagatccaatctacgtgccgtcaccatggtgaacgttccaaagacgaagaaaacctactgcaagagcaaggaatgcaagaagcatacacttcacaaggttacccaatacaagaagggtaaagatagcatagctgctcaaggtaagcgtcgttacgatcgcaaacagtccggttatggtggtcagactaagcccgtcttccacaagaaggcaaaaaccaccaagaaaattgttctgaggttgcaatgccaaggttgcaagcatgtttctcaacatgcaatcaagaggtgcaagcattttgagattggtggtgataagaagggcaaaggaacttctctcttctaggtggagaattaggatatgttgttttgatgttttattttccattgttgttgaaatgttttggttctcttatggatttctgatagatatattttgttatttgaaatatctttgtgattgacaagtgaaagctctgttgctgttatcaattagtacttgtttacattccttaaattcctttgatgattttaaaaatctttatcattttggcttgcataaaa

SEQ ID NO: 3575 - DNA, 755 bp, Mimulus guttatus
caaatcggcccctagggttttcagtcgtcatttgtagaagatcgaacatcactctccgtcgctccgctctctctctctcctctctccgccggcagccatggtgaatgttccaaagacgaagaaaaccttctgcaaatcgaaggagtgcaagaagcacacgctgcacaaggtcacacagtacaagaagggaaaagacagcttagccgctcaagggaaacgacgttacgatcgcaagcagtccggttatggtggacaaaccaagcccgttttccacaagaaggccaagacaactaagaaaattgtgctcaggctgcagtgccaaagttgcaagcatagttcccagcaccctatcaagaggtgcaagcactttgaaattggtggagataagaaagggaaaggaacttcacttttttaggtgttctattttgcattttactctagtatttagctttgtactttgccgtcgtgctacaaatatttgataaaaatgtcagactcggatttttttggtttttttttgtttcggcgcttggattaagtgtctcgatgcaattttctccgctaacacaaggtttgtgtccatcacattataggatcttgtttattcctccattctatgtttcttctgttctatcttattgcattggtactatactatgtgtaaacaatgatgacatcgaatattaggacacttttcgagtgtatgcgaaatcgagttgaatggaaacttgaataagggaggatcttgttcgtcg

SEQ ID NO: 3576 - DNA, 565 bp, Nicotiana benthamiana
  misc_feature (2)..(2): n is a, c, g, or t
tnacggccggggccactgtaactgctgaacggcgacagatctaatcctctgcccgcgacaatggtgaatgtacctaagacaaagaagacctactgcaaatccaaggaatgcaaaaagcacaccttgcataaggtcacacaatacaagaaaggaaaagatagtttagctgcccagggaaagcgtcgttatgatcgtaagcagtcaggttatggtggacagacaaagcctgtcttccacaaaaaggctaaaactacaaagaagattgtcttaaggttgcaatgccaggggtgcaagcatgtctctcagcacccaatcaagaggtgcaagcattttgagattggtggggacaagaaaggaaagggaacctctcttttctaaattgcctgtgatgcaaaatttggtagttttctgttatacatttttagatatctttttttgttggtgtagttcaagagcttttgttttgttagattcaagttaatactatgctgtgttaattacattttgatcaggagatcaaagctgtacttttcaagtttctatttagtatggttcttgttccctt

SEQ ID NO: 3577 - DNA, 508 bp, Nicotiana benthamiana
  misc_feature (2)..(2): n is a, c, g, or t
  misc_feature (487)..(487): n is a, c, g, or t
  misc_feature (504)..(504): n is a, c, g, or t
cngccggggatcggcaccagctgaacggcaattgtgctctctgctatttctgtctaaatctcggccggcgaaaatggtgaacgttcctaagacaaagaagacctactgcaagtctaaggagtgcaaaaagcataccttgcacaaggttacacaatacaagaaggggaaagatagtttggctgctcagggaaagcgtcgttatgataggaagcagtcaggttatggtggtcagacaaagcccgtcttccacaaaaaggcaaaaaccaccaagaagatcgtgttgaggttgcaatgccaaggttgcaaacatgtttcacagcacccaatcaagaggtgcaagcactttgaaattggtggagacaagaaaggaaagggaacctctcttttctagattgcatgtcaagcgtaatccacagctttcttttttgccttcttttatgttgacttggagatgtgggttcttatgggttacattgtttttcaatanatgcgttttgtgatggnaaaa

SEQ ID NO: 3578 - DNA, 558 bp, Nicotiana benthamiana
  misc_feature (445)..(445): n is a, c, g, or t
  misc_feature (469)..(469): n is a, c, g, or t
  misc_feature (472)..(472): n is a, c, g, or t
  misc_feature (516)..(516): n is a, c, g, or t
  misc_feature (527)..(527): n is a, c, g, or t
gggggtttttcgacggcgtcaattccctctgccatttccgtctcactcttcgcccgcggcaatggtgaacgttcctaagacaaagaagacctactgtaagtcaaaggagtgtaagaaacacactttgcacaaggtcacacaatacaagaagggaaaagatagcttagctgctcaaggaaaacgtcgttatgatcgcaagcagtctggttatggtggtcaaacaaagcccgtcttccacaaaaaggcaaaaaccacaaagaagattgtgttgagattgcaatgccagggttgcaaacatgtgtcgcagcacccaatcaagaggtgcaagcattttgagattggcggggacaagaaaggaaagggaacctctcttttctagattgccttcgaagcagaatgtaacagatctttctccccttctgttctgttacactgttcagatacnttggttatatttgatgtagtgcangantttctgttatttaatcatgtgatcaattttgtgctatcttgganaatctgatcangagacaaaatgaatatttcaagttttcggtt

SEQ ID NO: 3579 - DNA, 704 bp, Capsicum annuum
tcttttttttcgtgtccacatctgaactgctagcctgtttggccgccattaaagcttaagctattttcccttcagctccttcctaccccaacaacaatggtgaacgttccaaaaactaagaagacatactgcaagtcaaaggaatgcaaaaagcacacgttgcacaaagttacacagtacaagaaaggaaaggatagccttgcagctcaagggaagcgtcgttatgaccgcaagcagtctggttatggtgggcagacaaaacccgtcttccacaagaaggccaagaccaccaagaagattgtgctaaggctgcaatgccagggttgcaaacatgtgtcccaacacccaatcaagaggtgcaagcacttcgaaattggtggagataagaagggcaagggaacttcactcttttaagttgcgagagatgttatcgtttatctttgtttcgtgctgtcctttttttcaaaatgatgttagctcaacagagtttcgtttgcttgatgaacaacttatgtctgttgcaaaatactggtgtttcgagttttaaattttgaaaatatctgctatttcttttcatcttttcttctctttcaattgctagtcgtaatgaaatgttatatgatcctgttattgttagattgaaattatctttcaaaaatttggatttcaattgagatgtaacaattttggatgctccctcgtgc

SEQ ID NO: 3580 - DNA, 704 bp, Capsicum annuum
tcttttttttcgtgtccacatctgaactgctagcctgtttggccgccattaaagcttaagctattttcccttcagctccttcctaccccaacaacaatggtgaacgttccaaaaactaagaagacatactgcaagtcaaaggaatgcaaaaagcacacgttgcacaaagttacacagtacaagaaaggaaaggatagccttgcagctcaagggaagcgtcgttatgaccgcaagcagtctggttatggtgggcagacaaaacccgtcttccacaagaaggccaagaccaccaagaagattgtgctaaggctgcaatgccagggttgcaaacatgtgtcccaacacccaatcaagaggtgcaagcacttcgaaattggtggagataagaagggcaagggaacttcactcttttaagttgcgaaagatgttatcgtttatctttgtttcgtgctgtcctttttttcaaaatgatgttagctcaacagagtttcgtttgcttgatgaacaacttatgtctgttgcaaaatactggtgtttcgagttttaaattttgaaaatatctgctatttcttttcatcttttcttctctttcaattgctagtcgtaatgaaatgttatatgatcctgttattgttagattgaaattatctttcaaaaatttggatttcaattgagatgtaacaattttggatgctccctcgtgc

SEQ ID NO: 3581 - DNA, 543 bp, Capsicum annuum
atcaaaggcatcagtattccctcccattttcgttccattatcacgccggccacaatggtaaacgttcctaagacgaagaagacttactgcaagtcgaaggagtgcaagaagcacaccttgcataaggttacacaatacaagaagggcaaagatagcttagctgctcagggaaagcgtcgttatgatcgcaagcagtctggttacggtggacagacaaagcctgtcttccacaagaaggcaaagaccacgaagaagattgtcttgagattgcaatgccaaggttgcaaacatgtgtcacagcacccaatcaagaggtgcaagcattttgagattggcggtgacaagaaaggaaaaggaacctctcttttctagattgcttgtgaagcagaatttaatctctctctcctgttctattacactcttcagatatttgttttacatcgaatgtagttgaggagttttctgttatcgattcctggttagttatgtgctctgtgtcaatgataaatcttatcaggggatgaaatgaatatttaagtttcc

SEQ ID NO: 3582 - DNA, 565 bp, Capsicum annuum
gcacgaggcttcatacatcaaaggcatcagtattccctcccattttcgttccattatcacgccggccacaatggtaaacgttcctaagacgaagaagacttactgcaagtcgaaggagtgcaagaagcacaccttgcataaggttacacaatacaagaagggcaaagatagcttagctgctcagggaaagcgtcgttatgatcgcaagcagtctggttacggtggacagacaaagcctgtcttccacaagaaggcaaagaccacgaagaagattgtcttgagattgcaatgccaaggttgcaaacatgtgtcacagcacccaatcaagaggtgcaagcattttgagattggcggtgacaagaaaggaaaaggaacctctcttttctagattgcttgtgaagcagaatttaatctctctctcctgttctattacactcttcagatatttgttttacatcgaatgtagttgaggagttttctgttatcgattcctggttagttatgtgctctgtgtcaatgataaatcttatcaggggatgaaatgaatatttaagtttccgattca

SEQ ID NO: 3583 - DNA, 667 bp, Capsicum annuum
tgcagagaaagaggagagaaatgaagaagcagagatctcgttctcgttctcgtcctccctggagctgtctactttgtttgctgaacggcgattgtgctctctgctatttctgtctgcgaaaatggtgaacgttcctaagacgaagaagacctactgcaagtccaaggagtgcaaaaagcacaccttgcataaggtcacacaatacaagaaagggaaagatagcttggctgctcagggaaagcgtcgttatgacaggaagcagtctggttatggtggtcagacaaagcctgtcttccacaaaaaggcaaagaccacaaagaagattgtgttgaggttgcaatgccaaggctgcaaacatgtttcacagcacccaatcaagaggtgcaagcattttgaaattggtggggacaagaaaggaaagggaacctctcttttctagattgcctatgaagtcaccaagaacttccttttttgtcttctcttatgctgcaatgttgaactttgattattttggatgttggctctattgtgttacattttcttccaatagattttgcgttgtgatagctgtatgaagatcctaactatattctagtttttgatagtgtgtttactgtttttgtaatttattttcaggccaatgggatgaagttctgatgttatattt

SEQ ID NO: 3584 - DNA, 499 bp, Petunia hybrida
tctccaccggcaacaatggtgaacgttcctaagacaaagaagacctactgcaagtccaaggagtgcaagaagcataccttgcataaggtcacacaatacaagaaggggaaagatagcttggctgctcagggaaagcgtcgttatgataggaagcagtcaggttatggtggtcagacaaagcctgtcttccacaaaaaggcaaaaaccacaaagaagattgtgttgaggttgcaatgccaaggttgcaaacatgtttcacagcacccaatcaagaggtgcaagcattttgaaatcggtggggacaagaaaggaaagggaacatctcttttctagattcgcgctggagtggaatctggaacctactttttggcatactatctatgttgcactatttaattttggttattttggatgtttgttcgtttgtgttagattgttttccaatagatgatttatgttatgatagcaatatggatatcaaatccgtttctcatgttct

SEQ ID NO: 3585 - DNA, 497 bp, Petunia hybrida
cggggggaattttcctctgcatttctctttcattcttcgccggcgacaatggttaacgttccgaagacaaagaagacttattgcaagtcgaaggaatgcaagaagcataccttgcataaggttacacagtacaagaaggggaaagatagcttggctgctcaaggaaagcgtcgttatgaccgtaagcagtctggatatggtggacaaacaaagcctgtgtttcacaaaaaggccaaaaccacaaagaagattgtgttgagattgcaatgccaaggttgcaaacatgtgtcacaacacccaatcaagaggtgcaagcattttgagattggtggggacaagaaaggaaagggaacttctcttttctagattagctgtgatgcagaatgtgatagttgtttctccccttctattatgttacactgttcagatattttggttatcttgaatgttgttcaggtgtttctgttgtccaattatgatttatccggtgctctgtt

SEQ ID NO: 3586 - DNA, 525 bp, Lippia dulcis
acactaaattatacacggacaaagttagggtttcagacggaggaaaatcgagtacgacgatcgctcgccgtcagccatggtgaacgttccaaagacaaagaagacttactgcaaatcaaaggagtgcaaaaagcacaccttgcacaaggtcacccagtacaagaagggaaaagatagcttagctgctcagggaaagcgtcgttatgatcgcaaacagtcaggttatggtggccagaccaaacctgttttccacaagaaggccaaaaccaccaagaaaattgtgttgaggctgcaatgccagggttgcaagcatgtttcccagcatccgatcaagaggtgcaagcattttgagattggtggagacaagaagggcaagggaacgtcccttttctaagcttatcctgatttggaattggggcattgttggtttcccccggtgtttttggactttagtttcttttgtgatttagccaagttatgtttgaatactgaatttacatttcaatgaaatattccttgttataa

SEQ ID NO: 3587 - DNA, 523 bp, Lippia dulcis
gctgcgaaaccaaatcacattcggagctcctttctcaacctccagccatggtgaacgttcctaaaactaagaagacttactgcaagtcaaaggagtgcaagaagcacaccttgcacaaggtcacccagtataagaaggggaaggatagcttagctgctcagggtaagcgtcgttatgaccgtaagcagtcgggttatggtggtcagaccaagcctgtcttccacaagaaggctaaaacgaccaagaagattgtactgaggttgcaatgccagggttgcaaacacgtttcccaacacccgatcaagaggtgcaagcactttgaaattggtggagataagaagggcaagggaacatcgcttttctagtcttatcgttttactgccttgttttgttctgattttgatcttgacaatttgcttagctgctttagctaaagtttagattaacatggttatgagttttgtttttctacaaatggattacggtttcacaatgcaagaaatggattaaattttactactta

SEQ ID NO: 3588 - DNA, 491 bp, Platanus occidentalis
tctgaaaaccctagcactcgatctgcttgcagccatggtgaatgttccaaagacaaagaagacatactgcaagagcaaggagtgcaggaagcacactctgcacaaggtcacccagtacaagaagggtaaagatagtcttgctgcccaggggaagcgtcgttatgatcgtaaacagtcaggttatggaggacagaccaaacccgtcttccacaaaaaggcgaagaccaccaagaagattgtgctgaggctgcaatgccagggatgcaaacatgtgtctcagcatgccatcaagaggtgcaagcattttgagattggtggggacaagaagggcaagggaacttctctcttttagatgtagcttttgcaagcatcatttttgtttggttggcacttgatttatgggtgtgtgttgtttaacctgcttagcacttacagttggttttagttaattgttttgatttcatgcttatgagcaagacacatgctaatgg

SEQ ID NO: 3589 - DNA, 685 bp, Solanum tuberosum
gtcagtcttctctgctatttctgttcgattctccgccggcgacaatggtgaacgttcctaagacaaagaagacttactgcaagtcgaaggagtgcaagaagcacaccttgcataaggttacgcaatacaagaaggggaaagatagcttagctgctcaaggaaagcgtcgttatgatcgcaagcagtcaggttatggtggacaaacaaagcccgtctttcacaaaaaggcaaagaccacaaagaagattgtcttgagattgcaatgccaaggttgcaaacatgtgtcgcaacacccaatcaagaggtgcaagcattttgagattggtggagacaagaaaggaaaaggaacctctcttttctagattgcttgtgaagcagaatttgatctttctcttctgttctattaactgttcagatatttttgttatattgaatgtagtcaaggagtttatgttatcagttcatgattaattatgtgctcaatcagtgattttatcaggagatgaaatgaatattttaagtttttgatttagcagttttgattgtcttgttgatgcaatgatgcttaagctttggcaagaaagttcaacagatgtactgtccttgagtacatcaattcgaacattggtgttgtattgtttatttagctacttaaaagtagaatctgtagtggaagttacatttg

SEQ ID NO: 3590 - DNA, 638 bp, Solanum tuberosum
ggagcgcgcatgtgttggtaccgggaatcggcattacggccgggggcttacaaaaggagcccgtaatcttaaaaccctagctataaacatctccccttattttctagggtttgtggacgccattagagcaaaggtgttttctacggcagctcagactcagtcgccgacaatggtgaacgttccaaaaactaagaagacatactgtaagtcgaaagagtgcaaaaagcacactctgcataaagttacacagtacaagaaaggaaaagatagtcttgcagctcaagggaagcgtcgttatgatcgcaagcagtctggttatggtgggcagacaaaacccgtcttccacaagaaggccaaaactaccaagaagattgtgctaaggttgcaatgccagggatgcaaacatgtgtcccaacacccaatcaagaggtgcaagcactttgaaattggtggagataagaagggaaagggaacttctctcttttaagtggagatggtatcgtttttgtctgtgtaatgttgtccttttttctcaagtgatgttagctcaacagagtttcttttgtttgatgatgaacaacttatgtctgtcccaaaatacttatgtttccagttttaaaatgactagtttattcttt

SEQ ID NO: 3591 - DNA, 643 bp, Solanum tuberosum
gctgaacggcgattgtgctctctggtatttctgtctaacctctcggcctgcgaaaatggtgaacgttcctaagacaaagaagacctactgcaagtccaaggagtgcaaaaagcacaccttgcataaggtcacacaatacaagaaggggaaagatagcttggctgctcagggaaagcgtcgttatgacaggaaacaatcaggttatggtggtcagaccaagcctgtcttccacaaaaaggctaaaaccacaaagaagattgtgttgaggttgcagtgccaaggctgcaaacatgtttcacagcacccaatcaagaggtgcaagcattttgaaattggtggggacaagaaaggaaagggaacctcacttttctagattgcctctgaagtcacccagaacttccttttttgccttctcctatgttgcactgttgaattttagttattttggatgttggttcttttgtgttacattgtctttccaatagagatgattttgtgttatgaaatagttatatggagatcctatctatattctagttttttggtactatgtttaatgttttagtaattgagttttaagtcattgggatgcaggtcaaatgttttagtttatataatagcaatgtccctttaagaaaaaaag

SEQ ID NO: 3592 - DNA, 538 bp, Raphanus sativus
  misc_feature (247)..(247): n is a, c, g, or t
  misc_feature (250)..(250): n is a, c, g, or t
ggaggagcagaagacggcacacaagcttcaccggagatagatcagaggagcgaaaatggtgaacattccgaagacaaagaagacatactgcaagaacaaggaatgcaagaagcataccttgcacaaggttacccaatacaagaagggtaaagacagtctcgctgctcaagggaagcgtcgttatgaccgtaagcaatccggttacggtggtcagactaagcctgtcttccacaagaaggctaagacnacnaagaagattgtcttgaggcttcagtgccaaacctgcaagcacttttctcagcactccatcaagaggtgcaagcattttgagatcggtggagacaagaagggcaagggaacatcacttttctaagctggtctcgtcttaagctttacaagttttgtacttcgttggatctttgatttcatctgttttagctctcgtatacgattgtttctcatctttgcctgttaactcttatgtttttgtatcatcaagatgtgtttttcagtttatctaaagtatgtgtcaatttta

SEQ ID NO: 3593 - DNA, 651 bp, Raphanus sativus
gggttcgctgacgacggcacacaatcttcacccgagagagagatcagattagcgaaaatggtgaacattccaaagacaaagaagacatactgcaagaacaaggaatgcaagaagcacacattgcacaaggttacccaatacaagaagggtaaagacagtctcgccgctcaagggaaacgtcgttatgaccgtaagcaatctggctacggtggtcagaccaagcctgttttccacaagaaggctaagactaccaagaagatcgttctcaggcttcagtgccaaacttgcaagcacttttcgcagcactcaatcaagaggtgcaagcattttgagatcggtggagacaagaagggaaagggaacatctcttttctaagctgttgtcatcttattttgttacaagttttctatttcgttggatctttgattccatctgttttagcactcgtataagattgtcctcacccccaactctatattttgaatcatctagatatgattttgctgttttctatgcacctaaaatggttacttttgactttcgagatatagtttgtacgaaactcacgaggctctgttttctcgagcagaaagtattgatctttcatgtgaaagcctcttgaaattaagcaataacaagtgttgatctttt

SEQ ID NO: 3594 - DNA, 603 bp, Raphanus sativus
gggttcgctgacgacggcacacaatcttcacccgagagagagatcagattagcgaaaatggtgaacattccaaagacaaagaagacatactgcaagaacaaggaatgcaagaagcacacattgcacaaggttacccaatacaagaagggtaaagacagtctcgccgctcaagggaagcgtcgttatgaccgtaagcaatctggctatggtggtcagaccaagcctgtcttccacaagaaggctaagaccacgaagaagatcgtcctcaggcttcagtgccaaacttgcaagcacttttctcagcactcaatcaagaggtgcaagcattttgagatcggtggagacaagaagggcaagggaacatctcttttctaagctgttgtcatcttattttgttacaagttttctatttcgttggatctgtgattccatctgttttagccctcgtataagatttgtcccctcgccctccaactctatattttgaatcatctagatatgattttgctgtttttctatgcacttgaaatggttacttttgagaaatagtttgtacgaaactcatgaggctctgttttctcgagcagaaagtattgatctttc

SEQ ID NO: 3595 - DNA, 566 bp, Raphanus sativus
  misc_feature (380)..(380): n is a, c, g, or t
  misc_feature (527)..(527): n is a, c, g, or t
  misc_feature (565)..(565): n is a, c, g, or t
ggtgggcagcggaggacaacgacggctcgagctttcacctaagagcgaaaatggtgaacattccaaagactaagaagacttactgcaagaacaaggaatgcaagaagcataccttgcacaaggtcacccagtacaagaagggtaaagacagtcttgctgcccagggtaaacgtcgttatgaccgcaaacaatccggttacggtggtcagaccaagcccgtcttccacaagaaggccaagacaaccaagaagattgtcttgaggctccagtgccaaacatgcaagcatttctctcaacactcgattaagaggtgcaagcacttcgagattggtggagacaagaagggaaaaggaacatctctcttttaagttttctcctcntatctgctttcttttttttgtttgttacttactactctcttgcttcgatacttgaatacattttgaatcttccagaaatggttatcaggtttaagttagacaacattttcgtatggaatatcttttaatttcgtgaacctttgtttntacacccgtttgatgtttaaatttcacaactacttgtnt

SEQ ID NO: 3596 - DNA, 580 bp, Raphanus sativus
ggataacccaacctatagttactctgtgttgtttggcagcggacggcacgagcttcaccgaagatcgaaaatggtgaacattccaaagacaaagaagacttactgtaagaacaaggaatgcaagaagcataccttgcacaaggtgacccagtacaagaagggtaaagacagtcttgctgcccaaggaaagcgtcgttatgaccgcaagcaatctggttatggtggtcagaccaaacccgtcttccacaagaaggctaagacgaccaagaagattgtgctgaggctccaatgccaaacctgcaagcatttctctcaacactcaattaagaggtgcaagcactttgagattggtggagacaagaagggaaaaggaacatctctcttttaagttgtttcctctatcttacctttttttttttatcttttgtttggtacttgtcttgcttgggcattcgaaatacattttgaatcttcaaaaaatggttatggacctatgatcttttaattaagaggacattttcgtatgtaatatcgtgaacctagttattacagacattaatgaaattcatttgcttttaca

SEQ ID NO: 3597 - DNA, 586 bp, Raphanus sativus
ggagcagaagacggcacacaagcttcaccggagatagatcagaggagcgaaaatggtgaacattccgaagacaaagaagacatactgcaagaacaaggaatgcaagaagcataccttgcacaaggttacccaatacaagaagggtaaagacagtctcgctgctcaagggaagcgtcgttatgaccgtaagcaatctggttacggtggtcagactaagcctgtcttccacaagaaggctaagaccacgaagaagattgtcttgaggcttcagtgccaaacctgcaagcacttttctcagcactccatcaagaggtgcaagcattttgagatcggtggagacaagaagggcaagggaacatcacttttctaagctgctcttgtcttaaactttacaagttttgtacttcgttggatctttgatttcatctggtttagctctcgtataagattgtttcttatctttgcttgttaactctgtttttgtatcatcaagatgtgcttttcagtttttatcagtcactgcaatctaagtatgtgtttttacaatccaattttaaatcgactatattcatttcattatagaata

SEQ ID NO: 3598 - DNA, 566 bp, Raphanus sativus
ggggcagcggaggacgacgacggcacgagcacgagctttcaccgaagagcgaaaatggtgaacattcccaagaccaagaagacttactgcaagaacaaggaatgcaagaagcataccttacacaaggtcacccagtacaagaagggtaaagacagtcttgctgcccagggtaaacgtcgttatgaccgcaaacaatccggttacggtggtcagactaagcccgtcttccacaagaaggccaagacaaccaagaagattgtcttgaggctccagtgccaaacatgcaagcatttctctcaacactcgattaagaggtgcaagcacttcgagattggtggagacaagaagggaaaaggaacatctcttttttaagttttctcctcttatctactttctttttttgtttgttactactctcttgcttcgatacttgaatacattttgaatctcccagaaatggttttcaagtttaatttaggcaacactttcgtatggaatatcttttaatttcgtgaacctttgtttctacacccctttgatggttaattttcacgtcttgttattac

SEQ ID NO: 3599 - DNA, 544 bp, Raphanus sativus
gggacgacgacggcacacaagcttcactcaaggtcagacgagcgaaaatggtgaacattccaaagacaaagaagacatactgcaagaacaaggaatgcaagaagcatacattgcacaaggtgacccaatacaagaaaggtaaagacagtctcgctgctcagggaaagcgtcgttatgaccgtaagcaatctggttacggtggtcagactaagcctgtcttccacaagaaggctaagaccacgaagaagattgtcttgaggcttcagtgccaaacctgcaaacacttttctcagcactcgatcaagaggtgcaagcattttgagatcggtggagacaagaaggggaagggaacatctcttttctaagcttgtccttaactttttgcaagttttgttacttgtgtcggatcatgattccttctgttttaaaatcttccattgcccaaattaaaatttcaaattatgcatgtaaaagtgagagactttttcagatgttctttgctcaatgatgtcattatttaaacattttgctgcaaaaaaaaaaa

SEQ ID NO: 3600 - DNA, 608 bp, Raphanus sativus
gggttcgctgacgacggcacacaatcttcaccctagagagagagatcagattagctaaaatggtgaacattccaaagacaaagaagacatactgcaagaacaaggaatgcaagaagcatacattgcacaaggttacccaatacaagaagggtaaagacagtctcgccgctcaagggaagcgtcgttatgaccgtaagcaatctggctatggtggtcagaccaagcctgtcttccacaagaaggctaagactacgaagaagatcgtcctcaggcttcagtgccaaacttgcaagcacttttctcagcactcaatcaagaggtgcaagcattttgagatcggtggagacaagaagggcaagggaacatctcttttctaagctgttgtcatcttatttcgttacaagttttctatttcgttggatcttgattccatctgttttagccctcgtataagatttgtcccttccccccaactctatattttgaatcatctagatatgattttactgtttttctatgcacttgaaatggttacttttgatatataatttgtacgaaactcatgaggctctgttttctcgagcagaaagtattgatctttcatgcga

SEQ ID NO: 3601 - DNA, 656 bp, Raphanus sativus
ggggcattacggccgggggggttcgctgacgacggcacacaatcttcacccgagagagcgatcagagtagctaaaatggtgaacattccaaagacaaagaagacatactgcaagaacaaagaatgcaagaagcacacattgcacaaggttacccaatacaagaagggtaaagacagtctcgccgctcaagggaagcgtcgttatgaccgtaagcaatctggctatggtggtcagaccaagcctgtcttccataagaaggctaagaccacgaagaagattgtcctcaggcttcagtgccaaacttgcaagcacttctcgcagcactcaatcaagaggtgcaagcattttgagatcggtggagataagaagggcaagggaacatctcttttctaagctgttgtcatcttattttgttacaagttttctatttcgtttggatcttgattccatctgttttagccctcgtataagatttgtcccctccccccaactctatattttgaatcatcttgatatgattttgctgtttttctatgcacttgaaatggttacttttgagatataatttgtacgaaactcatgaggctctgttttctcgagcagaaagtattgatctttcatgtgaaagcctctgaaattaagcaataacaaatgct

SEQ ID NO: 3602 - DNA, 477 bp, Raphanus sativus
gggcagcggacggcacgggcttcaccgaagatcgaaaatggtgaacattccaaagacaaagaagacttactgtaagaacaaggaatgcaagaagcatacgttgcacaaggtgacccagtacaagaagggtaaagacagtcttgctgcccaaggaaagcgtcgttatgaccgcaagcaatctggatatggtggtcagaccaaacccgtcttccacaagaaggctaagacgaccaagaagattgtgctgaggctccaatgccaaacctgcaagcatttctctcaacactcaattaagaggtgcaagcactttgagattggtggagacaagaagggaaaaggaacgtctctcttttaagttgtttcctctatctactttttttttaatcttttgtcttgcttgggctttcgaatacattttgaatcttcaaaaaatggttatggacttatgatcttttaattaagacgacattttcgtga

SEQ ID NO: 3603 - DNA, 495 bp, Raphanus sativus
gggcggacggcacgagcttcaccgaagatcgaaaatggtgaacattcccaagacaaagaagacatactgcaagaacaaggaatgcaagaagcacacattgcacaaggttacccaatacaagaagggtaaagacagtctcgccgctcaagggaagcgtcgttatgaccgtaagcaatctggttatggtggtcagaccaagcctgtcttccacaagaaggctaagactacgaagaagatcgtcctcaggcttcagtgccaaacttgcaagcacttctcgcagcactcaatcaagaggtgcaagcattttgagatcggtggagacaagaagggcaagggaacatctcttttctaagctgttgtcatcttattttgttacaagttttctatttcgtttggatcttgattccatctgttttagcccaagtataagatttgtctctcccccccccccccccaactctatattttgaatcatctagatatgattttactgtt

SEQ ID NO: 3604 - DNA, 547 bp, Rosa hybrid cultivar
gagggtttcagcttcaccgtccaggccgctttcgctgctcaactcatttctgtatcgagccgctgccttcaccatggtgaacgttcccaagactaagaagacctactgcaagaacaaggcgtgcaagaagcacaccttgcacaaggttacacagtacaagaagggcaaggacagtcttgctgctcagggaaagcgtcgttacgatcgcaagcagtctggttatggaggtcagaccaagccagtctttcacaagaaggccaagactaccaagaagattgttctgaggctccaatgccagggatgcaagcatgtttctcagcatccaatcaagaggtgcaagcactttgagattggtggagacaagaagggaaagggaacatcgcttttctaaatggagtgtttttggtttttatcttatgctgctgtcctttgttggagactttaagctaatatggaagatttgttttgagattttattagtttttatgtaaaacttcatggtgttatgacactcttctgcccatcaattcagaatttgaaattagac

SEQ ID NO: 3605 - DNA, 666 bp, Rosa hybrid cultivar
agcttcaccgtccaggccgctttcgctgctcaactcatttctgtatcgagccgctgccttcaccatggtgaacgttcccaagactaagaagacctactgcaagaacaaggcgtgcaagaagcacaccttgcacaaggttacacagtacaagaagggcaaggacagtcttgctgctcagggaaagcgtcgttacgatcgcaagcagtctggttatggaggtcagaccaagccagtctttcacaagaaggccaagactaccaagaagattgttctaaggctccaatgccagggatgcaagcatgtttctcagcatccaatcaagaggtgcaagcactttgagattggtggagacaagaagggaaagggaacatcgcttttctaaatggagtgtttttggtttttatcttatgctgctgtcctttgttggagactttaagctaatatggaagatttgttttgagattttattagtttttatgtaaaacttcatggtgttgtgacacttttctgcccatcaattcagaatttgaaattagacttgaattacagctgtgcatctgtttcagtgtgctcatcagcaccagtatctttaggttaaactatctgttagcctcgtttggtttaacccgtatctgagtttgtgccttgcttgctgatttactttgg

SEQ ID NO: 3606 - DNA, 579 bp, Salvia sclarea
ccgaatcacactttccagtgctcctctctccgccctcagccatggtgaacgttccaaagactaagaagacttactgcaagtcaaaggaatgcaaaaagcacaccttgcacaaggtcacccaatacaagaaggggaaggatagcttagctgctcagggtaagcgccgttatgacaggaagcagtcaggttatggtggtcagaccaagcctgtcttccacaagaaggctaaaacgacgaagaagattgtgctgaggctgcaatgccagggttgcaaacatgtctcccaacacccaatcaagaggtgcaagcactttgaaattggtggagataagaagggcaaaggaacatcgcttttttaagcttattgttttggaaagtttcttgtgttttcttccttgttctgtcgcgtctgtcgacttaacattttgcttggctgctctagctaaactttagattaattatgagacatggttatgagttttgttttgcaacaagctatactcatcagtttattatcacaagttttattctgtggctaaaaaaaaaacctcgtgccgaattcggcacgaggcctcgtgc

SEQ ID NO: 3607 - DNA, 511 bp, Salvia sclarea
ctactagaccttggctgtcactcacattctgtaggaaactgatttccaaattccagtgagcctattcgcccgacttgcaatggtgaacgttcctaagacgaagaagactttctgcaagtcgaaggagtgcaaaaagcacaccttgcacaaggtcacccagtacaagaagggcaaggatagcttagctgctcagggaaagcgtcgttatgaccgcaagcagtccggttatggtggccagacgaagcccgttttccacaagaaggccaaaacgacgaagaagattgtgctgaggctgcaatgccagggctgcaagcatgtttcccagcacgccattaagaggtgcaagcactttgaaatcggtggagataagaagggcaaaggaacatcacttttctaagtgtaatacttttgtttgctgccttctttgttttgttgtgattttccattttagctaaaacatttgattagttatttatatgtgagatttggttgtaatttggtttttgaacaa

SEQ ID NO: 3608 - DNA, 504 bp, Scabiosa columbaria
ctgttctacaatttgctccgtaggtctctttctcttcgcctctatcaatctcagccgcatctattgcttgagataagccatggtgaacgttccaaagacaaagaagacttactgcaaaaacaaggcatgtaagaagcataccttgcataaggttactcagtacaagaagggaaaggacagtttggccgcacagggtaagcgtcgttatgatcgcaaacagtctggttatggtggacagaccaagcctgtcttccacaagaaggcaaaaactactaagaagattgtgctgaggttgcagtgccagggttgcaagcatgtctcccagcaccccatcaagaggtgcaagcattttgagataggtggagataagaaaggcaaggggacttcacttttctaaactggagatcgcagaaatttggaaatctcactttattattgctttattagtttatgaaagtttcttttcaagttttaagagttgcagatttatatttgcttgttagt

SEQ ID NO: 3609 - DNA, 669 bp, Scabiosa columbaria
aacccctaaacctgatccactagtttgatcgataagcctcttctgcttccattcatccatttcaatccccaattcctcatctattcgcctcgcctgagataaacaaaccatggtgaacgtcccaaagaccaagaagacttactgcaaaaacaaggcatgtaagaagcataccttgcataaggttacacaatacaagaagggaaaggatagtttggctgcacagggaaagcgccgttatgatcgcaagcagtctggttatggtggacaaactaaacctgttttccacaagaaggcaaaaactactaagaagattgtgctgaggttgcaatgccagggctgcaaacatgtttcccagcacccaatcaagaggtgcaaacattttgagattggtggcgataagaaggggaaggggacttcacttttctaagtttgagattgcagaaagctggaaatgtcccattgctagtgcgttttcttgctttactagtttactaagtacgttttgtcgagtttagagttttcagtttatatatatgaatgttacccgctgtcagttttaataatacctttgtttgtagacatccaaattcttgtccttcgaaacttgcagatttcatatttaatgcattatatgacataacatagcggagtaattggattcctttgtaa

SEQ ID NO: 3610 - DNA, 444 bp, Scabiosa columbaria
acgcgcacatttgtacaaagctcactagcttctctccgaggtacccgtacggccggcaccggatcaactgtagatcgaatcctctcagcaagtcggagcttaacaatggtgaacgtgccaaaaacgaagaagacttactgcaagtcaaaagaatgcaagaagcacactttgcacaaggttacacagtacaaaaagggaaaggatagtttggctgcacaaggaaagcgtcgttatgaccgtaaacaatctggttatggtggtcaaactaagcctgttttccacaaaaaggctaaaactacaaagaagattgtgctgaggttgcagtgccagggctgcaaacatgtttcccagcacccaatcaagaggtgcaagcattttgaaattggaggagacaagaaggggaagggaacctctcttttctagaaagtgaatttctcattattg

SEQ ID NO: 3611 - DNA, 598 bp, Solanum phureja
gggctgcttacaaaaggagcccataatcttaaaaccctagctatatacatctccccttattttctaggttttgtggacgccattagagcaaaggtgttttctacggcagctcagactcagtcgccgacaatggtgaacgttccaaaaactaagaagacatactgtaagtcgaaagagtgcaaaaagcacactctgcataaagttacacagtacaagaaaggaaaagatagtcttgcagctcaagggaagcgtcgttatgatcgtaagcagtctggttatggtgggcagacaaaacccgtcttccacaagaaggccaaaactaccaagaagattgtgctaaggttgcaatgccagggatgcaaacatgtgtcccaacacccaatcaagaggtgcaagcactttgaaattggtggagataagaagggaaagggaacttctctcttttaagtggagatggtatcgtttttgtctgtgtaatgttgtccttttttctcaagtgatgttagctcaacagagtttcttttgtttgatgatgaacaacttatatctgtcccaaaatacttatgtttccagttttaaaatgactagtttattcttt

SEQ ID NO: 3612 - DNA, 555 bp, Solanum phureja
acatcaaagggttattcaacggcgtcagtcttctctgctatttctgttcgattctccgccggcgacaatggtgaacgttcctaagacaaagaagacttactgcaagtcgaaggagtgcaagaagcacaccttgcataaggttacgcaatacaagaaggggaaagatagcttagctgctcaaggaaagcgtcgttatgatcgcaagcagtcaggttatggtggacaaacaaagcccgtctttcacaaaaaggcaaagaccacaaagaagattgtcttgagattgcaatgccaaggttgcaaacatgtgtcgcaacacccaatcaagaggtgcaagcattttgagattggtggagacaagaaaggaaaaggaacctctcttttctagattgcttgtgaagcagaatttgatctttctcttctgttctattaactgttcagatatttttgttatattgaatgtagtcaaggagtttatgttatcagttcatgattaattatgtgctcaatcagtgattttatcaggagatgaaatgaatattttaagtttttgattta

SEQ ID NO: 3613 - DNA, 674 bp, Solanum phureja
gggctttagatcggcaccagctgaacggcgattgtgctctctggtatttctgtctaatctctcggcctgcgaaaatggtgaacgttcctaagacaaagaagacctactgcaagtccaaggagtgcaaaaagcacaccttgcataaggtcacacaatacaagaaggggaaagatagcttggctgctcagggaaagcgtcgttatgacaggaaacaatcaggttatggtggtcagaccaagcctgtcttccacaaaaaggctaaaaccacaaagaagattgtgttgaggttgcagtgccaaggctgcaaacatgtttcacagcacccaatcaagaggtgcaagcattttgaaattggtggggacaagaaaggaaagggaacctcacttttctagattgcctctgaagtcacccagaacttccttttttgccttctcctatgttgcactgttgaattttagttattttggatgttggttcttttgtgttacattgtctttccaatagagatgattttgtgttatgaaatagttatatggagatcctatctatattctagttttttggtagagtatgtttaatgttttagtaattgagttttaagtcattgggatgcaggtcaaatgttttagtttatataatagcaatgtccctttaagaattgcacactttgaatg

SEQ ID NO: 3614 - DNA, 526 bp, Euphorbia esula
  misc_feature (8)..(12): n is a, c, g, or t
  misc_feature (50)..(50): n is a, c, g, or t
cctctttnnnnngtaatctcctggtttccttgaagataagcatcatggtnaactttccaaaaacaaagaaaacatactgcaagagcaaggaatgcaagaaacacaccttgcataaggttacccaatacaagaaagggaaagattccctttctgcacaaggaaaaagacgttatgatcgcaagcaatctggatatggtggacagactaagcctgttttccacaagaaggctaaaaccaccaagaagattgttctgaggctgcagtgtcaaggctgcaagcatgtgtctcagcatccaattaagaggtgcaagcattttgaaattggtggagacaagaagggcaagggaacttctcttttctagacacaaatatggaatcatgtgttgttgattttgttcaacttttatgcttgaggtggaccagatctataatttttgttatctttgtttttaatcatgttgtgattgctagacatcgactgcatgtttattacttaacatactttaattgcaaatttagatttggc

SEQ ID NO: 3615 - DNA, 577 bp, Fragaria vesca
gtctagggtttcagcttcaccgtctaggccgctttcgctgcgctcaacacatttctgtatcgagccgctgccttcaccatggtgaacgttcccaagacaaagaagacctactgcaagagcaaggagtgcaagaagcacaccttgcacaaggtgacgcagtacaagaagggcaaggacagtcttgcggctcagggaaagcgtcgttatgatcgcaagcaatctggatatggaggtcagaccaagccagtctttcacaagaaggccaagactaccaagaagattgttctaaggcttcaatgccagggatgcaagcacgtttctcagcatccaatcaagaggtgcaagcacttcgagatcggtggagacaagaagggaaagggaacatcgcttttttaaatggagtgtttttggtttttatgctgctgtacttgctggagagcttaagctaatatggaagatttgttttgatattttgttagttttgatgtggaattttaatggtgttatgacacttttctggctatcaattccgaatatgaaattagacttcatatacagcgtatctcaagttcatgtc

SEQ ID NO: 3616 - DNA, 898 bp, Fragaria vesca
gcttaaattgctccaagttgtaacgaggccgcttctgctttcttcttcttcatcttctcagtcttctccatatccgccgccgcagtagccatggtgaacgttccgaagacaaagaagacctactgcaagagcaaggagtgcaagaagcacaccctgcacaaagtcacgcagtacaagaagggcaaggacagccttgctgcccaggggaagcgtcgttatgatcgtaagcaatcaggttatggaggtcagaccaagcctgtgtttcacaagaaggccaagaccaccaagaagattgtgttgaggctccaatgccagggttgcaagcatgtgtcgcagcacccaatcaagaggtgcaagcactttgagattggtggagacaagaagggcaagggaacctctcttttctagacgaaccattttggttgtatctcttgtttttgctttgtctatcctgttggagctttaaagcaagtatcttagattcgttgttgttaatttatgctgaacaccaaagttattggtgagactcggtttttgctttcaatcgatattagctttttgactacatcaatctgtgtttttatttggaaattgctcctttgtgtttgtttcggaaattgatttatgaaccacctttttctgcttctgctaaacaaaacaacactggctccaagttatggaaatgctgctagcttcacatcacatgccttgtagttatgggccatggagtctttttgtggcatttaactctcctcatcttgctctcatggggtgtcttagctgcagaattgatacaagttgtggtcctatatattagatatttttcgcaacaaaaaaaattgtttccctactttgaattggtattatgattgtaggctttttgtgcctgtttcaaaaa

SEQ ID NO: 3617 - DNA, 514 bp, Helianthus annuus
tcctctcggtcaaatttcagtagctcttcagccatggtgaacgttcccaagacgaagaagacttactgcaagaacaaggaatgcagaaagcataccttgcataaggtgacccaatacaagaagggaaaagatagtttggctgcacaaggaaagcgtcgttatgacaggaaacaatccggttatggtggtcaaaccaaacccgtctttcacaagaaggcaaaaactacaaagaagattgtgctaaggttgcaatgccaaggttgcaagcatgtttctcagcacccaattaagagatgcaagcattttgaaattggtggagacaagaagggcaagggaacttcacttttttaagcagtttgttgcagggttgcagctactattcatatttttgttctagcagactttttatattatttgaaatttatattgcaagtgcctgtttagcttttgacacatctgcctggagaaatgaaaatcttgtgttattgactgttcttacctagtgttgcttttt

SEQ ID NO: 3618 - DNA, 583 bp, Helianthus annuus
ctcaatcaatagaaatgaaaccctaactctctgagtagtcttaaagcaaacacttgtggcagaaccctacggcggctcttcatctcatcctctcggtcaaatttcagtagctcttcagccatggtgaacgttcccaagacgaagaagacttactgcaagaacaaggaatgcagaaagcataccttgcataaggtgacccaatacaagaagggaaaagatagtttggctgcacaaggaaagcgtcgttatgacaggaaacaatccggttatggtggtcaaaccaaacccgtctttcacaagaaggcaaaaaccacaaagaagattgtgctaaggttgcaatgccaaggttgcaagcatgtttctcagcacccaattaagagatgcaagcattttgaaattggtggagacaagaagggcaagggaacttcacttttttaagcagtttgttgcagggttgcagctactattcatatttttgttctagcagactttttatattatttgaaatttatattgcaagtgcctgtttagcttttgacacatctgcctggagaaatgaaaatcttgtgttattgactgttct

SEQ ID NO: 3619 - DNA, 575 bp, Helianthus annuus
ggtgcttgcttcctatctttcatccggcagttcggttcatcggagatcttcagccatggttaacgttccaaagactaagaagacttactgcaagaacaaggagtgccgaaagcacaccttgcataaagttacccaatacaagaagggaaaagatagcttggctgcccaaggaaagcgtcgttatgacaggaaacagtcgggttatggtggtcaaactaagcccgtctttcacaagaaggcaaaaaccacaaagaagattgtcctgaggttgcaatgccaaggctgcaagcatgtgtcacaacacccgatcaagagatgcaagcattttgaaattggtggagacaagaagggcaagggaacctcactattttaagtaataattgtgtgttgttttgatatatttagacctacagatggtgcatctctttcaggtttttatgcaggttttgtgtttgcttgccacattttagttttttgttgtatggagcaaatgttgaggaaatggtattactgtgttggatgtgtttggtgccaaatcaaaagaaattaaattaaaacaggctggtttaagacat

SEQ ID NO: 3620 - DNA, 649 bp, Helianthus annuus
ataacaaggctagagcctagaaacgcttaaatgggccatatcattttaagatgggcctttagcccaaaccctaccaatgaaacaaaacttataacctatacatacattcacaaaaccctaacactggtgcttgcttcctatctttcatccggcagttcggttcatcggagatcttcagccatggttaacgttccaaagactaagaagacttactgcaagaacaaggagtgccgaaagcacaccttgcataaagttacccaatacaagaagggaaaagatagcttggctgcccaagggaagcgtcgttatgacaggaaacagtcgggttatggtggtcaaactaagcccgtctttcacaagaaggcaaaaaccacaaagaagattgtcctgaggttgcaatgccaaggctgcaagcatgtgtcacaacacccgatcaagagatgcaagcattttgaaattggtggagacaagaagggcaagggaacctcactattttaagtaataattgtgtgttgttttgatatatttagacctacagatggtgcatctctttcaggtttttatgcaggttttgtgtttgcttgccacattttagttttttgttgtatggagcaaatgttgaggaaatggtattactgtgttggataag

SEQ ID NO: 3621 - DNA, 595 bp, Helianthus annuus
ttaaaacatacacaaagaaccctaatctcgctgtgcggctctgcatctcatctctctcggtagacgttcaggaactctgcagccatggtgaacgttccgaagaccaagaagacttactgcaagaacaaggaatgcagaaagcataccttgcataaggtgacacagtacaagaagggcaaagatagcttggctgcacaaggaaaacgtcgttacgacaggaaacaatctggttatggtggtcaaactaagcccgtctttcacaagaaggcgaaaaccacgaagaagattgtgctaaggttgcaatgccaaggctgcaagcatgtctcacagcacccaatcaagagatgcaagcattttgaaattggtggagataagaagggcaagggaacatctctcttttgatcagttttgtgtaattttgttgcagcagctactattctttctttttgttgtagcagactattattcactgttttaagttttcgaaacttgtaatgcaagtatctgttttgattttacgtgttgatttcggcctgtatgatttatctggtgttcggttattctatggatcaaaatgcaaaaactttttccgatt

SEQ ID NO: 3622 - DNA, 582 bp, Helianthus annuus
gtacgcgtggcctaaaaactggtggttcctctctgtctcactcatccggcaggttggttcatcggagatcgtcggccatggttaatgttccaaaaactaagaagacttactgcaagaacaaggaatgcagaaagcacacattgcacaaggtgacacagtacaagaagggtaaagatagtttggctgcacaagggaaacgtcgttatgacaggaaacagtcaggatatggtggtcaaaccaagcccgtctttcacaagaaggctaaaaccaccaagaagattgtgctaaggttgcaatgccaaggttgcaagcatgtgtcccagcatccaattaagaggtgcaaacattttgaaattggtggagacaagaagggcaaaggaacatcacttttttaagcaatattcatgtgttattttagtatgtttagacctatatatgtttcaagtttttatgcaggtttaatgttgcaaactttaaaatttgtgtttaagagttttatttattgttttatctaattaaaaaacaaatttatcataaacatgcacaaatctaaaatcaactgtgccgacccccccgacccgg

SEQ ID NO: 3623 - DNA, 432 bp, Tamarix hispida
ggggacttaaaaccctagctgagaattgggaggcgctccatcacggacaactcgtacgctttgttcctccagcagcagccatggtgaacgtaccaaagaccaagaaaacatactgcaaaaacaaggaatgcaggaagcacactctccacaaggtaactcaatacaaaaagggaaaagatagtttggctgctcagggaaagcgtcgttatgataggaagcaatctggttatggtggtcagactaagcccgtctttcacaagaaggctaagaccacaaagaagattgttttgaggttgcaatgccaagcttgcaagcatatgtctcagcacccaatcaagagatgcaagcactttgagattggtggagacaagaagggaaagggaacatctctgttttagtatgcaagtattgctactattgctgttttatcag

SEQ ID NO: 3624 - DNA, 493 bp, Thellungiella halophila
ggttttcggcagcggacgacgacggcacgagcttcaccgaagagcgaaaatggtgaacattcccaagactaagaagacttactgcaagaacaaggaatgcaagaagcataccttgcacaaggtgacccagtacaagaagggtaaagacagtcttgctgcccagggaaaacgtcgttatgaccgtaaacaatctggttatggtggtcagaccaagcccgtcttccacaagaaggctaagacaaccaagaagattgtcctgaggctccaatgccaaacatgcaagcatttctctcagcactcgattaagaggtgcaagcacttcgagattggtggagacaagaagggaaaaggaacatctctcttttaagttgtttttatttctacttttcctttttgtatggtactgtcttgcttcgatactcaaaatacattttgaatctctcggaaatgcttgtggtgtttaatttaataggacatggtcgtatggaatatc

SEQ ID NO: 3625 - DNA, 496 bp, Thellungiella halophila
  misc_feature (325)..(325): n is a, c, g, or t
gcacgaggcacaagcttcacccgagatcagagtagcgaaaatggtgaacattccaaagacaaagaagacttactgtaagaacaaggaatgcaagaagcatacattgcacaaggtgacccaatacaaaaagggtaaagacagtcttgctgctcaggggaagcgtcgttatgaccgtaagcaatctggttatggtggtcagactaagcctgtcttccacaagaaggccaagaccacgaagaagattgtcctgaggcttcagtgccaaacctgcaagcacttctctcagcactccatcaagaggtgcaagcattttgagatcggtggngacaagaagggaaagggaacatcacttttctaagttggttatatcttaatttctacaagttttgtacttcgctggatcttgattccatctgttttagctctcgtataagatttgtctcatctttgcttgttaactctatattttgaatcatcaagatatggttttgctgtt

SEQ ID NO: 3626 - DNA, 584 bp, Nicotiana tabacum
gctttcgatcggcaccagctgaacggcaattgtgctctctggtatttctgtctaaatatcggccggtgaaaatggtgaacgttcctaagacaaagaagacctactgcaagtccaaggagtgcaaaaagcacaccttgcacaaggttacacaatacaagaaagggaaagatagtttggctgctcagggaaagcgtcgttatgacaggaagcagtcaggttatggtggtcagacaaagcccgtcttccacaaaaaggcaaaaaccactaagaagatcgtgttgaggctgcaatgccaagggtgcaaacatgtttcacagcacccaatcaagaggtgcaagcactttgaaattggtggagacaagaaaggaaagggaacctctcttttctagattgcctgtgaagtgtaatccacagctttcctttttgccttcgtttatgtttacttggatgatgttggttcttatgggttacattgtttttcaatagatgcttttttgttatggtagtgatatggagatgaaatttatatttcaaagttttaatttggtatggatactcttttggtaattgattttcaagcaatt

SEQ ID NO: 3627 - DNA, 699 bp, Nicotiana tabacum
ggtttttcaacggcgacaattcaccctgccatttctgtctcactcttcgcctgcgacaatggtgaacgttcctaagacaaagaagacctactgtaagtcaaaggagtgtaagaaacacactttgcataaggtcacacaatacaagaagggcaaagatagcttagctgctcaaggaaaacgtcgttatgatcgcaagcagtctggttatggtggtcaaacaaagcccgtcttccacaaaaaggcaaaaaccacaaagaagattgtgttgagattgcaatgccagggttgcaaacatgtgtcacagcacccaatcaagaggtgcaagcattttgagattggcggggacaagaaaggaaagggaacctctcttttctagattgcctgtgaagcagaatgtgacagatttctccccttctgttctgtcactgttcagatactttggttatattggacgtagtgcaggagtttctgttattgaatcatgtgatcaattttgtctctcttagtgatatctgatcaggagacaacgaatttttcaagttttgggtttagtagttttgctattgtcttattgttgcttaatctattgcaagaaagttatgctgctctaccgcacttggctgcatcaatttgtatgttgggattctatctattatagttttgattctccaaattagtctatattgaaacgcttgtttt

SEQ ID NO: 3628 - DNA, 606 bp, Nicotiana tabacum
gctttcgatcggcaccagctgaacggcaattgtgctctctgctatttctgtctaaatctcggccggcgaaaatggtgaacgttcctaagacaaagaagacctactgcaagtctaaggagtgcaaaaagcataccttgcacaaggttacacaatacaagaaggggaaagatagtttggctgctcagggaaagcgtcgttatgataggaagcagtcaggttatggtggtcagacaaagcccgtcttccacaaaaaggcaaaaaccactaagaagattgtgttgaggttgcaatgccaaggttgcaaacatgtttcacagcatccaatcaagaggtgcaagcactttgaaattggtggagacaagaaaggaaagggaacctctcttttctagattgcctgtgaagtgtaatccacagctttcttttttgccttcgtttatgttaacttggagatgttggttcgtatgggttacattgtttttcaatagatgtttttgtgttatggtcgtgatatggagatgaaatttatatttcagggttttaaatttcgtatggatactctttttggtaattgatgttcaagcaattcggacagagttctgctgtctt

SEQ ID NO: 3629 - DNA, 665 bp, Nicotiana tabacum
  misc_feature (47)..(47): n is a, c, g, or t
  misc_feature (617)..(617): n is a, c, g, or t
cgcggggagaaacctacatataaagtggtttcgtcttccctcatttnctaggcttctggacgccattagaaacaaaggtggtttatactgcagctccttccttgcttgaagtcagcctccaaccatggtgaacgttccaaaaactaagaagacatactgcaagtcgaaggagtgcaaaaagcacactctgcataaagttacacagtacaagaaaggaaaagatagcctagcagctcaaggcaagcgtcggtatgatcgcaagcagtctggttatggtgggcagacgaaacccgtcttccacaagaaggccaaaactaccaagaagattgtgctaaggttgcaatgccagggttgcaaacatgtgtcccagcacccaatcaagaggtgcaagcactttgagattggtggagataagaagggaaagggaacttctctcttttaagtggcgcattcacggagatgaaattgtttatttttgtgtcgtggtggacttttttatcaagtggtgtagctcaacaatgtttcttttgcttattgaacaatgtatgtctatggcagaatacttgtatttcgagttttaaattgagaatatctatgccttttttccacatcatttncaacgctatttgtataaatgagatgtgatactgtccagcggccgcatg

SEQ ID NO: 3630 - DNA, 730 bp, Nicotiana tabacum
  misc_feature (478)..(478): n is a, c, g, or t
ctacaaaaactagtctttcacatatcaaagggcttttcaacggcgacaattccctctgccatttctgtctcactcttcgccggcgacaatggtgaacgttcctaagacaaagaagacttactgtaagtcaaaggagtgtaagaaacacactttgcataaggtcacccaatacaagaagggaaaagatagcttagctgctcaaggaaagcgtcgttatgatcgcaaacagtctggatatggtggtcaaacaaagcccgtcttccacaaaaaggcaaaaaccacaaagaagattgtgttgagattgcaatgccagggttgcaaacatgtgtcgcagcacccaatcaagaggtgcaagcattttgagattggtggggacaagaaaggaaagggaacctctcttttctagattgcctgtgaagcagaacgtgacagatctttctccccttctgttctgttacactgttcagatactttggtnacatttgacgtagtgcaggagtttccgttattgaatcatgtaatcagttttgtgctctcttagtgacatatctgatcaggagacaaaatgaatatgtcaagtttttggtttagtaatttgctattgttagcttaatctgttgcaagaaagttatgctgctctactgcacttggctgcatcaatttgtatgttgggattatattatagttttgattctccaaagtagtctatattgaaatacttgcgttgggt

SEQ ID NO: 3631 - DNA, 533 bp, Solanum lycopersicum
ggggctttcgatcggcaccagctgaacggcgattgtgctctctgctatttctgtctaacctctcggcctgcgaaaatggtgaacgttcctaagacaaagaagacctactgcaagtccaaggagtgcaaaaagcacaccttgcataaggtgacacagtacaagaaggggaaagatagcttggctgctcaggggaagcgtcgttatgacaggaaacagtcaggttatggtggtcagaccaagcctgtcttccacaaaaaggctaaaaccacaaagaagattgtgttgaggctgcagtgccaaggctgcaaacatgtttcacagcacccaatcaagaggtgcaagcattttgaaataggtggggacaagaaaggaaagggaacctcacttttctagattgcctctgaagtcattcagagcttccttttttgccttctcctatgttgcactgttgaattttagttattttggatgtttattttgtgttacattgtcttccaatagatgattttgtgttatggatagttatatggaga

SEQ ID NO: 3632 - DNA, 641 bp, Trigonella foenum-graecum
caaagcatagcttcatagttccattttcactgcgcacaaaacttcatcttccagatcccgatccacgcgccgccaccatggtgaacgttccaaagacaaagaaaacctactgcaagagcaaggaatgcaagaagcacacacttcacaaggttacccaatacaagaagggtaaggatagcatcgccgctcaaggtaagcgtcgttacgatcgtaaacagtccggttatggtggtcagactaagcccgtcttccacaagaaggcaaaaaccactaagaaaattgttctgaggttgcaatgccagggttgcaagcatgtttctcaacatgcaatcaagaggtgcaagcattttgagattggtggtgacaagaagggaaaaggaacatctctcttctaggtggagaattaggatctgttgttttgttgttttattttcctgtgttggaatgttttgtttcttctttctatggatttctgataggtatattttgttatttgaaataccttattgttattgagatgtgaaagctattgctattatcagtcagtacttgttttcattccttgaattcctttgattttaaaaatcttaatcaatgtctggcataaagtaatccatgtctatgataaaatttagatgtta

SEQ ID NO: 3633 - DNA, 662 bp, Trigonella foenum-graecum
cggccgggggtttgccgagccgatctcataccacctccgcaacaatggtgaacgttccaaagacaaagaaaacctactgcaaaagcaaggagtgcaagaagcacaccttacacaaagttacccaatacaaaaagggtaaagattccatcgctgctcagggaaaacgtcgttatgatcgcaaacaatctggttatggtggacaaaccaaacccgtctttcacaaaaaggcgaaaaccactaagaaaattgtgttgaggcttcagtgtcaaggttgcaagcatgtttctcaacacgcaattaagaggtgcaagcactttgagattggtggtgacaagaagggaaaaggaacatctctgttttaggtggaaaattacaagaattttgcactttcgctgtgtatttcttttgtacccttgtttggatttttaattttgcagaaatactttgtgtttgagattattgttctaatatttctaatggatggttattttagtttacttgagtttttgcaattccatcatgggtttcttctttctgctatatatttgattaattggaaacctagttttagcttagaaatgaatcaacattattaatttttattatcagtgcatttacttgagtgatacctgtgatcttcgttatagtggagataacacttt

SEQ ID NO: 3634 - DNA, 548 bp, Utricularia gibba
ggcagttgtggtatctctgttccttcggcgcaggcggccatggtgaacgttcctaagactaagaaaacctactgcaagtcaaaggaatgcaaaaagcataccttgcacaaggtgactcagtataaaaagggcaaggatagcttggcagtccagggaaagaggcgttacgatcgcaagcagtcgggttatggtggccagacaaagcctgttttccacaagaaggccaaaactacgaagaagatcgttttgaggctgcagtgccagagctgtaagcatgtctcccagcatcccatcaagaggtgcaagcatttcgaaataggcggagacaagaaggggaagggaacttcgttgttttaagccaaggaaatcgaatcgcaacttctttttcccaatgtgcactttgcttgtttatgttctatttggtgaacttgtcttatcagagtctgtttcctgattatcatcctcgtacaatgaaaaagcttccattttgttagaacaatggctccaattttgaaatcatgtaaaaagataacgcacaagagttactt

SEQ ID NO: 3635 - DNA, 615 bp, Utricularia gibba
ggggaatcgtaatcgattgctgctccttcggtgccttcagccatggtgaacgttcctaagactaagaaaacctactgcaagtcaaaggaatgcaaaaagcataccttgcacaaggtgactcagtataaaaagggcaaggatagcttggcagtccagggaaagagacgttacgatcgcaagcagtcaggttatggtggccagacaaagcctgtcttccacaagaaggcaaaaactacgaagaaaattgtgctgaggttgcaatgccaaagctgtaagcacgtctcacagcatcctatcaagagatgcaagcatttcgaaataggtggtgacaagaagggaaaggggacttcattgttttaagccaaggactagggtccggagtcgctgctcgttttgtggacttcgcacttctgcatgatgctttatttgatgaacctgtcttaattgggcttgtttcctggtttcaaacctcttacaagcttgcttcttttcctagaagaatacatttggttggaactaatgctgctttaattttgaaatcatataaaagatcttgtacaagagctcatcagtgccctctgcatttgatgggaaaggattagtgcagtcctgata

SEQ ID NO: 3636 - DNA, 539 bp, Valeriana officinalis
ttttcactctacgatttcatcgtcgatctccagagacgagctatggtgaacgttccaaaaacaaagaagacttactgcaagaacaaagcatgcaagaagcacacattgcataaggttactcagtataagaaggggaaagatagtttagctgcacagggaaaacgccgttatgatcgcaagcagtctggttatggtggacaaaccaaacctgttttccacaagaaggcaaaaactacaaagaagattgtgctaaggctgcaatgccagggttgcaaacatgtctctcagcatccaatcaagaggtgcaagcattttgagattggtggagacaagaagggcaaaggaacttctctgttctaaaatccagatatcaaaaacttactacttattactatcctcctcacctttccttcttttacagttttacccccactctatattgattgttaccactcgtgagtttcaataacaactttcatctctacttctctagacctaaagctttcttttatggttgcagattttaaatattaaaatat

SEQ ID NO: 3637 - DNA, 515 bp, Valeriana officinalis
cgatttcattgtcgatctgcagagacgagctatggtgaacgttccaaagacaaagaagacttactgcaagaacaaggcatgcaagaagcacacattgcataaggttacacagtataagaaggggaaagatagtttagctgcacagggaaaacgccgttatgatcgcaagcagtctggttatggtggacaaaccaaacctgttttccacaagaaggcaaaaactacaaagaagattgtgctaaggctgcaatgccagggatgcaaacatgtctctcagcatccaatcaagaggtgcaagcattttgagattggtggagacaagaagggcaaaggaacttctctgttctaaattctagacatcaaaaagttattactatcctcctcaactatctttcgtttacagttttacccaactctatattgattgttaccactcgtgagtttcaataacaactttcttccatatctagacctaaagcttgcttttatggttgcagatttaaagattaaaatat

SEQ ID NO: 3638 - DNA, 495 bp, Valeriana officinalis
tctcaagtctcaactactttcatccatccattttcactctacgttttcattgtcgatctccagagacgagctatggtgaacgttccaaagacaaagaagacttactgcaagaacaaggcatgcaagaagcacacattgcataaggttactcagtataagaaggggaaagatagtttagctgcacagggaaaacgccgttatgatcgcaagcagtctggttatggtgggcaaaccaaacctgttttccacaagaaggcaaaaactacaaagaagattgtgctaaggctgcaatgccagggttgcaaacatgtctctcagcatccaatcaagaggtgcaagcattttgagattggtggagacaagaagggcaaaggaacttctctgttctaaattccagatatcaataagttacttattactatcctcctcctcctcacctatctttcttttacacgttttaccccactatattgattgttactactcgtgtagttt

SEQ ID NO: 3639 - DNA, 583 bp, Brassica juncea
tagtacgcgggggttggctagcagacgacggcacacacgcttcaccggagatatcagaggagcgaaaatggtgaacattcccaagacaaaaaagacttactgcaagaacaaggaatgcaagaaacataccttgcacaaggttacccaatacaagaagggtaaagacagtcttgctgctcaaggaaagcgtcgttatgaccgtaagcaatccggttatggtggtcagactaagcctgtcttccacaagaaggctaagaccaccaagaagattgtcctgaggcttcagtgccaaacctgcaagcacttctcccagcactcgatcaagaggtgcaagcattttgaaatcggtggagacaagaagggcaagggaacatcacttttctaagctggcctcgtcttgagctttttacaagttttgtacttcgttggatcttgatttcatctgttttagctctcgtataagattgtttctcatccttgcttgttgactctaatattttgtatcatcaagatatggtttttctttttgtcattgcgctcatcagtcaatacaatcaaagtaaaacttacagtacagttttta

SEQ ID NO: 3640 - DNA, 581 bp, Brassica juncea
agtacgcggggcggacgacggcacacaatcttcacccgagagagagatcagagtagcgaaaatggtgaacattccaaagacaaagaagacgtactgcaagaacaaggaatgcaagaagcacacattgcacaaggttacgcaatacaaaaagggtaaagacagtctcgccgcccaaggaaagcgtcgttatgaccgtaagcaatctggttatggtggtcagaccaagcctgtcttccacaagaaggctaagaccacgaagaagattgtcctcaggcttcagtgccaaacttgcaagcacttttcgcagcactcaatcaagaggtgcaagcattttgagatcggtggagacaagaagggcaagggaacatctcttttctaagctgttgtcgtcgtctgttttctatttcgtttggatcttgattccatctgttttagccctcgtataagattgtcccctcatctttggttgtcactctatattttgaatcatctagacatgattttgctgtttttctttgcacttgaaatggttacttttgagatatttgcctcgtttcccgacaatgcaagccaaaggccag

SEQ ID NO: 3641 - DNA, 619 bp, Lactuca sativa
taaaaccctaaccacttaaatacaagtgccgtaaaacatctcgtcgttgacgaaaccctaaaaaacctgttatcgcctcttcagagaaactcgtccaccatggtgaatgttcctaaaacaaagaagacttactgcaagtcaaaggagtgcaagaagcacaccttacataaagtaacacaatacaagaagggcaaagatagtttagctgcacaaggaaaacgtcgttatgatagaaaacagtctggttatggtggtcaaaccaaacccgtttttcacaaaaaggcaaaaaccaccaagaaaattgttctaaggcttcaatgccaaggttgcaagcatgtctcacagcacccgattaagaggtgcaaacattttgagattggtggtgacaaaaagggaaagggaacttctctattttaagcagttatgcatcatttttggctggctttttcagtgttatcttttttcttgtttacaatgcaagaatgtaatgacttcacagattttggattgtattttcttttatttaacttggactactgtttaaagtaatgcaaaattgtttttcaaggggtgtttggggttttttacttaatttgctaaattctgttttgataacgtg

SEQ ID NO: 3642 - DNA, 2262 bp, Malus domestica
atgcccgtactccaaaccacctgcatctccaatttcccgccaaatcccaactccgcggttccacttccgccctattctttgagctgctccgccctcagctccgccgcttctacattcttcgccagaagtaaaaacccaatcttccaacccaattccgcttctttcctccgcgccaatcccccgcgcggggctcgtttggccatcagagccgccggaaccgattactataagactctcaacgtccccagaaccgccacgctgcaggagatcaagtccgcttatcgaaatctcgcccgaaagtatcatccggacaagggcggtggagctgaggacaagttcaaagagattagtgctgcatatgaggtcctatcagatgatgggaaaaggtctttatatgatcgctttggtgaagcaggtttacagggagactatggttcctcaaccatgggtccatcaggggtggatccttttgacatttttgatacattctttggaggttcggatgggatgtttggaggaaggggtgaatcaggaggcatgaacttcaatttcagcaacaggggaaaccagggtcttgacattcggtacgatctgtatttgagctttgaagaatccatttttggggtacagagagaaatccaagtttcttgtgttgagacatgtgatgactgcggtggaacaggtgctaaatctgataaaggcataaaatcatgtactggttgtggaggaagaggaggggtgatgaaaactcagaaaacaccatttggaatgatttcgcaggtatcaacctgctcaaagtgtggtggtgatggtagaataatcactgatccttgccaaagatgcagtggcaaaggacaagtgcagtcaaaaagagctatgagcataagcattccagccggtgttaatgatggagccacaatgcaaattcaaggggaggggaatttggataagaaaaggggtaaagttggagatgtctacatagtactccatgtagatgaaaaggctggaattcgaagagatggtctcaatctgtactcaaaaatcaatattgattataccgaagccattttagggaccgttataaaggttgaaactgttgaaggcttgaaagagcttcagattccttctggaattcagcctggagagacggtaaagttgcgacgcatgggggttccagacatcaacagaccttcttctcgaggagatcatcattttactgtcaatgttctgatcccaaagataatcagtgataaggaacgtgcacttgtcgaagaactggcttcgcttaaagcatctagagaaggtcattcagctgcttctaaaggcaccgggatacgagataggaactttggcaagcatagaaccaatgcgtcaagccaggcaactaaacgttctgcatccctgtgggactcgataaagggcgtgttggggaagaggcagtcgggagagggatttgcatcagtcagcgtggacaggccaccgttattatggggctcattccagccggatccgttgcatatggcatcaatttttacagttttagtcgtaacttgtatttgtaccgtcatgggaaagaccgctgacgcaagtgcctcttctagggttctactgagaggccgcttctgctccactgcagagtcatctccatacgaacccgccgtcgccatggtgaacgttcccaaaacaaagaagacctactgcaagagcaaggagtgcaaaaagcacaccttgcacaaggttacccaatacaagaaaggaaaggatagccttgctgctcagggaaagaggcgttatgatcgtaagcagtcaggttatggaggtcagaccaaaccagtgttccacaagaaggcaaaaactaccaagaagattgttctgaggctccaatgccagggttgcaagcatgtgtcccagcacccaatcaagaggtgcaagcatttcgagattggtggagacaagaaggggaagggaacctctcttttctaaatctacttgtgttacttttctatcttgttggagctttaaagcaaatatcatggttttaattatccgtgttattaggtttctgttaaacatcagattgttcttgacgatcttttccctgctttaaattgatgttagagtttctgtttgaaattgatatggcaattcgatcttttctttcatttcgttatcatgggattaggagttgatggctatataaaccctagttctttgctgtaactttcagatttcagatcaattaaacttttgagttttagtcaa

SEQ ID NO: 3643 - DNA, 500 bp, Cleome spinosa
cttctgggctcgtttaaccagttggagagagagacggaagctccgcgctgctgccgaagttcctcgaaagaagagaggaagatggtgaacgttccgaagacgaagaagacatactgcaagaacaaggagtgcaagaagcacaccttgcacaaggtgacacagtacaaaaggaaaaaacagtcttgctgctcagggaaagcgtcgttatgaccgtaagcaatctggttatggtggtcagaccaaacccgtcttccacaagaaggccaaaacaaccaagaagattgtgttgaggcttcaatgccagagctgcaagcatgtgtctcagcacccaattaagaggtgcaagcactttgagatcggaggagacaagaagggcaaaggaacatccctcttttaagtgtaccttcccctcctgaaacttctagttctgagttactttccgttcttatcggatcaatatcttaaatagacgttttattgtgacgaaactgcttcaattt

SEQ ID NO: 3644 - DNA, 475 bp, Humulus lupulus
ctcgcacatctcaactcggctccggcggcggcggcggctccggctctgttagcagacatggtgaaagttcccaagaccaagaagacttactgcaagaacaaggagtgcaagaagcacacccttcacaaggtgactcaatacaagaagggcaaggatagtcttgctgctcagggtaagcgtcgttatgaccggaaacagtccggttatggaggtcagaccaagccagctttcacaagaaggccaaaaccaccaagaagattgttcttaggctgcagtgccagggttgcaagcatgtctctcagcacgcaatcaagcgttgcaagcattttgagataggaggagacaagaagggaaagggaacttctcttttctaaatttgtgttactatgtcatttttgtttttatggatcttgaaatagagttgggatatttgttaacctagacatgttgtcatgttaaagatcgattttgtttg

SEQ ID NO: 3645 - DNA, 463 bp, Lolium multiflorum
  misc_feature (357)..(357): n is a, c, g, or t
agcgtggtcgcggccgaggtacgcggggctcattcgcgagcgcagttagggttttccgcacagagctcgcgccgccgccaagaacacaacaaggccggaggaagtaacacctcggtagccatggtgaacgttccaaaaaccaggaagacctactgcaagaacaaggagtgcaagaagcacacacttcacaaggttacccaatacaagaaggggaaggatagcctttctgctcagggaaagcgtcgttatgatcgcaaacagtcaggatatggtgggcagacaaagcctgttttccacaagaaggccaagacaacaaagaagattgtgctaaaaacttcagtgccagagctgcaagcnctaactctcagcgtgcgatcaagaggtgcaagcactttgagatcggtggagacaagaagggaaagggaacttcgtctcttctaagctgatggtagcaatgttgtcc

SEQ ID NO: 3646 - DNA, 494 bp, Capsicum annuum
cggcgattgtgctctctgctatttctgtctgcgaaaatggtgaacgttcctaagacgaagaagacctactgcaagtccaaggagtgcaaaaagcacaccttgcataaggtcacacaatacaagaaagggaaagatagcttggctgctcagggaaagcgtcgttatgacaggaagcagtctggttatggtggtcagacaaagcctgtcttccacaaaaaggcaaagaccacaaagaagattgtgttgaggttgcaatgccaaggctgcaaacatgtttcacagcacccaatcaagaggtgcaagcattttgaaattggtggggacaagaaaggaagggaacctctcttttctagattgcctatgaagtcaccaagaacttccttttttgtcttctcttatgctgcaatgttgaactttgattatttggatgttggctctattgtgttacattttcttccaattgattttgcgttgtgatagctgtatgaagatcc

SEQ ID NO: 3647 - DNA, 458 bp, Triticum aestivum
cgcggacgacggcacacaatcttcacccgagagagagatcagagtagcgaaaatggtgaacattccaaagacaaagaagacgtactgcaagaacaaggaatgcaagaagcacacattgcacaaggttacccaatacaaaagggtaaagacagtctcgccgcccaaggaaagcgtcgttatgaccgtaagcaatctggttatggtggtcagaccaagcccgtcttccacaagaaggctaagaccacgaagaagattgtcctcaggcttcagtgccaaacttgcaagcacttttcgcagcactcaatcaagaggtgcaagcattttgagatcgggggagacaagaagggcaaggggacatctcttttctaagctattgttctcgtctttattgttacaagttttctatttcgtttggtatcttgattccatctgttttagccctcgtataagattgtccc

SEQ ID NO: 3648 - DNA, 601 bp, Amsonia hubrichtii
tagtttgggtggcggcattaacccacttctatagaaaaaagctcttgcagaatctctctctgagccgtcgaaaatggttaacgttcccaagacaaagaagacatactgcaaatccaaggagtgcagaaagcacaccttgcacaaggttacccaatacaagaagggaaaagatagtttggctgctcaaggaaagcgtcgttatgatcggaagcagtcaggttatggtggtcagaccaaacctgtcttccacaagaaggcaaaaaccacaaagaagattgtgttgaggctccaatgccagggttgcaagcacgtctcgcagcaccctattaagaggtgcaaacattttgagattggtggagataagaagggaaaaggtacctccctttttaaggagctggtccatggagttcagctgctgtgttatctgttgcgatttagtttcacatatgcttcatgtttttttgtgatctagacaaaagtattagagatatttatggaagaaagttcagattttgatttttattgagttttgattctgatattttatggaacttaatatttgcatcttatttataagataagtagtagaagtacgtactac

SEQ ID NO: 3649 - DNA, 477 bp, Brassica juncea
ggacgacggcacacaatcttcacccgagagagagatcagagtagcgaaaatggtgaacattccaaagacaaagaagacgtactgcaagaacaaggaatgcaagaagcacacattgcacaaggttacgcaatacaaaaagggtaaagacagtctcgccgcccaaggaaagcgtcgttatgaccgtaagcaatctggttatggtggtcagaccaagcctgtcttccacaagaaggctaagaccacgaagaagattgtcctcaggcttcagtgccaaacttgcaagcacttttcgcagcactcaatcaagaggtgcaagcattttgagatcggtggagacaagaagggcaagggaacatctctgtgttttctatttcgtttggatcttgattccatctgttttagccctcgtataagattgtcccctcatctttggttgtcactctatattttgcagcaaaatcatgtctagatgattca

SEQ ID NO: 3650 - DNA, 494 bp, Distylium racemosum
ggagaggagaggaggcgaaagagaaacagtctctgtgcatatcctacaatggtgaacgtaccgaagactaagaaaactttctgcaagaacaaggcttgcaagaagcataccttgcacaaggtaacacagtacaagaagggcaaggatagtcttgctgtccaaggaaagaggcgatatgacaggaagcagtcagggtatggaggtcaaactaagccggttttccacaaaaaggctaaaacaaccaaaaagaattgtgctgaggctgcagtgtcagtcgtgcaaacatgtttcccaacatcccatcaagcgctgcaaacactttgagattggtggagataagaaagggaaaggcacctctctcttttaggtgcattcagttgctagttgacatcaaaatgattctattagcacaactagaatattttagttatgtttttttgtagctgtatttcaattgttctatgaggagtgtacttttgaaagttgtgaccggc

SEQ ID NO: 3651 - DNA, 497 bp, Flaveria ramosissima
tgcggctcatctttctctcgatcgacttcaggaattctgtagccatggtgaacgttcctaagaccaagaagacctactgcaagaacaaggaatgcagaaaacataccttgcataaggttacgcaatacaagaagggaaaagatagcttggctgcacaaggaaagcgtcgttacgacaggaaacaatctggttatggtggtcaaacaaaacccgtgtttcacaagaaggcaaaaaccacgaagaagattgtgctaaggttgcaatgccaaggctgcaagcatgtctctcagcacccaataaagagatgcaagcattttgaaattggtggagacaagaagggcaagggaacatctctttctgagcaatttgttgcaggcttgcttgcagctactatatcgttaattttttgtttagcagactattcaggtttaagtgtttgtaagtttgtattgcaagggcctattttgttttgacacatctgtctggagaaatagaaa

SEQ ID NO: 3652 - DNA, 1290 bp, Quercus alba
tttatcaaaacaatcactctcaagttctcaattcaaattcagtttcagtgttcgaagctttgaatagcaatggcaccaaaggcagagaagaagccggcggagaagaagccagcggaggagaagaaagccgagaaagcgccagcggagaagaagccacgagcggagaagaagctgcccaaggactcgtcggagaagaagaagaagcggtcgaagaagagcgtcgagacttacaagatctacatcttcaaagtgctgaagcaagtgcacccagatatcggaatctcgagcaaagccatgggaatcatgaacagcttcatcaacgacattttcgagaagcttgcacaggaagcgtctcgtctcgcgcgatacaacaagaagcccaccataacttctcgcgagattcagactgctgttcgtctcgttcttcctggggaactcgcgaagcacgctgtttctgagggcactaaggctgttacgaagtttacaagctcttagggcttgtttgggtgtttttgaatttaggggttgtaatttttgtttttttgtgatgtatagtctggcttctctgtgtttggagttagatttggtagggtttctctgtaattctctgttctagaaatgaaatttagcttttgcttatctgaaagcgcctccacaccgcaaatcgtagcagccatggtgaacgttcctaagacaaagaagacatactgcaagagcaaggagtgcaggaagcacaccttgcataaggttacacagtacaagaagggcaaggatagtcttgctgttcagggaaagcgccgctatgaccgcaagcaatctggttatggaggacagaccaaacctgtcttccacaaaaaggcaaagactacgaagaagattgtgctaaggttgcagtgccagagctgcaagcacatgtcgcaacatccaattaagcgctgcaaacactttgaaattgggggtgataaaaaaggcaaggggacatctcttttctagatgcgttctgttggttgtattttattttgctttacttatcaatcttgttggagcttgaaagctaaaattggataattgttcagttttgtttgttagtctaattttgtagtggaacagcaagttgtttctgatcaccatttatgattactgttatggtttgactgtttgagattaaattttgttaaatgtcttccaaatttcatgggggtgttagcgtcattgccgaaaataacttgccataagttggtggagatacaaaccttgagaaatctcattcacatatataattttgtaacc

SEQ ID NO: 3653 - DNA, 637 bp, Lippia dulcis
ggggttcggttcattttagataactataaaccctaaattggacttcctctgttgcaaaatcgcagttttgcagagaccttccaagccgtaagccatggtgaacgtgccaaagacaaaaaagacctactgcaaatcaaaggagtgcaaaaagcacaccttgcataaggtgacccaatataagaagggaaaggatagcttagctgttcaaggaaaaaggcgttatgatcgcaagcagtctggttatggtggccagaccaagcctgtcttccacaagaaggccaaaacaaccaagaagattgtgttgaggctgcaatgccagggctgcaagcatgtctcccaacacccgatcaagaggtgcaaacatttcgaaattggcggtgacaaaaagggacaaagggacatccctattctaatgtggaaaaacagaatcgttggtttgctttgttatttttgagtcctatagttatttttttttgttgtgtgtgtactgtttggtgaaatatgagacatcttacaactgaattttgtgtttttctgacattggattagtttccgaactgtattccacaagtattcagcatcgtattgcttgaacagtttgttggtttgcttaattttctaggagcagtttgaataa

SEQ ID NO: 3654 - DNA, 559 bp, Nicotiana tabacum
  misc_feature (41)..(41): n is a, c, g, or t
  misc_feature (50)..(50): n is a, c, g, or t
gccactgtaactgctgaacggcgacagatctaatcctcggnccgcaacantggtgaatgtacctaagacaaagaagacctactgcaaatccaaggaatgcaaaaagcacaccttgcataaggtcacacaatacaagaaaggaaaagatagtctagctgcccagggaaagcgtcgttatgatcgtaagcagtcaggttatggtggacagacgaagcccgtcttccacaaaaaggcaaaaactacaaagaagattgtcttaaggttgcaatgccaggggtgcaagcatgtctctcagcacccaatcaagaggtgcaagcattttgagattggtggggacaagaaaggaaagggaacctctcttttctaaattgcctgtgatgcaaaatttgatagttttctgttatacgtttttagatatctttttttgttggtgtagttcaagagcttttgttttcctagattcaagagcttttgttttcctatgctgtgttaattacattttgatcaggagatcaaagttgtacttttcaagtttctatttagtatgattcttgttccc

SEQ ID NO: 3655 - DNA, 528 bp, Eutrema halophilum
gaaattgtaggtgaacattccaaagacaaagaagacttactgtaagaacaaggaatgcaagaagcatacattgcacaaggtgacccaatacaaaaagggtaaagacagtcttgctgctcaggggaagcgtcgttatgaccgtaagcaatctggttatggtggtcagactaagcctgtcttccacaagaaggccaagaccacgaagaagattgtcctgaggcttcagtgccaaacctgcaagcacttctctcagcactccatcaagaggtgcaagcattttgagatcggtggagacaagaagggaaagggaacatcacttttctaagttggttatatcttaatttctacaagttttgtacttcgctggatcttgattccatctgttttagctctcgtataagatttgtctcatctttgcttgttaactctatattttgaatcatcaagatatggttttgctgttaatcactgcactgaagtccataagatatttaactcgcaagccaaatttaattcatgactttttca

SEQ ID NO: 3656 - DNA, 538 bp, Eutrema parvulum
taaactgaaatattttttgtttttaaggtgaacattccgaagacaaagaagacttactgcaagaacaaggaatgcaagaagcatacattgcacaaggtgacccaatacaaaaagggtaaagacagtctcgctgcacaggggaagcgtcgttatgaccgtaagcaatctggttatggtggtcagactaagcctgtctttcacaagaaggctaagaccacgaagaagattgtcttgaggcttcagtgccaaacctgcaagcacttctctcagcactcaatcaagaggtgcaagcattttgagatcggtggagacaagaagggcaagggaacatctcttttctaagctagtctcatcttgattttttttacaagttttgtacttcgtcggatctggattccatctgttttagctctcatataagattgtctcatctttgcttgttaactctatattttgaatcatcaagatatggttttgctgttaatcagtgcacttaagtcgatacgatatacctcgcaaaattaaacttaatgacttc

SEQ ID NO: 3657 - DNA, 615 bp, Mesembryanthemum crystallinum
  misc_feature (20)..(20): n is a, c, g, or t
  misc_feature (23)..(23): n is a, c, g, or t
  misc_feature (25)..(25): n is a, c, g, or t
ctctagatactcagcaaggngcncnagatttttagggttttcccatctctcgccgctcttcgtcaccatggtgaacgtacccaagattaagtaatacttactgcaagaacaaggagtgcaagaagcacaccacccacaaagtgacccaatacaagaaggggaaggatagtttggcagctcaaggaaagagacgttatgacaggaagcagtcaggatatggtggtcagacaaagcctgtctttcacaagaaggccaagactaccaagaagattgtgttgaggctacaatgccaatcatgcaagcatgtgtcacagcaccccatcaagcgatgcaagcactttgagattggtggagacaagaagggcaagggaactttctctgttttagttgtgccttcgagaacagtattcaatgtttcggtttatttgtaacctcttaccttgttttggttctgcacatgtctaaaaataactatagtttaaaatctctagtccattttttgtatatataaacggtgtataacatatttatatccgtctctttgttttttctctttcttcttactttctcttttatcttttttctttatgattctatattctagatactgtttct

SEQ ID NO: 3658 - DNA, 499 bp, Beta vulgaris
cttcatttttagggtttatcattccatctttctgccgcttgcaacaatggtgaacattcccaaggttaagaagacatactgcaagaacaaggagtgcaaaaagcacaccacgcacaaagttacccaatataagaagggcaaggatagtttggctgcccaagggaagaggcgttatgatcgcaagcagtctgggtatggtggtcagacaaagcctgtctttcacaagaaggccaagacaactaagaagattgtcttgaggctacagtgccaagcatgcaagcatgtatcccagcacgccattaagcgttgcaagcacttcgagattggtggagacaagaagggaaagggaacttctctcttttagttgtgttctgtggatcagtatttttgtttactgccagtatgtttttgttgaagatagttaaaacttgaacattttattagttgccatatgtatggtgtgaatttttcagccattttggaagaatcatttgggcat

SEQ ID NO: 3659 - DNA, 699 bp, Gossypium hirsutum
agcatctataaaactcaaactaccactgctagtttagcacaggagaacttagttttatccaaaatcttatgaaattctagttattacctttactggaagatctaggacaggcaaaacagaaaatacagataaattttaagtttatatgatccaatcatacacaaaggcaactgttataaaactgaagcttctcgcttttcagccgcagccatggtgaacgtacctaagaccaagaagacctactgcaagagcaaggagtgcaggaaacacactttgcacaaggtcacacagtataagaagggcaaggatagtttggctgcacaggggaagcgtcgttacgaccggaaacaatccggttacggtggtcagaccaaaccagtgttccacaagaaggcaaagaccaccaagaagattgtgctaaggctgcaatgccaaggttgcaagcacgtttcacaacatccgatcaagaggtgcaagcactttgagattggtggagacaagaaggggaaaggaacatctctgttttaaacgtgttattcatggtatcttgttatgtttgctttactttatatggagtagtttgaacttacaagactgtaatggaattttgttaaatttgcttagtttcttctgatgatgttttgcagttttctaactgttagcaaatgtttcactggcaattttgagttcaatttgttt

SEQ ID NO: 3660 - DNA, 649 bp, Gossypium raimondii
caaaacccaaaagccgagaaagccactaaaaaccctagagtcgataattactggtagcatctttgttagattgttggagtggccgcctcctaatttacagttctcaggttctctcgattcagccgtagccatggtgaacgtaccgaagaccaagaagacttattgcaagagcaaggagtgcaggaagcacacattgcacaaggttacacagtataagaagggtaaggatagtttggctgctcaagggaaacgccgttatgatcgcaaacaatccggttatggtggtcagaccaaaccagtgttccacaagaaggcaaaaaccaccaagaagattgtgctgaggctgcaatgccagggttgcaagcatgtgtcgcagcatccgatcaagaggtgcaagcactttgagattggtggagacaagaaagggaagggaacatctcttttctaaatgtggtgttcttgttcttgtgtttttgttggttttgagttcaatgctagtatggaatttttgtccaagttttgatttttaattttctcatgttataaaaacattaatgtgaaattcacattttattgttatgcgtcaagtgtttttatcttattattttaaattcacatccttaaaatgaatgatatatctaatccttgt

SEQ ID NO: 3661 - DNA, 710 bp, Gossypium raimondii
gaataattgggcttcattttctttttagcccaaaactcaaagcctaaaattgaaaccctcaaaaaccctaaaatgagaaatcagtactcctaatttttccatcctcaccgaaacagagctcgggtactctcatcttcagccgcagccatggtgaacgtacctaagacgaagaagacctattgcaagagcaaggagtgcaggaagcacactttgcacaaggttacacagtacaagaagggcaaagatagtttggctgctcaagggaagcgccgttacgatcgcaaacaatcaggttatggtggtcagaccaaaccagtgttccacaagaaggccaagaccaccaagaagattgtgctgaggctgcaatgccagggttgcaagcatgtatcccagcatccaatcaagaggtgcaagcattttgaaattggtggcgacaagaaggggaagggaacatctcttttctaaatggtgtttattcatttcatgtcatgtcatgttgttgggaactttttaagacagtatggaattttagtttttctaatgtattgttttccgagggatatggtgttctttaagcacttaatagttaatggcatcgtttgatctattgtcgccatttgttttaaatactgtattttaatttaattgtttttggaacttcaataatctttgctatatttttcatgaacgaggaattcaattcagcactc

SEQ ID NO: 3662 - DNA, 713 bp, Gossypium raimondii
ggaaaaccaagtaagataaacatgaaacatttaggttaattggctgccaccaccggatcaaaactgaagcttctcgcttttcagccgcagccatggtgaacgtacctaagaccaagaagacctactgcaagagcaaggagtgcaggaaacacactttgcacaaggtcacacagtataagaagggcaaggatagtttggctgcacaggggaagcgtcgttacgaccggaaacaatccggttacggtggtcagaccaaaccagtgttccacaagaaggcaaagaccaccaagaagattgtgctaaggctgcaatgccaaggttgcaagcacgtttcacaacatccgatcaagaggtgcaagcactttgagattggtggagacaagaaggggaaaggaacatctctgttttaaacgtgttattcatggtatcttgttatgtttgctttactttatatggagtagtttgaacttacaagactgtaatggaattttgttaaatttgcttagtttcttctgatgatgttttgcagttttctaactgttaccaaatgtttcactggcaattttgagttcaatttgttttagtaactcttgttaataatctccactgtgtttttctctgaaaagaggaaatcagcaccaagtcatgcaggtggaatgaattaaaagaagagaagaaaacaaaacaaaaaaaagttcagaatttttacttta

SEQ ID NO: 3663 - DNA, 839 bp, Gossypium raimondii
attcacgttattttttttaagcccaaaacccaaccctaaaaagggagccatttaaaaaccctagttaggttaaaatcttcaattggctgcttcctacttcaccatttacaccgaaacagagctcgggtcatctctcaccagccgcaaccatggtgaacgtacctaagacgaagaagacttattgcaagagcaaggagtgcaggaagcacactttgcacaaggttacacagtataagaagggtaaggatagtttggctgctcaagggaagcgacgttacgatcgcaaacaatcaggttatggtggtcagaccaaaccagtcttccacaagaaggcaaagaccaccaagaagattgtgctaaggctgcaatgccagggttgcaagcatgtctcacagcatccgatcaagaggtgcaagcactttgaaattggtggagacaagaaggggaagggaacatcacttttctagatgtgatgatattcatgtcaaattttatgttatgggtttttacttggaacttaacgcagaatggagttttgttaagtttggtattagtattctaatgttgtttttaagaggatattgtgttttttaaggttaatggcatcggtcacactcatcgatagcaattgtcattggttcttgttatatcaatatcttgtgagctcgcatcacttccttgagatcttgtaggtcaacgcccttaacgaagaaacttcatcgaatcaatagctcccaagcttcgtataattgggatcatgcatttgacatggataaagtatctgtcgcttgcatgttacattattcattttttagattgcatgatatttagtaggtcaa

SEQ ID NO: 3664 - DNA, 501 bp, Allium cepa
gagagaagaaacctagcacatcatcatggtgaacgttccaaagacaaagaagacatattgtaagagcaaggagtgcaggaagcacacattgcacaaggtgacacagtacaagaagggtaaagatagcttagccgcccaaggaaagcgcaggtatgaccgcaaacaatcaggttatggaggacagacaaaacctgtcttccacaagaaggccaagacaaccaagaagattgtgctgaggcttcaatgccagggttgcaaacatgtatcccaacacccaatcaagaggtgcaagcattttgagattggaggggataagaagggaaagggaacttctctattttagatggattattcatggtgtttttgctatactatctttcttttagaccttctttctctgatgttagtttctacatttaagtactttgattttgatatggtgttccattctcaagtttctgattatgattaatttgttagatgttctatgatatttgaagt

SEQ ID NO: 3665 - DNA, 572 bp, Plantago ovata
gggggtttcatcacggccgtctgcagaaactcatctcagcttgcccttccccgctgttgacaatggttaacgttccaaaaacaaagaagactttctgcaagtcaaaggagtgcaagaagcacaccttacataaggtgacacaatacaagaagggcaaagatagcttggctgcccaaggaaaacgtcgttatgaccgtaagcagtcaggttatggtggtcagacgaagcctgtctttcacaagaaggcaaagaccaccaagaagattgtactgaggttgcaatgccagggatgcaagcacgtctctcagcatcccatcaagaggtgcaaacattttgaaattggtggagacaagaaaggcaaaggaacttctctcttctaagccatctgggaatatcatgaagcttttgtgtttgcaacctggtgctggttgctgctatcttcttccaatgttagatgaaagccagacatgttttcaattttgctttataagccatgtaatgacccaactattcaacattaatttacgtcttactgttatggatttggttaccttatcaagttaattttgtta

SEQ ID NO: 3666 - DNA, 576 bp, Plantago ovata
cggccggggcattcagccagctagggttccaattccaaacgcttgcagaaaacagtcgcttgaagctcccttttgcaccgtcaaaatggttaacgttccaaaaactaagaagactttttgcaagtcgaaggaatgcaaaaagcacactttgcataaggtgacacaatacaagaaaggtaaggatagtttggctgcacaagggaagcgtcgttatgacaggaagcagtctggttatggtggtcagaccaagcccgtcttccacaagaaggcaaagaccacaaagaaaattgtgttgaggttgcagtgccaggggtgcaagcatgtatctcagcatcctattaagcgatgcaagcatttcgagattggtggtgacaagaagggcaaaggaacatcactcttttaagtgtgtggagtcatttggtattgtggttttgtttgaacaagatgttagacagaatattttgtatttgcaattcagttccattttacatgctcttgttaattggtggtagtatcagaccaaaaatttcagatttagttgtttctcctaccctgattgatgacagattttgttac

SEQ ID NO: 3667 - DNA, 677 bp, Citrullus lanatus
ctactttgccactaattagggtttttcgagcaggcctcgtccacgtccggccgtcatggtgaacgttcccaagacaaagaagacttattgcaagagcaaggagtgcagaaagcacaccttgcacaaggttacacaatataagaagggaaaggatagtcttgctgcacagggtaagcgtcggtacgatcgcaagcaatcaggatatggaggtcagaccaagcctgtgtttcacaagaaggcaaaaactaccaagaagattgtgttgaggctgcaatgccaagggtgcaaacatgtatcccagcacccaatcaagagatgcaagcacttcgaaattggtggagacaagaagggaaagggaacttctcttttctagaccctttgtcagtttttatcttttgtcatttctttttcacaagattatttgttattggagttcttgcaccattactctgtgttcagcaattagttctacgtgctgtaatgatactgtttagctgaaactctcatgtcttaattattgaattgccaaaattttgatgctctttgtttgatttatctagtcctttctcatagaaacttgtctgcatgaggaatcggtcagtaatagaattaatcgattgattattgttagattcgtgaaaattgtcttccaactatttcacgataacgcagatgag

SEQ ID NO: 3668 - DNA, 874 bp, Amsonia hubrichtii
tgggaaacaggaactcatcagggacaataccatctccatcatcatcaaggggcattaacgctcctccgtagaagccgctatagcaggatctctctcgggctgtcgaagatggttaacgttccaaagactaagaagacatactgcaaatccaaggagtgcaggaagcacaccttgcacaaggttacccaatataagaagggaaaggatagtctagctgctcaggggaagcgacgttacgatcgcaagcagtcaggttatggtggacaaactaaacccgtcttccacaagaaggcaaagaccacaaagaagattgtcctgaggctccagtgtcaggggtgtaagcatgtctcacagcaccctattaagaggtgcaagcattttgaaattggcggagacaagaagggaaagggaacctcacttttctaagaaactgggcattgaagttgaagtgctgttctatctattatcatgttttagtttcttatgtgcttttgatgttatgttatctaaatcggagtattagatattgatggaaagaagcttagatttttgttttgtttgagattcggatcctggatcattaattgcattcaatattttggttggagttaaaaggtagaaatagttatcatgatcatatcctgtgcttttgttgactgggcataataccatgagtatcacaattcgaggacacggtaaaatgatcagttgtattgggaagaaggattaagaaagagtagtatagttgagatggataaaagaccgaactgtgttttagttgtccggaatatctgctttcaagtgtgatatttctctgaacaatatcgtacttgtatgtctcgtgtattaatttatggatggaattgagagaaat

SEQ ID NO: 3669 - DNA, 530 bp, Arabidopsis lyrata
cgtctagtggaacgacgacggcacagaagcttcaccggagatcagagacgcgaaaatggtgaacattccaaagacaaagaacacttactgtaagaacaaggaatgcaagaaacatactttgcacaaggttacccagtacaagaagggtaaagacagtcttgctgctcaaggaaagcgtcgttatgaccgtaaacaatctggttatggtggtcagactaagcccgtcttccacaagaaggctaagaccacgaagaagattgttctgaggcttcagtgccaaagctgcaagcacttttcgcagcgcccgatcaagaggtgcaagcattttgagattggtggagacaagaagggaaagggaacatctctcttctaagctggtttcattttattttctgcaatttttgtactttgctggatttggaatccatttgttttagctctctcgtataagattgtctcatctttgcttgttaactctatattttgaatcatcaagatatggttttgctgttaatcatagaccttcgata

SEQ ID NO: 3670 - DNA, 477 bp, Arabidopsis lyrata
tttttgggaagtggaagacgacggcgcaagcttctccgaagagcgaaaatggtgaacattcctaaaaccaagaacacttactgcaagaacaaggaatgcaagaagcataccttgcacaaggttactcagtacaaaaagggtaaagacagtctcgctgcccaaggaaagcgtcgttatgaccgtaaacaatctggttatggaggtcagaccaagcccgtcttccacaagaaggctaagacaaccaagaagattgtcctgaggcttcagtgccaaagctgcaaacatttctctcaacgcccgattaaaaggtgcaagcactttgagatcggtggagacaagaaaggaaagggaacatctctcttttaagttgtttcatctatctacttttttgttttgtttggtacttgtcctgcttcaatattgagatatactttgaatctaccagaaatggttgtggttttcaattcaataggactt

SEQ ID NO: 3671 - DNA, 541 bp, Arabidopsis thaliana
cgtctagtggaacgacgacggcacaaaagcttcaccggagatcagagacgcgaaaatggtgaacattccaaagacaaagaacacttactgtaagaacaaggaatgcaaaaagcatactttgcacaaggttacccaatacaagaagggtaaagacagtcttgctgctcaaggaaagcgtcgttatgaccgtaaacaatctggttatggtggtcagactaagcctgtcttccacaaaaaggctaagaccacgaagaagattgttttgaggcttcagtgtcaaagctgcaagcacttttcgcagcgtcctatcaagaggtgcaagcatttcgagatcggtggtgacaagaagggaaagggaacatctctgttttaagttggtttcatcttattttctgcgatttttgtacttgctggatttggaatccatttgttttagctctctcgtataagattgtctcatctttgcttgttaactctatattttgaatcatcaagatatggttttgctgttaatcattgaccttcgatatttttttgccaa

SEQ ID NO: 3672 - DNA, 535 bp, Arabidopsis thaliana
aaatgtctctcttataagctctgttactttaggtttttattagaggttttgcggcagtggaagacgacggcacgagcttcaccgaagagcgaaaatggtgaacattccgaaaactaagaacacttactgcaagaacaaggagtgcaagaagcataccttgcacaaggtgacgcagtataagaaaggtaaagatagccttgctgcccaaggaaagcgtcgttatgatcgtaaacaatctggttatggaggtcagaccaagcccgtcttccacaagaaggctaagacaactaagaagattgtgctgaggcttcaatgccaaagctgcaagcatttctcgcaacgcccgattaagaggtgcaagcactttgagatcggtggagacaagaagggaaagggaacatctctcttttaagttgttgtttcatctatctacttttttttgttttgtttggtacctgtcctgcttcaatactgtgatatactttgaatctaccagaaatggtcctggtttttaatttaaataggacttggtctt

SEQ ID NO: 3673 - DNA, 704 bp, Artemisia annua
aacagggtatcaacgcagtactccaacgggaagtggtatcaacgcagtactccgacggggaggataaccctaatatcagtattcttgtgtttgtgcggctgttcatccttttcagtagccatggtgaacgttcccaagactaagaagactttctgcaaaaacaaggcctgcgggaagcacactttgcataaggtgacccaatacaagaagggtaaggatagtttggctgcacaaggaaagcgtcgttatgacaggaaacagtccggatatggtggacagaccaagcccgtctttcacaagaaggctaagaccaccaagaagattgtgctaaggctgcaatgccaaggttgcaagcatgtttcccagcatgctatcaagaggtgcaagcattttgaaatcggtggagacaagaagggcaagggaacttctcttttctgagcagttttgtgtaattttgttgaagctagtgatattttttgtttttacctgaatttcagctttaagtctttgaaactgcgagtatcttcttttttgctttgacacatcttgctagacttggaagttatggcagtggttatgaattttaacttgcggttggtgtctaatatgatcattgcttgttttagattgcgtgcttggtgataaaaatttgcagttgactgaatatgatcattgtaatagttaggttcgtaaagagtgcgtct

SEQ ID NO: 3674 - DNA, 540 bp, Artemisia annua
gaaaccctaaggcgcctcctgcttccagctccattctccaaaccttgtcaccatggtgaacgtacctaagaccaagaagactttctgcaaaaacaaggcatgtggaaagcacaccttgcataaggtgacacaatacaagaagggaaaagatagcttggctgcacaaggaaagcgtcgttatgacagaaaacagtctggttatggtggtcagacaaagcccgtctttcacaagaaggcgaaaaccaccaagaagattgtgttgaggttgcaatgccaagggtgcaaacatgtttcacagcatgcaatcaagaggtgcaagcattttgagatcggtggagacaagaagggaaagggaacttcccttttttaggcagtttgtgtttcagctatgcagtatttttggcagacttttcagtgttgtttctctttcaggattacggtggaattatgtattagctttgcatgtttggcttatttctttagtgattttgacacttttcagagtaatgtgaatctgtttttgagccaaatagagacacg

SEQ ID NO: 3675 - DNA, 596 bp, Artemisia annua
gtatcaacgcagtactccgacggggtggctcatatatctctcatacggcggcttagttcatcggcgatctttaaccatggtgaacgttcccaagactaagaagactttctgcaagaacaaggcgtgcggaaagcacaccttgcacaaggtgactcagtacaagaagggtaaggatagtttggctgctcaaggaaagcgtcgttatgacaggaaacaatcaggatatggtggacagaccaagcccgtctttcacaagaaggctaaaaccaccaagaagattgtcttgaggttgcagtgccaaggatgcaagcatgtgtcacaacacgctatcaagcgatgcaagcattttgaaattggtggagacaagaagggcaagggaacttcactcttttaagctattactattatgtgttatcttgatatgtctagacttatagatgttacatctgttttgacttttaatgcaagaatgttttcgtatgctacatttggcttttgttgtatgggttgatgttgcattacgttttagttggtcacaattctgtgaacgttttgtgaatgcggttgaattctgttttatcccaaactacagtgct

SEQ ID NO: 3676 - DNA, 494 bp, Brassica juncea
gggcacacgacgacacaagcttcactcaaggtcagacgagcgaaaatggtgaacattccaaagacaaagaagacatactgcaagaacaaggagtgcaagaagcacacattgcacaaggttacccaatacaaaaagggtaaagacagtctcgccgctccaggaaagcgtcgttatgaccgtaagcaatccggttacggtggtcagaccaagcctgtcttccacaagaaggctaagaccacgaagaagatcgtcctcaggcttcagtgccagacttgcaaacacttttcgcagcactcaatcaagaggtgcaagcattttgagatcggtggagacaagaagggcaagggaacatctcttttctaagctgttctgatcttaatttgttacaagtttgtcatcttgattccatctgttttagctctcgtacaagattgttcccttatctttggttgttaactctatattttgatacatcagtatgtggatttgctgtt

SEQ ID NO: 3677 - DNA, 519 bp, Musa acuminata
gacgcttcggaggcggccaccctaacgctaacctgcagccatggtgaacgtgccaaagaccaagaaaacgttctgtaagaacaaggcttgtaggaagcacacgcttcacaaggttacacagtacaagaagggtaaggatagcctttctgttcaagggaagcgccgctatgacaggaagcagtctggttatggtggacagacgaagcctgttttccacaagaaggcaagaacgacaaagaaaatcgtgttgaagcttcaatgccaaagttgcaagcattattcgcagcatccgataaagagatgcaagcactttgagattggtggagacaagaaggggagggggacctctctcttctaatttgtctttgttgacatttcagcattacatttttatgtgtttatgtgaaatggtagtttgttctatgctgattttagtttaaactactggaatttcaatgttggttaacttttgcatgtggtttaaaatggatatgcaatattcatgaagtttatttggtc

SEQ ID NO: 3678 - DNA, 1385 bp, Beta vulgaris
  misc_feature (1347)..(1347): n is a, c, g, or t
  misc_feature (1373)..(1373): n is a, c, g, or t
gtggagtcggacgggcgacaaaaaggctaagagagatagaaaatctgggataggcataatggaaagatctttagagtaagccaatatcgcgggagacgcatgcatggagagaaggtagaacagaagagactaggacagaggcgacgaggagaaaaggaggaaacaagagcggtaagacaagtattagggattaacggactagagcgcaaagaggaggataccagagtgagacatataaaacattttgttgcgagcgagaggccgcaaagattatgagaaaagcggagaggtaaagagatttatctagacgaggtggagagattatacgggggcataattggtttatttggtggtcaaaagaagaggacgactgagaacgtgtttttttgggaggcaacaagatcgaatttttcttaagagcaaagaatttttgttcctgtgggaaaaatttcatgacaacggggcgtgataagaattaaactggggaccccttcgtagaagcaaaaggcggggaaattttcccccccaagtcgtgtaagcctccaatattgtgggtagtgaataagaattctgattagctacgaagcgccggtgtcccgcctatgtgagtagggaaggaagaaacattggaaaaaccatgccaatttttggatattttcaaggtggttaaagtaccaaattttatattttcaaaggcatggacactgtggattgacaaaaaaaaaaatttttttctaattaaggaaggttttttttttggtagaatagcagggataatgtaaaactaacagtaataaacgacttcggggactagttctctccctagtgcggaattcggcacgaggcttcatttttagggtttatcattccatctttctgccgcttgcaacaatggtgaacattcccaaggttaagaagacatactgcaagaacaaggagtgcaaaaagcacaccacgcacaaagttacccaatataagaagggcaaggatagtttggctgcccaagggaagaggcgttatgatcgcaagcagtctgggtatggtggtcagacaaagcctgtctttcacaagaaggccaagacaactaagaagattgtcttgaggctacagtgccaagcatgcaagcatgtatcccagcacgccattaagcgttgcaagcactttgagattggtggagacaagaagggaaagggaacttctctcttttagttgtgttctgtggatcagtatttttgtttactgccagtatgtttttgttgaagatagttaaaacttgaacattttattagttgccatatgtatggtgtgaatttttcagccattttggaagaatcatttgggcattanttgaaaaaaaaaaaaaaaaaaaactngagggggggccc

SEQ ID NO: 3679 - DNA, 528 bp, Bruguiera gymnorhiza
gatcgctgcgcttctcgtcttctttgtaccgaggcagagctctctaccactccgccgtcaacaatggtgaacgttccaaagacaaagaagacttactgcaagaataagcagtgcagaaagcacaccttgcacaaggttacccagtacaagaaggggaaggatagccttgctgctcaggggaagcgtcgttacgatcgtaagcaatctgggtatggaggacagacaaagccagttttccacaagaaggcaaaaactaccaagaagattgtgttgaggctccagtgccagagctgcaagcatgtgtcccaacaccccctcaagaggtgcaaacattttgagattggtggagacaagaagggcaagggaacatcattattttaagttcttcattgtagtcttgtgtttctaacttccataattgtgtttgagaaacccccgtgatttgattttgttttgttttgttgtaagtcttgatgaccattctagaccatcatatcagataattgagtttatgctttcagtcagtgg

SEQ ID NO: 3680 - DNA, 591 bp, Manihot esculenta
aagcggctcttctcctcacaagctctggcactctagggttttcagaacgctatcagaatggtgaacgttcccaagacgaagaaaacatactgcaagagcaaggagtgccgaaagcacactttacataaggtcacacagtacaagaagggcaaggatagtcttgctgcacaagggaagaggcgttatgatcggaagcagtcaggttatggaggtcagacaaagcccgttttccacaagaaggccaaaactactaagaagattgttctgaggctgcaatgtcaaggttgcaagcatgtatctcagcatccaattaagagatgcaagcattttgagattggtggagacaagaagggaaagggaacttctcttttctaaatgctattttatggatatgttttttggatgtgtttcattgttaagaactttgctggaactgggatgatcctagagtttttgttctgacttcattttgttggttatcttgttatttctagacatctactactagtttattattttaatttactcaatagcaatcaacttttagtcagaactatcttaatccagttttaatgattcattttttgtttg

SEQ ID NO: 3681 - DNA, 540 bp, Manihot esculenta
ggaacaaccagggttttgtagagcctaaccacgatggtgaacgttcccaagacaaagaaaacatattgtaagagcaaggaatgccgaaagcacactttgcataaggtcacacaatacaagaaaggtaaagatagccttgctgcacaaggtaaaaggcgttatgatcgtaagcagtcgggttatggagggcagacaaaacctgttttccacaagaaggccaaaactactaagaagattgttctgaggttgcaatgtcaaggttgcaagcatgtgtctcagcatccaattaagagatgcaagcattttgagattggtggagataagaaggggaagggtacttctctgttctaaatgctattttatggttatgttttggttgtgattcactgttcagacatttaagctaaggcaaaatctagaatttttcttcacttcattttgtgtggttaaagtgctgtcacgctacttcattatggttgtttacaataaccaattgtcttctaattagaattagtgagctattttgattgagctatgaat

SEQ ID NO: 3682 - DNA, 833 bp, Ricinus communis
aagggcaaaaatgaaattctaatttagcagctatgcttttgaaggaacttggactttggctacatattcgagtcgcctcctgctcttgctagggtttttgcgaaattgcgaaaatggtgaacgtcccgaagacaaagaagacatactgtaagagcaaggagtgcagaaagcacactttgcataaggtcacacaatacaagaaagggaaggatagccttgccgcacaagggaagcgccgttatgatcgcaaacaatcaggttatggaggccagacaaagcctgttttccataagaaggccaagacaaccaagaagattgttctgaggctgcaatgtcaaggctgcaagcatgtatctcagcatccaattaagagatgcaagcattttgaaattggtggagacaagaaggggaagggtacctctcttttctaaatgcaaattaacatgcggcatttttgcatgttcacaactgttaaaactttgtgccagagctggatcaaatatggaacttttgttgagtttatagtgtcagttgcttcttttggttttgctagacatctactgtttgtttatggtagtagtaactgataatttatagcaatcttgttattgtcactagttaacaagctatttcaatttagttttgaatgcaatctatgctaaacacttaaacatcagaaaggtcattcattcgtcaggtttgaatctatgctcgaggcttttgtaattatacatgttctctggaaggttcttaagttgcgatacctgatagtttttaaggcatatacagattaatgattaaatttgtattgcttggctaaaatgataatcaaa

SEQ ID NO: 3683 - DNA, 714 bp, Ricinus communis
gaaatttcatagagaggcccagctataaaagaaaaaccaacatggagccctagcgctggtaaagactctaactgctgctcttcttctttctagggttttcgcaggaccgccagggttttcgtaggactgccaaaatggtgaatgttcccaagacaaagaagacttactgtaagagcaaggagtgcagaaagcacactttgcataaggtgacacagtacaagaaagggaaggatagccttgctgcacaagggaagcgtcgttatgatcgcaaacaatcaggttatggaggccagacaaagcctgttttccacaagaaggccaagactaccaagaagattgttttgaggttgcagtgtcaaggctgcaagcatgtatctcagcatccaatcaagagatgcaagcattttgaaatcggtggagacaagaagggaaagggtacatctcttttctaaatgcaggtctacatgcaattttttgcatgttttctacttctaaagccttgtgcttgagctggatcaaatctacaacatttcttgtatttatgttgttagtttcttttgtctttatggtagtaattgacgatcaatagcaatcatgttttttttcagggtgaacaagcaattttaatttagttttgaatgcatttttatttgaaccatatttacttaagtttcacaaactacttgccacattccaagtaatctacattcttca

SEQ ID NO: 3684 - DNA, 676 bp, Ricinus communis
ggcccggctataaaagaaaaaccaacatggagccctagcgctggtaaagactctaactgctgctcttcttctttccagggttttcgcaggaccgccagggttttcgtagggctgccaaaatggtgaatgttcccaagacaaagaagacttactgtaagagcaaggagtgcagaaagcacactttgcataaggtgacacagtacaagaaagggaaggatagccttgctgcacaagggaagcgtcgttatgatcgcaaacaatcaggttatggaggccagacaaagcctgttttccacaagaaggccaagactaccaagaagattgttttgaggttgcagtgtcaaggctgcaagcatgtatctcagcatccaatcaagagatgcaagcattttgaaatcggtggagacaagaagggaaagggtacatctcttttctaaatgcagatctacatccaattttttgcatgtttcctacttctaaagccttgtgcttgagctggatcaaatctacaacatttcttgtctttatgttagtttcttttgtctttatggtagtgtaattgatgatcaatagcaatcatgttttttgtcaagggtgaacaagcaattttaatttagttttgaatgcatttttatttgaaccatatttacttaaatttcacaaactacttgccaca

SEQ ID NO: 3685 - DNA, 666 bp, Castanea mollissima
cgcacgcctggttcgttcgcttgctctgattctcatcaccatggtgaacgttcctaagacaaagaagacctactgcaagagcaaggagtgcaaaaagcacaccttgcataaggtcacacagtacaagaagggaaaggatagccttgctgttcagggaaaacggcgatatgatcgcaagcaatcaggttatggagggcagacaaaacctgttttccacaagaaggctaagacaaccaaaaagatcgtgctaaggctacaatgccaaggctgcaaacacgtttcacagcaccccattaagaggtgcaagcattttgaaataggaggagacaaaaaggggaagggaacttctcttttctaaatgattgttctgttctattattatgctgcttactttcagttatgttggagcctgaagacaaaatatgggatagttatttgctggcctaggaaaacattgaagtgaattttgatatattttattgcaaaagtttgatattggagtttgaattaatgattatctgtgcaaatgaaactgctttgtgattgatcttgttctcttgggtcaaacgtattttgatgactgggcttgagtttggtctttggacaattctctatgtctgtcccaggatatgctaattttgatttgtgttgtggtgccaccattat

SEQ ID NO: 3686 - DNA, 586 bp, Citrus sinensis
gggatggcattaggccggggaaccttaggcagcatttggaagttacgaagagctctcctcgtcgtcgccgcagccggccatcatggtgaacgttcccaagactaagaagacttactgcaagagcaaggagtgcagaaagcacaccttgcacaaggtgacacagtacaagaagggcaaggacagtcttgctgctcaagggaagagacggtatgatcgcaagcagtctggctatggtggtcagaccaagcctgtcttccacaagaaggctaagaccaccaagaagattgtgctgaggctccaatgccagggttgcaagcatgtgtctcaacatcccatcaagaggtgcaagcactttgaaattggtggagacaagaagggaaagggaacatctcttttctaaatgcctttatttttgtttttatgctttttactttgctgcacttgatggaactttacccagtatgagaatatttgttttagttttgttgggttagtttgatgctgttaatttaaaacttgaagcggttgtttgttaagtgcttattatatcagttaattttagatttggatttttttaccaaaaaaa

SEQ ID NO: 3687 - DNA, 590 bp, Citrus clementina
attctcttgtttcagaaaccgagtctctagttacccttcggcagcagttggaagttacgaagagctctctcgtcgtcgccgcagccggccatcatggtgaatgttcccaagactaagaagacttactgcaagagcaaggagtgcagaaagcacaccttgcacaaggtgacacagtacaagaagggcaaggacagtcttgctgctcaagggaagagacggtatgatcgcaagcagtctggctatggcggtcagaccaagcctgtcttccacaagaaggctaagaccaccaagaagattgtgctgaggctccaatgccagggttgcaagcatgtgtctcaacatcccatcaagaggtgcaagcactttgaaattggtggagacaagaagggaaagggaacatctcttttctaaatgcctttatttttgtttttatgctttttactttgctgcacttgatggaacattacccagtatgagaatatttgttttagttttgttgggttagtttgatgctgttaatttaaaacttgaagcggttgtttgttaagtgcttattatatcagttaattttagatttggatttttttacc

SEQ ID NO: 3688 - DNA, 686 bp, Gossypium hirsutum
gacccaaaagccgagaaagctactaaaaaccctagagtcgataattactggtagcatctttgttagattgttggagtggccgcctcctaatttacagttctcaggttctctcgattcagccgtagccatggtgaacgtaccgaagaccaagaagacttattgcaagagcaaggagtgcaggaagcacacattgcacaaggttacacagtataagaagggtaaggatagtttggctgctcaagggaaacgccgttatgatcgcaaacaatccggttatggtggtcagaccaaaccagtgttccacaagaaggcaaaaaccaccaagaagattgtgctgaggctgcaatgccagggttgcaagcatgtgtcgcagcatccgatcaagaggtgcaagcactttgagattggtggagacaagaaagggaagggaacatctcttttctaaatgtggtgttcttgttcttgtgtttttgttggttttgagttcaatgctagtatggaatttttgtccaagttttgatttttaatattctcattttataaaaacattattgtgaaattcacattttattgttatgcgtcaagtgttcttatcttattattttaaattcacatccttaaaatggatgatatataaatttaaattataataaaatttagacatataaatacaccagattaaaagt

SEQ ID NO: 3689 - DNA, 635 bp, Gossypium hirsutum
gacccaaaagccgagaaagctactaaaaaccctagagtcgataattactggtagcatctttgttagattgttggagtggccgcctcctaatttacagttctcaggttctctcgattcagccgtagccatggtgaacgtaccgaagaccaagaagacttattgcaagagcaaggagtgcaggaagcacacattgcacaaggttacacagtataagaagggtaaggatagtttggctgctcaagggaaacgccgttatgatcgcaaacaatccggttatggtggtcagaccaaaccagtgttccacaagaaggcaaaaaccaccaagaagattgtgctgaggctgcaatgccagggttgcaagcatgtgtcgcagcatccgatcaagaggtgcaagcactttgagattggtggagacaagaaagggaagggaacatctcttttctaaatgttgtgttcttgttcttgtgtttttgttggttttgagttcaatgctagtatggaatttttgtccaagttttgatttttaatattctcattttataaaaacattattgtgaaattcacattttattgttatgcgtcaagtgttcttatcttattattttaaattcacatccttaaaatggatgatatat

SEQ ID NO: 3690 - DNA, 571 bp, Gossypium hirsutum
tcctacttcaccatttacaccgaaaaagagcttgggtcatctctcaccagccgcaaccatggtgaacgtacctaagacgaagaagacttattgcaagagcaaggagtgcaggaagcacactttgcacaaggttacacagtataagaagggtaaggatagtttggctgctcaagggaagcgacgttacgatcgcaaacaatcaggttatggtggtcagaccaaaccagtcttccacaagaaggcaaagaccaccaagaagattgtgctacggctgcaatgccagggttgcaagcatgtctcacagcatccgatcaagaggtgcaagcactttgaaattggtggagacaagaaggggaaaggaacatctcttttctagatgtgatgatattcatgtcaaattttatgttatgggtttttacttggaacttcaggcagaatggagttttgttaagtttgatattagtattctaatgttgtttttaagaggatattgtgtttttaaggttaatggcatcggtcacactcattgatagcaattgtctaattggttcttgttatatcaatatcttgt

SEQ ID NO: 3691 - DNA, 547 bp, Gossypium hirsutum
accgaaacagagctcgggtactctcatcttcagccgcagccatggtgaacgtacctaagacgaagaagacctactgcaagagcaaggagtgcaggaagcacactttgcacaaggttacacagtacaagaagggcaaagatagtttggctgctcaagggaagcgccgttacgatcgcaaacaatcaggttatggtggtcagaccaaaccagtgttccacaagaaggccaagaccaccaagaagattgtgctgaggctgcaatgccagggttgcaagcatgtatcccagcatccaatcaagaggtgcaagcattttgaaattggtggcgacaagaaggggaagggaacatctcttttctaaatggtgtttatttatttcatgtcatgtcatgttgttgggaaccttttaagacagtatggaatttttgtttttctaatgtaatgttttccgagggatatggtgttctttaagcacttaatagttaatggcatcgtttgatctcattgtcgccatttgttttaaatactgtattttaatttaattgtttt

SEQ ID NO: 3692 - DNA, 1049 bp, Gossypium hirsutum
acttcggattcgtccttattttaagtattacttttttgaaaaatcaaagcttacaaatatgaataaaattctttaatgaatccgtctccgattatatttgtatcgatgaatcaaaatgcacgatgaagtgaacaaaatttgaggaagaaaatcgtgtaaaaatgtctgcatgtaaaattttacttattttagggttgaatattgatgatgggcttctaattcttggatatgtcgaagactaattgggctgctaaagaattttctgggttagatcatggcaatcaatttttgtttttgtttctaagcccaaaatccaaaccctaatccaaaatcaatatatttgttaggttaattagctgccaccaccggatcaaaactgaagcttctcgcttttcagccgcagccatggtgaacgtacctaagaccaagaagacctactgcaagagcaaggagtgcaggaaacacactttgcacaaggtcacacagtataagaagggcaaggatagtttggctgcacaggggaagcgtcgttacgaccggaaacaatccggttacggtggtcagaccaaaccagtgttccacaagaaggcaaagaccaccaagaagattgtgctaaggctgcaatgccaaggttgcaagcacgtttcacaacatccgatcaagaggtgcaagcactttgagattggtggagacaagaaggggaaaggaacatctctgttttaaacgtgttattcatggtatcttgttatgtttgctttactttatatggagtagtttgaacttacaagactgtaatggaattttgttaaatttgcttagtttcttctgatgatgttttgcagttttctaactgttaccaaatgtttcactggcaattttgagttcaatttgtttaaatactcttgttaaaaaaaaaaacaaaaactccagagtcttttatagcgcgcggggcccttgattttcacccggtggggcccagtagggtcccaattcgcttattgaggggattaaatcactggccgctttaaacgcggaatgggaaacctggg

SEQ ID NO: 3693 - DNA, 571 bp, Gossypium hirsutum
tcctacttcaccatttacaccgaaacagagctcgggtcatctctcaccagccgcaaccatggtgaacgtacctaagacgaagaagacttattgcaagagcaaggagtgcaggaagcacactttgcacaaggttacacagtataagaagggtaaggatagtttggctgctcaagggaagcgacgttacgatcgcaaacaatcaggttatggtggtcagaccaaaccagtcttccacaagaaggcaaagaccaccaagaagattgtgctaaggctgcaatgccagggttgtaagcatgtctcacagcatccgatcaagaggtgcaagcactttgaaattggtggagacaagaaggggaagggaacatcacttttctagatgtgatgatattcatgtcaaattttatgttatgggtttttacttggaacttaacgcagaatggagttttgttaagtttggtattagtattctaatgttgtttttaagaggatattgtgttttttaaggttaatggcattggtcacactcatcgatagcaattgtcattggttcttgttatatcaatatcttgtt

SEQ ID NO: 3694 - DNA, 689 bp, Cryptomeria japonica
gggtgttttctgttcggggacgaaggaaaggagacgacatctgcgaggagtgttagcgtggaggacaaaggctatcatggtgaacgtaccaaagactaagaaaactttctgcaagaataaggcttgcagaaagcacaccttacacaaggtaactcagtacaagaagggaaaggatagtcttgctgcccaaggaaagaggcgttatgacaggaaacaatcaggatatggaggtcaaactaagcctgttttccacaaaaaggctaagacaacgaagaagattgtgctgaggctgcagtgtcaatcatgcaaacatgtttcccaacatccgatcaagcgctgcaaacattttgagattggtggagacaagaaaggaaaaggcacttctctcttttaggtgcattcagccgctagttaatattgaaatgatttgatcagcctagctaatatattcaagcgtcatgtataatgcaatttatcaatcgtcatgatcattattttacttttcattcttaaagtagttaagcttcttataaattctggttgcttgcttttgctgacaatgctttgcagcatagttagaaataacttatgagcatttataatgaagaaaccttggattgttctttccttggctgattctgaaccgtgaggtttgaaacaaaacagaatgtatgagattctatttggtt

SEQ ID NO: 3695 - DNA, 568 bp, Cryptomeria japonica
  misc_feature (388)..(388): n is a, c, g, or t
  misc_feature (561)..(561): n is a, c, g, or t
cgccaaagtagagagcgccgaggagaagtagcttgttttcagcgcagcaggagcaatggtgaacgttccaaaaactaagaaaaccttctgcaaaaacaaagcatgcagaaagcacactttgcacaaggttactcagtacaagaaaggcaaggacagtcttgcagcccaaggaaaacggcggtatgatcgaaaacaatcaggctatggaggccagacaaaacctgtctttcacaagaaggcaaaaacaacaaagaagattgttttgaggttgcaatgccagtcttgcaaacacgtctcacagcatccaatcaagcgatgcaaacactttgagattggtggagacaagaaggggaagggaacatcccttttctagatgggaggttatgtnctgcatttgcttgaacagtttacactgtttatatctacagatacctatctgagacaaaagatctgttttgactgtagaagtgagttacacggaagcaatctattgaagataactatttagttttgacattcgagtaatgttttgatgataattaaaaaacttaaatttttttntttcggg

SEQ ID NO: 3696 - DNA, 571 bp, Cucumis sativus
gttcgccgattagggtttcttcggagaagttgtgaggacaagaatccaccatggtgaacgttcccaagacaaagaagacttactgcaagagcaaggaatgtagaaagcataccttgcacaaggttacccaatacaaaaagggtaaggacagccttgctgctcaaggaaagcgtcgttatgatcgtaaacaatcaggatatggtggacaaaccaagcctgtctttcacaagaaggctaaaactacaaagaagattgtgctaaggttgcaatgccagggttgcaagcatgtctcacagcatcccattaagagatgcaagcattttgagattggtggagacaagaagggaaagggaacttctcttttttagatgcattaacattgtcattcactatatattgctgtttagggagtcagaattgtgggcttgtttctgccctttgcttttttgttttggtgtttctgatatttgggaacatttttacttgttgaattttgtttaatgtatcagtttataatggaacaactagctttatcttctacccaatgtcgtattatcagtttgtttgaatt

SEQ ID NO: 3697 - DNA, 561 bp, Cucumis sativus
actttgccactaaattagggtttctggagcaggcctcgtcgacgtccagccgtcatggtgaacgttcctaagaccaagaagacttattgcaagagcaaggagtgcaggaagcataccttgcacaaggttacacaatataagaagggaaaagatagtcttgctgcacagggaaagcgtaggtacgatcgcaagcaatcaggatatggaggtcaaaccaagcccgtgtttcacaagaaggcaaaaactaccaagaagattgtgttgaggcttcagtgccaaggttgcaaacacgtatcccagcaccctatcaagagatgcaagcacttcgaaattggtggagacaagaaagggaagggaacttctcttttctagacccttttatcagttttttatcttttgtcacaaagattatttgtttttggagttcttgcagaattgctttgttttgttcagcaattagatctacctgtcgtaatgatactttttagctgaaactttctcatcttaattaatgaattaccataattttgatgctctttgattgatatatcgagtcttctc

SEQ ID NO: 3698 - DNA, 718 bp, Cycas rumphii
tggatccaaagtggaaacgaatagcgtttgggcattctccatacattggaaaaatggtgaacgttccgaagacaaagaaaactttttgcagaaataaggagtgcagaaagcacaccttgcacaaagtcacacaatacaagaagggaaaggacagtcttgctgcccaagggaagagacgttatgaccgaaaacaatcaggttatggaggtcaaaccaagcctgtctttcacaaaaaggctaaaacaacaaagaagattgtgttaaggttgcaatgtcagtcttgcaaacatgtgtcccaacatcccattaagcgttgcaaacactttgagattggtggagacaagaaaggaaaaggcacatctctcttctaggcagagagctgctaattgagctggataagagctttgaacactgcagctgttgaattatagagatgctttctttatggctgaaacatttgaattgttctattttaatgatttttcttaccatgcatagtttagcttggaatatgcaactagctcgtaagtagttcatcacatagcaattttggatgccttctttccttttttttgaaaattttgccgtaatgctttgaaccatagagatgcttacttcattgccaaaacatttgaatagttctattgcaaggacatttcttgccatgcatggtttagcttgaaatgttgactagctcttaatagttaatcctgtagca

SEQ ID NO: 3699 - DNA, 820 bp, Taraxacum officinale
tagactggtggtttttatctctcctctgctagatcggttctcccgagatcttcagccatggtgaatgttcccaagacaaagaagacttactgcaagaataaagattgcagaaagcacacattgcataaggtgactcaatacaagaagggaaaagatagtttggctgctcaaggaaaacgtcgttatgacaggaaacaatctggttatggtggacagaccaagcctgtctttcacaagaaggcaaaaaccacaaagaagattgtgttgaggttacaatgccaagggtgcaagcatgtgtctcaacacccaatcaagaggtgcaagcattttgaaattggtggagacaagaagggcaagggaacatcacttttttaagctaagaaaacatgtgttgttattttgataaaatcagacttttagatgatcttcattttattaagtttttatgcaagtatgtgtttttggttacatttacaattctgttgtttaagctatttactattttctaaaaaaaaaatgaaaaaacatgcacaaaaaaaaagatcaactgggccgaggcggccgacatgtaggtttattttatttttttttttggcaactttatggaagcggcgtcattcccaacctaatgaaagggccgtgctttaaaaaggacagggcagcccaaaacaagggggaaccgagccctaataagggcgatccagcccaggggccctcccggaaccccctccccaaatttagatcatcttggctgggaaagggaatcggagggacttttttctgcttactctctagccagtgttttccccccggaaagaag

SEQ ID NO: 3700 - DNA, 520 bp, Taraxacum officinale
gttggcgaaccctagaagcctattgttgcctcttctccgaagcttgcaaccatggttaacgtaccaaaaacaaagaagacttactgcaagaataaagattgcagaaagcacacactgcacaaggtgactcaatacaagaagggaaaagatagcttggctgcccaaggaaaacgtcgttatgacagaaaacaatctggttatggtggtcaaaccaaacccgtctttcacaaaaaggcaaaaaccaccaagaagattgtcctaaggttgcaatgccaaggttgcaagcatgtctctcagcacccaattaagagatgcaagcattttgagattggaggagacaagaagggcaagggaacttcccttttctaagtggtttcaattatgcagtgtttttggcagactttttaatgtgacatttttccaggtttacaatgcaattatgtatcaacttctcacagatttgggttgtgttattttattaacttggtactgtttaaagtaatgaaattttgggttttag

SEQ ID NO: 3701 - DNA, 569 bp, Taraxacum officinale
gtggcgaaccctagaagcatattgttgcctcttctccgaagcttgcaaccatggttaacgtaccaaaaacgaagaagacttactgcaagaataaagattgcagaaagcacacattgcacaaggtgactcaatacaagaagggaaaagatagcttggctgcccaaggaaaacgtcgttatgacagaaaacaatctggttatggtggtcagaccaaacccgtctttcacaaaaaggcaaaaaccaccaagaagattgtcctaaggctgcaatgccaaggttgcaagcatgtctctcagcacccgatcaagaggtgcaagcattttgagattggtggagacaagaagggcaagggaacttctcttttctaagtggtttcaattatgcagtgtttttggcagatcttttaatgttattttctccaggtttacaatgcaattatgtatcaacttctcacagatttgggctgtgtccttttcttaatttggtactgtttaaagtaatgaaattttgggttttagtcacttctaaaactgttatatggatcttaaatattttttttttgttactaa

SEQ ID NO: 3702 - DNA, 532 bp, Taraxacum officinale
aagcctcgaagaaccctaatagcattgtgcggctgtccttcccatctttctcccgttcgtcttttaggagctctccagccatggttaacgttccaaagacaaagaagacttactgcaagaataaagattgcagaaagcatactttgcacaaggtgacacagtacaagaagggtaaagacagcttggctgcacaaggaaaacgccgttatgacaggaagcaatctggttatggtggacagacaaagcctgtctttcacaagaaggctaaaaccacaaagaagattgtgctaaggttgcagtgccaaggttgcaagcatgtctcacagcacccaattaagaggtgcaagcattttgaaattggtggcgacaagaagggcaagggaacttctcttttctgagcaatttttaaatgtatttttagtttcagatatttttatttttattgttttgatttaaagttggttttcagttttacaatctatgcgacttttttgctattgagatacatggctagacatgaaagttaattgtc

SEQ ID NO: 3703 - DNA, 549 bp, Distylium racemosum
ggggagggagaggagtaggagctttagcggcgtagcagtagcagcgatggtgaatgttccaaagacaaagaaaactttttgcaaaaacaaagcatgcaaaaagcacactttgcacaaggttacacagtataagaaaggcaaggacagtcttgctgttcaaggtaaaaggcgttatgatcgaaaacaatcaggttatggaggacaaacgaagcctgtgtttcacaagaaggcaaagaccacaaagaagattgtgttgaggctgcaatgccagtcttgcaaacatgtctcacagcatccaatcaagcgttgcaaacacttcgagattggtggggacaaaaagggcaagggaacatctcttttttaaacatccggttatgttttggctttgttaaattttttacacttgtacctatgaaggtctatttaagccaagtgttttgttgtcagagttgatgctacatggaagatatctgttggggatgttactaaaaattgcccttgttactaaaaattgtccttgatttcatgtttctgatactgagagaggag

SEQ ID NO: 3704 - DNA, 661 bp, Eucalyptus grandis
cgtcttcttctctcgatagctagggttttctgccgcgcagctcgagcaacggagagggagagagacagagaccagtcatcatggtgaacgttcctaagacgaaaaagacatactgcaagagcaaggagtgcaggaagcacaccttgcataaggttacccaatacaagaaggggaaggacagcctcgctgcccagggcaagcggcgttatgatcgcaaacaatcagggtatggtggccagaccaagcccgtgttccacaagaaggcaaaaaccaccaagaagattgtgctgaggcttcaatgccagggttgcaagcacgtctcgcagcaccctatcaagaggtgcaagcattttgagatcggtggagacaagaaagggaagggaacatctctgttctaggtcattagagtttttaagctgcttagctattcctttgtgttggattatgttgttccaccttacttttgttatgtatttcatggaaaagacgccgaagtgttacaaattacccatgatattccatcggtgttacgtcttttgagtttgataaaatcttcaggctcttttatttaccgtgctgagtcattcgacaaaatagtgttactctggttcataggaacattacctgtgtgtttgcttgagtgaaataatttttttagcaa

SEQ ID NO: 3705 - DNA, 824 bp, Eucalyptus grandis
gccggggataaatcggaaaatcagaaaccctagacgccttccctcagcacgagagatttcgctgcttcagttggccagagcagagcagaagcggcggcaacaatggtgaacgttccaaagacaaagaagacatattgcaagagcaaggaatgcagaaagcacaccctgcacaaggtgacacagtacaagaagggaaaggatagccttgctgcccagggaaagaggcgttatgacaggaagcagtcgggttatggtggtcagaccaagcctgtcttccacaaaaaggccaaaactaccaagaagattgtgttgaggcttcagtgccagggttgcaagcatgtttctcagcaccccatcaagagatgcaagcatttcgagattggtggagataagaagggcaagggcacttcacttttctagatgatttctctagtcttctggttctctggatctttcaaagaccttttagcatctgaatttttgtattttttcttcctttttggccttccaagatgatgttactggttatctgaatttgcgagatgatttatgtgatagtgattaattttgactgggatatcttttcaaagacttcgaccccaataggcatgatctgtttctatggggatgttgtagcagtttgagtggcgtagatgagactcgcaggaatcatttcacgtttggaaagtataggctatataatagagacactgcaggcatcggttgtggtttgtgaaaatctagatcttgagactaagcacgagagctgaccaactttatgttgaatgaaattgaagctacgtttcattatggaacgaagcatt

SEQ ID NO: 3706 - DNA, 671 bp, Euonymus alatus
ggagctcggtttcgtaagtcggctcccgataacctccagtcctccacaatccacatagggtttcataccaagaaccctagccctaaaacgaaacttgatataaaagctcttttatttgcggagtggccatcgttcgttcgccttctttaggtttctctgttcgtggcgaaaacagagccgtccaccatggtgaacgttccaaagactaagaagacctactgcaagagtaaggagtgcaggaagcacaccctacataaagtcactcagtataagaaggggaaggatagtcttgctgctcaagggaagcgccggtatgatcgcaaacaatcagggtatggaggacagaccaaaccagtcttccataagaaggcaaagacaactaagaagattgtgctgaggttgcagtgccagggttgcaagcatgtttcccagcacccaatcaagaggtgcaagcactttgagatcggtggggacaagaagggaaaagggacttctcttttctaagtgacgccttgtttgtcttaattttgtaatctctcgcgttttctttatgttagagctcaaatgccatttttggcttgaacccaagtggattggtttatcggtatatctagttgtgatgtttctgttatttgagattgctggtttatgtaaggtactctctatgtcta

SEQ ID NO: 3707 - DNA, 571 bp, Euonymus alatus
gatataaaagctcttttatttgcggataggccatcgttcgttcgcctcctttaggtttatctgttcgtggcgaaaacagagccgtccaccatggtgaacgttccaaagactaagaagacctactgcaagagtaaggagtgcaggaagcacaccctacataaagtcactcagtataagaaggggaaggatagtcttgctgctcaagggaagcgtcggtatgatcgcaaacaatcagggtatggaggacagaccaaaccagtcttccataagaaggcaaagacaactaagaagattgtgttgaggttgcagtgccagggttgcaagcatgtttcccagcacccaatcaagaggtgcaagcactttgagatcggtggggacaagaagggaaaagggacttctcttttctaagtgatgccttgtttgtcttaattttgtaatctctcgcgttttctttatgttagagctcaaatgccatttttggcttgaacccaagtggattggtttatcagtatatctagttgtgatgtttctgttatttgagattgctggtttatataaggtaccctctatg

SEQ ID NO: 3708 - DNA, 604 bp, Euonymus alatus
catacaggtctcctggcgcagcagagctctcaaccatggtgaacgttccaaagaccaagaagacctactgcaagagcaaggagtgcaggaagcacaccctccataaggtcacacagtataagaaggggaaggatagtcttgcagctcaaggtaagcgccgttatgatcgcaaacaatcggggtatggagggcagaccaaaccggtcttccacaagaaggctaaaacaactaagaagattgtgctgaggttgcaatgccagggttgcaagcatgtttcccagcacccaatcaagaggtgcaagcactttgagattggtggggacaagaagggaaaggggacttctcttttctaagtgattgtcttgtttgtcttaattttgttctctcgcattttcttcatgttaaaactcaaatgccatttttggcttgcaaatgctagtggattgatttattagtatatctagttgtaatgtttccgactttctgttatttgacgttgctgatcttatatgaggcactctttatggaatttgtatcagttagtcctggttcttggttaatacttttgattttttgttctagtttacttatttaagatgttgag

SEQ ID NO: 3709 - DNA, 702 bp, Euonymus alatus
cacgtatacaaagcctgcaaattactgggttgggacttgggagagttgggacaattcatgctgtcactctgtcaggctcattgttacgattggatttgataaattgattcaggttgcggatcgagttgattccgtgtccaatcaacaggaagccctaaccctagcaataaggcaaaagtgtaggcgccgcgagttttcttttctggtgtggcttaaggtaccgagtgagttctcctgtccggcaaaacctccaatcatggtgaacgttccaaagacaaagaagacgtactgcaagagcaaggagtgtaggaaacacaccttgcataaagtgacacaatacaagaaagggaaagacagccttgctgctcaaggaaagcgccgatatgaccgtaaacaatcaggttatggagggcagaccaaaccagttttccacaagaaggcaaaaactacgaagaagattgtcctaaggctgcaatgccaaggttgcaagcatgtgtctcagcacccaatcaaaagatgtaagcactttgagattggtggagataagaagggaaagggaacgtcacttttctaaatgttttccatggtatttttctttttatatgtgtttcctttttcgtattttgttggaactcggggacaaaggcgcttatgacagccattttgtgtaagcttttcaagtcatttgttaatcggtcattt

SEQ ID NO: 3710 - DNA, 725 bp, Euonymus alatus
gcccactccatcccaattggtaaaagcacgtatacaaagcctgcaaattactgggttgggacttgggagagttgggacaattcatgctgtcactctgtcaggctcatggtcccctttcattcctacgattggatttgataaattgattcagcttgcggatcaagttgattccgtgtccaatcaacaggaagccctaaccctagcaataaggcaaaagtgtaggcgccgcgagtttacttttctgctgtggcttaaggtaccgagtgagctctcctgtccggcaaaacctccaatcatggtgaacgttccaaagacaaagaagacgtactgcaagagcaaggagtgtaggaaacacaccttgcataaagtgacgcaatacaagaaagggaaagacagccttgctgctcaaggaaagcgccgatatgaccgtaaacaatcaggttatggagggcagaccaaaccagttttccacaagaaggcgaaaactacaaagaagattgtcctaaggctgcaatgccaaggttgcaagcatgtgtctcagcacccaatcaaaaggtgtaagcactttgagattggtggagataagaagggaaagggaacgtcacttttctaaatgttttccatggtattctctttttatatttgtttcctttttcgtattttgttggaactcggggacgaaggcacgtatgacagccattttgtttaagcttttcaagtcattt

SEQ ID NO: 3711 - DNA, 705 bp, Euonymus alatus
cggccggggggttgtacagccatacaggtctcagggcgcagcagagctctcaaccatggtgaacgttccaaagaccaagaagacctactgcaagagcaaggagtgcaggaagcacaccctccataaagtcacacagtataagaaggggaaggatagtcttgcagctcaaggtaagcgccgttatgatcgcaaacaatcagggtatggagggcagaccaaaccagtcttccacaagaaggctaaaacaactaagaagattgtgctgaggttgcaatgccagggttgcaagcatgtttcccagcacccaatcaagaggtgcaagcactttgagattggtggggacaagaagggaaaagggacttctcttttctaagtgattgtcttgtttgtcttgattttgttctctcgcattttctttatgttaaaactcaaatggcatttttggcttgcaaatgcaagtcaaaggtggattgatctatattagtatatctagttgtaatgtttccgactttctgttatttgacgttgctgatcttatatgaggcactctttgtggaattagtatcagttagccctgtttcttggttaacacttttgattttttgttctagtttacttatttaagatgttgagatggtttggttgattaggtatgttgaatatggatatttttgttggaagaagaaagatgcatcatttttgtac

SEQ ID NO: 3712 - DNA, 523 bp, Euphorbia peplus
caggcctcgtccacgtccggccgtcatggtgaacgttcccaagacaaagaagacttattgcaagagcaaggagtgcagaaagcacaccttgcacaaggttacacaatataagaagggaaaggatagtcttgctgcacagggtaagcgtcggtacgatcgcaagcaatcaggatatggaggtcagaccaagcctgtgtttcacaagaaggcaaaaactaccaagaagattgtgttgaggctgcaatgccaagggtgcaaacatgtatcccagcacccaatcaagagatgcaagcacttcgaaattggtggagacaagaagggaaagggaacttctcttttctagaccctttgtcagtttttatcttttgtcatttctttttcacaagattatttgttattggagttcttgcaccattactctgtgttcagcaattagttctacgtgctgtaatgatactgtttagctgaaactctcatgtcttaattattgaattgccaaaattttgatgctctttgtttgatt

SEQ ID NO: 3713 - DNA, 479 bp, Fraxinus spp
aaataaataaataaataacagcagcaatttagggtttacaggcggcgttttgcatcctctctcttacctacggcacgatggtgaatgttccaaaaaccaagaagacttactgcaaatcaaaggagtgcagaaagcacacgttgcataaggttacccaatataagaagggaaaagatagcttagctgctcaggggaagcgtaggtacgaccgcaagcaatctggttatggtggacagaccaagcctgtcttccacaagaaggcaaaaacgactaagaagattgtgctgaggctgcaatgccagggctgcaagcacatgtctcagcatccaatcaagaggtgcaagcattttgagatcggtggagataagaagggaaaaggaacttctctattctaagcaccttcctattgtggaacttgaaatctctctttttaccatttttatcatttgtgttgacttgaggttttattcttgttttaa

SEQ ID NO: 3714 - DNA, 449 bp, Gerbera hybrid cultivar
ggttcccatctatccttgctcagttcggttcttcggagatcttcagccatggttaacgttccaaagactaagaagacctattgcaagaacaaggattgccgaaagcacacgttgcataaggtgacacagtacaagaagggaaaggacagcttggctgcacaggggaagcgccgttatgatagaaaacaatcgggttatggtggacaaactaagcccgttttccacaagaaggcaaaaaccacaaagaagatcgtgctgaggttgcaatgccagggttgcaaacacgtgtcccagcacccaattaagaggtgcaaacattttgagattggtggagacaagaagggcaagggcacctcacttttctgacctattattatgttgtcatgtcttattattctaatacatttttattattatgttctagtttgttttggcagacatttgacgtg

SEQ ID NO: 3715 - DNA, 703 bp, Gnetum gnemon
cactttcagaggcggagcacgggacgatcgatcgaatcagagacccttacctgccttcaaaatggtgaatgtaccgaaaacgaagaagacattctgcaagaacaaggcttgtagaaagcatactctgcacaaggtgacacaatacaagaagggcaaggacagtcttgctgtgcaggggaaaagacgttatgaccggaagcagtctggttatggaggtcagacaaagccagtatttcataaaaaggccaaaacaacaaagaaaattgtgctgaagctgcagtgccaatcctgcaaacatgtctctcaacatccaattaagcgctgcaaacatttcgaaattggtggagacaagaaagggaaaggaacttcactgttttaagtttatttggtgtgaacagaaacatccgtcatttttgcttgttataattaacaccgaggaagttataagattttgtccttagggattgaaatttcaccaattctctggtgtgaaacatgtaagatttaattaggatccatttgtactgttttaactttgtttaaattgcttagccaaaagtcgcctcggcattatgattagcttgctttaactgagataagattttaattcatgaatctttagcaagttttttgaaaaaaaaaagaaaaacattcattagtatgtctcgagcttcatccaccttagatcgctctgacctatctg

SEQ ID NO: 3716 - DNA, 683 bp, Vitis vinifera
atgccaaaggaaattttgagactaggaactctactgataaagccatgccacaactcacaaggtttgcgaagaactgaaggagagaaccctagcacatcatcatggtgaatgttccaaagacaaagaagacatattgtaagagcaaggagtgcaggaagcacacattgcacaaggtgacacagtacaagaagggtaaagatagcttagctgcccaaggaaagcgcaggtacgaccgcaaacaatcaggttatggaggacagacaaaacccgtcttccacaagaaggccaagacaaccaagaagattgtgctgaggcttcaatgccagggttgcaaacatgtatcgcaacacccaatcaagaggtgcaagcattttgagattggaggggataagaagggaaagggcacttctctattttagatggattattcatggtcttttttgctatactatcttccttttagacccttccttttatgtttgttctacttttttgtactttgattattgtgttccattcccaaatttctgaatatgattaatttgttggatgttctgtgatgcttgaagtatgtttaatttcaagattgagtacatgtagggttagggacttgttttcttgaatttcattccaagattaagatgcaatatagatgtcatggcatggatgatattggatagctg

SEQ ID NO: 3717 - DNA, 874 bp, Vitis vinifera
attaagaaggcggcaggggagtcgaactagaggataggagcggagatcgcaaaaccctaaccctagcccggaggttcctgcaggcggcaacagagaggagctctcagaaaaaaaaaaaaaaaaaaaaccccaatttttcccgggaattttcggtcaccatggtaaatgttccaaagaccaagaagacttactgcaaaagcaaagaatgcagaaaacacaccttgcacaaggtgacacagtacaagaaaggaaaagatagccttgcagcccaggggaaacgccggtatgatcggaaacagtcaggctatggaggacagaccaaacctgtcttccacaaaaaggcaaaaaccaccaagaagatagtactgaggttgcaatgccagggctgcaaacacgtatcccagcatccaatcaagaggtgcaagcactttgagatcggtggcgataagaaggggaagggcacttctctattttagattgcaaaaccaggcaattgcagggtccatcttccatttttgttatgcttttgagcttttctatttgttttcagcaagaaatacaaacaaactttgatttatagatttttgtagttttatgctgccatcaaatttgtctgattaggattcgtcttatcaaagagtgatctagcttgaacttatcctgaagattaggtgggtttccaactggagagttgttgggagcctttccattattagttggttttacatttgctgcaaatcccatataattggtaattcttgtatggcgttttgtaagatcaatggatgaaatgtatccattccattggtggggtaaatggaatccacattggaatgaaagagatttgatgtcatgatccaaggtttccctctaa

SEQ ID NO: 3718 - DNA, 1281 bp, Vitis vinifera
cgcagactataaaagcaagagaagcagctgtttttagggtttgtgcttcgtctacctccagctctctttctctcttcatccgcctaagccgccgaaaatggtgaacgttccaaagacaaagaagacgtactgtaagagcaaggagtgtaggaagcacaccttgcacaaggtgacacaatacaagaagggcaaggatagcttagccgcacaagggaagcggaggtatgatcgcaaacagtcaggttatggaggacagaccaaacccgtcttccacaaaaaggctaagaccaccaagaagattgttctgaggctccagtgccagggttgcaaacacgtatcccagcacccaatcaagaggtgcaagcattttgagattggaggggacaagaaggggaagggaacttctctcttttaggaggcaaacttggtcattttcgtcttgctatattatgttgcttaaatttttctccttgtttgagctggaatgcaactattatgatactccatacactttgtagttcaatgccaggaattttgatgtttgaagtttggttttaaattttggactttctccatccctactcagaaaactgcggttttctcttaagtatagttgtcttttcaccatagagggcaggtggttgagctctcaatgtcggaagctggtggaactctttcctccattgtttttgacacggcattcagagtggaagacccttgcagaataacaatggtattctcttccattcttagttctcttttaactcacctgaattctcctttgatcacagtgactgtgtgatgaatgaccatggtagagagagttgaaaaggtagtacaatattacttagtaaaaagtagtcactttctgtttggttgcaaggaaaatccaaacaaaaattttctagtcccttgtttggttaacaaaaaaaaacacatttggagatatatccatcattagtaaaagttcatattttttattcacaaaccctaaatgatggacggtatatgtgtgtgtatatatatttaacaaagaagttggaaaaagaggtcagagcaatacctcaagcaaagaggtcgatctaagcaaaacaagaaatgcttagaaatgtggagcatgattttggaaaatttgaattgagtgcacaccatagggttgaaaataacaagcaaaaaaaaaaaaaaaacgagaaatcgagattatgttaaaaaaatgggaggaaagtggaattcgtggaagtttcaagcacattttaaatttggtctaaaactagcgtggac

SEQ ID NO: 3719 - DNA, 499 bp, Hevea brasiliensis
gataatggtgaacgttcctaagacaaagaaaacatactgtaagagcaaggagtgccgaaagcacactttgcataaggtcacacaatacaagaagggcaaggatagccttgctgcacaagggaaaaggcgttatgatcgcaagcagtcaggttatggaggtcagacaaagcctgtttttcacaagaaggccaaaactactaagaagattgttctgaggctgcaatgtcaaggctgcaagcatgtgtctcagcatccaattaagagatgcaagcattttgagattggtggagacaagaaggggaagggaacttctcttttctaaatgctattttatgggtatgcttttggttgtgtttcactgttaagacttaagacctttgctggaactggagcaaatctagagtttttgtttactttgttgatttcttatgttgccatttctagacatctactgctagtttacaattttaattgacttaatagcaatctttttctcgtc

SEQ ID NO: 3720 - DNA, 475 bp, Jatropha curcas
gttcagcacaaatggtgaatgttccaaagacaaagaagacatactgcaagagcaaggagtgcaggaagcacaccttgcataaggttacccagtacaagaaaggaaaggatagtcttgctgcacaagggaaaaggcgctatgatcgcaaacagtctgggtatggaggccagactaagcctgttttccacaagaaggccaaaactaccaagaaaattgttttgaggttgcaatgtcaaggttgcaagcacgtgtctcagcatccaattaagaggtgcaaacattttgagattggtggagacaagaaggggaagggaacttcacttttctaaattctatttttatgtatgtgttttggatgtacttagtgttgaagcaaatctagaagttttgttcacttcattgttgatttcttttctgtcatttccagacatctactacttattttatatggttttagacaattaatagtaattgg

SEQ ID NO: 3721 - DNA, 651 bp, Lactuca sativa
cggcggggatagcattttgcggctgtcattccaatctttctcccgttcgtctttcaggagctcttcagccatggttaacgttccaaagacaaagaagacatactgcaagaataaagattgcagaaagcatacattgcataaggtgacacagtacaagaaggggaaagatagcttggctgctcaaggaaaacgtcgttatgacaggaagcaatctggttatggtggtcaaacaaagcctgtctttcacaagaaggcaaaaaccacaaagaagattgtgctaaggttgcaatgccaaggttgcaagcatgtctcacagcacccaattaagaggtgcaagcattttgaaattggtggagacaagaagggcaagggaacttctcttttctgagctgttattaaatgtagttttagtttcagctatttatattattgttttggtttaaagttgttgaaattctacaatttaagtgacttttctttttttttggttttgagatacttggcttgaattgaaagttagtcttctttttgagtgtcaacttgcatgtggtctgtttcatttttagatacatgttatgttaatttctttagaataagtttcaaattgtcttaagattattgtatgtcatgagggttttgtttgattaaaat

SEQ ID NO: 3722 - DNA, 481 bp, Lactuca sativa
ttatcgcctcttcagagaaactcgtccaccatggttaacgttcctaaaacaaagaagacttactgcaagtcaaaggattgcaagaagcacaccttacataaggtaacacaatataagaagggaaaagatagtttggctgctcaaggaaaacgtcgttatgatagaaaacagtctggttatggtggtcaaaccaagcccgtttttcacaaaaaggcaaaaaccaccaagaaaattgtcctaaggctgcaatgccaaggttgcaagcatgtctcacagcacccaattaagaggtgcaaacattttgagattggtggtgacaaaaagggaaagggaacttccctattttaaacggttatgcaatatttttggcagacttttcaatgttatcttttttcttgtttacaatgcaaaaatgtaatgacttcacagattttggattgtattttcatttattcaccttggactattgtttaaagtaatg

SEQ ID NO: 3723 - DNA, 746 bp, Pinus pinaster
caaaaccctagaatacacatttttattcgtataaaaaccttaccggctcctattagtctttcattgagcggcgagtaacgaaagcacagaggacgacgacgagattactaacgggtctgcatctgcatctgcatcgtagcaatggtcaatgttccaaagaccaagaaaactttttgcaagaacaaagcttgcaaaaagcacactgtgcacaaggttactcagtataagaaagggaaggacagtctttctgctcaagggaaacgacggtatgatcgaaaacaatcaggttatggaggccagacaaaacctgtgtttcacaagaaggcaaaaacaacaaagaagattgtgttgaagctgcaatgtcagtcttgcaagcattattctcaacatgcaatcaagcgttgcaaacattttgagattggtggagacaagaagggaaggaacctccttttttaaacttcagctttgttgcagctttatatccatcattttacattcttgtttgcatgtctgtccaaggacagaaattttgttgtgttgtttattagtagatagagtcaaccaaccgaagatgccaatctaaattttgcctgtcttaatgtctcttgcacttaatttaaagaacaaatccttggattcaaatcttgcttggttatgttctctggttactttatgttaaaactattttttggtccctgaatgtgcaagttttcacatagttgataatgacaatgatggctattgcg

SEQ ID NO: 3724 - DNA, 563 bp, Cucumis melo
ttcgccgattagggtttcttcagagaagttgtgaggaccagaatccaccatggtgaacgttcccaagacaaagaagacttactgcaagagcaaggaatgtagaaagcataccttgcacaaggttacccaatacaaaaagggtaaggacagtcttgctgctcaaggaaagcgtcgttatgatcgtaaacaatcaggatatggtggacaaaccaagcctgtctttcacaagaaggctaaaactacaaaaaagattgtgctaaggttgcaatgccagggttgcaagcatgtctcacagcatcccattaagagatgcaagcattttgagattggtggagacaagaagggaaagggaacttctctgttttagatgcattaacattgtcattcactatatattgctgctgtttagggagtcagaattgtgggcttgttctgccctttgcttttttgttttggtgtttctgatatttgggaacatttttacttgttgaattttgtttaatgtatcagtttataatggaacgactagcctatcttcttcccaatttcatataacggtttgt

SEQ ID NO: 3725 - DNA, 676 bp, Cucumis melo
gagcaggcctcgtcgacgtccagccgtcatggtgaacgttcccaagaccaagaagacttattgcaagagcaaggagtgcaggaagcataccttgcacaaggttacacaatataagaagggaaaggatagtcttgctgcacagggaaagcgtaggtacgatcgcaagcaatcaggatatggaggtcagaccaagcccgtgtttcacaagaaggcaaaaacgaccaagaagattgtgttgaggcttcagtgccaaggttgcaaacacgtatcccagcaccctatcaagagatgcaagcacttcgaaatcggtggagacaagaaggggaagggaacttctcttttctagaccctttgatcgtttttttatcttttgtcacaagattatttgttattggagttgttggagaattgctttgttttggttcagcaattagatctacatgtcgcaacgatactttttagctgaaactttcttgtcttaattattgaattcccaaaattttgatgctctttgattgatttatctgagtcttctcttgtaaatttgtttggccgctgaatctgattggtcggtgcctctcaagttaatttgatatattgttgttagatttgtgacaaactttgtatcttctaactatcattgataacacacagttgaagggaaattatcttttta

SEQ ID NO: 3726 - DNA, 526 bp, Momordica charantia
ggccccatcaattagggttttctgggcaggcctcgtcgacgtttcgcagtcatggtgaacgttcccaagacgaagaagacttattgcaagagcaaggagtgcaggaagcacaccttgcacaaggttacacagtataagaaaggaaaggatagtcttgctgcacaaggaaagcgtcggtacgatcgtaagcagtcaggatatggaggtcagaccaagcctgtgtttcacaagaaggcaaaaactaccaagaagattgtgttaaggttgcaatgccaaggttgcaaacacgtctcccagcaccctatcaagagatgcaagcactttgaaattggaggagacaagaagggcaagggaacttctcttttctagatccattgcagttctttgtcttttgttgtctcttttttcacaagatcatttgttattgggagtttagcagcattactctgttttgttcagctttttgttgttccacatgttagctgaaattatctatgttatcgaattttaaaatcgatgctcttct

SEQ ID NO: 3727 - DNA, 544 bp, Momordica charantia
tatctaacgtctagtagttgtacctatttacggtccggggtaagtttagggttttcttcagagaagcaatacgcaccagaagcagccgccatggtgaacgttcctaagacaaagaagacttactgcaagagcaaggagtgcagaaagcacaccttgcacaaggttacccagtacaaaaagggtaaggacagtcttgccgctcagggtaagcgtcgttacgatcgtaaacaatcaggatatggaggacagaccaagcctgtctttcataagaaggccaaaaccacaaagaagattgtgctaaggttgcaatgccagggttgcaagcatgtgtctcaacatcctattaagagatgcaagcactttgaaattggtggagacaagaaagggaagggaacttctcttttttaggttgctctaacattatccttcactatatatttgatttgcattcatgcattttagggattcaaaattgcgggcttcttttgccctttgctttttgtctggtttttctgacatttgtgaacttttacatgttcttgag

SEQ ID NO: 3728 - DNA, 624 bp, Nuphar advena
  misc_feature (273)..(273): n is a, c, g, or t
  misc_feature (479)..(479): n is a, c, g, or t
  misc_feature (512)..(513): n is a, c, g, or t
  misc_feature (539)..(539): n is a, c, g, or t
  misc_feature (577)..(578): n is a, c, g, or t
  misc_feature (585)..(585): n is a, c, g, or t
ctgtgttcgcctcacccgccgccatggtgaacgtcccaaaaactaagaaaacttattgcaagagcaaggaatgcaggaagcataccttgcataaagttactcagtacaagaagggcaaggatagtttggctgttcaagggaagcgacggtatgatcggaagcagtctggatatggtggccaaaccaaacctgtatttcacaagaaggccaaaacaacaaagaaaatcgtgttgaggttgcaatgccaaagctgcaagcatgtatcacagcatncaattaagcgctgcaagcactttgaaattggtggagataagaagggaaaaggaacctctctcttctagttggattgtttgctttagattgaagataggcattgtcctggacattgtggttctggtcaatgatgggagtaggacttagaattatcatggttacgtaggactttaatcctgtgttaattgtttttgacgcaagtagcnaagaaaagcatttcacaggcttttctttttttnntcgacctcatgaactaacatagtggnatgcccacttatgtgaatttttgttcactatgattttnnttatcanattttttttttctggagcagataaggctggatattgaaa

SEQ ID NO: 3729 - DNA, 641 bp, Nuphar advena
  misc_feature (43)..(44): n is a, c, g, or t
atcaagttgaccacacatcacattttaaggccacttctaatcnnttttaatgtaacagtcaaacatggtgaacgtcccaaaaactaagaaaacatattgcaagagcaaggaatgcaggaagcataccttgcataaagttactcagtacaaaaagggcaaggatagtttggctgttcaaggtaagagacgttatgatcggaagcagtctggatatggtggccaaaccaaacctgtattccacaagaaggccaaaacaacaaagaaaatcgtgttgaggttgcaatgccaaagctgcaagcatgtatcacagcatccaattaagcgctgcaagcactttgaaattggtggagataagaaaggaaaaggaacctctctcttctagttggattgtttgctttagattgaagatgggcattgccctggacattgtggttgtggtcaatgatcggaggacttagaagtatcatcatggttatgtaggatttcaagcatgtgttaattgttttgggcgcaagtatcaaagaaaagcatttcaggggcttttcttttttgggacctcgtgaactaaaacttgatggaatgccaacttatatgaacttttgttcactttgattttatttatcatattttcttttctagcc

SEQ ID NO: 3730 - DNA, 865 bp, Quercus alba
aaagcccaaaccctaacaagccccgagccgtaaccctataaaagactaaactaaatatcaatgcgctagggtttttcctataccaacaaacacacgcctggttcgctcgcttgctctgattctcatcaccatggtgaacgttcctaagacaaagaagacctactgcaagagcaaggagtgcaaaaagcacaccttgcataaggtcacacagtacaagaagggaaaggatagccttgctgttcagggaaaacggcgttatgatcgcaagcaatcaggttatggagggcaaacaaagcctgttttccacaagaaggctaagacaaccaaaaagatcgtgctaaggctacagtgccagggctgcaaacatgtttcacagcaccccattaagaggtgcaagcactttgaaataggaggagacaaaaaggggaagggaacttctcttttctaaatgattgttctgttctattattatgttgcttactttcagttatgttggagcctgaagacaaatatgggatagttatttgctggcctaggaaaacattggagtgaattttgatatattttatttcataagtttgatattggagtttgaattaatgattatctgtgcaaatgaaactgcttgtgattgatcttgttctcttgggtcagacgtatttaatttgatgactaggcgtgagtttggtctttggacaagtctcgatgtttggacaagtctcgatgtctgtcccaggatatgataattttgatctataactaaaacatccagagcctgctgctggagctggttgtgtggtaacttgtgttgtggtgccaccattatcaatgggtgaaagaactagctcgagtatatttatatttt

SEQ ID NO: 3731 - DNA, 481 bp, Olea europaea
gacagcatttgcagaaccgagcatcaagccactcgatttccggctatctgtgccattaaccatggtgaacgttccaaagacaaagaagacctactgcaaatccaaggagtgcagaaagcacaccttgcataaggttacgcaatacaagaagggaaaagacagcttagctgctcagggcaaacgtcgatatgatcgcaagcagtcaggttatggtggacagaccaagcctgtcttccacaagaaggcaaaaacaacaaagaagattgtgctgagattgcaatgtcagggctgcaagcatgtatcccagcatccaattaagaggtgcaagcattttgaaattggtggagacaagaaaggaaagggaacctctcttttctaggcgtgctttcatggaaactgaaatgcctttcatacgtttcgttattgtcaactttacgtctagcagactgtttttacgtaaaataattagtctgaaaattta

SEQ ID NO: 3732 - DNA, 941 bp, Lippia dulcis
gcgccacttgcagaaaccgaatcacactttccagagctcctctctccgccctcagccatggtgaacgttccaaaaactaagaagacttactgcaagtcaaaggaatgcaagaagcacaccttgcacaaggtcacccagtacaagaaggggaaggatagcttagctgttcaggggaagcgtcgttacgaccgcaagcagtcaggttatggtggtcagaccaagcctgtcttccacaagaaggctaaaaccacgaagaagattgtgctgaggttgcagtgccagggttgcaaacatgtttcccagcacccaatcaagaggtgcaagcactttgaaattggtggagataagaagggcaaaggaacatcacttttctaagcttatcgatttggaaagattcttgttcttactgtgttgttctgtcgttattttcgtcttagcattttacttcagattaaatatgaaacatggttctgagtttttgtttgcaacttgtggatcaagtatctcagttctgtttactacttacaagctatgcgttaaatcgagttctgttattgtgttggctttgagtcttttacttgtttcgattttcttttgtcattctaagctcggtttttggttgaatatttttgtacgctcgtctatttaattaagttatatttcgtgctttacatcgatagtattatgttcaatgttgtactaatatgcaaggtatatttggagaagagtgccaaactagttcatataatttgagtccttgatagtatatgattgcattgaagtttgaactctatatatttgaaatatttattcacagtcgaaatgagtactttttctaagtcttgaatggtttcaatatgtaaaaggaatcacctttagtaagtaaagaacgtaaatatttgtagtcttgtatggtttcaacatgtagtatgtcaaatact

SEQ ID NO: 3733 - DNA, 626 bp, Plantago ovata
agtccacagaccgacatcttcaaaaccccttatctggttataaagtgccgtctcttccattctgctagggtttcaaacgccattttgaagatctgtccgatccacttgccgagctcccttttgcgccgtcaaaatggttaacgttccaaaaactaagaagactttctgcaagtccaaggagtgcaaaaagcacactttgcataaggtgacacaatacaagaagggtaaagacagtttggctgcacaagggaagcgtcgttatgacaggaagcagtctggttatggtggtcagaccaagcctgtcttccacaagaaggcaaaaaccacaaagaaaattgtgttgaggctgcagtgccaggggtgcaagcatgtatctcagcatcctattaagcgatgcaagcacttcgagatcggtggtgacaaaaagggcaagggaacatcactcttttaagtttgttagaagtttggtcctgtggatctcttgtttgtttaagcaagatattaaacactattttgtatttgcaatttagttgcatcactcttgttaattagtggtatcatcagacctaaagtttcagtgctatttccccaattcttatggatgacaaattttgattctcaatttc

SEQ ID NO: 3734 - DNA, 559 bp, Plantago ovata
gctagggttccaattccaaacgcttgcagaaaacagtcgcttgaagctcccttttgcaccgtcaaaatggttaacgttccaaaaactaagaagactttttgcaagtcgaaggaatgcaaaaagcacactttgcataaggtgacacaatacaagaaaggtaaggatagtttggctgcacaagggaagcgtcgttatgacaggaagcagtctggttatggtggtcagaccaagcccgtcttccacaagaaggcaaagaccacaaagaaaattgtgttgaggttgcagtgccaggggtgcaagcatgtatctcagcatcctattaagcgatgcaagcatttcgagattggtggtgacaagaagggcaaaggaacatcactcttttaagtgtgtggagtcatttggtattgtggttttgtttgaacaagatgttagacagaatattttgtatttgcaattcagttccattttacatgctcttgttaattggtggtagtatcagaccaaaaatttcagatttagttgtttctcctaccctgattgatgacagattttgttccta

SEQ ID NO: 3735 - DNA, 557 bp, Plantago ovata
gaaactcatctcagcttgcccttccccgctgttgacaatggttaacgttccaaaaacaaagaagactttctgcaagtcaaaggagtgcaagaagcacaccttacataaggtgacacaatacaagaagggcaaagatagcttggctgcccaaggaaaacgtcgttatgaccgtaagcagtcaggttatggtggtcagacgaagcctgtctttcacaagaaggcaaagaccaccaagaagattgtactgaggttgcaatgccagggatgcaagcacgtctctcagcatcccatcaagaggtgcaaacattttgaaattggtggagacaagaaaggcaaaggaacttctctcttctaagccatctgggaatatcatgaagcttttgtgtttgcaacctggtgctggttgctgctatcttcttccaatgttagatgaaagccagacatgttttcaattttgctttataagccatgtaatgacccaactattcaacattaatttacgtcttactgttatggatttggttaccttatcaagttaattttgttatcaatgctca

SEQ ID NO: 3736 - DNA, 556 bp, Plantago ovata
gaaactcatctcagcttgcctttcccgctgttgacaatggttaacgttccaaaaacaaagaagactttctgcaagtcaaaggagtgcaagaagcacaccttacataaggtgacacaatacaagaagggcaaagatagcttggctgcccaaggaaaacgtcgttatgaccgtaagcagtcaggttatggtggtcagacgaagcctgtctttcacaagaaggcaaagaccaccaagaagattgtactgaggttgcaatgccagggatgcaagcacgtctctcagcatcccatcaagaggtgcaaacattttgaaattggtggagacaagaaaggcaaaggaacttctctcttctaagccatctgggaatatcatgaagcttttgtgtttgcaacctggtgctggttgctgctatcttcttccaatgttagatgaaagccagacatgttttcaattttgctttataagccatgtaatgacccaactattcaacattaatttacgtcttactgttatggatttggttaccttatcaagttaattttgttatcaatgctca

SEQ ID NO: 3737 - DNA, 475 bp, Plantago ovata
gaaactcatctcagcttgcccttccccgctgttgacaatggttaacgttccaaaaacaaagaagactttctgcaagtcaaaggagtgcaagaagcacaccttacataaggtgacacaatacaagaagggcaaagatagcttggctgcccaaggaaaacgtcgttatgaccgtaagcagtcaggttatggtggtcagacgaagcctgtctttcacaagaaggcaaagaccaccaagaagattgtactgaggttgcaatgccagggatgcaagcacgtctctcagcatcccatcaagaggtgcaaacattttgaaattggtggagacaagaaaggcaaaggaacttctctcttctaagccatctgggaatatcatgaagcttttgtgtttgcaacctggtgctggttgctgctatcttcttccaatgttagatgaaagccagacattgttttcaattttgctttataagccatgtaa

SEQ ID NO: 3738 - DNA, 685 bp, Platanus occidentalis
ggaaggaaaaagaaagctctcaaaacgctcacccttacctcgttcattcaaagccatggtgaacgttccgaagacaaagaagacgtattgcaagagcaaggagtgccggaagcatactctgcacaaggtcacccagtacaagaagggtaaggatagccttgctgcccaagggaaacgtcgttatgatcgaaaacagtcaggttatggtggacagaccaaacctgtcttccataagaaggcaaaaactaccaagaagattgttctgaggctgcaatgccagggatgcaaacatgtgtcccagcaccccatcaagaggtgcaagcattttgagattggtggggataagaagggcaagggaacttctctcttttagatgtggctttgtcaagccattggaggatcatcattttgttctcgtcttgtttttttgttttgcgcttcttaatctaattagcacttgtctgttgagtgagaaaatagtttagaatctgtttaatgaagttactctttagtcgattgttattctagactttttggtttaaagattgtgtatgctttgacaacatgagacgtatcatgtagtggcaacacgagacggttcgttattaatagggctatcaactctccacctaagcattcttcttcggtttgtatttgccagaatacagttataaatatttgttcc

SEQ ID NO: 3739 - DNA, 656 bp, Primula obconica
tccaaaatagagccctaaatatctctccatttataacatttgttttttccgcccctgcggctttcattgctagctcacagacaggcatcatggtgaacgttccaaaaacaaagaagacttattgcaagtccaaggaatgtcgcaaacacaccttgcacaaggttacccaatacaaaaagggtaaggatagtttggctgcccaaggaaaacgtcgttatgaccgcaaacaatctggttatggcggacagacaaagcctgttttccacaagaaggccaaaactacaaaaaagattgtgttgaggctgcaatgccagggttgcaaacatatgtcccaacacccaatcaagaggtgcaaacattttgaaattgggggagataagaaaggaaaagggacttcgctcttctaattactcttttcgcctcagtgttggttatttttgaactaagtttaccttttggtatcaagatgttcttttggttgtacactcaactttttaattatgttaattatctcgctcttgagagaatttgtttccaattttcgtgcttggtgatttcttcagctcaacgttctacaatcacaaaaaagatttacttacagtaatgtgataaaagtggattgtagaatattttttgttacagtgcggtgcctttct

SEQ ID NO: 3740 - DNA, 465 bp, Raphanus sativus
ggggaggacgacgacggcacgagctttcaccgaagagcgaaaatggtgaacattcccaagactaagaagacttactgcaagaacaaggagtgcaagaagcataccttgcacaaggtcacccagtacaagaagggtaaagacagtcttgctgcccagggtaaacgtcgttatgaccgcaaacaatccggttacggtggtcagaccaaacccgtcttccacaagaaggccaagacaaccaagaagattgtcttgaggctccagtgccaaacctgcaagcatttctctcaacactcgattaagaggtgcaagcacttcgagattggtggagacaagaagggagaaggaacatctctcttttaagttttctcctcttatctgctttctttgtttgttactactctcttgcttcgatactttaatacattttgaatcttccggaaatggttatcaggtttaatttagaca

SEQ ID NO: 3741 - DNA, 484 bp, Raphanus sativus
ggagcggaggacgacgacggcacgagctttcaccgaagagcgaaaatggtgaacattcccaagactaagaagacttactgcaagaacaaggaatgcaagaagcataccttacacaaggtcacccagtacaagaagggtaaagacagtcttgctgcccaaggaaagcgttgttatgaccgcaaacaatccggttacggtggtcagaccaagcccgttttccacaagaaggctaagacaaccaagaagattgtcttgaggctccagtgccaaacatgcaagcatttctcccaacactcgattaagaggtgcaagcacttcgagattggtggagacaagaagggaaaaggaacatctctcttttaagttttctcctcgttatctactttctttttttgtttgttactactcttttgcttcgatacttgaatacattttgaatcttccagaaatggttatcaggtttaatttagacaatattttcgta

SEQ ID NO: 3742 - DNA, 541 bp, Raphanus sativus
  misc_feature (210)..(210): n is a, c, g, or t
  misc_feature (281)..(281): n is a, c, g, or t
  misc_feature (354)..(354): n is a, c, g, or t
  misc_feature (364)..(364): n is a, c, g, or t
  misc_feature (443)..(443): n is a, c, g, or t
ggagacaagcttcaccggagatagatcaggggagcgaaaatggtgaacattccgaagacaaagaagacatactgcaagaacaaggaatgcaagaagcatacattgcacaaggttacccaatacaagaagggtaaagacagtctcgctgctcaagggaagcgtcgttatgaccgtaagcaatccggttacggtggtcagactaagcctgtnttccacaagaaggctaagaccactaagaagattgtcttgaggcttcagtgccaaacctgcaagcacttttntcagcactccatcaagaggtgcaagcattttgagatcggtggagacaagaagggcaagggaacatcacttttntaagctggtntcgtctttacgctttacaagttttgtatttcgttggatctttgatttcatctcttttagctctcatataagattgtttntcatctttgcttgttaactctgtctttgtatcatcaagatgtgtttttcagtttatcagtcactacaatcgaagtgtgtgttttacaatccagtttta

SEQ ID NO: 3743 - DNA, 542 bp, Raphanus sativus
gggacgacgacggcacacaagcttcactcaaggtcagacgagcgaaaatggtgaacattccaaagacaaagaagacatactgcaagaacaaggaatgcaagaagcatacattgcacaaggtgacccaatacaagaaaggtaaagacagtctcgctgctcaaggaaagcgtcgttatgaccgtaagcaatctggttatggtggtcagactaagcctgtcttccacaagaaggctaagaccacgaagaagattgtcttgaggcttcattgccaaacctgcaaacatttttctcagcactcaatcaagaggtgcaagcattttgagatcggtggagacaagaaggggaagggaacatctcttttctaatttggtcttgtcttaactttttgcaaattttgttacttgtgttggatcatgattccttgtgttctagaatcttccattgcccaaattaaaatttcaaattatgcatgtaaaagtgtaatactttgtcagctgttttcttgctctatgatgtcattatttaaacattttttgctgtca

SEQ ID NO: 3744 - DNA, 630 bp, Rhizophora mangle
gcggtgctcttaccaacttcgtcgtcaacaatggtgaacgttccaaagacaaagaagacttattgcaaaagcaaggattgcagaaagcacactttgcacaaggttacacagtacaagaaggggaaggatagccttgctgctcaaggaaagcgtcgttatgatcggaagcaatcaggttatggagggcagacaaagccagttttccacaagaaggcaaaaactaccaagaagattgtgttgaggcttcagtgtcagagctgcaagcatgtttcccaacaccctatcaagagatgcaagcattttgagattggtggagacaagaagggcaagggaacatcactattctaagtgtgtgattgtagttctgtgtttttaactttcatatttcctttttcaaccccatcaactgttattctgtcattatgatttcatttggtttgtcttaagtttcaaggactattctagaacattgtagaaggattatgcagcttatgctttccgtttatgttaagtttttaccaactttatagctctcttgatgtggtggttggtatctcctaaagtcgtagaattcagaattgtatgaaccgttttctaaatgcctcagattgtgaggtgcttccaagtcag

SEQ ID NO: 3745 - DNA, 354 bp, Rhizophora mangle
cgtcgtcgacaatggtgaacgttccaaagacaaagaagacttactgcaaaagtaaggactgcagaaagcacaccttgcacaaggtcacccagtacaaaaaggggaaggatagccttgctgctcaagggaagcgtcgttatgatcgcaagcaatcgggctatggtggacagacaaagccagttttccacaagaaggcaaaaaccactaagaaaattgtgttgagactccagtgccagagctgcaagcatgtgtcccaacaccccatcaagaggtgcaagcactttgagattggtggagacaagaagggcaagggaacatcactattttaaatttgtcattgaagtcatgtgtttc

SEQ ID NO: 3746 - DNA, 723 bp, Sciadopitys verticillata
gggaagagagctgttgctgagcggctagttctgtcacacacaaggcaagggaagggaaggcaaggaggagcgttatctgccaaaatggtgaatgtaccaaagactaagaaaactttctgcaagaataaggcttgcagaaagcacagcttgcacaaagtaacacagtacaagaagggaaaggatagtctttctgcccaaggaaagagacgttatgacaggaaacaatcaggttatggaggtcaaactaagcctgttttccacaaaaaggcaaagacaacaaagaaaattgttctgaggttgcagtgtcagtcgtgcaaacatgtttcccaacatccaatcaagcgctgcaaacactttgaaattggtggagacaagaaaggaaaaggcacatctctcttttaggtgcattcagctgctagtcgatgttgaagtgattctatcagcacaactaacatattctagtgatgttcatgaagtaacatttcaatagtcacgtgttttccatgactaatgtgctttcaaaaatttgactggctgttaagtagttcatcttttagtgaattttggttgctatctttggctgtaatgcttggaagtgtagtaggtcctggatattagtatagttagagctaaccgattttgaactttgctgttgtcaagagaatgtaaaatggaaacaagattgattgaaagaaagtaaaaatggaactatacttaaaattg

SEQ ID NO: 3747 - DNA, 802 bp, Sequoia sempervirens
gttggaaaccctaaaacccttggtgttggctgttagggtaaaggaaggagagaacatctgcgaggagggttctgcgcggaggacagaggcaagcatggtgaacgtaccaaagaccaagaaaactttctgcaagaataaggcttgcaaaaagcacaccttacacaaggtaactcagtacaagaagggaaaggatagtcttgctgtccaaggaaagaggcgttatgacaggaaacaatcaggatacggaggtcaaactaagcctgttttccacaaaaaggctaagaccacgaagaagattgtgctgaggctgcaatgtcaatcatgcaaacatgtttcccaacatccaatcaagcgctgcaaacattttgagattggtggagacaagaaaggaaagggcacttctctattttaggtgcatccagctgctagttaatgttgaaatgattcaatcagcctaactaatatattcaagcgacatgtatgatgcaatttatcaattgtcatgatcaacagtttatttttcattgttaaaatagttaagcttctagaaaattctgatggccaacttttgctgaaaatgctttgtagcatagcaggaaataactcgtgagtttttacagtaaaggaaacctggattgttctttccttggcagattttgaactgtgagctgtgaaatgaaatagaatgtgttagattctgctagattaaatcatttgttcctgtgtctgtttgttgatttctaagacagcttatcacccattgatgattaagcacacgagattatatggaatactttagaat

SEQ ID NO: 3748 - DNA, 736 bp, Sequoia sempervirens
tctgcgaggaggacaaaggcaagcatggtgaacgtaccaaagaccaagaaaactttctgcaagaataaggcttgcaagaagcacaccttacacaaggtaactcagtacaagaagggaaaggatagtcttgctgtccaaggaaagaggcgttatgacaggaaacaatcaggatacggaggtcaaactaagcctgttttccacaaaaaggctaagaccacgaagaagattgtgctgaggctgcagtgtcaatcatgcaaacatgtttcccaacatccaatcaagcgctgcaaacattttgagattggtggagacaagaaaggaaagggcacttctctcttttaggtgcattcagctgctagttaatgttgaaatgattcaatcagcctaactaatatattcaagcgacatgtatgatgcaatttatcaattgtcctgatcaacagtttacttttcatttttaaagtagttaagcttctagaaaattctgatggctaacttttgctgaaaatgctttgtggcatagtaggaaataacttatgagttcttacaataaaggaaccctggattgttctttccttggcagattttgaactgtgagctgtgaaacgaaatagaatgtgttagattctattagattaaattatttgttcctgtgtctgtttgttgatttctaagacagcttatcaccattgatgattaagtatatgagattatatggaatactttagaatgccta

SEQ ID NO: 3749 - DNA, 344 bp, Sesamum indicum
ccatggtgaacgttcctaagacaaagaagacttactgcaaatcaaaggagtggaaaaagcacaccttgcataaggttacacagtacaagaagggaaaagatagcttagctgctcagggaaagcgccgttatgatcggaagcagtcaggttatggtggtcagaccaagcccgtcttccacaagaaggcaaaaacgactaagaaaattgtgttgaggctgcaatgccaaggctgcaaacatgtctcccagcacccaatcaagaggtgcaagcattttgagattggtggagataagaaggggaaaggaacatcacttttctaagtgccccgatacagtaattggaac

SEQ ID NO: 3750 - DNA, 498 bp, Silene vulgaris
ctcgcatttccattgtgagtcactgctactctgctaggtttcctcctcttcatctcccccattctcccgccgctcatcaaaatggtgaatgtaccaaagttgaagaagacctactgcaaaaacaaggaatgcaggaagcacacccagcacaaggtgacccaatacaagaagggtaaggacagtttggcagctcagggaaagaggcgttatgaccgcaagcagtcaggttatggtggtcagaccaagcctgtctttcacaagaaggctaagacaaccaagaaaatcgtgttgaggctacaatgtcagtcatgcaagcatgtttcccaacaccccattaagagatgcaagcactttgagattggtggagacaagaagggcaagggaacttctctcttttaatttcgcagaaagctagtttttggttactgcccccttgtttgtcctagatatttgttcaagtttgaatcatttaatttagttattgtatgatggcaagac

SEQ ID NO: 3751 - DNA, 491 bp, Silene vulgaris
cgattttcgtcaccatggtgaatgttcccaagttgaagaagacatactgtaagaacaaggagtgcaggaagcacacacagcacaaggtgacccaatacaagaagggtaaggacagtttggctgctcaagggaagaggcgttatgaccgtaagcagtcaggatatggtggtcagactaagcctgtcttccacaagaaggctaagacaactaagaagattgtgttgaggctacaatgccagtcatgcaagcatgtttcacaacaccccatcaagagatgcaagcactttgaaattggtggggacaagaagggaaagggtacatctctcttttaattgctcaggaaggttgttcggtttttatttcatgtgtttttatgtccaagatacttgtttcagcttgaacaatttaattgttggatttttgttagtactagctgatctttccgattttggtattcgttcgtaagttcgtatctatgaaatgcgtggctg

SEQ ID NO: 3752 - DNA, 594 bp, Glycine max
aagagcatttaactaaccctaattcgccattgaaccctagacattgtgctttcaccttggctccgctctttggtttgctcaaccgatctccgcagcaatggtgaacgttccgaagacaaagaagacctactgcaagagcaaggagtgcaggaagcacacgctccacaaggtcacccaatacaagaagggcaaggacagcatcgccgctcagggaaaacgccgttatgaccgcaaacagtccggttacggtggccagaccaagcccgttttccacaaaaaggcgaaaaccaccaagaaaattgtgttgaggctccagtgccaaggatgcaagcatgtctcgcagcacgctatcaagaggtgcaagcactttgagatcggtggtgacaagaagggaaaaggaacatctctcttctagatggaatattagaatttgcaatttcacacactctctgtacttttctcagtttgattgccatcttcggcttttaatttttgcagaagtattttgtgtttggggatgttagaatttgcaattttgtttttgtttatgcactgattatagtattaatgactagtttctcttcctttccttga

SEQ ID NO: 3753 - DNA, 656 bp, Glycine max
acaatgagtaattgatattgataaaataaaattggttaaggatctgggccacaaaattcgacccggacaagtatgtaactggaaggcccgacctaatagaaagcgcatttaactagccctaattcgccattgaaccctatactgtgcttccgccttgatctccgcagcaatggtgaacgttccgaagacaaagaagacctactgcaagagcaaggagtgcaggaagcacacgctccacaaggtcacccaatacaagaagggcaaggacagcatcgccgctcagggaaaacgccgttatgaccgcaaacagtccggttacggtggccagactaagcctgttttccacaaaaaggccaaaaccaccaagaaaattgtgttgaggctccagtgtcagggatgcaagcatgtctcgcagcacgctatcaagaggtgcaagcattttgagatcggtggtgacaagaagggaaaaggaacctctctgttctagatggaatattagaatttgccatttcacacactctctctacctctctcagtttttattgtcatcttcggcttttgattttgcagaaatgttttgtgtttgaggatattagaatttgcaatttcgttttgtttaagcactgattatagtattaattactagtttctcttcc

SEQ ID NO: 3754 - DNA, 596 bp, Glycine max
gtccagcccagcctcgtttgcctccgtgtaaccctaattcccaaagccattaaaacgcgttgcttgtctttcattgcctcattttcgcggcgcaaagctgaagtgtctgcttcttccgattccggcacgcccccatcaccatggtgaacgttccgaaaacaaagaagacatactgcaagagtaaggagtgcaggaagcacaccctgcacaaggttacccaatacaagaagggtaaagatagcattgctgcccaaggaaaacgccgttacgatcgcaaacaatctggttatggcggacaaactaagcccgtcttccacaagaaggctaagaccaccaagaagattgttctgaggttgcaatgccagggttgcaagcatgtctcccaacacgctattaagaggtgcaagcactttgagattggtggtgacaagaagggcaagggaacatctctgttctagtttgcgaattaggattcgcagctttttatgtttcagcaatgttggaatcttttagtttctctctggatttttctgcccagttatattttattattttgcaataccctcgtgattgagaaattaaaactatttttgcta

SEQ ID NO: 3755 - DNA, 517 bp, Glycine max
gcctcattttcgcggcgcacagcagaactctgcttcttcggattccgatcgcacgcgccgtcaccatggtgaacgttccgaaaacaaagaagacatactgcaagagtaaggagtgcaggaagcacacgctgcacaaggttacccaatacaagaagggtaaggatagcattgctgcccaaggaaaacgccgttatgatcgcaaacaatccggttatggtggacaaactaagcccgtcttccacaagaaggctaaaaccaccaagaagattgttctgaggttgcaatgccagggttgcaagcatgtctcccaacacgctattaagaggtgcaagcactttgagattggtggtgacaagaagggcaagggaacatcactcttctagtttgagaattaggatttagagctttatgtttcagcaatgttggaatgttttgtttctctctggattttttctgctagttatattttattattttgcaacaccttgttattgagaaattaaaactattttgctca

SEQ ID NO: 3756 - DNA, 534 bp, Euphorbia esula
  misc_feature (8)..(9): n is a, c, g, or t
  misc_feature (11)..(11): n is a, c, g, or t
ggtttctnnancaggcctcgtccacgtccggccgtcatggtgaacgttcccaagacaaagaagacttattgcaagagcaaggagtgcagaaagcacaccttgcacaaggttacacaatataagaagggaaaggatagtcttgctgcacagggtaagcgtcggtacgatcgcaagcaatcaggatatggaggtcagaccaagcctgtgtttcacaagaaggcaaaaactaccaagaagattgtgttgaggctgcaatgccaagggtgcaaacatgtatcccagcacccaatcaagagatgcaagcacttcgaaattggtggagacaagaagggaaagggaacttctcttttctagaccctttgtcagtttttatcttttgtcatttctttttcacaagattatttgttattggagttcttgcaccattactctgtgttcagcaattagttctacgtgctgtaatgatactgtttagctgaaactctcatgtcttaattattgaattgccaaaattttgatgctctttgtttgatt

SEQ ID NO: 3757 - DNA, 622 bp, Tabernaemontana elegans
atttttctggagctaatccaacatggttaacgttcctaagacaaagaagacatactgcaagtccaaggagtgcagaaagcacaccttgcacaaggttacccaatataagaagggaaaggatagtctagctgctcaagggaagcgacgttatgatcgcaagcagtcaggttatggtggacagactaaacctgtcttccacaagaaggcaaaaactactaagaagattgtcctgaggctccaatgccagggctgcaagcatgtttcacagcaccctattaagaggtgcaagcattttgagattggtggagacaagaagggaaagggaacctctcttttctaagaagctgcattgtacttcaagtgctgttttatctgtcatgtttcttataagcttttgaccttatgttgatctaaatcagaggattactagatagttttggaaggagctcagttttttgttttttgttgagttttggatcctggattattaattgcattcagtatttggaattatacatgataccgtgaatattaacaattgagggcgcctgatttttgtccagaaagggtacttcaaaaaaggttggacgccctttccatgcgtgctggtgaaaaaaggttc

SEQ ID NO: 3758 - DNA, 585 bp, Camellia sinensis
caacaataaagtttacgctagagctctcacaaaccctagaagctttgagactgactctgcgacgcagccatggttaacgttccaaagaccaagaagacctactgcaagtcaaaggagtgccggaagcacaccttgcataaggttacccaatataagaagggaaaggatagtttggcagcacaaggcaagcgtcgttatgatcggaaacaatctggctatggtggacaaacaaaaccagttttccacaaaaaggcaaaaaccactaaaaaaattgtgctgaggctgcaatgccagggttgcaaacatgtatcacagcacccaatcaagaggtgcaaacattttgagattggtggagataagaaggggaagggaacttctctattctaagtggctagtgatgggaaattgcgtgtatcttatcgttttgcagctgttgccttgacctttcaattaattattacggtttttcagttggaatggaagtatctgttttagcccatagttttctagatgttgttttggaatgatgttatatgtttcttccaagtactaattgcttttatgagattgcagtttcacccttgc

SEQ ID NO: 3759 - DNA, 498 bp, Nicotiana tabacum
  misc_feature (14)..(14): n is a, c, g, or t
  misc_feature (497)..(497): n is a, c, g, or t
atctaatcctcggnccgcaacaatggtgaatgtacctaagacaaagaagacctactgcaaatccaaggaatgcaaaaagcacaccttgcataaggtcacacaatacaagaaaggaaaagatagtctagctgcccagggaaagcgtcgttatgatcgtaagcagtcaggttatggtggacagacaaagcccgtcttccacaaaaaggcaaaaactacaaagaagattgtcttaaggttgcaatgccaggggtgcaagcatgtctctcagcacccaatcaagaggtgcaagcattttgagattggtggggacaagaaaggcaacggaacctctcttttctaaattgcctgtgttgcagtatttgatagtcatctgttatacgttgctagatatctttgaatgttggtgtagttcaagagcttctgttgtcctagattcaagagctttcgtgtacctatgccgtgttaattacatattgatcagcggatcgaagttgtanc

SEQ ID NO: 3760 - DNA, 509 bp, Tragopogon dubius
ctggtttttccatctttcatcaggcagatcggttctccgaagatctccagccatggtgaatgtacccaagacaaagaagacttactgcaagtcaaaggactgcaaaaagcacacattgcataaggtgacacagtacaagaagggaaaagatagcttggctgctcaagggaagcgtcgttatgacaggaaacaatccggttatggtggtcagaccaagcccgtctttcacaagaaggctaaaaccacaaagaagattgtgttgaggttgcaatgccaagggtgcaagcatgtgtctcagcacccaatcaagaggtgcaaacattttgaaattggtggagacaagaagggcaagggaacttcacttttttaagcaattaatattattatcattatgtgttgttattttgataaatttagacatttcatcaaagattttatcaaagtatgttttgtattgctggcttgatacgttccttcattaataggattttgcaacatttatttctcca

SEQ ID NO: 3761 - DNA, 628 bp, Tripterygium wilfordii
caaacatgcagaagtgtaggcgccgcgcttttgtctttcttggggtggttacagtaccgagagagctctcctgttcggctaaacctcaaatcatggtgaacgttccaaagacaaagaagacatactgcaagagcaaggaatgtaggaaacacaccttgcataaagtcacacaatacaagaaagggaaagacagtcttgctgctcagggaaagcgtcgatatgaccgtaagcaatcaggttatggagggcagaccaaaccagttttccacaagaaggcgaaaactacaaagaagattgtcctaaggctgcagtgccaaggttgcaagcatgtgtctcagcacccaatcaaaaggtgtaagcactttgagattggtggagataagaaggggaaggggacgtcacttttctaaatgttttccatggtattgtctttttatgtttgtttcctttttgtatgttgtttaaactcaagggccaggcgcttatgacagtcattttgtttaagcttttttagtcattagtgtgtgctgatatattgtggatgattcctttaaatagttttctgagtggtgtttatgaatgtttttcagtataagaaaatcgtatattatatttggttaagttgttt

SEQ ID NO: 3762 - DNA, 547 bp, Tripterygium wilfordii
ttcgttcgccttctctaggtttctgttagtggcgcaacagagctctcaacgatggtgaatgttccaaagaccaagaagacctactgcaagagtaaggagtgcaggaagcacactctacataaagtcactcagtataagaaggggaaggatagtcttgccgctcaaggtaagcgccgttatgatcgcaaacaatcagggtatggaggacagaccaaaccagtcttccacaagaaggcaaaaacaactaagaagattgtgctgaggttgcagtgccagggttgcaagcatgtttcccagcacccaatcaagaggtgcaagcacttcgagatcggtggggacaagaagggaaaggggacttctcttttctaagtgattgtcttgtttgtcttagttttgtattctctcatttttttctttatattagaactggaattctatatttggcttgaacccaagtggattggtttatcagcatatctagttgtaatggttcttgtatttgagattgctggtctatatgaggtactatctatgaaatcagtatcaa

SEQ ID NO: 3763 - DNA, 622 bp, Tripterygium wilfordii
agctctcaacaatggtgaatgttccaaagacgaagaagacctactgcaagagcaaggagtgcaggaagcacacccttcataaagtcacacagtataagaagggtaaggatagtcttgccgctcaaggtaagcgccgttatgatcgcaaacaatcagggtatggagggcagaccaaaccagtcttccacaagaaggcaaaaacaactaagaagattgtgctgaggttgcaatgccagggttgtaagcatgtttcccagcacccaatcaagaggtgcaagcactttgagattggtggggacaagaagggaaagggaacttcccttttctaagtaattgtcttaattttgtgttcccttgcattttctttatgttagaactcaaatgtcatgttttgcttggaaatgcaaatggattggtttattagtagatctagttgtaatgtttctgttatttgacattgctggtcttacatgaggcactctatggaattagtatcagttagccttggttcttggtaatactttttattttttttgttttaatttacttgtttcagatgttgagatggtttggttgacaagttatgtcgaagatggatttttttgttggtatacttaggtgt

SEQ ID NO: 3764 - DNA, 559 bp, Valeriana officinalis
ttctctagcggccgtcttctgtttatcgatttctctctgcaaccggagctcaaccatggtgaacgttccgaagacaaagaagacttactgcaagtcgaaggactgcaagaagcacactttgcacaaggttactcagtataagaagggaaaggacagtttggctgcacaaggaaagcgtcgttatgatcgtaagcagtcaggttatggtggacagaccaagcctgttttccacaagaaggctaaaaccaccaagaagattgttctgaggcttcagtgccagggctgcaaacatgtgtcccagcaccccatcaagaggtgcaagcattttgagattggtggagacaagaagggaaagggtacctctcttttctagaatgccgaaatctgatcagaagagctgcagctgtcatcttgatattgtgttatattttgattcagctttccattaagtttacttcttttgaattggatttttagtgtattacttcatttagcagttaaaattttgtgctcctcaatgttagacttgttatggtaattgagattgagattttggtgc

SEQ ID NO: 3765 - DNA, 591 bp, Vinca minor
ttcccttaaacttaggtctcacaagatctctccatcagtaaaaaatggttaacgttccgaagacaaagaagacatactgcaaatcaaaggagtgcaagaagcacaccttgcacaaggttacccaatataagaagggtaaggatagccttgctgctcaggggaagcgtcgttatgaccgcaagcagtcaggttatggtggacagacaaagcccgtcttccacaagaaggccaaaaccacaaagaagattgtactgaggctccaatgtcagggttgcaagcacgtctcgcagcacccaattaagaggtgcaagcattttgagattggtggcgacaagaagggaaagggaacccagcttttctaagaagctgagcatcaaatttcaagtgctgtttttactcgtgtttttgttttctatttgctttggaaattaaactgtaatcaaggaccattttataagtgggattttcatggagaatagcctatcctaaaccacgattagtctttttgttttcttagaattactgtccctccagttgcagattttttgtcccaaattataatgacttgtttatttggtaacttcgactata

SEQ ID NO: 3766 - DNA, 456 bp, Triticum aestivum
atggtgaacgttccgaagaccaagaagacttactgcaaaaacaaggagtgcaagaagcacacccttcacaaggtcactcaatacaagaagggtaaggacagcctgtctgcccagggaaagcgtcgttatgacaggaaccagtcgggatacggtggtcagaccaagcccgttttccacaagaaggccaaaacccccaagaagattgtgctgaaactccagtgccagagctgcaagcactactcccagggaaaaatcccccggtcccaccattttgagatcggtggagacaagaagggcaagggaacatccctcttttagattgctttcacctatatctgtagtcgttgtgttcaagaactattactacttgtcatattgttttggtgttatgagttgaatcaatcagaccctgtcttgtatccaaacccccttatttggcatttgagcaacgatcga

SEQ ID NO: 3767 - DNA, 727 bp, Zamia vazquezii
  misc_feature (320)..(320): n is a, c, g, or t
  misc_feature (438)..(438): n is a, c, g, or t
  misc_feature (457)..(457): n is a, c, g, or t
  misc_feature (470)..(470): n is a, c, g, or t
  misc_feature (495)..(495): n is a, c, g, or t
  misc_feature (566)..(566): n is a, c, g, or t
ggcccaacgcaaacaggcaacgaagcaaccaccgcgagcagggtgagacgccctcatcgtcaccaacagttctgtgattaccttttaagcctgttgggggcactctctacggtacagaaaaagaaaatggtgaatgtgccaaagacaaagaaaacgttttgcaggaacaaggagtgcaaaaagcacaccttgcacaaagttacacaatataagaaaggaaaggacagccttgctgcccaagggaagaggcgttatgatcggaagcaatcaggctatggaggtcaaactaagcctgtcttccataagaaggcaaaaacaangaagaagattgtgttgaggttgcagtgccagtcttgcaaacatgtttcacaacatcctatcaagcgctgcaagcactttgaaattggtggcgacaaaaagggaaagggaacatctctnttttagttgggcagctttntagttttaaaatntggatacaatcctcagtggagttgntattcaattttagaaagctttaatttatagcaaaaacacttgaatgacctggttttaattacatagtttgntatgcataatttagcatcagatgcaactggatattttaggcagtttaagcaatcactagttgtatgttgttcaccttcagtttcatggtggaattttgtacaaggtctccaactcacctttgggcaatcatgaggttattgaagctgtaccggtagccgaa

SEQ ID NO: 3768 - DNA, 655 bp, Gossypium hirsutum
ggcagaggccatttaaaaacccccattaggttaaaatcatcaattggctgcttcctacttcaccatttacaccgaaacagagctcgggtcatctctcaccagccgcaaccatggtgaacgtacctaagacgaagaagacttattgcaagagcaaggagtgcaggaagcacactttgcacaaggttacacagtataagaagggtaaggatagtttggctgctcaagggaagcgacgttacgatcgcaaacaatcaggttatggtggtcagaccaaaccagtcttccacaagaaggcaaagaccaccaagaagattgtgctaaggctgcaatgccagggttgtaagcatgtctcacagcatccgatcaagaggtgcaagcactttgaaattggtggagacaagaaggggaaaggaacatcacttttctagatgtgatgatattcatgtcaaattttatgttatgggtttttacttggaacttaacgcagaatggagttttgttaagtttggtattagtattctaatgttgtttttaagaggatattgtgttttttaaggttaatggcatcggtcacactcatcgatagcaattgtctaattggttcttgttatatcaatatcttgtgagctcgcatcacttccttgagatcttgtag

SEQ ID NO: 3769 - DNA, 635 bp, Gossypium hirsutum
aacagagctcgggtactctcatcttcagccgcagccatggtgaacgtacctaagacgaagaagacctattgcaagagcaaggagtgcaggaagcacactttgcacaaggttacacagtacaagaagggcaaagatagtttggctgctcaagggaagcgccgttacgatcgcaaacaatcaggttatggtggtcagaccaaaccagtgttccacaagaaggccaagaccaccaagaagattgtgctgaggctgcaatgccagggttgcaagcatgtatcccagcatccaatcaagaggtgcaagcattttgaaattggtggcgacaagaaggggaagggaacatctcttttctaaatggtgtttattcatttcatgtcatgtcatgttgttgggaaccttttaagacagtatggaattttagtttttctaatgtaatgttttccgagggatatggtgttctttaagcacttaatagttaatggcatcgtttgatctattgtcgccatttgttttaaatactgtattttaatttaattgtttttggaacttcaataatctttgctatatttttcatgaacgaggaattgaattttgcccactacaccaacaaatttttgaaacgaatgtggaatcct

SEQ ID NO: 3770 - DNA, 610 bp, Vaccinium corymbosum
gcccacctccagaaaccctaaaactctgtggcatccttcttcgaccgcagcaatggtgaatgttccaaagacaaagaagacatactgcaagtcgaaggaatgccgaaagcacaccttgcataaggtaactcaatacaaaaaggggaaagatagtttggctgtgcaaggcaagcgccgttacgatcggaaacaatcagggtatggtgggcaaactaagcctgttttccacaagaaggctaaaactacaaaaaagattgtgctgaggctgcaatgccagggctgcaaacatgtatcccagcacccaatcaagaggtgcaaacactttgaaattggtggagataagaaagggaaggggacttctcttttctaaatgatactttgtggaggactgcacttgcactctcattgcagtgctaagtagctcgcaatttcagttggaactttttgattttgttttgttcatgtttaaagatactatggttgtgttttttagttagaatttcagtcgttcctctcttgagtacaagacgagatttcaaattgttgtgccaatattttgatccgattttcttgcaaggttgcaggcataccactgctgaatggtttatct

SEQ ID NO: 3771 - DNA, 639 bp, Vaccinium corymbosum
aaccctaacaccaaacagatcgctataaaaccttcgtattgagcgtaaaaaaggccttcgcccacctccagaaaccctaaaactctgtggcatccttcttcgaccgcagcaatggtgaatgttccaaagacaaagaagacatactgcaagtcgaaggaatgccgaaagcacaccttgcataaggtaactcaatacaaaaaggggaaagatagtttggctgtgcaaggcaagcgccgttacgatcggaaacaatcagggtatggcgggcaaactaagcctgttttccacaagaaggctaaaactacaaaaaagattgtgctgaggctgcaatgccagggctgcaaacatgtatcccagcacccaatcaagaggtgcaaacactttgaaattggtggagataagaaagggaaggggacttctcttttctaaatgatactttgtggagaactgcacttgcactctcactacagtgctaagtagctcgcaatttcagttggaactttttgattttgttttgttcatgtttaaagatactatggttgtgttttttagttagaatttcagtcgttcctctcttgagtacaagacaagatttcaaattgttgtgccaatatgttgattcgattttcttgcaaggtt

SEQ ID NO: 3772 - DNA, 656 bp, Vaccinium corymbosum
acctccagaaaccctaaaactctgtggcatccttcttcgaccgcagcaatggtgaatgttccaaagacaaagaagacatactgcaagtcgaaggaatgccgaaagcacaccttgcataaggtaactcaatacaaaaaggggaaagatagtttggctgtgcaaggcaagcgccgttacgatcggaaacaatcagggtatggtgggcaaactaagcctgttttccacaagaaggctaaaactacaaaaaagattgtgctgaggctgcaatgccagggctgcaaacatgtatcccagcacccaatcaagaggtgcaaacactttgaaatcggtggagataagaaagggaaggggacttctcttttctaaatgatactttgtggagaactgcacttgcactcgcactacagtgctaagtagctcgcaatttcagttggaactttttgattttgttttgttcatgtttaaagatactatggttgtgttttttagttagaatttcagtcgttcctctcttgagtacaagacaagatttcaaattgttgtgccaatattttgatccgattttcttgcaaggttgcaggcataccactgctgaatggtttatcttaactttttctggttgtttgctgattgtggttgataagttttagttttag

SEQ ID NO: 3773 - DNA, 773 bp, Vaccinium corymbosum
ttcgtaaaaatggccttcgcccacctccagaaaccctaaaactctgtggcatccttcttcgaccgcagcaatggtgaatgttccaaagacaaagaagacatactgcaagtcgaaggaatgccgaaagcacaccttgcataaggtaactcaatacaaaaaggggaaagatagtttggctgtgcaaggcaagcgccgttacgatcggaaacaatcagggtatggtgggcaaactaagcctgttttccacaagaaggctaaaactacaaaaaagattgtgctgaggctgcaatgccagggctgcaaacatgtatcccagcacccaatcaagaggtgcaaacactttgaaattggtggagataagaaagggaaggggacttctcttttctaaatgatactgtggagaactgcacttgcactctcactacagtgctaagtagctcgcaatttcagttggaactttttgattttgttttgttcatgtttaaagatactatggttgtgttttttagttagaatttcagtcgttcctctcttgagtacaatgacaagatttcaaattgttgtgccaatattttgatccgattttcttgcaaggttgcaggcataccagtgctgaatggttttatctactttttctgggagtttgatgactgtattgtggttgataagtttaagttttagcaacacaaggtagaattctactgtccatcgaaaactgggcagattgtaacatttttccgtatcactagctaagaaagtgtctcaagttggaa

SEQ ID NO: 3774 - DNA, 493 bp, Centaurea maculosa
gtcatcagctccactctctgcagctggtccgccatggttaacgttcccaagacaaagaagacttactgcaagtcgaaggactgcaggaagcacactttgcataaggttacacaatataagaagggaaaagatagcttggctgcacaagggaagcgtcgttatgacagaaaacaatcaggttatggtggacagactaagcccgtctttcacaagaaggctaaaaccaccaagaagattgtgctaaggttgcaatgccaagggtgcaagcatgtatcccagcacccaatcaagaggtgcaagcattttgagattggtggagacaagaagggcaagggaacctcccttttctaagcatgcagttgtctggatttcagctatgcaatattttctctctttcaggtttacaattatgttatggagtttgcagatttggtttctttttaactgaacttagctactgtttaaagcaatgcaaatctgtttttgagtcttt

SEQ ID NO: 3775 - DNA, 640 bp, Centaurea maculosa
ctttcgatctttcaggagctcttcagccatggtgaacgttcctaagacaaagaagacttactgcaagtcgaaggattgccgaaagcatactttgcataaggtgacacagtataagaagggaaaggatagtttggctgcacaaggaaagcgtcgttatgacaggaaacagtccggttatggtggtcagacaaagcctgtgtttcacaagaaggcaaaaaccacaaagaagattgtgctaaggctgcaatgccaagggtgcaagcatgtgtcccagcacccaattaagaggtgcaagcattttgagattggtggagacaaaaagggcaagggaacatcacttttctagagggaatatgtgtaatttagttgcagttattcatttttcaattttggtagacttgagatttacaatgaaagtggctttttttgctttgacacatgtggcttgacttgtagtaagttagtgaaggagatgggcaacttttccagttatttctttctacttgcagctgtggtttcatatgatggattgcttgtttagaaaaacctgaatttggaggttcataagtcgaattttgctatctactttggctactaatttggagtcttgttattgaatggaagctgttggagtctagtc

SEQ ID NO: 3776 - DNA, 373 bp, Brassica juncea
gatctcagagctcaggttctctctcttcgtctgcagccatggtgaacgtacccaagaccaagaagacttactgcaagagcaaggattgcagaaagcacactttgcacaaggttacacagtataagaagggtaaggatagtttggctgcccaagggaaacgccgttatgatcgcaaacagtcaggttatggtgggcagaccaaaccagtgttccacaagaaggcaaagaccaccaagaagattgtgctaaggctgcaatgccagggttgcaagcatgtctcccagcatccaatcaagaggtgcaagcactttgagattggcggagacaagaaggggaagggaacatctcttttctaaatgtgttattagatcgg

SEQ ID NO: 3777 - DNA, 456 bp, Brassica juncea
tgaacattccgaagacaaagaagacttactgcaagaacaaggaatgcaagaagcataccttgcacaaggtcacccagtacaagaagggtaaagacagtctcgctgctcaagggaagcgtcgttatgaccgtaaacaatccggttatggtggtcagactaagcctgtcttccacaagaaggctaagaccacgaagaagattgtcctgaggcttcagtgccaaacctgcaagcacttttctcagcactccatcaagaggtgcaagcattttgagatcggtggagacaagaagggcaagggaacatcacttttctaagctggtctcgtcttgagctttttacaagttttgtacttcgttggatctttattttatctgttttagctctcgtataagattgtttctcatccttgcttgttgactctaatactttgtatcatcaagatatggtttttttttt

SEQ ID NO: 3778 - DNA, 691 bp, Phaseolus coccineus
ctccgtgcaaccctagttcccaaagccattaaaactcagggcattgtcattcgtggccttattttcgcggcgcataacagaaccctacatcttcagattttgatcgcacgcgccgtcacaatggtgaacgttccaaaaactaagaagacatactgcaagagtaaggagtgcaggaagcacactctgcacaaggttacgcaatacaagaagggtaaggatagcattgctgcccagggaaaacgccgttacgatcgcaaacaatccggttatggtggacaaactaagcctgttttccacaagaaggctaagaccaccaagaagattgtcttgaggttgcaatgtcagggttgcaagcatgtctcccaacacccaattaagaggtgcaagcactttgagattggtggtgacaagaagggcaagggaacatcacttttctaagttgagaattaggatctgcagctttttgtgtttctgcaatgttggaatgtattgtttctctgtggatttatttgctagttatattttattatttcgcaataccttatcatgcgattgagaaatgaaaactattgctaatatcagtgagtatttgtttcccctctcttgaatttcacttattgcaccattcctctattcttatgccttgctactattttttgcttctgggttaccttttggggtgcctcagcta

SEQ ID NO: 3779 - DNA, 596 bp, Phaseolus coccineus
aagcagtggtatcaacgcagtagtgttcctattatggccggggattttcgcggcgcataacagaaccctacatcttcagattttgatcgcacgcgccgtcacaatggtgaacgttccaaaaacgaagaagacgtactgcaagagtaaggagtgcagaaagcacactctgcacaaggttacccaatacaagaagggtaaggatagcattgctgcccagggaaaacgccgttacgatcgcaaacaatccggttatggtggacaaactaagcctgttttccacaagaaggctaagaccaccaagaagattgtcttgaggttgcaatgtcagggttgcaagcatgtctcccaacacccaattaagaggtgcaagcactttgagattggtggtgacaagaagggcaagggaacatctcttttctaagttgagaattaggatctgcagctttttgtgtttctgcaatgttggaatgtattgtttctctgtggatttatttgctagttatattttattatttcgcaataccttatcatgcgattgagaaatgaaaactattgctaatatcagtgagtatttgtttcccctctcttgaattcct

SEQ ID NO: 3780 - DNA, 674 bp, Phaseolus coccineus
gagaaagaacatttaactagccctaattgccagaagccattaaaccctacacacgctgcttccaccgttgctccaccgatccctgcaacaatggtgaacgttccgaagacgaagaagacctactgcaagagcaaggagtgcaggaagcacaccctccacaaggtcacccaatacaagaagggtaaggacagtatcgccgctcagggaaaacgccgttatgaccgtaaacagtccggttacggtggacagaccaagcccgttttccacaaaaaagccaaaaccaccaagaaaatcgtgctgaggcttcagtgccagggatgcaaacatgtctcccaacatccaatcaagaggtgcaagcacttcgaaatcggtggtgacaagaagggaaaaggaacgtctctgttttagttggaatttactatttcactcacattttttttcttgttttgtttgccgtctttggcattttaattttggagtaataccttttgtttgaggatattagaatttgctatttagttttgtttgagaactgttatagtatcaatgactggttatttccatttcttgaatttgagttattgcaatttcgtcgagtttggcttcatctacctctatgcttagcgcaccactgaattgctctttggtttactttgtttggaaagagaacaatg

SEQ ID NO: 3781 - DNA, 584 bp, Phaseolus coccineus
tggccaggggaaaccctacacacgctgcttccaccgttgctccaccgatccctgcaacaatggtgaacgttccgaagacgaagaagacctactgcaagagcaaggagtgcaggaagcacaccctccacaaggtcacccaatacaagaagggtaaggacagtatcgcagctcagggaaaacgccgttatgaccgtaaacagtccggttacggtggacagaccaagcctgttttccacaaaaaagccaaaaccaccaagaaaatcgtgctgaggctccagtgccagggatgcaaacatgtctcccaacatccaatcaagaggtgcaagcacttcgaaatcggtggtgacaagaagggaaaaggaacgtctctgttttagttggaatttactatttcactcacattttttttcttgttttgtttgccgtctttggcattttaattttagagtaataccttttgtttgaggatattagaatttgctatttagttttgtttgagaactgttatagtatcaatgactggttatttccattccttgaatttgagttttgagttattgcaatttcgtcgtagtttggcttcg

SEQ ID NO: 3782 - DNA, 2220 bp, Theobroma cacao
agtacaattttttatgaatagaataatgtggtcattatttagtcatagcgacccaagaagagggccatccattcgggtattcaaagtcctccatgccaactcccttctctctcttccatggccgaacctcaaatgaaaacccatcaaaccaaccgcagaagcagttgttttataggctgttttgggttttccgggaaggaaaaacccctgaagaaaaccatccatgccaggagcaaaaaagagacccgtttgctctcttggccaatgtttcgttcaagcgtgagaaagtcccgtaccaaaacggtgcctgttgataacaccgagaaagcagagggcgcagatggcaataaaagccatacatcaaagctgatcaagaggaaatctgataccaaactctcctctaaacctcagaacccggttaccaatcatacaccttcacctcaaaattccgaagctgagcaagtggcgtcctgcaatcaagctgcaagagagaaacctaaagagacaaggcagggacctgaaccgaatatcatcctcgggaataggaaactttcggagccgacgagaacagggtcgagcccacctggttcgccgaacgttaagcccaaatccaaaacgcagaccaagttgtcccacacggtttcgttaccggtcctagaagagaacaaacgggtggggaatccccggatgcacttgagggaggtccaacggaaaaataatgaggtggttgaaaaaatcgaccccgtactgggcatgtctattattatggtgaccctgataataatgttactttggggtcgattgtgcgccattctttgtacgtcggcatggttctatttttgccctcgtttccgatccacaattaacaataatgacactgctgttagaggtaccgccaattccagtgatttagatttggattcggaggagtacaagaagaaggtggtgttggaggggttcctccagaggaaccaccggctcacgtaattgtgaaactttttgtacaaaataagttttgtttgatgttcaatgcgcacgttagatgcaactatacatgttttgctaaagtgagcccaatgggcattttgtgtaaattaccagaactttttgtgaaaatttgccgtgggtcagtgtcttctagaatcaaagttgagcttttttcttgtttttttccattgtggtggtgctcttgtttaattggcagttgggggatgtcacgtgattttagatgtggagcacgtgccaggactccgtcaacgagtgatgttggggactgtttggcttttgtggctggaaaatagcggtcagcttcagttgtcggcttctgcatcacctaacataaccgagagaatttaaagagaaaaaacatgaaatccatattcaaagatgttatttatttttcaaataatttttttgatcctgtttaatcaatttgactttgctgttatttatttatttttcttatgacttatccacacctgatttttctttcgatttatctgttttttctaatgtatgcattaattttcttttgatgcaaagcaatggatccgacgaaaatacccctaaccctttcaaaccctaaattttagaatggatatatctatagcttggacgcctcccagttcaccttccggccgaaacagagctcaggttctctctcttcgtctgcagccatggtgaacgtacccaagaccaagaagacttactgcaagagcaaggattgcagaaagcacactttgcacaaggttacacagtataagaagggtaaggatagtttggctgcccaagggaaacgccgttatgatcgcaaacaatcaggttatggtgggcagaccaaaccagtgttccacaagaaggcaaagaccaccaagaagattgtgctaaggctgcaatgccagggttgcaagcatgtctcccagcatccaatcaagaggtgcaagcactttgagattggcggagacaagaaggggaagggaacatctcttttctaaatgtgttattcatgccatctgttatgttgctttactgtaatgcagtagtcgaaaaacataaaagacagtttggaattttgttgagtttgcttttagttttatgatgttgtttttagaggatattttggtgttcttttcaagtacttaatgacatcagttgctcttactgttagcaattgtttcaaagtttcaccattattttttaatttaaatcttccactatttt

SEQ ID NO: 3783 - DNA, 528 bp, Centaurea maculosa
gcggggacgaaccctaaaaaatcgtcttccctgtcatcagctccactctctgcagctggttcgccatggttaacgttcccaagacaaagaagacttactgcaagtcgaaggactgcaggaagcacactttgcataaggtgacccaatataagaagggaaaagatagcttggctgcacaagggaagcgtcgttatgacagaaaacaatcaggttatggtggacagactaagcccgtctttcacaagaaggctaaaaccaccaagaagattgtgctaaggttgcaatgccaagggtgcaagcatgtatcccagcacccaatcaagaggtgcaagcattttgagattggtggagacaagaagggcaagggaacctcccttttctaagcatgaagttatctggatttcagctatgcaatattttctctctttcaggtttacaattatgttatggagtttgcagatttggtttcttctttactgaacctaactactgtttaaagcaatgcaaatctgtttttgagtctttgtc

SEQ ID NO: 3784 - DNA, 512 bp, Centaurea maculosa
tcaggcagtttggttttccggagatctgcagccatggttaatgttccaaagaccaagaagacctactgcaagtccaaggattgccgaaagcacaccttgcacaaggtgactcaatacaagaagggaaaagatagcttggctgcccaaggaaagcgtcgttatgacaggaaacagtccggttatggtggacagaccaagcccgtctttcacaagaaggcaaaaaccacgaagaagatcgtgctaaggttgcaatgccaaggctgcaagcatgtgtctcagcacccaatcaagaggtgcaaacattttgagattggtggagacaagaagggcaagggaacttcacttttctaagcaattattatcagttatattgtgttatgttttagacttttttattataatagatgttaactctttcttttatacattctcacatttagctttctgttgtatgaagtgaacattgtgttctgtgatttttggaaaattttgagttggttatagttgcattt

SEQ ID NO: 3785 - DNA, 521 bp, Cichorium intybus
atcttgacaaccctagactggtggttcctatctcacatcgggcagatcggttctccggagatcttcagccatggtgaatgttcccaaaactaagaagacttactgcaagtcaaaagactgcagaaagcacacattgcataaagtgacgcaatacaaaaagggaaaagacagtttggctgctcaagggaaacgtcgttatgacaggaaacaatcaggttatggtggacaaaccaagcccgtctttcacaagaaggcaaaaaccacgaagaagattgtgttgaggttgcaatgtcaagggtgcaagcatgtgtcacagcacccaatcaagaggtgcaagcattttgagattggtggagacaagaagggaaaaggaacctcactattttaagcaattatgtgttgttattttgataattttagacttttagatgctacatttctttcaagttttaatgcaagtatgtgtttggttgttacatttagctttcagtatggagtatttactttactatttccaaaaa

SEQ ID NO: 3786 - DNA, 497 bp, Cirsium arvense
aaaaaaagtcatcagctccactctctgcagctggtccgccatggttaacgtccccaagacaaagaagacttactgcaagtcgaaggactgcaggaagcacactttgcataaggtgacacaatataagaagggaaaagatagcttggccgcacaagggaagcgtcgttatgacagaaaacagtcaggttatggtggacagactaagcccgtctttcacaagaaggctaaaaccaccaagaagattgtgctaaggttgcaatgccaagggtgcaagcatgtatcccagcacccaatcaagaggtgcaagcattttgagattggtggagacaagaagggcaagggaacctctcttttctaagcatgctgttatctgtatttcagctatgcaatattttatctctttcaggtttacaattatgttatggagtttgcagatttggtttctttttaactaaacttacctactgtttaaagcaatgcaaatctgtttttgagtc

SEQ ID NO: 3787 - DNA, 628 bp, Cirsium arvense
taaacatatacactactttattgagaagtaaatgggctggactttttatgttatagaggttcaactgggctgtatggtaaagaaatgaagccctaaccttaatagaagccttaaaacacacacaaagcgatggtgaaaacctaatagcgatctgcggctgtccatctcgtctttcgactttcaggagctattcagccatggtgaacgttcctaagacgaagaagacttactgcaagtcaaaggattgccgaaagcacaccttgcataaggtgacacagtataaaaagggaaaagatagcttggctgcacaaggaaagcgtcgttatgacagaaagcagtctggttatggtgggcagacaaagcctgtgtttcacaagaaggcaaaaaccacaaagaagattgtgctaaggctgcaatgccaagggtgcaagcatgtgtcccaacacccaattaagaggtgcaagcattttgagattggtggagacaagaagggcaagggaacatctcttttctagagggaatatgtgtaatttagttgcagttattcatttttcaattttggtagacttgagatttacaatgaaagtgacttttgcttttgacacatgtggcttgacttgtagtaagt

SEQ ID NO: 3788 - DNA, 1444 bp, Cirsium arvense
aatcaaacgaagacagaagacaggggaagggggaaggaaaggatgcatcgaaaacatcttctcatgtgtttcaggcccttcaatttttgtcttaaactctgcagtcatcctttgcttgtccttggtggagcgattcaagattcacttccccgcattttgcctgatctttttgcaacgagttctgacattaattcagaactccataaactgcaccactcccctaagttagttgctcttcaggaaattcttgaagagtgtggcataggcgttgagggctcgagttctgaaggctccgttgggcaacatcgagttttgatattcgcacaacataaggcgctgctggacattatcgagaaagacttgtttcatgtgcatatgagaagtgtgacatacttgcggctggatggatcagttgaaccaagaaaagcgttttgacattgttaagtcattcaattcagaccctaccatcgatgttttgctcctgacgacacatgttggtggacttggtttaatttaacctcagctgataccctagttttcatggaacacgattggaatccaatgcgagaccatcaggcaatggatagagcacacaggttgggtcagcggaaggtggtcaacgttcatcgtctcataatgagaggaactctggaagagaaggttatgagcctccaaaagttcaaagtgtccgtcgccaatgccgtcatcaactcagaaaacgctagtctcaaaacaatgaacaccgatcaattgcttgatctatttactccagcagataccaaaaagggtgcatccacttcaaagggttctgaaaacgatggattaccgaaagtaccaggtagcggtaaagggttaaaagccatccttggtggactcgaggagctttgggatcaatcacagtacacggaggaatataatttgagtcaatttttagcgaaatcctaatcttccatcaattcatcaggcagttcggttcttcggagatctgcagccatggttaacgttcccaagactaagaagacttactgcaagtcgaaggactgccgaaagcacaccttgcacaaggtgacacagtacaagaagggaaaagatagcttggctgctcaaggaaagcgtcgttatgacaggaaacagtcaggttatggtggacagaccaagcctgtctttcataagaaggcaaaaaccacaaagaagattgtgctaaggttgcaatgccaagggtgcaagcatgtgtctcagcacccaattaagaggtgcaagcattttgagattggtggagacaagaagggcaagggaacttcacttttctgagcaattcttcttcttattattatctgttttgttttattataaaatagatgttacattttcttttttatgtattttgttgtgttttgttactgtgatttttggaaccctttagatggttataattcaattctgt

SEQ ID NO: 3789 - DNA, 606 bp, Vigna unguiculata
gcagggcattatcactggtggccttattttcgcggcgcacatcagaaccctacttcttcagattccgatcgcacgcgccgtcactatggtgaacgttccaaaaacgaagaagacttactgcaagagtaaggagtgcaggaagcacactctgcacaaggttacccaatacaagaagggtaaggatagcattgctgctcagggaaagcgccgttatgatcgcaaacaatccggttatggtggacagactaagcctgttttccacaagaaggctaagaccaccaagaagattgtcttgaggttgcaatgtcagggttgcaaacatgtctcccaacacccaattaagaggtgcaagcactttgagattggtggtgacaagaagggcaagggaacatctcttttctaggttgagaattaggatttgcagcttttgtgtttctgcaatgttggaatgttttgtttctctgtggatttatttgctagttatatttattatttcgcaataccttattatgtgatcgagaaatgaaaactatcactgatattagtgagtatttgtttgccttctcttgattatctcttatggtagccttcatctattcgtccgta

SEQ ID NO: 3790 - DNA, 671 bp, Vigna unguiculata
ggaatttgcagaagccattaaaccctactccgctgcttccgctttccttcaccaatctctgcaacaatggtgaacgttccgaagaccaagaaaacctactgcaagagcaaggagtgcaggaagcacactctccacaaggtcacccaatacaagaagggtaaggacagcatcgccgctcagggaaaacgccgttatgaccgtaaacagtccggttacggtggacagaccaagcccgttttccacaaaaaggcaaaaaccaccaagaaaatcgtgctgaggctccagtgccagggatgcaaacatgtctcccaacatccaatcaagaggtgcaagcacttcgaaatcggcggcgacaaaaagggaaagggaacctctctgttttagttggaatttgctatttcacacactcatttttatttttattttttgttgtttgccgtctttggcattttaattttggagtaataccttgtgtttgaggatattatttagttttgtttgagaactgttatagtatcaatgactagttttttgcattccttgaatctgaactgtgtctatttcgtatagtttggcttcatctatctatattcttagtgcattactgaatcgctctttggcttactttgtttgggagcaatgcagttgtgggttttaaaaaaaaaaaaaaa

SEQ ID NO: 3791 - DNA, 681 bp, Vigna unguiculata
gggagaaagaacactaaaccaaccctaatttgcagaagccattaaaccctactccgctgcttccgctttccttcaccaatctctgcaacaatggtgaacgttccgaagaccaagaaaacctactgcaagagcaaggagtgcaggaagcacactctccacaaggtcacccaatacaagaagggtaaggacagcatcgccgctcagggaaaacgccgttatgaccgtaaacagtccggttacggtggacagaccaagcccgttttccacaaaaaggcaaaaaccaccaagaaaatcgtgctgaggctccagtgccagggatgcaaacatgtctcccaacatccaatcaagaggtgcaagcacttcgaaatcggcggcgacaaaaagggaaagggaacctctctgttttagttggaatttgctatttcacacactcatttttatttttattttttgttgtttgccgtctttggcattttaattttggagtaataccttgtgtttgaggatattatttagttttgtttgagaactgttatagtatcaatgactagttttttgcattccttgaatctgaactgtgtctatttcgtatagtttggcttcatctatctatattcttagtgcattactgaatcgctctttggcttactttgtttgggagcaatgcagttgtgggtttta

SEQ ID NO: 3792 - DNA, 653 bp, Cyamopsis tetragonoloba
ttcctacctcttcagatcgaccacaccaaagcgcagccatcatggtgaacgttccaaagacgaaaaagacatactgcaagagcaaggaatgcaggaagcacacactgcacaaggtcactcagtacaagaaggggaaggattctattgctgctcaaggaaaacgccgttatgaccgcaaacaatccggttatggtggacagactaagcctgtctttcacaagaaggcgaaaaccaccaaaaagattgtcctgaggctgcagtgccagggttgcaagcatgtctctcaacatcccatcaagaggtgcaagcactttgagattggtggtgacaagaagggaaaaggaacctctctgttttaagtggtatattaggatatgcagtttttatgctgttttgtttctatagtgatttctgttagctatattttgtttttccatgatagccaacctcgcctagtgggattgggataagacttttgttgtttgttattttgcttttttgcaatatattttatgaaaagtgaaaactgctgccagtatcagtggctacttgtttccattccttgaaattgcagtccttatttttatgcttctacatattgccattgtttttggctttccccccattggcattaaaataaacaaatcctcgtg

SEQ ID NO: 3793 - DNA, 713 bp, Cyamopsis tetragonoloba
tacatggactgtattgggaggcttcaaatcgtcatggggaagaatacagggcctgtttgatgggcaagtttcatatgactcatatggtcatgaccttgaccatttcctttttcatgaccatacgagcatgtgaatagtatcagtggaagaaagaggatccaaagcatatgttttgcttccatgtttctgcttgattgtattattttttttctttgcactgctatccaggttccgatcccagtcgcagccatggtgaacgttccaaagacgaagaagacatactgcaagagcaaggaatgcaggaagcacacgctacacaaggttacccaatacaaaaagggtaaagatagcattgctgctcaagggaagcgccgttacgaccgcaaacaatccggttatggtggacaaactaagcctgtcttccacaagaaggctaagaccaccaagaaaattgtgctgaggttgcaatgtcagggttgcaagcatgtctctcaacatccaatcaagaggtgcaaacactttgagattggtggcgacaagaagggcaagggaacctctctgttttagctgttgtactaggatcttcagtttttctgtgttactgtaatgttggaatgttttgttcttctatggatttctgttggctataatttatttttcctaatacattttgtgactgagaagtcaaatctgttgccaatattagtgattac

SEQ ID NO: 3794 - DNA, 504 bp, Cynara scolymus
ggtggttccatcttctttcatcaggcagaccggttcttcggagatctgcagccatggttaatgttcccaagactaagaagacttactgcaagtccaaggactgccgaaagcacaccttgcacaaggtgacacagtataagaagggaaaggatagcttggctgcccaagggaagcgtcgttatgacaggaaacagtcaggttatggtggacaaaccaagcccgtctttcacaagaaggcgaaaaccacgaagaagattgtgctaaggttgcaatgccaagggtgcaagcatgtgtctcagcacccaattaagaggtgcaagcattttgagattggtggagacaagaagggcaagggaacttcacttttctgagctgtgctattttattataaaatagatgttacattttattttttatgtatttggttgtcactttggaacctttgagattggttataattgaaatctgtctgtgttgctgcacaaatggactggactttaacca

SEQ ID NO: 3795 - DNA, 436 bp, Gerbera hybrid cultivar
gatcgtttcgctgaagctcgtccgccatggttaacgttcctaaaacgaagaaaacttactgcaagtcaaaggattgcagaaagcacaccttgcacaaagtgacccaatataagaaggggaaagacagtttggctgcacagggaaagcgtcgttatgatcgaaaacaatcgggttatggtggacaaacaaagcctgtcttccacaagaaggcgaaaacaaccaagaagatcgtgctaaggctgcagtgccaaggatgcaagcatgtgtcccagcacccgatcaagagatgcaagcattttgaaatcggcggagacaagaagggcaagggaacttcgcttttctaagcaaatcacaattgtgtctctgttgcagttatgcaacttttatgaaagttatctttaaacttgcatttcaagtatgtatttgcttgtcttat

SEQ ID NO: 3796 - DNA, 646 bp, Actinidia deliciosa
  misc_feature (18)..(18): n is a, c, g, or t
  misc_feature (30)..(30): n is a, c, g, or t
  misc_feature (175)..(175): n is a, c, g, or t
  misc_feature (328)..(328): n is a, c, g, or t
  misc_feature (536)..(537): n is a, c, g, or t
  misc_feature (584)..(584): n is a, c, g, or t
  misc_feature (598)..(598): n is a, c, g, or t
  misc_feature (620)..(620): n is a, c, g, or t
caagctctcagaaacccnagaccgactctncgacgcagccatggttaacgttccgaaaaccaagaagacctactgcaagtccaaggagtgccgaaagcacaccttgcacaaggttactcaatataagaaggggaaggatagtttggcagtacaagggaagcgccggtatgatcgnaaacaatctggttatggtggacaaacaaaaccagttttccacaagaaggcaaaaactactaagaagattgtgctgaggctgcaatgccagggttgcaaacatgtgtcgcagcacccaatcaagaggtgcaaacattttgagattggtggaganaagaaggggaagggcacttctctattctaagtggcaattaatggataattgctcctgtcttgtcatcatgcagctgttgctgagaccttccagttaaaactttgtttcagttggaatggaactctcttttagttaatagttatttcaaatttctgttgtttttgcagggtgttgtgtgtttctcccaagcatactatttgtttaacgnngattccaaattgagttttgcacttgcttataggaggtttgtcatggntgatgttaaaaagntagctgtaactagctttctcantttaatatgcacttcatctggctttc

SEQ ID NO: 3797 - DNA, 619 bp, Actinidia deliciosa
ataaaagccacctcttcagagttcgggtcaagctctcagaaaccctagaccgacaccgcgacgcagccatggttaacgttccaaaaaccaagaaaacctactgcaagtccaaggagtgccgaaagcacaccttgcacaaggttactcaatataagaaggggaaggatagtttggcagtacaagggaagcgccggtatgataggaaacagtctggttatggtggacaaacaaaaccagttttccacaagaaggcaaaaactactaagaagattgtgctgaggctgcaatgccagggttgcaaacatgtgtcgcagcacccaatcaagaggtgcaagcattttgaaattggtggagataagaaggggaagggcacttctctattctaaatagcaattagtggataattgcgtctgtcatcctgcagctgttgctgagaccttccagttaaactttgtttcagttggaatggaactctcttttagatttatgttgtttttgcaggatgtgatatgttttccccaagcatactatttgttaatgcggattcgaaattgagttttgcacttgcttatgagggcatcttagccggaactagctttctcactttaaaaaaaaaaaa

SEQ ID NO: 3798 - DNA, 501 bp, Lactuca sativa
tctctcatcctgcagatcggttctccggagatccttagccatggtgaatgttcccaaaactaagaagacttactgcaagtcaaaggactgcagaaagcacacattgcataaggtgacgcaatacaagaagggaaaagacagtttggctgctcaaggaaagcgtcgttatgacaggaagcagtctggttatggtggacaaaccaagcctgtctttcacaagaaggcaaaaaccactaagaagattgtgttgaggttgcaatgccaagggtgtaagcatgtgtcccaacacccaatcaagagatgcaagcattttgaaattggtggagacaagaagggcaagggaacttctcttttctaagcattttattattattattattatgtgttgttattttgataaaatgattagacctttagatatgctacaactcctttatgtttttatgcaagtatgtgtttggttatttactattatctactttagttatttttgaatatttg

SEQ ID NO: 3799 - DNA, 516 bp, Lactuca sativa
ggggggttccatctctcatcctgcagatcggttctccggagatcctcagccatggtgaatgttcccaaaactaagaagacttactgcaagtcaaaggactgcagaaagcacacattgcataaggtgacgcaatacaagaagggaaaagacagtttggctgctcaagggaagcgtcgttatgacaggaaacaatctggttatggtggacaaaccaagcctgtctttcacaagaaggcaaaaaccactaagaagattgtgttgaggttgcaatgccaagggtgtaagcatgtgtctcaacacccaatcaagaggtgcaagcattttgaaattggtggagacaagaagggcaagggaacttctcttttctaagcattttattattattttgtgttattttgataaaatgtttagacttttagatgctacaactcctttatgtttttatgcgagtatgtgtttggtttttattgtatgggttatttgctatttcctattttaatcattcttaaatatttc

SEQ ID NO: 3800 - DNA, 558 bp, Glycyrrhiza uralensis
gcactgcattttcgcggcgcacaccacaaacactgcctcttcagattccgatccaacacgcgccgtcaccatggtgaacgttccaaagacgaagaagacatactgcaagagcaaggaatgcaggaagcacacactgcacaaggttacccaatacaagaagggtaaggatagcattgctgctcaagggaagcgccgttacgatcgcaaacagtccggttatggtggacagactaagcccgttttccataagaaggcaaaaaccactaagaaaattgtcctgaggctgcaatgccagggttgcaaacatgtctcccaacatcctatcaagaggtgcaagcactttgagattggtggagacaagaagggcaagggaacctctctgttctaggtggagaattttaggatttgcagtttttatgttttttccccaatgttggaatgtgttgtttctgtatggatttctggtagctatattttatttttttgaaataccttttgtgattgagaagtgaaaaccgaaaactattgccaatatcagtgactccttgcttttcactc

SEQ ID NO: 3801 - DNA, 559 bp, Glycyrrhiza uralensis
ggaggatgagcatttaaccctaaatttcccaaggcatcgtgctttcctgcttcactcttcatttttctctcatctcggtcgatctcactgccgcaatggtgaacgttccgaagacaaagaagacatactgcaagagcaaggaatgcaggaagcacaccctgcacaaggtgactcaatacaagaagggtaaggatagcatcgccgctcagggtaagcgccgttatgaccgcaaacagtccggttatggtggtcagaccaagcctgtcttccacaagaaggcaaaaaccaccaagaaaattgtcttgaggctgcagtgccagggttgcaaacatgtctctcaacatcctatcaagaggtgcaagcactttgagattggtggtgataagaaggggaaaggaacatctctgttctaggtggactactagagttttgcagtttcactctgtttttgcacccatttagcttgccattgttggccttctgaattttgcttaaatacttttgtgtttgacaactgttctaattaatatcaatggacggcttctttcttcctttcctc

SEQ ID NO: 3802 - DNA, 503 bp, Orobanche aegyptiaca
ggtgaacgttccaaagacaaagaagactttttgcaaatcaaagcagtgcaagaagcacaccttgcacaaggtcacccaatacaagaagggtaaagacagcttagccgctcaggggaaacgccggtatgacaggaagcagtctggttatggtggtcagaccaagcctgttttccacaagaaggcaaaaacaactaagaagattgtgctgaggttgcaatgccaaggttgcaaacatgtttctcagcatgctatcaagaggtgcaagcattttgagattggtggagacaagaagggcaagggaacttcacttttttgagtgtttacaaaattggaaattgcaacttgttagtttttgccttttattattgggagtttactttgacattgtcctttgttgttattgctactagatatttagattgaatgttgaactttcaatttaatcgactcagttttgtgtcactctgcatcggatcaagtatttgaatgcattttctcctttt

SEQ ID NO: 3803 - DNA, 655 bp, Arachis hypogaea
gtacgggggattttcgcggcgcacagcactctctctgcacaatccgatcccacacacagcgccaccatggtgaacgttccaaagacaaagaagacctactgcaagagcaaggaatgcaggaagcacacactgcacaaggttacccaatacaagaagggtaaggatagcattgctgctcaaggaaagcgtcgttatgatcgcaaacagtccggttatggtggtcagactaagcccgtcttccacaagaaggcaaaaaccaccaagaagattgtcctgaggctgcaatgccagggttgcaagcatgtgtctcaacatccaattaagaggtgcaagcactttgagattggtggtgacaagaagggaaagggaacctctctgttctaggcaggagtattaggatttgcagttgtactgtttttgaagtatctgaatgttttgtttctctatggatttctcctagttatattttcattttgcaagaccttttttgtgagggagatgtgaaaagtgttactaatattagtgatctcttgtttccattttttgaatgattacaatattcatctttttatactccttttcaaatccctgcctttctatgtgattatgcctttatctaatttaattaaatgagtgccacaatgaatggatccta

SEQ ID NO: 3804 - DNA, 715 bp, Arachis hypogaea
aagcaccgttcttcgcttccaattttcgcaggtgcagagctccacacgagtgttacgatcccctgcaacagcttcaccaccgccgctaccatggtgaacgttccgaagacaaagaagacgtactgcaagagcaaggagtgcaggaagcacactcttcacaaggttacccaatacaagaagggcaaggatagcatcgccgctcagggtaagcgccgttatgaccgcaagcaatccggttatggtggccagaccaagcccgtcttccacaaaaaggccaagaccaccaagaaaattgtgttgaggcttcaatgccagggctgcaaacatgtctcccagcatcctattaagagatgcaagcactttgagattggtggtgacaagaagggaaaaggaacttccctcttctaatttcattgctccagtttgctgtttcatcttattttgttttttatcctttgctatttgcagcattttctttttgccagtgttaagttcttaaaagtctgaagatctgttagctatacttaaattttgtacgttgcgtttgagaagtattctaatatcaatgactagtatcctttgttttcttggccgtacatttgtattttgtctggtacgcgatgcatggccgtattttgatggtatactttttaaatctgcataatgcataaggtgcttagcagttaaatgatgagaataaatgtttcatttgaag

SEQ ID NO: 3805 - DNA, 493 bp, Petunia hybrida
tgaacgtaccaaagacaaagaagacctactgcaaatctaaggagtgtaaaaagcacaccttgcataaggtcacacaatacaagaaaggaaaagatagtctagccgcccagggaaagcgtcgttatgatcgcaagcagtcaggttatggtggccagacaaagcctgtcttccacaaaaaggcaaaaactacaaagaagattgttttgaggttgcaatgccagggttgcaagcacgtttcgcagcacccaatcaagaggtgcaagcattttgagattggcggggacaagaaaggaaaaggaacctctcttttctaaattgctgttgaagcaaaatgcgacatgcaaaatatttctgttatacatttttcttttgggtgtagttcaaggattcgtgctctctaaaagagattctatgttctgttgactgattacgagatcaaaatttgtattcctcaagattctatttagtaagataactgctttcttattatgtt

SEQ ID NO: 3806 - DNA, 592 bp, Cajanus cajan
gcagaaagaagacactaaaccccacacaccgtgcctccgccttagctctctgatctcatagacgcaatggtgaacgttccgaagacaaagaagacatactgcaagagcaaggagtgcaggaagcacacgctccacaaggtcacccaatacaagaagggtaaggacagcatcgccgctcagggaaaacgccgttatgaccgcaaacagtccggttacggtggacagactaagcccgttttccacaaaaaggcgaaaaccaccaagaaaatcgtgttgaggctgcagtgccagggttgcaagcacgtttcccagcatccaatcaagaggtgcaagcactttgagatcggtggtgacaagaagggaaaaggaacctctctcttctagatggaatagtagaattctctatttcaaactttctctccctctctctctattctcttttcttattttgtttgccttgcttggcttttgattttgctcaagtgtttgcgtttgaggatattagagtttacagtttcaatttgtttcagaactcttaatctgttatagtgtcaatgactaatttatttcttccttagaaaaaaaaaaaaaa

SEQ ID NO: 3807 - DNA, 678 bp, Cajanus cajan
atgcttagttggatttgggccaacccagagaaagagaaagggaaaaaagcccaacatagagaaagagaaagagaaaaggcatttaactaaccctaattcgcagaaagaagacactaaaccccacacaccgtgcctccgccttagctctctgatctcatagacgcaatggtgaacgttccgaagacaaagaagacatactgcaagagcaaggagtgcaggaagcacacgctccacaaggtcacccaatacaagaagggtaaggacagcatcgccgctcagggaaaacgccgttatgaccgcaaacagtccggttacggtggacagactaagcccgttttccacaaaaaggcgaaaaccaccaagaaaatcgtgttgaggctgcagtgccagggttgcaagcacgtttcccagcatccaatcaagaggtgcaagcactttgagatcggtggtgacaagaagggaaaaggaacctctctcttctagatggaatagtagaattctctatttcaaactttctctccctctctctctattctcttttcttattttgtttgccttgcttggcttttgattttgctcaagtgtttgcgtttgaggatattagagtttacagtttcaatttgtttcagaactcttaatctgttatagtgtcaatgactaatttatttcttccttgaa

SEQ ID NO: 3808 - DNA, 671 bp, Primula obconica
tgaagcatttttctttcacatccgttgcggctttgctatctcaggggggcatcatggtgaacgttccaaaaacgaagaagacttactgcaagtcgaaggaatgtcgcaaacacaccttacacaaggttacccaatacaaaaagggtaaggacagtttggctgtccaaggaaaacgtcgttatgatcgcaagcaatctggttatggtggacaaacaaagcctgttttccacaaaaaggccaaaactacgaaaaaaattgtgctgaggctgcagtgccagggctgcaaacacatgtcccagcatccaatcaagaggtgcaagcattttgagattggaggagataagaaagggaaggggacttcgctgttttaatttggaatatctggtgaactgcatgtgtaccctttgtgcctcagtgtttgcttattttcaaactaagtttttgatttcatgacgtttatttcgttgtagacttaaattttgtttgtgggattttcaatcttattggacaacttgttaaattaagtatctcactcttcaattatgtgaatccaacttgtttgctttagagatttctctgtctacaaaagagtaacactatttacacaaatcagtgtacggaacatacatttgtacacgttgtttggctggcagtaggcattacatcgatta

SEQ ID NO: 3809 - DNA, 602 bp, Primula obconica
atatatctctttctctcttataataattctgcagaagagtttacttgctgcggctgttatttctttgtagaccaatccttcaggcatcatggtgaacgttccaaaaacaaagaagacttactgcaagtccaaggaatgccgcaagcataccttgcacaaggtgacccaatacaaaaagggtaaggatagtttggctgtacaaggaaagcgtcgctatgatcgcaaacaatctggttatggtggtcagactaagcctgttttccacaaaaaggccaaaactaccaaaaagattgtgctgaggttgcaatgccagggttgcaagcatatgtcccagcatccgatcaagagatgcaaacattttgaaattggtggagacaagaaaggcaagggaacctctcttttctagattcgagtttctggtgatttggatatttactttttctgggcttgtgttggttattttctaattaagttgaacttttggttttcttattctcttttggttgtagacttggtttattgtgggatttgtaatcttaccagacaacttcttatgataagtatctcagttttaaggttgtttgaactcaacttatgtgctc

SEQ ID NO: 3810 - DNA, 530 bp, Raphanus sativus
gggacgacgacggcacaagcttccctcaaggtcagacgagcgaaaatggtgaacattccaaagacaaagaagacatactgcaagaacaaggaatgtaagaagcatacgttgcacaaggtgacccaatacaagaaaggtaaagacattctcgctgctcaaggaaagcgtcgttacgaccgtaagcaatctggttacggtggtcagactaagcctgtcttccacaagaaggctaagaccacgaagaagattgtcttgaggcttcagtgccaaacctgcaaacacttttctcagcactcgatcaagaggtgcaagcattttgagatcggtggagccaagaaggggaagggaacatcgcttttctaagttggtcttgtcttaacttttttttttgcaaggttttgttacttgtgtcggatcatgatccccatctgttttagaatcttccattgcccaaatttaaaatttcaaactatgcatgtaaaagtgaaatactttttcagatgttctttgctctatgatgtcattgttta

SEQ ID NO: 3811 - DNA, 554 bp, Carthamus tinctorius
gcggggacgatctgcggctggtccatctcgtcgtctctcgactttcaggagctcttcagccatggtgaacgttcccaagacgaagaagacttactgcaagtccaaggattgccgaaagcatactttgcataaggtaacacagtataagaagggaaaggatagtttggctgcacaaggaaagcgtcgttatgacaggaaacagtccggttatggtggtcagacaaagcctgtgtttcacaagaaggcaaagaccacgaagaagattgtgctaaggctgcaatgccaagggtgcaagcatgtgtcccagcacccgattaagaggtgcaagcattttgagattggtggagacaagaagggcaagggaacatctcttttttagaggggatatgtgtaatttagttgcagttattcatttttcaattttggtagactttgagagatctacaatgaaagaggcttctttgctttgacacatgtggcttgacttgtaacttagtgaaggaaatgggaaacttttccagttaataatttctacttgcagatgtggtttcatt

SEQ ID NO: 3812 - DNA, 460 bp, Sarracenia psittacina
gtatttgaatcccagtcgcagtcatggtcaacgttccaaagaccaagaagacctactgcaagtccaaggagtgccgaaagcacaccttgcataaggttactcaatataagaaggggaaggatagtttggcagtacaaggcaagcgccgctatgatcggaaacaatctggttatggtgggcaaacaaaacctgtcttccacaagaaggcaaaaactacaaaaaagattgtcttgaggctgcaatgccagggttgcaaacatgtgtctcagcacccaatcaagaggtgcaaacattttgagattggaggagataagaaggggaagggcacttctctcttctaactggccattgatggaaatttcttgtcccatcttcatgcagctgcgaaaacctttcaattaatctattttagttggaagtaactctttatgttatgatttgtagttttgtgtttctattg

SEQ ID NO: 3813 - DNA, 770 bp, Sarracenia psittacina
ccctgctcactgccttcgctgacggagctttcggaaaccctgactcaagaccgactctgcgacgcaaccatggttaacgttccaaagactaagaagacctactgcaaatccaaggagtgccgaaagcacaccttgcataaggttactcaatacaagaaggggaaggatagtttggcagtacaaggcaagcgccggtatgatcggaaacaatctggttatggtggacaaacaaaaccagttttccacaagaaggcaaaaactactaaaaagattgtgctgaggctgcaatgccagggttgcaaacatgtgtcgcagcacccaatcaagaggtgcaaacattttgagattggaggagataagaaggggaagggcacttctctattctaactagctattgatgagaaattgcttgtcctctcttcatgcggttgccaaaacgttccaagtaaaacctttttagtgggaatataaccctcgtgttatgattttgagttttgtgtatttcattttcctcctagtattgctgcactatgaggttcctagttgacctgttcactttcttagatattttttttatggaaatgttcaatttttcctagttgatctgttcactatggagttaatgttttcccagtattgctgcactattaagtcattgccattgttaggcatgtaaatcttgtggctttgaaaggatattgcaccacgaccactctggaaggccaccggaggataattgtgtgatttgataaggaatggtaggcttcact

SEQ ID NO: 3814 - DNA, 603 bp, Taxus baccata
ctggagaggagactaccgagagcggcgggcgaagcagagtgtgtcgaaaacaaatcagaagcaatggtgaacgttccaaaaacaaagaaaactttttgcagaaataaagcatgcaaaaagcacactttgcacaaggttactcagtacaagaaaggaaaggacagtcttgctgtccaaggaaaacgacggtatgatcgaaaacaatcaggttatggaggtcaaacaaaacctgtctttcacaagaaggcaaagacaacaaagaagattgtgttgaggctgcaatgccagtcttgcaaacatgtttcacagcatccaatcaagcgttgcaaacattttgagatcggtggagataagaaggggaagggaacatcccttttctagagatgcagttttgttctggctgtgctcaaaacattttatattgtttgtatttacagatacttatttgtctgagacaacagatctgttttgaaaatgaatgttaccatttagatacctatggaagccatctatttaagataccatttagtattcattttatgattttaatgtaggcaactttggatttttatttgctttgacataggagggatgaattttttg

SEQ ID NO: 3815 - DNA, 570 bp, Camellia sinensis
ttcgagcggccggcccggcaggtcaaaccctagtcttcgcagccgagtctgtaacctactgtagcgatggtgaacgttccaaagacaaagaagacttactgcaagtcgaaggattgtcggaaacacaccttgcataaggtaacacaatataaaaagggcaaggatagtttggctgcacaaggcaagcgccgttacgatcgaaaacaatcaggttatggtggacagactaaacctgttttccacaaaaaggcaaaaactacaaaaaagattgtgctgaggctgcaatgccagggttgcaaacatgtatcccagcacccaatcaagcgttgcaaacattttgagatcggtggagataagaaggggaagggaacttctctcttctaaattgctgttcatggaaaattgcttgtcgtttggttgcagcgctaaataactttacatttcggttcagttaaacttcatgtagacggaattcatgtgttttttggttgttgactttgttgttatgctgtttggtttggaatttcagattttattcgagtaccagacatatcaattgctgataaaaaa

SEQ ID NO: 3816 - DNA, 554 bp, Vinca minor
agcccctctacagccgcagcatctctcgtgccgtcaacaatggttaacgttccgaagacaaagaagacctactgcaaatcaaaggagtgcaaaaagcacaccttgcacaaggttacccaatacaagaagggtaaggatagccttgcagttcaggggaagcgtcgttatgaccgcaagcagtctggttatggtggacagactaaacccgtcttccacaagaaggcaaaaaccacaaagaagattgtcctgaggctccaatgtcaaggttgcaagcatgtctcgcagcacccaattaagaggtgcaagcattttgagattggtggagacaagaagggaaagggaacccaacttttctaagaaactgggcatcaatgttcaagtgctgttttccctcatgttttagttttatatatgctttcgaaattaactgtaatcgaagaccattttatcagtgggactttgagttgttttcttttcttctagaattcctatgtccctctttgcagttttgtcttaatcctaaaatgaccttgttgtttattgggtaacttcta

SEQ ID NO: 3817 - DNA, 604 bp, Juglans hindsii x Juglans regia
  misc_feature (365)..(365): n is a, c, g, or t
  misc_feature (411)..(411): n is a, c, g, or t
gtcgccatggtgaacgtacctaagacaaagaaaacatactgtaagagcaaggagtgcaggaagcacaccttgcataaggttacacagtacaagaagggcaaggatagtcttgctgttcagggcaagcgccgttatgaccgcaagcaatctggttatggaggacagaccaagcccgttttccacaaaaaggccaagactaccaagaagattgtgctgaggttgcagtgccagggttgcaagcatgtttcccagcacccaattaagaggtgcaagcattttgagattggtggagacaagaaggggaaggggacttctcttttctaaatgcaattttttcggtcttattgtatgctgttttgcttttntaccttgttggagcttgaaagctaaaaatatcggattatttttaanttagttttgttagtctaatggcgccttgaagctaaacttaaacgcatatgatatttggcgtggttagagattaaagctgataatcatctttgctggtgtggttaccatttcatgtgttgtatccgacgcagttagattgattagtttttttatccttggtttgtcaattttcatcgtaacgtatggtttggtc

SEQ ID NO: 3818 - DNA, 551 bp, Juglans hindsii x Juglans regia
gggggttcacctccgagggttttcttgagtagctctgaccacaactagtagccatggtgaacgttcctaagacaaagaaaacatactgtaagagcaaggagtgtaggaagcacaccttgcacaaggttacacagtacaagaagggcaaggatagccttgctgttcaaggaaagcgccgctatgaccgtaaacaatctggttatggaggacagaccaaacctgtcttccacaaaaaggccaagactaccaagaagattgtgctgaggttgcagtgccagggttgcaagcatgtttcccagcatccaattaagaggtgcaagcattttgagatcggtggcgacaagaaggggaaggggacttctcttttctaaatgcattcttctgtttttttgtatttttggcttccaatgttggaccatgaagctaaaatcttggatttttttgttgagttttactttttgttaatctaatggcgtcttgtagcaaccatcaaattgtttcttgtccctgtttatgatagctgttgtggttagagattaaatttgatgacc

SEQ ID NO: 3819 - DNA, 785 bp, Cajanus cajan
gtccagcccattcttgcttgtttccttgtaaccctaaaccccaaagccattaaaacgcagagcattgtcattcgtagcttcattttcgcggcgcacaacaaaaccgtgcttcttcagattccgatcgcacgcgccgtcaccatggtgaacgtaccaaagacgaagaagacgtactgcaagagcaaggagtgcaggaagcacactctgcacaaggttacccaatataagaagggtaaggatagcattgctgcacagggaaaacgtcgttatgatcgcaaacaatctggttatggtggacaaactaagcctgtcttccacaagaaggctaagaccaccaagaagattgtcctgaggttgcaatgccagggttgcaaacatgtctcccaacaccctattaagagatgcaagcactttgagattggtggtgacaagaagggcaagggaacatctctgttttaggttgagaactaggagttgcagctttttatatttccgcaatgttggaatgttttgtttctatgaggatttttctgctagttatatcttattatttgcaatacattatgtgatttgagaaatgaaaactattgctaatatcagtgagtacttgtttcccttccttcaatggtcagccatgtctattttataccttgatactactctattgttcctgggttacctagttatttggggcgttttaggtatgctcccttgtctcttggctgcactttgttgttgctgttcttagattagaataatcagtggaaaatacaattagaaagctg

SEQ ID NO: 3820 - DNA, 578 bp, Vigna unguiculata
cagaaccctacttcttcagattccgatcgcacgcgccgtcactatggtgaacgttccaaaaacgaagaagacttactgcaagagtaaggagtgcaggaagcacactctgcacaaggttacccaatacaagaagggtaaggatagcattgctgctcagggaaagcgccgttatgatcgcaaacaatccggttatggtggacagactaagcctgttttccacaagaaggctaagaccaccaagaagattgtcttgaggttgcaatgtcagggttgcaaacatgtctcccaacacccaattaagaggtgcaagcactttgagattggtggtgacaagaagggcaagggaacatctcttttctaggttgagaattaggatttgcagcttttgtgtttctgcaatgttggaatgttttgtttctctgtggatttatttgctagttatatttattatttcgcaataccttattatgtgatcgagaaatgaaaactatcactgatattagtgagtatttgtttgccttctcttgattatctcttatggtagccttcatctattcgtccgtaaaaaaaaaaaaaaa

SEQ ID NO: 3821 - DNA, 1676 bp, Centaurea maculosa
ctacgtaagaggagatatggacacttttccacatgtacctcccggcttcggttccatcccaccgatgaagaacttgttgattactatcttaggaaaaagatcaactcaagaaggattgacctagatgtcatcagagatatcgatctttacaaaatcgagccatgggatcttcaagagctatgcaggctaggtaccgaagagcaaaatgaatggtattctttagtcataaagataagaaatatccaacagggactcgaaccaatagagctacaacggcaggattttggaaggctacaggaagagataaggcgatttacgcgaagaacgacttggttgggatgagaaagacattggtattttataaaggccgtgctcccaatggacaaaaatcagactggataatgcatgaatatcgccttgaatccgatgaaaatgcaaccacaactcaggaagaagggtgggtggtatgtagggttttcaagaaaaggctacccacaatgagaagagcaagtgatcatgaatcacctatttggtatgatgatcaagtctcattcatgccagacattgactcaccaaatcagaacaataactctcaatcccacttggttaaccatggttaccaatacccttatggtgcttgcaagaaagaactagatcaactgcaaaattaccagattacccctgatcacttcctccaactccctcttttagagtctccaaaactgctccccacctgcaatccttccatgcccatttatggtattaacataaaccaagctggaaatatcaactatcagccatcctcactcacacaaaaccaaaacaacaacatccatcaaaatcaagatcaaaatgtcaacaatcaggtgaccgattggcgagttctagacaagtttgtggcatcacagttacttagccaaggtgatgtttcaattaaagaaaatgatcattatgcaaatattgaagacaacagtcccatcttccagtcaaatgaagatcatgatacatcaaattctgagctgatgattacacatctgaacaagcaagacacgaaaggtccacggtgccagaagatgcctcgaattccatctccagttgtcacatagattttgaacaatgaacgaagatttacgcaaagccggagaacaagaactagagcccatggatcatgcagccatatataagtgacaatcaggcagtttggttctccggagatctgcagccatggttaatgttccgaagactaagaagacttactgcaagtccaaggactgccgaaagcacaccttgcacaaggtgacccaatacaagaagggaaaagatagcttggctgcccaagggaagcgtcgttatgacaggaaacagtcaggttatggtggacagaccaagcccgtctttcacaagaaggcaaaaaccacgaagaagatcgtgctaaggttgcaatgccaaggctgcaagcatgtgtctcagcacccaatcaagaggtgcaagcattttgagattggtggagacaagaagggcaagggaacttcacttttctaagcaattattatcaattatattgtgttatgttttagactttttattataatagatgttacctctttacttttatgcattctcacctttagctttctgttgtatgaagtgaacattgtgttctgtgatttttggaa

SEQ ID NO: 3822 - DNA, 638 bp, Citrullus lanatus
atggtaatcttccttccattgttctttgctgtttgtctggattttcttcctgttaatgcttctatgctgtgtttggtgaacgttcccaagacgaagaagacttactgcaagagcaaggaatgcagaaagcataccttgcacaaggttacccaatacaaaaagggtaaggatagtcttgctgctcaaggaaagcgtcgttatgatcgtaaacaatcaggatatggaggacagaccaagcctgtctttcataagaaggccaaaactacaaaaaagattgtgctaaggttgcaatgccagggttgcaagcacgtctcacagcatcccattaagagatgcaagcattttgagattggtggagacaagaagggaaagggaacttctcttttttagatggattaacattgtccttcactatatattgctgtttagggagtcagaattgtggggttcttctgccctttgctttttgtttggtgtttctgatatttgggaacatttttacctgttgaattttgtttaatgtatcagtttataatggaacaactagcttatcctctacctaatttctgtttatcactttgtttgatatccactcttcattcttcgctgatatgatgccgaattgttttttacttgtt

SEQ ID NO: 3823 - DNA, 1252 bp, Cichorium intybus
cggggatgcgctgtgcggctgtcctcccatctttctcccgttcatctttcaggagctctccagccatggttaacgttcctaagacaaagaagacttactgcagaacaaagattgcagaaagcataccttacataaggtgacacaatacaagaagggaaaagatagtttggctgcacaaggaaaacgtcgttatgacaggaagcaatctggttatggtggtcagacaaagcctgtctttcacaagaaggcaaaaaccacaaagaagattgttttgaggttgcagtgtcaaggttgcaagcatgtctcacagcacccaattaagagatgcaagcattttgaaattggtggagacaagaagggcaagggaacttctcttttctgagcaattattacatgtaattttagtttcagttttttatattattgttttgggtaagagtcttttttatttaaaagtctttgaatttttacaatctaagtgattactttgctattgaaatatttggttggactccaacaaaccttccggaaacaaaattccaaccatgcaggaagtccatgtggaaaccggtgaggaaaacgagaaggcggttttcactgcggattccgttctttttgagttccttgacagcgggtggaaggaacgcgggaaaggggaactgaaagtcaacgtgttgaccaccgggacgaaaaaagcgagacttgtgatgagggcacgcgggaattatcggttgattttaaacgcgagtatttttccagacatgaagctgacaaatatggagaaaaaagggatcacgtttgcgtgtttgaacagtacgggggaaggacaaaatggtctttcgacgtttgcgttgaagttcaaagacgcgtccattgttgacgagttccgttcggttgttacagaacataaagggaacaccggtgctaccgcggcgctcaagacacctgaaaattccccaaaagcatcggatgagtaaggtaaaaattaaaaatcatgtttttatgttgaatcctgtaggtttattgtagcaagagtcttttatgtaaaagctgttatatcgtacccattttgttgttatcttttgatagacatttgtgagaggctaaaatccagagtcttaaatgttataaatagttttgatctcatgctcgtgtttgggactcgagtctcaacaacatgagcaaacagagttgggtcgtcaggtcgaatgttttcaaggcacattgtgctaattggccttttcaattgtct

SEQ ID NO: 3824 - DNA, 1773 bp, Cirsium arvense
gcgggtccttttgcttgtctggaaggatagcaggctagtacctttttttgtatctgggttaccactcatttccttcctgtcttcccacatcttctacaagttcatacccctagggtttgatttcaaaaacaccaattcatcatggacgtagaattacacgattgggaggttctccccaattcagaggactccacctcccttcagaataccagctatttggagggaatcgaacgcgactctgaaggtataatacgatctgattatttctctcttgattctcgcaacaagtatgccggaacgcaggttgaagacgttactgacggtatttccgttgaatcggacaatcctagttggattgatcccgtatgtgacactcgttattcgacaaccaaggagatgggggagttttggagcaccgatggttcttctgatgatggcaagtatgttgaatcggaagccaataacaaggaactggatattgttgaaactggaacaaggcaagtggcttatgatggaagtgcatctgttgagatggacaaatcgtggtctgattcgggcgaaattggatctaaaccaacaaaatatgaaaatatggatgtggatagatatgatgatgatttgaagatccatgaggaatcggagccttcaggtgaacagaagatcatgcaagcaagaggccaaggagagaatgaagatgtgttgatagaaactatgaaagcagatggtgaagaaaggaacagggtagcggtctggtggaagcttccattcgatttgttgaaatattgtttatttaaggctagccctgtatggactctctctgttgcagctgcaatgatgggtgttgtaattttgggacggagattgtataaaatgaagcgaaagagcagaactttgcagcttaaggtcacggtggatgataagaaggtatctcagtttatgagccgggctgcacgactcaatgaagcattctcagtagtgaaacggggtcccatcattcggccatctttgccagctggtgggactgggattgcaccctggcccatgatggctttaagatgaaagtaaatggttggaaaataggtaaacatatggatatggtgtggttctactataatgcttttgtaatggctgtgtaatataaagctttgcattaagttgccctgtgactattgtatgtaacattccaatactatgtgtgatctttgaccattatgtggtcctgtaatagttaaaatcatgagctcttttttgactcaaaaacagatttccattgcttttaaacagtagctagttcagttttaaaaaaaaagacgcaaaatctgcaaaactccataacataattgtaaacatgaaacagacaaaatattgcataatagctgtgaaatccagatacaactgcttccttagaaaagagaggttcccttgcccttcttgtctccaccaatctcaaaatgcttgcacctcttgattgggtgctgggaaacatgcttgcacccttggcattgcaaccttagcacaatcttcttggtggttttagccttcttgtgaaacacaggttttgtctgaccaccataacctgattgttttcggtcataacgacgcttcccttgtgcagccaagctatcttttcctttcttatattgtgtcaccttatgcaatgtgtgctttctgcagtcctttgacttgcagtaagtcttctttgtctttgggacgttaaccatggcggacgagctgcagagagcggaggtgatgacagggaagaggctttctttt

SEQ ID NO: 3825 - DNA, 507 bp, Silene vulgaris
ctcgattttcgtcaccatggtgaatgttcccaagttgaagaagacatactgcaagaacaaggaatgcaggaagcacacacagcacaaaggtgacccaatacaagaagggtaaggacagtttggctgactcaagggaagaggcgttatgaccgtaagcagtcaggatatggtggtcagactaagcctgtcttccacaagaaggctaagacaactaagaagattgtgttgaggctacaatgccagtcatgcaagcatgtttcccaacatccgatcaagaggtgcaagcactttgaaattggtggagacaagaagggcaagggtacatcactcttttaattgctctggaaggttgttcggtttttgttttcgtctccttttcatgtcttttcatgtccaagatacttgtttaagcttgaacaatttaattgttggattttggttagtgctagctgatctttccgattttggtactcgttcgtaagttcgtatctatgaaatgtgtggctg

SEQ ID NO: 3826 - DNA, 484 bp, Vaccinium corymbosum
cccacctccagaaaccctaaaactctgtggcatccttcttcgaccgcagcaatggtgaatgttccaaagacaaagaagacatactgcaagtcgaaggaatgccgaaagcacaccttgcataaggtaactcaatacaaaaagggaaagatagtttggctgtgcaaggcaagcgccgttacgatcggaaacaatcagggtatggcgggcaaactaagcctgttttccacaagaaggctaaaactacaaaaaagattgtgctgaggctgcaatgccagggctgcaaacatgtatcccagcacccaatcaagaggtgcaaacactttgaaattggtggagataagaaagggaaggggacttctcttttctaaatgatactttgtggagaactgcacttgcactctcactacagtgctaagtagctcgcaatttcagttggtaactttttgattttgttttgttcatgtttaaagatactatggttgtg

SEQ ID NO: 3827 - DNA, 713 bp, Catharanthus roseus
ctctttctatcaatctcctgcagcggcgcgctcttccgccctttctctctaccggcaagtgacaccactctctctccctccctctgagcgaaaatggttaacgttcctaaaacaaagaagacttattgcaagtctaaggagtgcaaaaagcacaccttgcacaaggttacccaatacaagaagggaaaagatagtttggctgctcaaggaaagcgccgttatgaccgcaagcagtcaggttatggtggtcagaccaaacctgtgtttcacaagaaggcaaaaaccacaaagaagattgtgttgaggcttcaatgccagggttgcaaacatgtatcacagcaccctattaagaggtgcaagcattttgagattggaggagataagaagggaaagggaactccctttttaagaagctgggcactggttttcaattgctgttttatctgtgttacattctatttttttatgtttgttcatctagatcaaatgactgacagatgtttatggcagaatgaatcttcagatttttatttttattgagttttcgctctatggtttctaattgcattcaatatttgtgttaaacttaatttaattagcttctgtagattgaatgccatcatttcttgttagttgtccatagatgaagatgaatttcttttgtaccaagattgggttaagtgtcaagaaaaacttggtattctcctcgtgcc

SEQ ID NO: 3828 - DNA, 490 bp, Vigna unguiculata
  misc_feature (84)..(84): n is a, c, g, or t
  misc_feature (101)..(101): n is a, c, g, or t
  misc_feature (385)..(385): n is a, c, g, or t
  misc_feature (391)..(391): n is a, c, g, or t
  misc_feature (427)..(427): n is a, c, g, or t
gttttcgcggcgcacatcaaaaccctacttcttcagattccggtcgcacgcgccgtcacgatggtaaacgttccaaaaacgaanaagacttactgcaagantaaggagtgcaggaagcacactctgcacaaggttacccaatacaagaagggtaaggatagcatcgcctgctcaggggaaacgccgttacgatcgcaaacaatccggttatggtggacaaactaagcctgttttccacaagaaggccaaaaccaccaagaaaattgtcttgaggttgcaatgtcagggttgcaagcatgtttcccaacacccaattaagaggtgcaagcactttgaaattggtggtgacaagaagggcaagggaacttctcttttctaggttganaattangattttcagccttttgtgtttctgcaatgttggaangttttgtttctgtgtggatttatttgctagttatatttattatttcgcaatacccttattatg

SEQ ID NO: 3829 - DNA, 364 bp, Flaveria ramosissima
tgtgcggctgtcaatctcatctctttcggtcgattttcaggggctcttcaaccatggttaacgttcctaagaccaagaagacttactgcaagaacaaggaatgccgaaagcataccttgcataaggtgacgcagtacaagaagggtaaagacagcttggctgcacagggaaagcgtcgttatgacaggaaacaatctggttatggtggtcaaaccaagccagtgtttcacaagaaggcaaaaaccaccaagaagattgtgctaaggttgcaatgccaaggctgcaagcatgtctcccagcaccaatcaagagatgcaagcatttgaaattggtggagataagaaggcaagggacatctctcttt

SEQ ID NO: 3830 - DNA, 473 bp, Fraxinus spp
ggtcgtcagacggccgggggaagacggtattttgcggatctgtgtttccacttaatcgttgctctcgaccgcaacaatggtgaacgttccaaagacgaagaagacctactgcaaatccaaggagtgcagaaagcacaccttgcataaggttacacagtataagaaggggaaggatagtttagctgtccaaggtaaaagacgttatgatcgcaagcagtcaggttatggtggacagacaaagcctgtcttccacaagaaggcaaaaacaacaaagaagattgtgctaaggttgcaatgccagggctgcaagcatgtatcccagcatccaattaagagtgcaagcattttgagattggtggagacaagaaaggaaagggaacctctcttttctaggcgtgctttcaaggaactgaaatgtctttacgtgttttgttatgttaagtttacatctagctagacctaatttaactaaa

SEQ ID NO: 3831 - DNA, 612 bp, Gnetum gnemon
gctacgcaagggaacgaggaagaggaagaatcgtgactggagtgcagcgagtcgattagagtcaaaatggtgaacgtaccgaagacgaagaaaacttttttcaaaaccaaggcttgcagaaagcatacattgcacaaagtaacgcagtacaagaaggggaaggacagtctcgccgtccagggaaagaggcgttatgacaggaagcagtctgggtatggaggtcaaacaaagcctgtcttccataagaaggcaaaaactacaaagaaaattagtgctgaagctgcagtgccaatcttgcaaacacgtctctcaacaccctatcaagcgctgcaagcattttgagattggaggggacaagaagggaaaaggaacatctttgttttaggcttattaccttttgtcatatttggacgagttttggtttagaatcgttaaaaattgtgatggaacagcaagattgggtttctgtattttccattgaagaaccatctgttgagacaatttcaagaatcttttggcatcctagcttagatagtttttatcatgttcgattctttgcctgtaagattccagggaacacttgtttgctctattgcataaatgcaaatatat

SEQ ID NO: 3832 - DNA, 399 bp, Humulus lupulus
cattcggtccctctgctcccgttcccctcaggctcgcacatctcaactcggctccggcggcggcggcggctccggctctgttagcagacatggtgaacgttcccaagaccaagaagacttactgcaagaacaaggagtgcaagagcacacccttcacaaggtgactcaatacaagaagggcaaggatagtcttgctgctcagggtaagcgtcgttatgaccggaaacagtccggttatggaggtcagaccaagccagtctttcacaagaaggccaaaaccaccaagaagattgttcttaggctgcagtgccagggttgcaagcatgtctctcagcacgacaatcaagcggtgcaagcattttgagataggaggagacaagaaagggaaagggaacttct

SEQ ID NO: 3833 - DNA, 632 bp, Pinus taeda
gaaagcacagaggacgacaagattactagcgggtctgcatctgcataagcatcgtagcaatggtcaatgttccgaagaccaagaaaactttttgcaagaacaaagcttgcaaaaagcacactgtgcacaaggttactcagtataagaaagggaaggacagtctttctgctcaagggaaacaatcaggttatggaggccagacaaaacctgtgtttcacaagaaggcaaaaacaacaaagaagattgtgttgaagctgcaatgtcagtcttgcaagcattattctcaacatgcaatcaagcgttgcaaacattttgagattggtggagacaagaaggggaagggaacctccctttttaaactttcagctttgttgcagctttatatccatcattttacattcttgttcgcatgcctgtccaaggacagaaattttgttgtgttgtttattaggagatagagtcaaccaaccgaagatgccaatttaaattttgccttgtcttaatgtctcttgcacttaatttaaagaacaaatccttggattcaaatcttgcttggttatgttctctggttacttcatgataaaactatttttggtccctgaatgtgcaagtttcacatagttgataatgac

SEQ ID NO: 3834 - DNA, 494 bp, Lippia dulcis
gcagagttcttcctagctgtaaaccataggcgaacgttccaaaaacaaagaaagacttactgcaagtcgaaggagtgcaaaaagacataccttgcataaggtcacccagtataagaagggaaaggacagcttagctgctcaggaaagaggcgttatgatcgtaagcagtccggctatggtggccagaccaagcccgtcttccacaagaaggccaaaacaaccaagaagattgtgttgaggctgcagtgccagggctgcaagcatgtctcccaacacccgatcaagaggtgcaagcatttcgaaatcggtggggacaaaaagggcaagggaacgtccctcttctaatctggtaaacgtaatcattggttttgctttgttacttgggataattatagtgacatttttgtgttttggctataatgtttggtgaaatatgagacatcgtgtaacgaacattggattagtttctgaatttattctacaaaaaagaaaag

SEQ ID NO: 3835 - DNA, 671 bp, Podocarpus macrophillus
ggttagggttagtggcagcagagcaaagagacgcgagaggattcctgttctgatcgatcaagatggtgaacgttcctaaaacaaagaaaacgttttagtaaaacaaagcatgcaaaaagcacactttgcacaaggttactcagtacaagaaaggcaaagacagtattgctgtacaaggaaaacggcgttatgacagaaaacaatcaggttatggaggtcaaacaaagcctgtttttcacaagaaggcaaaaacaacaaagaagattgtgttgaagctgcaatgccaatcatgcaaacatttctcgcagcatccaatcaagcgttgcaagcattttgaaattggcggagataagaaaggaaagggaacatcccttttctaaatgtgtgttatgttttggttctcttgaacttttacattttactactgacagatgctaatccaagccaaatgatctgtcaatgctgatcgtagatggaagaaaactattgaaagtggcatttagtattttattttcatcggttttttgatgccctgattatgatcatttatctcaatgcaaatatttgacttatggtagaactcttttgattggtctcaagagccttcttcttttcttgcttacataatgtttaattgagactgaaattgcttcaatactcattgcatttgc

SEQ ID NO: 3836 - DNA, 584 bp, Centaurea maculosa
gcgggggcggctgtccatctcgtctttcgatctttcaggagctcttcagccatggtgaacgttcctaagacaaagaagacttactgcaagtcgaaggattgccgaaagcatactttgcataaggtgacacaatataagaagggaaaggatagtttggctgcacaaggaaagcgtcgttatgacaggaagcagtccggttatggtggtcagacaaagcctgtgtttcacaagaaggcaaaaaccacaaagaagattgtgctaaggctgcaatgccaagggtgcaagcatgtatcccagcacccaattaagaggtgcaagcagtttgagattggtggagacaagaagggcaagggaacatcacttttctagagggaatatgtgtaatttagttgcagttattcatttttcaattttggtagacttgagatttacaatgaaagtggcttttttgctttgacacatgtggcttgacttgtagtaagttagtgaaggagatgggcaacttttccagttatttctttctacttgcaactgtggtttcatatgatggattgcttgttttagaaaatatgaatttggtggct

SEQ ID NO: 3837 - DNA, 632 bp, Primula obconica
ctatctcaggggggcatcatggtgaacgttccaaaaacgaagaagacttactgcaagtcgaaggaatgtcgcaaacacaccttacacaaggttacccaatacaaaaagggtaaggacagtttggctgtccaaggaaaacgtcgttatgatcgcaagcaatctggttatggtggacaaacaaagcctgttttccacaaaaaggccaaaactacgaaaaaattagtgctgaggctgcagtgccagggctgcaaacacatgtcccagcatccaatcaagaggtgcaagcattttgagattggaggagataagaaagggaaggggacttcgctgttttaatttggaatatctggtgaactgcatgtgtaccctttgtgcctcagtgtttgcttattttcaaactaagtttttgatttcatgacgtttatttcgttgtagacttaaattttgtttgtgggattttcaatcttattggacaacttgttaaattaagtatctcactcttcaattatgtgaatccaacttgtttgctttagagatttctctgtctacaaaagagtaacactatttacacaaatcagtgtacggaacatacatttgtacacgttgtttggctggcagtaggcattacatcg

SEQ ID NO: 3838 - DNA, 681 bp, Prunus persica
atgggagacacgaccagtgacactgatcttgtagctattgtgggttcttactacgattgttgtgttcctgctcagttttgtatccgcgccgcttccttcaccatggtgaacgttccaaagacaaagaagacttactgcaagagcaaggagtgcaagaagcacaccttgcacaaggttacacaatacaagacaggcaaggctagtattgctgctcaggggaagcgtcgttacgatcgcaagcagtctggttatggtggtcagaccaaaccagtcttccacaagaaggcaaagaccactaagaagattgtcctgaggctccaatgccagggttgcaaacatgtgtcccagcacccaatcaagaggtgcaagcactttgaaattggtggagacaagaaggggaagggaacatctctgttttaaatgcattattttgcttgtacttttgtgctgcacttctattttgttggagcttttaagcaagtatggaagatttgttcaagtttttgttagtttatgtcaaacgtcaaagtgtttgtgacactttttctgttatcagttgaagattgagattagagttccaatacagcgttcaccgttgtcgctaatttatatgtttcaatttgcatcttcagcactagatgttttgtttcagtttaatttgctaatatcagttggggttgt

SEQ ID NO: 3839 - DNA, 667 bp, Vinca minor
ggttaacgttccgaagactaagaagacatactgcaaatcaaaggagtgcaagaagcacaccttgcacaaggttacccaatacaagaagggaaaggatagccttgctgttcaggggaagcgccgttatgaccgtaagcagtcaggttatggtggacagaccaaacccgtcttccacaagaaggccaaaaccacaaagaagattgttctgaggctccaatgtcagggttgcaagcatgtttcgcagcacccaattaagaggtgcaagcactttgagatcggtggagacaagaagggaaagggaacccagcttttctaataagctggacatgaaagttcaagtgctgttttatatcgtgttttcgttttagatatgctgttttaaaactaaactgtgaccaatttatcagttgggagtttcatggagaataggctgtgctgactttgattggtcgtcttctttctaagaattactctgttccccgatttgctgttttgtccaacttaaatgatcttgtttattgggttacttctgctatattcctcattacttttgtttgttagaatttagaaattaaagttccccgatttgtgatttatatccggaaaacttaatgtaaacaaattctaaataactaggtatttgtagaattcaaacattaataactct

SEQ ID NO: 3840 - DNA, 535 bp, Cajanus cajan
gcggggcattttcacggcagcacaaaacttcgtctttcagatccggatccacgcgccgccatcatggtgaacgttccaaagacgaagaagacatactgcaagagcaaggagtgcaagaagcacacactccacaaagtgactcaatacaagaagggtaaggatagcatcgccgctcaaggtaagcgtcgttacgatcgcaaacagtccggttatggtggtcagactaagcccgtcttccacaagaaggctaaaaccactaagaaaattgttctgaggctgcaatgccaaggttgcaagcatgtttcccaacatgctatcaagaggtgcaagcactttgagattggtggtgacaagaagggcaagggaacttctcttttctgggtggagaattaggatttattactgttttgatgtgttattttccgtgttgggatgttttgtttctctatggatttctcatagctatattttattatttggaatacttttttgtgattgacaagtgaaaactattgctaatatcaatcagtacttg

SEQ ID NO: 3841 - DNA, 555 bp, Secale cereale
ccgtcaaaataggtgaacgttccgaagaccaaagaagacctactagcaaaacaaaggaagtgcaagaagacacacacttcacaaggtcactcagtacaagaagggtaaggacagtctgtctgcccacgggaaagacgtcgttatgacaggaagcagtcgggatatggtggtcagactaagcctgttttccacaagaaggcaaaaaccaccaagaagattgtgctgaagctgcagtgccagagctgcaagcactattcccagcgtgccatcaagagatgcaagcattttgagatcggtggggacaagaagggcaaggggacatctcttttctagagtgctttcacctctctggagtggtggtggtcaagaactattactacttgtgttaagagtttgttgttaggagctaaattaatcagaccttgtcatgtatccaaactcctgtgtctggcatttaagtgaggggtgacattttgctgaatgaagttttgtagtttgaaacctctttcattccgtataatttctcattttatttgcttcagtatattgttgagt

SEQ ID NO: 3842 - DNA, 336 bp, Brassica juncea
acaagcttcactcaaggtcagacgagcgaaaatggtgaacattccaaagacaaagaagacatactgcaagaacaaggagtgcaagaagcacacattgcacaaggtgacccaatacaagaaaggtaaagacagtctcgctgctcaaggaaagcgtcgttatgaccgtaagcaatctggttacggtggtcagaccaagcctgtcttccacaagaaggccaagaccacgaagaagattgtcttgaggcttcaatgccaaacctgcaagcatttttctcagcattcaatcaagaggtgcaagcattttgagatcggtggagacaagaaggggaagggaaa

SEQ ID NO: 3843 - DNA, 542 bp, Artemisia annua
aaccctaatatcagtattcttgtgtttgtgcggctgttcatcctctttcagtagccatggtgaacgttcccaagactaagaagactttctgcaaaaacaaggcctgcgggaagcacactgtgacacaatacaagaagggtaaggatagtttggctgcacaaggaaagcgtcgttatgacaggaaacagtccggatatggtggacagaccaagcccgtctttcacaagaaggctaagaccaccaagaagattgtgctaaggctgcaatgccaaggttgcaagcatgtttcccagcatgcaatcaagaggtgcaagcattttgaaatcggtggagacaagaagggcaagggaacttctcttttctgagcagttttgtgtaattttgttgaagctagtgatattttttgtttttacctgaatttcggctttaagtctttgaaactgcaagtatcttcttttttgctttgacacatcttgctagacttggaagttatggcagtggttatgaattttaacttgcgggtggtgtttaatatgatcatt

SEQ ID NO: 3844 - DNA, 618 bp, Humulus lupulus
ccctctgctcccgttcctctcaggctcgcacatctcaactcggctccggcggcggcggcggctccggctctgttagcagacatggtgaatgttcccaagaccaagaagacttactgcaagaataaggagtgcaagaagcacacccttcacaaggtgactcaatacaagaagggcaaggatagtcttgctgctcagggtaagcgtcgttatgaccggaaacagtccggttatggaggtcagaccaagccagtctttcacaagaagccaaacaccaagagattgtcttaggctgcagtgccagggttgcaagcatgtctctcagcacgcaatcaagcgttgcaagcattttgagataggaggagacaagaagggaaagggaacttctcttttctaaatttgtgttactatgtcatttttgtttttatggatcttgaaatagagttatgggatatttgttaacctagacatgttgtcatgttaaagatcgattttgtttgttgaactttgtcaatgttattcttcttaaaggttccgataagaaattttaaatgctgtgctttttgaaactttgtcttcagcggccgaaaacagagagcaagggagcaaagaagagaaggc

SEQ ID NO: 3845 - DNA, 518 bp, Humulus lupulus
cattcggtccctctgctcccgttcccctacaaggctcgcacatctcaactcggctccggcggcggcggcggctccggctcttgttagcagacatggtgaaacgtttcccaagaccaagaagacttactgcaagaacaaggagtgcaaagaagcacacccttcacaagggtgactcaatacaagaagggcaaaggatagtcttgctgctcagggtaagcgtcgttatgaccggaaacagtccggttatggaggtcagaccaagccagtctttcacaagaagccaaaaccaccagaagattgttcttaggctgcagtgccagggttgcaagcatgtctctcagcacgcaatcaagcggtgcaagcattttgagataggaggagacaagaagggaaagggaacttctcttttctaaatttagtgttgctatgtcattttgttttttatggatcttgaaatagagttatgggatatttgttaacctagacatgttgttcatgttaaagatcgattttgtttg

SEQ ID NO: 3846 - DNA, 684 bp, Cajanus cajan
agagcattgtcattcgtagcttcattttcgcggcgcacaacaaaaccgtgcttcttcagattccgatcgcacgcgccgtcaccatggtgaacgtaccaaagacgaagaagacgtactgcaagagcaaggagtgcaggaagcacactctgcacaaggttacccaatataagaagggtaaggatagcattgctgcacagggaaaacgtcgttatgatcgcaaacaatctggttatggtggacaaactaagcctgtcttccacaagaaggcaccaccaagaagattgtcctgaggttgcaatgccagggttgcaaacatgtctcccaacaccctattaagagatgcaagcactttgagattggtggtgacaagaagggcaagggaacatctctgttttaggttgagaactaggagttgcagctttttatatttccgcaatgttggaatgttttgtttctatgaggatttttctgctagttatatcttattatttgcaatacattatgtgatttgagaaatgaaaactattgctaatatcagtgagtacttgtttcccttccttcaatggtcagccatgtctattttataccttgatactactctattgttcctgggttacctagttatttggggcgttttatgctcccttgtctcttggctgaaccaaaaaaaagtaaaaaactcta

SEQ ID NO: 3847 - DNA, 421 bp, Thalictrum flavum
gccaaccctcgtgatttggtgtgcgagtgcgactgaaggagatacatatcggcataaaccctagctttcgatctacttgcagtcatggttaatgttccaaaaacaaagaagacatactgcaagaacaaggaatgcaagaagcacaccctgcacaaggtcactcaatacaagaaaggaaaagacagccttgcagcccagggaaagcgtcgttatgatcgtaagcagtcaggatatggtggacagactaagcctgtcttccacaagaaggccaagactactaagaagattgtgctgaggcttcaatgtcagagctgcaaacatgtatcccagcatgcactcaagagatgcaagcattttgagattggtggagacaagaaggggaagggaacttctctttttagatggggtgtttgtttagtat

SEQ ID NO: 3848 - DNA, 527 bp, Medicago truncatula
gcacgagaaaccaccttgcaacaatggtgaacgttccaaagacaaagaaaacctactgcaaaagcaaggagtgcaagaagcacaccttacacaaagtcaccaatacaaaaggtaaggattccatcgctgctcagggaaaacgtcgttatgaccgtaaacaatctggttatggtggacagaccaaacccgtctttcacaaaaggcaaaactactaagaaaattgtgctgaggcttcagtgtcaaggttgcaaacatgtttcacaacacgcaattaagaggtgtaagcactttgagattggtggtgacaagaagggaaaaggaacatctctgttttaggtggaaaattacaagaattttgcagttttactgtgtttttcttttgtacccatctttcgatttttaattttgcagaaatactctgttattagactattgttttaatatttctaatggatggttattttactttaaactcgtgccgaattccgcacgagatttggccaacagattgactcctcaaacttcgg

SEQ ID NO: 3849 - DNA, 466 bp, Humulus lupulus
tagcagacatggtgaacgtcctaagaaccaaaaaacttactgcaagaataaggagtgcaagaagcacacccttcacaaggtgactcaatacaagaagggcaaggatagtcttgctgctcgagggaaagcgtcggtatgacaggaaacagtctggttatggaggtcagactaagccagtcttcacaagaaggccaaaaccaccaagaagattgttcttaggctgcagtgccaaggttgcaagcatgtctctcagcacgcaatcaagcgatgcaagctattcgagataggaggagacaagaagggaaagggaacttctcttacttttaaatttgtgttactatgcctatttttgtttttatggatcttgaaatagaattatgggatatttgttaacctagacatatgctgtcatgttaaacatcgattttgtttgttgaactttgtcaatgttattattcttaaggtt

SEQ ID NO: 3850 - DNA, 630 bp, Linum usitatissimum
tggattgtcgttgcatctcacggagagcacccaagcagcaactccgccggcaacaatggtgaacgttcccaagacgaagaagacctaccgcaagagcaaggagtgcaagaagcacactctgcacaaggtcccccagtacaagaagggtaaggatagtcttgctgctcagggaaagcgtcgttatgaccgcaaacaatctggttatgggggtcagaccaagcccgttttccacaagaaggcaaagactacgaagaagattgtcctgaggctgcaataccagggatgcaagcatgtgtttcagcccccaatcaagagatgcaagcacttcgagattgggggagacaagaagggcaagggaacatctctgttctaaatgcagttcatctgttttttttttctcgtttgttgttctattagttgaactttgaagacttaagttagtatttgctgagctctgtaactgttggttatgatcgaatttgccttgttatttagttaagctagactgttttatcataagaattcgttttttcccttaaccaattcgcttcttcctctttcggtcttgtagggtttgccacattgtgatcttgaagttcgggagtaaaatgggggcgagacatctgtttg

SEQ ID NO: 3851 - DNA, 840 bp, Marchantia polymorpha
gatcgcggcccagcagcaatccgtctctctttcggagcttacacttcgtttctctcgatctgaaaacagatactcaggagaggtgcacgctccgtcgtcaagatggttaacgttccgaagactaagaagtccttctgcagtgggaaggactgcaagaagcacactctccacaaggttacccaatacaagaagggcaaggacagtctctatgcccagggtaagaggcgttacgacaggaagcaatcgggttacggaggtcagaccaagcccgtctttcacaagaaggctaagaccaccaagaagatcgtgctgaggttgcagtgccagggctgcaagcacgtgactcaacatccgatcaagcgatgcaagcatttcgagattggaggagacaagaagggcaagggtacatctctgttttagagacctaggttaccttctcttaggtagtgaacacattacatttgtcaggttctgtgttcaattctggaagggagggctttttgggatcgtacgtaggacctacggtgaattgcccctccgtattacttccgactagtctcgatctgaaggctctttcgagttgcatttatgggatggtcactgagagcagtgaatgcgtcctccgcccatgcgatttcccaggctggatggtcaagtaatcactagacctcactcattgccctcgagaattaagaatactgaaacgcggatgtgtaacatctcggaacagtgatttaattgaatattgttgttcccgagtgaagttttttaatgatcaccgaattttgtgtactacagcatattcggagaaaatgagctatttttacttcaaaaaaaaaa

SEQ ID NO: 3852 - DNA, 748 bp, Mesostigma viride
agtctgcggctctcatcgcctgtattctttttaggttcgccaaaatggtgaacattccaaagaccaagaagactttttgcaagggcaaggagtgcggcaagcacaggctgcacaaggttacccagtacaagacgggcaaggcctctctctccgcccagggtaagaggcgttacgacaggaagcagtccggttatggtggtcagaccaagccagtcttccacaagaaggctaagaccaccaagaagattgtgctgcgtctccagtgccagtcgtgcaaacacgtatcacagcacgccatcaagcgctgcaagcacttcgagatcggtggtgacaagaagggcaagggtgcccagctcttctagacgtagtggctataaatagtgaactcgccaagcactggttggcatggaccacaccgtggcaaggcgcagcacggtgtggctcaagcttttttattttaattgagacagccatcacatgtggacctgtccacgatgaccttgtcctggcccacggatgccttgtgcgtttgtctgctacacgggttcttggcggcctccttttgcacccgtaatcggaaccctgttcatgtcttcttacgctgtagagctagccgctccgccaacgtatatgtagatattcggtgccagcggaaacaagccacaaccaagtgagtcatcaagaaatgctctctctgagcctcatgtgtggcagtttcaaataacaaataaaaaaaggtcttcgtgtt

SEQ ID NO: 3853 - DNA, 563 bp, Picea glauca
cggggtcagtagcggcagctagaattgaaagaagcgcattctctcagagttcgggctgtttattgccttcaatcacaatggtcaatgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagatcgtgttgaagctgcaatgtcagtcttgcaagcactattctcaacatgcgatcaagcgttgcaaacattttgagattggtggagacaagaagggaaggaacgtcctttctaaactttcagctatgttccagctttctatcgatcattttacattcttgtttgcatatctgtctgaggacagtaagttgtgttgtttattcgtagattggtggagacaaggggaagggaacgtccttttctaaactttcagtctatgttccagctttctatcgattcattttaca

SEQ ID NO: 3854 - DNA, 335 bp, Brassica juncea
cacacaagcttcaccggagagttcagaagagcgaaaatggtgaacattcccaagacaaagaagacatactgcaagaacaaggaatgcaagaagcataccttgcacaaggtcacccaatacaagaagggtaaagacagtctcgctgctcaaggaaagcgtcgttatgaccgtaagcaatccggctatggtggtcagactaagcctgtcttccacaagaaggctaagaccaccaagaagattgtcctgaggcttcagtgccaaacctgcaagcacttttctcagcactccatcaagaggtgcaagcattttgagatcggtggagacaagaagggcaa

SEQ ID NO: 3855 - DNA, 717 bp, Mesostigma viride
aggcagcggctctcatcgcctgtattcttctaggttcgccaaaatggtgaacattccaaagaccaagaagactttctgcaagggcaaggagtgcggcaagcacaggctgcacaaggttacccagtacaagacgggcaaggcttctctcttcgcccagggtaagaggcgttacgacaggaagcagtccggttatggtggccagaccaagccagtcttccacaagaaggctaagaccaccaagaagattgtgctgcgcctccagtgccagtcgtgcaaacacgtatcacagcacgccatcaagcgctgcaagcacttcgagatcggtggtgacaagaagggcaagggtgcccagctcttctagacgtagtggcataaatagtgatcttgtcaagcacaggttggcatggaccacaccgaggcgcggtacggcatggcccatgctttttcattttaatcgagacagttgtcacatgtggacctgtccatgatgaccttgtcctggcccacggatgccttgtgcattcgtctgctacgcgggtctttgcggcatcattttgcatgcgtaattggaaccctcttcttacgctgaagctagccgctctgccgacgtctatgtagatattcggtgccagcagaaacaaggcacaaccaagtgagtcatccaggaatgctctctctgagcctcatgtgtggtagtttcacatgacaaataaataa

SEQ ID NO: 3856 - DNA, 531 bp, Physcomitrella patens
cgaagagctccctttccgctcccccagtaacgagttgcgctgcgttgcgctccattgaattttgcaaccggagctcttgaaacgcggtcaccatggtgaatgttcctaagacgaagaagtccttctgccctggaaaggcatgcaagaagcatacccttcacaaggtgacgcagtacaagaaggggaaggacagcttgtacgcccaaggaaagaggcgttatgataggaagcagtcgggttacggaggtcagaccaagcccgtctttcacaagaaggctaagaccacaaagaagattgtgctcaggttgcagtgccaggcttgcaagcatgtgacacagcaccctatcaagcgatgcaagcactttgagattggaggagacaagaagggtaagggcactcagctcttctaggcaactcgattggattacctcgcttctgaactttagagagtatgaactagatttcagtgtgaaccataactgttgtaactcaaatatgagttttgaatttaaattttctttgtccctctga

SEQ ID NO: 3857 - DNA, 581 bp, Physcomitrella patens
ggcggcggagcacaaaccctacgctgggtttcggaaggactccttttcacctcttgtcaggagcgttggtttggcgaggcagcaggagcgcgttggtcacggcaaccatggtgaacgtaccgaagaccaagaagtccttctgcccggggaaggcatgtaagaagcatacccttcacaaggtgacgcagtacaagaagggaaaggacagcttgtacgcccaagggaagaggcgttatgacaggaagcaatccggttacggaggtcagaccaagcctgtctttcacaagaaggccaagaccacaaagaagattgtgcttaggttgcaatgtcaggcttgcaagcatgtgactcaacatcccatcaagcgctgcaagcacttcgagattggaggagacaagaagggcaagggtacccaacttttttaaactacatgtcttaattgaaatgttaaaattgtggactggttttcaccgtgtaccactcattttgtaagaagctcttggagccttggtttcatacttggtgttcttggcgaatgtctttcacctaacccttaatttgcacaagttgattgtgggcta

SEQ ID NO: 3858 - DNA, 519 bp, Physcomitrella patens
accgcgcattcccttttgccttgctgctgtcacagctcgagcggtagcgaggccagttgaggcgatttctgaacgtaatcacgatggtgaacgttccgaaaaccaagaagtccttctgtccagggaaggcgtgcaagaagcacaccctccacaaggtcacccagtacaagaagggaaaggatagtttgtacgcacaaggtaagaggagatatgacaggaaacaatcaggatacggaggtcagaccaagcctgtcttccacaagaaggctaagactaccaagaagattgtactgaggttacagtgccaggcttgcaagcacgtgacacaacatcctatcaagcgatgcaagcacttcgagatcggaggagacaagaagggcaagggaacacaactcttctagacagtgttgttagaatgttctccttttagaatgcggaaagtaagattcagagaaaactgtatgttgtggtgattggaattgatggttttaagcttctggatgaaagatttgatcgtcc

SEQ ID NO: 3859 - DNA, 744 bp, Physcomitrella patens
ctctttggctgactgcacgtcaagcttctgtgttggcgaggcaaggcggtcaccatggtgaacgttccgaaaacgaagaagtccttctgtcctgggaagtcgtgcaagaagcacaccctccacaaggtcactcagtacaagaagggaaaggatagtctgtacgcacaaggtaagaggcgttatgacaggaagcaatctgggtatggaggtcagacgaagccagtctttcacaagaaggctaagactaccaagaagattgtgctgaggttgcagtgtcaggcttgcaagcacgtgacacaacatcccattaagcgatgcaagcacttcgagattggtggagacaagaaggggaaaggaacacaactcttttagatataatgctttactttgtattccgagaaattatgaagcaggaacatacttttcagtagttgcaaattatgttttcagattgtgtttgaagcacgtgtgtatcattttctggtgtgagaaggatggaaattttttatgcgttctttgatttgatttgcatcgaatgggtaaccttcagtatcaaatccaagagcttacgggactctcgttctttttgaaacaacgtagagttctttgctagcctagaaaggagacattgacgaaccccaagccttattgagccgtacgaaatgagtaagttctggaacactggacaaagatgccactgtcacattcgcaataatggaataatagaattattgttttgtgtgc

SEQ ID NO: 3860 - DNA, 415 bp, Senecio madagascariensis
aaaaagaaacaaagtaaggtaaatacaaacgacaagaagtaacgacgggatcggaaagatcttcaacaatggtgaatgttcctaagactaagaagacttactgcaaaaacaaggagtgcaaaaagcacaccttgcataaggtgacgcagtacaagaagggaaaagatagcttggctgctcaaggaaagcgtcgttatgacaggaaacaatctggttatggtggacagaccaagcccgtctttcacaagaaggctaaaaccaccaagaagattgtgttgaggttgcagtgtcagagttgcaagcatatgtcccaacaccctattaagcgatgcaagcattttgagattggtggagacaagtaagggtctaagggtaacttatttcttttgttttaagacggctattattatgcttt

SEQ ID NO: 3861 - DNA, 452 bp, Elaeis guineensis
acttattgcaaagaataaggcatgccgtaagcatactcttcacaaggttacccagtataaaaaaggcaaggatagtctgtctgctcaaggaaagcgtcgttacgaccgcaaacagtcaggttatggtggtcagacaaagcctgttttccacaagaaggcaaaaacaaccaagaaaattgtgttgaagctgcagtgccagagttgcaagcattattcacagcaccctataaagagatgcaagcattttagaaattggtggagataagaagggccaagggaacgtctctcttctagtgggcttctaccgtttcgggggcgtcacttggttatctgtgtgttctagggaaatgctgatctaaacccattaaatcggcactatatttttgttaaggactttttggtgtttcttaagtttacttggttgtcatgttctagcctataatgattcaggt

SEQ ID NO: 3862 - DNA, 538 bp, Tabernaemontana elegans
tctatctccgaggtcgaaaatggttaatgttcctaagacaaagaagacgtactgcaaatccaaggagtgcaaaaagcacaccttgcacaaggttacccaatacaagaagggaaaggatagtttggctgctcaaggaaaacgccgttatgatcgcaagcagtcaggttatggtggacagaccaaaccagtctttcacaagaaggcaaaaaccacaaagaagattgtgttgaggctccaatgccagggttgcaaacatgtttcacagcaccctattaagagatgcaaacattttgagattggtggtgataagcttgagaagctggtatacaaggatgtgaaaagaggaattagaagagaccgcaagtatgcggtgcaaccgcgtaatgtgtttgcaacaggcgttcacatgtctcagaacacggagggcaagacaacccacaagacagagggtcgtatcatgtacttccactatcatgggaccattgcagaccggcgggagccatgccggcaaatggtcaactccacagatataacggtt

SEQ ID NO: 3863 - DNA, 347 bp, Aquilegia formosa
gtatgattttaactcctggattatctattcaggtgaacgttccaaagacaaagaagacgtattgcaagaacaaggagtgcaagaagcacaccttgcacaaggttacgcaatataagaaggggaaagacagccttgctgcacaaggaaagcgtcgttatgatcgaaagcagtctggttatggaggtcagaccaaaccagtcttccacaagaaggcaaaaacaaccaagaagattgtcttgaggttgcagtgccagagctgcaagcatgtatctcagcatgcacttaagaggtgcaagcattttgaaatcggtggagacaagaaggggaagggaacctcgctcttttag

SEQ ID NO: 3864 - DNA, 394 bp, Solanum phureja
ggattggcaccagctgaacggcgattgtgctctctggtatttctgtctaacctctcggcttgcgaaaatagtgaacgttcctaagacaaagaagacctactgcaagtccaaggagtgcaaaaatcacaccttgcataaggtcatacaatacaagaaggggaaagatagcttggcttctcaggaaaagcgtcgttatgacaggaaacagtcaggttatggtggtcagaccaagcctgtcttccacaaaaaggctaaaaccacaaagaagattgtgttgaggttgcagttccaaggctgcaaacatgtttcacagcacccaatcaagaggttcaagcattttgaaattggtggggacaagaaaggaaagggaacctcacttttctagattgcctct

SEQ ID NO: 3865 - DNA, 501 bp, Musa acuminata
acttttaccattaatgttatcatacaggtgaacgtgccaaagaccaagaaaacgttctgtaagaacaaggtttgtaggaagcacacgcttcacaaggttacacagtacaagaagggtaaggatagcctttctgttcaagggaagcgccgctatgacaggaagcagtctggttatggtggacagacgaagcctgttttccacaagaaggcaaaaactaccaagaaaatcgtgttgaagcttcaatgccaaagttgcaagcattattcgcagcatccgataaagagatgcaagcactttgagattggtggagacaagaaggggaaggggacctctctcttctaatttgtctttgttgacatttcagcattacatttttatgtgtttatgtgaaatggtagcttgttatatgctgattttagtttaaactactggaatatcaatgttggttaacttttgcttgtggtttaaaatggatatgcaatattcatgaagtttatttgg

SEQ ID NO: 3866 - DNA, 916 bp, Physcomitrella patens
tcctttccgcttccagtcaccgtagcgttgcattgcgtcgcagtaggagcgctctagtcgcggccacgatggtgaacgttccgaagacgaagaagtccttctgtccggggaaggcatgcaagaagcacacccttcacaaggtgactcagtacaagaaggggaaggacagcttgtacgtccaaggaaagaggcgttatgacaggaaacagtccggatatggaggtcagaccaagcccgtctttcataaaaaggctaagaccacgaagaagattgtgcttaggttgcaatgccaggcctgcaagcacgtgacacaacatcctatcaagcgatgcaagcatttcgagattggaggagacaagaagggcaagggtactcagctcttctaggcatcacgtcaggtccaactagagtctggagtgttgataacatgcattgaatttcagtgcactatgcaaattttgtaacacgtacctgaggttcgcagcaaattttggtattacttgtttactttttgtaacaactatctcttttggggtagacctaatattaattctaaagggcaacaccatccaagagcacgtcatctcattttttcttctcacgtctctttgagtaatttttctgaatataaaaacaaccaaaagcgacttcccaatcgcaggaaaacccaagtttagaaagttgcaacttcctaccttctctcccaaatataaaggctgttcttaaaattcatcatcaagaattagtacaataataaaatacttaacacaacagtttaatttcttatgtattgccaaatagagatcaaaccatgaaaaacaacatttacttgtagttgatgtacatccaactccacaaacaaatcaatggggcatgctcaatagctatacttcaaagataaagaaaacacaccacc

SEQ ID NO: 3867 - DNA, 519 bp, Primula obconica
aaaacaaagaagacttattgcaagtccaaggaatgtcgcaaacacaccttgcacaaggttacccaatacaaaaagggtaaggatagtttggctgtccaaggaaagcgtcgttatgaccgcaaacaatctggttatggtggacagacaaagcctgttttccacaaaaaggccaaaactacaaaaaagattgtgttgaggctgcaatgccagggttgcaagcacatgtcccaacacccaatcaagaggtgcaaacattttgaaattgggggagataagaagggaaaagggacttcgctcttctaattactcttttcgcctcattgttggttatttttaaaaaagtttaccgtttggtatcaagatgttcttttggttgtacactcaactttttaattatgttaactatctcgctcctgagagaatttgtttccaactttcgtacttggtgatttcatgagctcagcgttctacaatcacaaaaaatatttattcacagttatgtgataaaagtggattgta

SEQ ID NO: 3868 - DNA, 751 bp, Pteridium aquilinum
cacagggcggtacattttaagttgtccggagcgtgctcatgtgaaatctttttacgaaaaccctacttgttgtgatcaacattcctgctttccgcttctctgctgctctctcgactcgcgttgccccgcgctgtgtgcaaccggagccgagcagccatggtgaacgtcccgaaaacaaagaagaccttctgcaaggggaaggattgcaagaagcacactcttcataaagtgactcaatataagaaggggaaggatagtctgtatgtgcaaggtaagaggcgatatgacaggaagcagtctggttatggtggacagacaaagccagtcttccacaagaaggccaagaccaccaagaaaattgtgttgaggttgcaatgtcagagctgcaagcatgtgacacagcatcctatcaagcgatgcaagcactttgagattggtggtgacaagaagcgcaagggtgctttgtactaggtttctggagcagctgtatggaacatggattttttctgtttagagctgatcattagccgacaaggcaatgagaattttgaaaactgccgactctaattaaatgtagacgagacttgattcatgagaaggatagatgttgcattttttcttctctactgcagtcttactctttgaatcatcattgaagtgatttgccgcttatggatcataatttttatggtgaagttttttttgtaactgtcgaggatgcttaagtagttttgttggaaaaaagaaaaag

SEQ ID NO: 3869 - DNA, 541 bp, Pteridium aquilinum
gggaatcactagcaactgggttttcttctgtcttgacgacgaggcgccgcggttagccatggtgaacgttcccaaaaccaagaagaccttctgcaaagggaaggactgcaagaagcacactcttcataaagtaacccaatacaagaaggggaaggacagtctttatgttcaaggtaagaggcgttatgatagaaaacagtctggatatggtggtcagacaaagcccgtcttccataagaaggctaagactaccaagaagattgttctgaggctgcaatgccagtcttgcaagcatgtgactcaacatccaattaagcgatgcaagcattttgagattggtggagacaagaagcgcaagggtgctttatactgagaacatggtgcatacatagccttcgccacttcaacgagaattgcactacatgatttttgcttgtagctcatcgttgacactcgtgtgcaaaatttgtagctggaacgtttcagcaagagaaaacattagacgtttactatgtgtcattcaatatagctattttcaatc

SEQ ID NO: 3870 - DNA, 493 bp, Sarracenia psittacina
aagaccaagaagacctactgcaagtccaaggagtgccgaaagcacaccttgcataaggttactcaatataagaaggggaaggatagtttggcagtacaaggcaagcgccgctatgatcggaaacaatctggttatggtgggcaaacaaaacctgtcttccacaagaaggcaaaaactacaaaaaagattgtcttgaggctgcaatgccagggttgcaaacatgtgtctcagcacccaatcaagaggtgcaaacattttgagattggaggagataagaaggggaagggcacttctctcttctaactggccattgatggaaattttcttgtcccatcgtgcagctgcgaaaacctttcaattaatcatttttagttggaaagtaactcttttatattatgatttgtagttttgtgtttcatgtttttttgccaagtattgctgcaatggacttgtaagtcgattaatgatatgatctgtgcactttcttatatac

SEQ ID NO: 3871 - DNA, 385 bp, Secale cereale
cgcactcctcgtgttctcacccaggcgcgcactcctcctcttcctcctcgccgtcgtcgtctcggatccgcagccatggtgaacgttccgaagaccaagaagacctactgcaagaacaaggagtgcaagaagcacaccctccacaaggttacccagtacaagaaaggcaaggatagcctttctgctcaggggaagcgtcgttatgaccgcaagcagtctggatatggtggccagacaaagcctgttttccacaagaaggccaagacaacaaagaagattgtgctgaagttgcagtgccagagctgcaagcattactcacagcgtgccatcaagaggtgcaagcacttcgaaatggtggagacaagaagggcaagggaacatctct

SEQ ID NO: 3872 - DNA, 707 bp, Ceratodon purpureus
ctccagtctctccttttcgcttccagccaggagctttctgttgcgtcccagcgggagatctcaggtcgcggccaccatggtgaacgttccgaagaccaagaagtccttctgccctgggaaggcgtgcaagaagcacacccttcacaaggtgacacagtacaagacgggcaaggccagtttgtacgcccaaggaaagaggcgttatgacaggaagcaatctggttacggaggtcagaccaagcccgtctttcacaagaaggctaagaccacaaagaagattgtgcttaggttgcaatgccaggcttgcaagcatgtgacacagcatcccatcaagcgttgcaagcatttcgagattggaggagacaagaagggcaagggtacccagctcttctaggcaatacgcttggtttatctcactactggaatgtggagagtatgagctagatttcagtgtgtaccacatattatgtaacacgcagctgagacttcagtttatatttctggttttcctctatgctgaagtccatcattctgtctcaagtgttcgaaccaatcacggaatgcgtcacgctaatgaaggaatccatattgtcaatcttttcacggtttatttgtccgctagtttgattatggtctgcaagtttgggtgactcaatccgtgattctctcggcactgtgcttgtttgcaagtctcgtaaacaaatcac

SEQ ID NO: 3873 - DNA, 431 bp, Selaginella moellendorffii
gggggagcgcatttcggcggcttggaagagcggcacaatggtgaacgtccccaagacgaagaagtccttctgccaagggaagaattgccggaagcacacgctccacaaggtcacgcagtacaagaagggcaaggacagcctctacgtccaaggtaagaggcgttacgatcgcaagcaatctggctatggcggccaaacgaagcccgtgtttcacaagaaggccaagaccaccaagaagatcgtgctccggctccagtgccagacgtgcaagcgcgtgtcgcagcaccctctaaagaggtgcaaacactttgaaatcggtggtgacaagaagggcaagggaacgagcttgttctaagcgcgcgcgattcaattttcctctcttggatatgatgttctcgaatttgcaagaagaaatagacaagctttgatta

SEQ ID NO: 3874 - DNA, 418 bp, Selaginella moellendorffii
gcggcttggaagcatctcggcggcacaatggtgaacgtgcccaagacgaagaagtccttctgccaagggaagaattgccggaagcacacgctccacaaggtcacgcagtacaagaagggcaaggacagcctctacgtccaaggtaagaggcgttacgatcgcaagcaatctggctatggcggtcaaacgaagcccgtgtttcacaagaaggccaagaccaccaagaagatcgtgctccggctccagtgccagacgtgcaagcgcgtgtcgcagcaccctctaaagaggtgcaaacactttgaaatcggtggtgacaagaagggcaagggaacgagcttgttctaagcgcgcgcgattcaattttcctctcttggatgatgttctcgaatttgcaagaagaaatagacaagctttgatt

SEQ ID NO: 3875 - DNA, 506 bp, Allium cepa
gcttcatttagcggctgtgcttttctcaactccatcaattaatcatggtcaacgttccaaaaacaaagaagacatactgcaggaacaaagaatgcaagaaacacactttacacaaggtgactcagtataagaagggcaaagatagcctttcagctcaaggaaagaggcgttatgaccgaaagcagtctggttatggtggtcagactaagcccgtctttcacaagaaggctaaaaccacaaagaaaattgtgctcaagttgcaatgtcagagctgcaagcattactctcaaaaagccatcaagaggtgcaagcattttgaaatcggtggagacaagaagggcaaagggaacatcactcttactaaatattgtttttcattcctttttgtttagcgaacgtatttgtgctgttggttttattctttattgttgaaatctgtagtgttgctgaatgtattttgttgaacctcttgatatgaattatttttgggtctattgctatttaga

SEQ ID NO: 3876 - DNA, 315 bp, Arnica chamissonis
agccattggtgaacgtttcccaaaaaccaagaagacttactgcaagaacaaggaatgcagaaagcataccttgcataaggtgacacagtacaagaagggaaaagacagcttggcagcacagggaaagcgtcgttacgacaggaaacaatctggttatggtggtcaaacaaagcccgtgtttcacaagaaggcgaaaaccacgaagaagatcgtgctaaggttgcaatgccaaggctgcaagcatgtctcccagcacccaattaagagatgcaagcattttgaaattggtggagataagaagggcaagggaacttc

SEQ ID NO: 3877 - DNA, 537 bp, Pinus taeda
  misc_feature (20)..(20): n is a, c, g, or t
gccaaaaacacaaagggcgnccccgagattactaacgggtctgcatctgcatttgcatcgtagcaatggtcaatgttccaaaggccaaaaaaactttttgcaaaaacaaagcttgcaaaaagccccctgtgcgcaaggtttctcagtataagaaagggaagggcagtctttctgctcaagggaaacggcggtatgatcgaaaaccatcaggttatggaggccagacaaaacctgtgtttcccaagaaggccaaaaccacaaaaaagattgtgtttaaactgcaatgtcagtcttgcaagcattattctcaacatgcaatcaagcgttgcaaacatttttagattggtggagacaaaaaggggaagggaaccccccctttttaaaccttcagctttggtgcagctttaaaaccctccttttacattcttgtttgcatgtctggccaaagacaaaaattttttggggggtggttattaggagaaaaagtccacccaccgaaaatgcccatctaaattttgcccgtcttaaagtctcctg

SEQ ID NO: 3878 - DNA, 413 bp, Prunus persica
tcatccatctccatacgaggcagccgttgccatggtgaacgttcccaaaacaaacaagacacactgcaagagcaaggagtgtaaaaagcacaccttgcacaaggtcacccaatacaagaaaggaaaggatagccttgctgctcagggaaagaggcgttacgatcgtaagcaatcaggttatggaggtcaaaccaagccagtgttccacaagaaggcaaaaactacaaagaagattgtcctgatgctccaatgccagggttgcaagcatgtgtctcagcaagaggtgcaagtactttgagattggtggagacaagaacggaaagagaacctctgttttctaagtcaactgattgggttgtattttgtgttgcgttccatcttgttggagctttaaagctaatatgatagtcttt

SEQ ID NO: 3879 - DNA, 454 bp, Triticum aestivum
  misc_feature (3)..(3): n is a, c, g, or t
  misc_feature (13)..(13): n is a, c, g, or t
  misc_feature (19)..(19): n is a, c, g, or t
  misc_feature (22)..(22): n is a, c, g, or t
  misc_feature (46)..(46): n is a, c, g, or t
  misc_feature (63)..(63): n is a, c, g, or t
  misc_feature (69)..(69): n is a, c, g, or t
  misc_feature (87)..(87): n is a, c, g, or t
  misc_feature (127)..(127): n is a, c, g, or t
  misc_feature (130)..(130): n is a, c, g, or t
  misc_feature (178)..(180): n is a, c, g, or t
  misc_feature (182)..(182): n is a, c, g, or t
  misc_feature (257)..(257): n is a, c, g, or t
  misc_feature (266)..(266): n is a, c, g, or t
  misc_feature (277)..(278): n is a, c, g, or t
  misc_feature (290)..(290): n is a, c, g, or t
  misc_feature (301)..(301): n is a, c, g, or t
  misc_feature (326)..(326): n is a, c, g, or t
  misc_feature (360)..(360): n is a, c, g, or t
  misc_feature (371)..(372): n is a, c, g, or t
  misc_feature (384)..(384): n is a, c, g, or t
  misc_feature (396)..(396): n is a, c, g, or t
gcngcaggagaanaagcanacncgcggaggagagcttccaggcggngaccatggtgaacgttncaaagnccaagaagacctagtgcnagaacaaggagtgcaagaagcacaccctccacaaggttangcngtacaagaaaggcaaggacagtttttctgctcagggaaagcgccgttnnnancgcaagcagtcaggatatggtggccagacaaagcctgttttccacaagaaggccaagacaacaaagaagattgtnctgaagctncagtgccaganntgcaagcattantctcaacgcgntatcaagaggtgcaagcactttganatcggtggagacaagaagggcaaggggacctctntcttctaagcnnatgatatccctnttttgttcagtnttgtgccagaacttcccactcgaacaatgtattagtatcatagttggtattctgggta

SEQ ID NO: 3880 - DNA, 742 bp, Picea glauca
gaggaacagcaacagcaggagtcaacgggatcgttgaggcggagtctgttcacaaacccaaaatggtgaacgtacctaagacaaagaaaactttctgcaagaataaggcttgcaaaaagcacactttgcataaagtaacgcagtacaagaaaggaagatagtcttgcttgtacaaggaaagagacgttatgacaggaaacaatctggtatggaggtcaaacaaagcctgtctttcacaagaaggctaaaacaacaaagaagattgtgttgaagctgcaatgccagtcttgcaaacattattcccaacatccgatcaagcgatgcaagctacttagaaattggggggacaagaaaggaagggcacatctctcttctaggtgcattgccatcagttgatagcgatgtcttcctacctgtagaactgtacaaaacaataagggttgttttatagatgctagttaactctactggttcagttaacttttaaattttcttttctatgaatactttaccttgaaatatgtctgccaagtagataatctcgtagacaaactgtcaatgagtatagtaaggaaaacgtagttttagttaataagaaccttatgaagtctttagtaaattcactacttaaatttattcatagaagatgagacctctgtggttatttttctcagcttacattatctagagtataggcctaactgtattttttattcgtagaaataagaaaactaaaattaag

SEQ ID NO: 3881 - DNA, 566 bp, Cedrus atlantica
caagaacaaagcttgcagaaagcacactttgcacaaggttactcagtataagaaggcaaggacagcctttctgctcaaggaaaacgccggtatgatcgaaaacaatcaggttatggaggccaaacaaaacctgtgtttcacaagaaggcaaaaacaacaaagaagattgtgttgaagctacaatgtcagtcttgcaaacattattctcaacatgcgatcaagcgctgtaaacattttgagatcggtggagacaagaaggggaagggaacgtcccttttctaaactgccagctatgttccagcattctatcaatcattttacattcttgtttgcatatctgtctgaagacagaagttttgttgtgttgtttattactagatagagtctaccaactgaaggcggcaatttaattgtgccttgatcttagtgtctcttgcagtttatttataaaacaaacctttggattgaaagcatgcttggttatgttttctggttactctatatttaaactattcgtctgttcctatttttaacccaaaatatttgacatttggtatgaccatgaa

SEQ ID NO: 3882 - DNA, 471 bp, Bupleurum chinense
gacttactgcaagtctaaggagtgccgcaagcacaccttgcacaaggtgacacaatacaaaaagggaaaagattctctcgctgcccagggaaagcgccgttatgatcggaaacagtctggttatggtggtcaaacaaagcctgttttccacaagaaggctaaaaccactaaaaagattgtgttgaggctccaatgtcagagctgcaaacacatgtctcagcacccaatcaagaggtgcaagcattttgagattggtggggacaagaagggaaagggaacatctcttttttagaatgttgcagttgtttcacctttgtacttggatgctgctgctggtgtttttgccaggctacatttcatttacataatgttagctacaatcgtttccttaaagtgtaatctggcaatgttttggctttggcacattgatagatactaatctgttagtacgaggagtatgaattatatatt

SEQ ID NO: 3883 - DNA, 605 bp, Adiantum capillus-veneris
ctcttttcgtctccttccgatcgtctgtgctgctgcagcaaaccagcggccatggtgaacgttccaaagacgaagaagtccttttgcaagggcaaggactgcaagaagcacactttgcataaggtgactcaatacaagaagggcaaggacagtctctatgtgcaaggaaagaggcgttatgacaggaagcaatctggctatggtggccaaacaaagccggtcttccacaagaaggctaagactacaaagaaaattgtgttaaggttgcaatgtcagagttgcaagcatgtaactcagcatccaatcaagcgatgcaagcactttgagattggtggtgacaagaagcgcaagggtgccatgtactaggtcaatttttgcagcatcatgatgaatcgaagagttttgctcagacctttgcactgttttaagtattaaattgaactgaattttgtgacaaacatgacctggatgtccctttgctctgagatttgagttaatttgttttgggctcttaaactcccttcgagcaacatcaaaccatattttgccattctggttgttccaatggtatgcgtgcttccaatgcgggaactgttctttgagtt

SEQ ID NO: 3884 - DNA, 385 bp, Pteridium aquilinum
ccttccggccgaaacagagctcaggttctctctcttcgtctgcagccatggtgaacgtacccaagaccaagaagacttactgcaagagcaaggattgcagaaagcacactttgcacaaggttacacagtataagaagggtaaggatagtttggctgcccaagggaaacgccgttatgatcgcaaacagtcaggttatggtgggcagaccaaaccagtgctccacaagaaggcaaagaccaccaagaagattgtgctaaggctgcaatgccagggttgcaagcatgtctcccagcatccaatcaagaggtgcaagcactttgagattggcggagacaagagggaagggaacatctctttctaaatgtgttattcatgccatctgtt

SEQ ID NO: 3885 - DNA, 428 bp, Sarracenia psittacina
cgcatcctcagaaaaccagtgctctcctcttcctctgcaacgcagtaatggtgaacgttccaaagacaaggaagacatactgcaagtcaaaagaatgcaggaagcacactttgcacaaagtaacacaatataaaaagagcaaggagagattggttgcacaaggcaagcgtcgttatgatcgaaagaattctggctatggcggacaagctaaacccattcaacgaaagaaggcaaaaactacaaaaaagattgtactaaagctgcaatgccagagatgcaaacatgtttctcagcacccaatcaagagatgcaaacattttgagattggtggagataagaaagggaaggggacttcactattctagtcatgtgtcaattttaagtgtactttgcttgcggtccttatttttatcttttttagattcttt

SEQ ID NO: 3886 - DNA, 516 bp, Secale cereale
gaaagggaagcacgccggagccccatctccccggccgtcaaaatggtgaacgttccgaagaccaagaagacctactgcaaaaacaaggagtgcaagaagcacacacttcacaaggtcactcagtacaagaagggtaaggacagtctgtctgcccagggaaagcgtcgttatgacaggaagcagtcgggatatggtggtcagactaagcctgttttccacaagaaggcaaaaaccaccaagaagattgtgctgaagctgcagtgccagagctgcaagcactattcccagcgtgccatcaagagatgcaagctattttgagatcggtggggacaagaagggcgaaggggacatcttcttttctagagtgctttcacctctctggagtggtggtggtcaagaactattactacttgtgttaagtgtttgtgttaggagctaaattaatcagaccttgtcatgtatccaaatcctgtgtctggcatttaagcgagggtgccatttgctgaatgaagtttt

SEQ ID NO: 3887 - DNA, 562 bp, Cephalotaxus harringtonia
ctttttgcaaaaacaaagcatgcaaaaagcacactttgcacaaggttacccagtacaagaaaggcaaggatagtctttctgtccaaggaaaacgacggtatgatcgaaaacaatcgggttatggaggtcaaacaaaacctgtctttcacaagaaggcaaaaacaacgaagaagattgttttgaggctgcaatgccagtcgtgcaaacatgtctcacagcatccaatcaagcgttgcaaacactttgagattggtggagacaagaaggggaagggaacatcccttttttagagatgcagctatgtatgctttgcgcgaacattttacactgttggtatctacagatacctatcagagacaagatttgttttgaaagtgaatactacggaagcaatctattgaagataccattagtattcggtttgaagttcatgttttgatgtcaattttataaacctttgatttttaattgctaaggtgtcttttggtgattactatctaattatatttgtttttctttaatgcaaaagatttggcaaatgctaaaacctcggatggattaa

SEQ ID NO: 3888 - DNA, 675 bp, Brassica rapa
caacgtatcgttcgcggacgacggcacacaatcttcacccgagagagagagagatcagagtagcgaaaatggtgaacattccaaagacaaagaagacgtactgcaagaacaaggaatgcaagaagcacacattgcacaaggttacccaatacaaaaacgtcgttatgaccgtaagcaatctggttatggtggtcagaccaagcctgtcttccacaagaaggctaagaccacgaagaagattgtcctcaggcttcagtgccaaacttgcaagcacttttcgcagcactcaatcaagaggtgtaagcattttgagatcggtggagacaagaagggcaagggaacatctcttttctaagctgttgtcatcgtcttaattgttacaagttttctatttcgtttggatctgattccatctgttttagccctcgtataagattgtcccctcatctttggttgtcactctatattttgaatcatctagacatgattttgctgtttttctttgcacttgaaatggttacttttgagatatttgcctcgtttcccgacaatgcaagccaaaggccagagtctctttgacgaatttgaaatcttaggtttgcccagagaggaggaagccaacataacataccacttatgctatgttatggaaatcttttgctaaacacatcttct

SEQ ID NO: 3889 - DNA, 321 bp, Eschscholzia californica
aacgaaaatctccatttacagttctacagtttcagccatggtgaacgttccaaagacaaagaagacatattgcaagaacaaggagtgcaagaagcacactctgcataaagttactcaatacaagaaaggtaaggacagtcttgcagctcaaggaaaacgtcgttatgatcgcaaacaatcaggttatggaggacaaaccaagcctgttttcacaaaaaggcgaaaaccacgaagaagattgttttgagacttcagtgtcagagttgcaaacatatggcccaacatgcaatcaaggagatgcaagcattttgagatcggcgg

SEQ ID NO: 3890 - DNA, 683 bp, Sarracenia psittacina
tcctcagaaaaccagtgctctcctcttcctctgcaacgcagtaatggtgaacgttccaaagacaaggaagacatactgcaagtcaaaagaatgcaggaagcacactttgcataaagtaacacaatataaaaagagcaaggagagattggttgcacaaggcaagcgtcgttatgatcgaaagaattctggctatggcggacaagctaaacccattcaacgaaagaaggcaaaaactacaaaaaagattgtactaaagctgcaatgccagagatgcaaacatgtttctcagcacccaatcaagagatgcaaacattttgagattggtggagataagaaagggaagggacttcactattctagtcatgtgtcaattttaagtgtactttgcttgcggtccttatttttatcttttttagattcttttatgttttggttaaaaaaatttatttttcgattatctcgattagagaaatctaaaaagtaaaataatttaaccaagcaatataaaaaaatattaaagataaaaataagctattattccaagtgggatcttagacttaaatgttaaaaactactttatgtttgagtttgtgttttaaggtaattttataatcaatatgtcgctatatatatccgttctcttgtactaatctacctatgatatagaataaggccatctttaa

SEQ ID NO: 3891 - DNA, 772 bp, Panicum virgatum
  misc_feature (771)..(772): n is a, c, g, or t
ttaacgtgaatgtttgaaattgtttagattctatgaattactatctgtgtctgtatccggctgccgccacagcagcccgatccctcccttccgccgccgccaaaatgatgaacgttcctaagaccatgaagacctactgcaggaacaaggagtgcaggaagcacccttcacaaggtgactcagtacaagaagggtaagaatagcctttctgcctagggaaagcgtcgttatgaccgcaagcagtcaggatatggtggtcagaccatgcccgtcttccacaaggcgaagacctcgaagaagattgtgctgaagctgtagtgccagagctgcaagcactattcccagcacccgatcaaggtgcaagcattttgagattggtggacacaaaagggggagggaacatctctgttctagattgctcagcttatctgaatgctggagttgtggtgtctactactgttcttaaaacctgtcgtcaaatttcagtgttactagtagttcttaaagcggaccaggcttatgtatccaacttcaaatgcctgacatttgctctgagtgttggttgagttttggctaaatgaggtttttttagcttgaatctgttttatgtcttcgattgttgcagccatcgtgattcgtgtgaagttgtctgaatctgtgctgctggatcaccaggatgggtgcttgagtctacaactttaggtctaatatgtgtttgttgactgttgttggcggcttggctcctaattgcaaagcgttcttttgtttttnn

SEQ ID NO: 3892 - DNA, 322 bp, Tragopogon dubius
ccgacacccgcgttctctgaagctcgttcgccatggttaacgtgccaaagacaaagaagacttactgcaagtcaaaggaatgcaagaaacacactttgcataaggtgacgcaatactagaagggtaaagatagtttggctgcacaaggaaagcgtcgttatgacagaaaacaatccggttatggtggtcagacaaaacccgtctttcacaagaaggcaaaaaccaccaagaaaattgttctaaggctgcaatgccaagggtgcaagcatgtttctcagcacccaatcaagaggtgcaagcattttgagattggtggagacaa

SEQ ID NO: 3893 - DNA, 722 bp, Citrus sinensis
tagtattttcagcaagactgggcatatgctgagttcttgatgtggcgtggaatggatgtgtaatttaaggcagatttacttgatgggttttgaatgttggtggacgttttgttgtaactgctcttgttcatgattgtttgttgtttttgtctctactcatataatgttggtgttggtttttgtgattcgaggtgaatgattctaacaagtagtgtgtgtgtattgcaggtgaatgttcccaagactaagaagacttactgcaagagcaaggagtgcagaaagcacaccttgcacaaggtgacacagtacaagaagggcaaggacagtcttgctgctcaagggaagagacggtatgatcgtaaacagtctggctatggtggtcagaccaagcctgtcttccacaagaaggctaagaccaccaagaagattgtgctgaggctccaatgccagggttgcaagcatgtgtctcaacatcccatcaagaggtgcaagcactttgaaattggtggagacaagaagggaaagggaacatctcttttctaaatgcctttatttttgtttgtatgctttttactttgctgcacttgatggaactttacccagtatgagaatatttgttttagttttgttgggttagtttgatgctgttaatttaaaacttgaagcggttgtttgttaagtgcttattttatcagttaattttagaattggattttttgacc

SEQ ID NO: 3894 - DNA, 642 bp, Orobanche aegyptiaca
aatggaacttgttgaatttagttcgtacatatctgtgaatcctatggttttggtgttttcctaagattttattttgtatttctagcagtcttgttttgttttacttacttgaatgctagaatgtattaatggtttgtgtttgcaggtgaacgttccaaagacaaagaagactttttgcaaatcaaagcagtgcaagaagcacaccttgcacaaggtcacccaatacaagaagggtaaagacagcttagctgctcaggggaaacgccggtatgataggaagcagtcgggttatggtggtcagaccaagcctgttttccacaagaaggcaaaaacaactaagaagattgtgctgaggttgcaatgccaaggttgcaaacatgtttctcagcatgctatcaagaggtgcaagcattttgagattggtggagacaagaagggcaagggaacttcacttttttgagtgtttacaaaatgggaaatggcaacttgtttgtttttgccttttattattgggagtttactttgacattgtcctttgttgttattgctactagatattttagattgaatgttgaactttcaatttaatagactcagttttgtgtcactctgcatcagatcaagtatttgaatgaattttct

SEQ ID NO: 3895 - DNA, 349 bp, Flaveria ramosissima
ttccaaagactaagaagacatactgcaagaacaaggagtgcagaaagcacaccttgcataaggtgacacaatacaagaagggaaaagatagtttggccgcacaagggaagcgtcgttatgacaggaaacagtcggggtatggtggtcaaaccaagcctgtttttcacaagaaggctaagaccaccaagaagattgtgctgaggttacaatgccaaggctgcaagcacgtgtctcagcacccaattaagagatgcaaacactttgagattggtggagataagaagggcaagggaacttctctttctaagctttatttattatatatgtagacttacaaatgtttcaacac

SEQ ID NO: 3896 - DNA, 469 bp, Lippia dulcis
cttcctagctgtaaaccatggtgaacgttccaaaaacaaagaagacttactgcaagtcgaaggagtgcaaaaagcataccttgcataaggtcacccagtataagaagggaaaggacagcttagctgctcaaggaaagaggcgttatgatcgtaagcagtccggctatggtggccagaccaagcccgtcttccacaagaggccaaaacaccaagaagattgtgttgaggctgcagtgccagggctgcaagcatgtctcccaacacccgatcaagagtgcaagcatttacgaatcggtgggaacaaaagggcaagggacctcctcttctaatcgtggtaaacgtatctatttgggttttgcttttcgttacgttgggaattaattctagtgacttagtttttgtagtttggctattatggtttgagaaatctgagactagtcgttgtaaacgaactgttaggtattacggc

SEQ ID NO: 3897 - DNA, 639 bp, Picea glauca
aaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattctcaacatgcgatcaagcgttgcaaacattttgagattggtggagacaagaaggggaagggaacgtcccttttctaaactttcagctatgttccagctttctatcgatcattttacattcttgtttgcatatctgtttgaggacagaagttgtgttgtttattagtagattggtggagacaaggggaagggaacgccccttttctaaactttcagctatgttccagctttctatcgatcattttacatttttgtttgcatatctgttcgaggacagaagttttgttgtgttgtttattagtagatagagtcaaaccaactgaagatgccaatttaattttgcctgtctaaaggcctcttgcactttatttatataacaaacccttggattcaaattttgcttggttatgttttctggttattctatattaaaaaactaatcttctgttg

SEQ ID NO: 3898 - DNA, 401 bp, Euphorbia peplus
actgcaagagcaaggaatgcaggaaacacaccttgcacaaggttactcagtacaagaaaggaaaagatagcctttcagctcagggaaaaaggcgttatgatcgtaaacagtcaggatatggtggtcagacaaagcctgtctttcacaagaaggcaaagaccacaaagaagattgtgctgaggctccagtgccaagcatgcaagcatatgtcgcagcatccaattaagaggtgcaagcattttgagatcggtggagacaagaagggcaagggaacttcactcttttaagtgctgtttttttatgtcgaagtttttgatgtacttgttgaactccttttctggagctgaatttaatctagaattttgtcactcattttttcccctttggtgattgctagacat

SEQ ID NO: 3899 - DNA, 500 bp, Cephalotaxus harringtonia
caatggtgaacgttccaaaacaaagaaacattttgcaaaacaaagcatgcaaaaacacacgttgcacaaggttactcagtacaagaaaggcaaggatagtctttctgtccaaggaaaacgacggtatgatcgtaaacaatcaggttatggaggtcaaacaaaacctgtgtttcacaagaaggcgaaaacaacaaagaagattgtgttgaggctgcaatgccagtcttgcaaacatgtctcacagcatccaatcaagcgttgcaaacactttgagattggtggagacaagaaggggaagggaacatcccttttctagagatgcagatatgtatgctttgctcgaacattttactctgtatctacagagattctatccgagactaaagatttgttttgaaaatgaatgctacggaagtaatcattagtattcaatttgaagttcatgttttgatggcaatttaatttgacgaatgatgaaaacttagtatagattaattttt

SEQ ID NO: 3900 - DNA, 357 bp, Euphorbia esula
aaggaatgcaagaaacacaccttgcacaaggttactcagtacaagaaaggaaaagatagcctttcagctcagggaaaaaggcgttatgatcgcaaacagtcgggctatggtggtcagacaaagcctgtcttccacaagaaggcaaaaaccacaaagaagattgttctgaggcttcagtgccagggatgcaagcatgtgtcacaacatcctattaagaggtgcaagcattttgagattggtggagacaagaagggcaagggaacttcactcttttaagttcagtatttttttttcgaaagtttttgatgtacttgttgaactccttttcaggagctgaatttaatctagaattttgtc

SEQ ID NO: 3901 - DNA, 550 bp, Citrullus lanatus
gttcaccgattagtgtttcttcatagaggcagtaaggaccagaatccatcatggtgaacattcccaagacgaagaagacttactgcaaaagcaaggagtgcagaaagcataccttgcacaaggttacgtaatacaaaaagggtaaggacagtcttgctgctcaaggaaagcgtcattatgatggtaaacaatcaggatatggaggacagaccaagcctctctttcataaggcggccaaaactacaaagaagattgtgctaaggttgcaatgccagggttgcaagcatgtctcacagcatcccattaagagatacaagcattttgagattggtgaggacaacaaggcaaagggaacttctcctttttagatgcattaacattgtcattcactatatattgctgtttagggagtcagaattgtggggtttttctaccctttgctttttgtttggtgtttctgatatttgggaatatttttacctgttggattttgtttaatgtatcaatttataatggaacaactagcttatcctctaccaatatatatata

SEQ ID NO: 3902 - DNA, 467 bp, Bupleurum chinense
gacttactgtaagtctaaggagtgcgcaggcacaccttgcacaaggtgacacaatacaaaaagggaaaagattctctcgctgcccagaaagcgccgttatgatcgaaacagtctggttatggtggtcaaacaaagcctgttttccacaagaaggctaaaaccactaaaaagattgtgttgaggctccaatgtcagagctgcaaacacatgtctcagcacccaatcaagagatgcaagcattttgagattggtggggacaagaaggggaagggaacatctcttttttagaatgttgcagtttcacctttgtacttggatgctgctgctggtgtttctgccaggctacatttcatttacataatgtcagctacaatcgtttccttaaagtgtaatctggcaattgttttgggtttgtcacattgatagatactaatctgttagtacgaggagtatgaattatatatttt

SEQ ID NO: 3903 - DNA, 376 bp, Aquilegia formosa
cttgcatatttttgatgttacgttacggataagagatatctgcattgttcaggttaacgttccaaaaacgaagaagacatactgcaagaacaaggagtgcaagaagcacaccctgcacaaggtcacccaatacaagaaaggaaaggacagccttgctgcacagggaaagcgtcgttatgatcgtaagcagtcaggatatggtggacagaccaagcctgtctttcacaaaaaggccaaaactacgaagaagatcgtgctgaggcttcaatgccagagctgcaaacatgtttcccagcatgcactcaagaggtgcaagcattttgagattggtggagacaagaagggaaagggaacttctctcttttagatgggaaga

SEQ ID NO: 3904 - DNA, 580 bp, Secale cereale
cccccaagcacaccctccacaaggttacacaatacaagaaaggcaaggatagtctttctgctcaggggaagcgtcgttatgaccgcaagcagtcaggatatggtggccagacaaagcctgttttccacaagaaggccaagacgacaaagaagattgtgctgaagctgcagtgccagagctgcaagcattactcacaacgcgccatcaagaggtgcaagcactttgaaatcggtggagacaagaagggcaagggaacctctctcttctaagctgatgatatccccgttatgttcagagtgctgtgccagaacttcccactcgaacaatgtattatctcattaatttctgggtatgaactcctatgggctatggagcatatgttttgtctttgtgtcaagtgtcaactactctcatcagatccatgagacaagtaaaatgttctttatgcttgagttcgttctgcttgttcttggtctacttaggattgtagtatatgtttgtggctttacatttcaaatgtgtgctccctctgtttcaaatttatgttcagatttcagctttgatatatatgaagtgcttt

SEQ ID NO: 3905 - DNA, 511 bp, Picea glauca
cggggttatttcgatttgaggagtgtactaaacctcccctttttttaatttactaactcaatataaagagcattatttcgctttattcataaacccttcccaaaaccctaagaacacatatttactcaaataaagtccttttgcgctcctctggttcattgttgagcggcgcgcaaggaaagcagagaggaggaggacgacgacgacgaggttatcagcggctccgcgtgtggatcgtagcaatggtcaatgttccgaagaccaagaaaactttttgcaagaacaaagcttgcaaaaagcacactttgcacaaggttactcagtataagaaagggaaggacagcctttctgcccaaggaaaacgacggtatgatcgaaaacaatcaggttatggaggccaaacaaaacctgtgtttcacaagaaggcaaaaacaacaaagaagattgtgttgaagctgcaatgtcagtcttgcaagcactattcccaacatccgatcaagcgatgcaagca

SEQ ID NO: 3906 - DNA, 326 bp, Triticum aestivum
ccgcaactcctccaccagaaagggaagcacgccggagtcccatctccccggccgtcaaaatggtgaatgttccgaagaccaagaagacctactgcaaaaacaaggagtgcaagaagcacacacttcataaggtcactcagtacaagaagggtaaggacagtctgtctgcccagggaaagcgtcgttatgacaggaagcagtcgggatatggtggtcagaccaagcctgtttccacaagaagcaaaaaccacaaagaagattgtgctgaagctgcaatgccagagctgcaagcactactcccagcgtgccatcaagaggtgcaagca

SEQ ID NO: 3907 - DNA, 373 bp, Fraxinus spp
gttataaataacagcggctttctaaagctagggtttccagacggcattttgcggatctgtgtttcgacttaatcgttgctctctaccgtaacaatggtgaacgttccaaagacaaagaagacctactgcaaatccaaggagtgtagaaagcacaccttgcataaggttacacagtacaagaagggcaaagacagcctagctgctcaggggaagcggcgttatgatcgcaagcagtcaggttatggtggacagaccaagcctgtcttccacaagaaggcaaaaacaacaaagaagattgtgctaaggttgcaatgccagggctgcaagcatgtatcccagcatccaattaagaggtgcaagcactttgagattg

SEQ ID NO: 3908 - DNA, 558 bp, Carthamus tinctorius
  misc_feature (16)..(16): n is a, c, g, or t
  misc_feature (18)..(18): n is a, c, g, or t
  misc_feature (25)..(27): n is a, c, g, or t
  misc_feature (31)..(31): n is a, c, g, or t
  misc_feature (34)..(34): n is a, c, g, or t
  misc_feature (41)..(45): n is a, c, g, or t
  misc_feature (50)..(52): n is a, c, g, or t
  misc_feature (151)..(151): n is a, c, g, or t
gaagctcatcagctcnantctctgnnnctgntcngccatgnnnnncgtcnnnaagacaaggatgacttactgttagtcgaaggactggaggaagcacactttgcataaagcgacacagtatatcgaagggaaaagatagcttgtctgcacnagggaaacgtcgttatgatagaaaacagtcaggttatggtgaacagactaagcccgtgtttcacaagaaggctaataccaccaagaagattgtgctaaggttgcaatgccaagggtgcaagcatgtatcccagcacccaatcaagaggtgcaagcattttgagattggtggagacaagaagggcaagggaacctcccttttctaagcatgcagttatctggatgtcagctatgcaatattttctctctttcaggattacaattatgttatggagtttgcagatttggtttcttttttactgaacttacctactgtttaaagcaatacaaatctgtttttgagtctttgttattgaatctgcttctcatgctttttttatgtgaaaagattgaagttcatttctcgtg

SEQ ID NO: 3909 - DNA, 384 bp, Helianthus annuus
cgatctcgcagagtacgggggcagctgtggccaagatggtgaacgtgcccaagaccaagaaggcctactgcaaggggcgtgactgcaagaagcacaccctgcacaaggtgacccagtacaagtctggcaaggccagcctgtacgcgcaagggaagcgccgttacgaccggaagcagtccggatacggtggtcagaccaagcccgtcttccacaagaaggccaagaccacgaggaagattgtgctgcgtctgcagtgccaggtctgcaagacccagcacatgcacgccatcaagcgctgcaagcacttcgagatcggtggcgagaagaagaccaagggcggtctgtactagacaccttcacatctcctctccatgtaacataagc

SEQ ID NO: 3910 - DNA, 473 bp, Helianthus annuus
gatctcgcagagtacgggggcagctgtggccaagatggtgaacgtgcccaagaccaagaaggcctactgcaaggggcgtgactgcaagaagcacaccctgcacaaggtgacccagtacaagtctggcaaggccagcctgtacgcgcaagggaagcgccgttacgaccggaagcagtccggatacggtggtcagaccaagcccgtcttccacaagaaggccaagaccacgaggaagattgtgctgcgtctgcagtgccaggtctgcaagacccagcacatgcacgccatcaagcgctgcaagcacttcgagatcggtggcgagaagaagaccaagggcggtctgtactagacaccttcgcacctcctctccatgtaacataagctttgcttccaaacacgacggtgtcagcaggaggagaggggcgtcacgtgggctcgcacaggcgtgctctgggcatcaagcaggtgtcagg

SEQ ID NO: 3911 - DNA, 826 bp, Vinca minor
accatttctcccacccgctgcaatttcccaccttcgccgccgacctctactgctctcgactccctctttcactctcccttctttttccaaatcttctgaacccatcacagcgttcatccccacctctcaaaattcatagatccccaattatcgtctacctccgtcagaccctccgcctcttcgatgtcgatttgccgttaccgtcggcgtctccatcactgaggaaaccgtcgaggatatatacagtggctgacaaatgattccaatttaatcagaatctcgggccaagattaactgtcagtttttcatatctacagttaattgttttggaagggcaaaagaaggataatgctgaagttcaactgctgcctttctttctgaactgttgaagggtatatgttaatgttccaaggacaaagaagacctactgcaattcaaatgagtgcaaaaagcacaacttgcacaaggttacccaatacaagaaaggtaaggctagccttgcagctcaagggaagtgttgttatgatcgcaagcagtcaggttatggtggacagactaaacccgtcttccacaagaaggcaaataccacaaaaaagattgtccggaggctccaatgtcagagttgcaagcatgtctcacagcacccaattaagcggtgcaagcattttgagattagtggagacaaaaagggaaagagagcccaacttttctaagaaactgggcatcaaagttcaagtgctgttttatctcatgttttagtcttatatatgctttcaaaattactgtaatcgaggaccattttatcagtggcagtttcatggagaat

SEQ ID NO: 3912 - DNA, 485 bp, Brassica juncea
ccttgtgcaagaaacataccttgcacaaggttacccaatacaagaagggtaaagaaaacttactgcaagaacaaggaatgcaagaaacataccttgcacaaggttacccaatacaagaagggtaaagacagtcttgctgctcaaggaaagcgtcgttatgaccgtaagcaatctggttatggtggtcagaccaagcctgtcttccacaagaaggctaagaccacgaagaagattgtcttgaggcttcagtgccaaacctgcaagcacttctctcagcactcgatcaagaggtgcaagcattttgaaatcggtggagacaagaagggcaagggaacatcacttttctaagctggtctcgtcttgagctttttacaagttttgtacttcgttggatctttattttatctgttttagctctcgtataagattgtttctcatccttgcttgttgactctaatactttgtatcatcaagatatggttttt

SEQ ID NO: 3913 - DNA, 573 bp, Humulus lupulus
gctcccgttcccctcaggctcgcacatctcaactcggctccggcggcggcggtcggtctccggctctgttagcagacatggtgttaacgttcccaagaccaagtaagtacttactgactaagaacaaggagtgcaagaagcacacccttcacaaggttgtactcaatactaagaagggcaaggatagtcttagactgctcgagggtaaccgtcgttaatgaccggaaacagtccggttatggaggtcagaccaagccagtctttcacaagaaggccaaaacacctaagaagatggttcttaggctgcagtgccagggttgcaagcatgtctctcagcacgcaatcaagcggtgcaagcattttgagataggaggagacaagaagggaaagggaacttctcttttctaaatttgtgttgctatgtcatttttgtttttatggatcttgaaatagagttatgggatatttgttaacctagacatgttgtcatgttaaagatcgatttttgtttgtttgaactttgtcaatgttattcttcttaaggttctgataagattttaaatgctgtgcttt

SEQ ID NO: 3914 - DNA, 454 bp, Chelidonium majus
ggagtgcaaaaaagcacaccttgcacaaggttactcaatacaagaagggtaaggacagccttgcagcccaggggaagcgacgttatgatcgcaaacagtctggttatggaggtcagaccaagcctgttttccacaaaaaggcaaaaaccacaaagaagattgttctgaggcttcagtgccagagttgtaaacatatgtctcagcatgctatcaagagatgcaagcattttgagattggtggagacaagaaagggaaaggaacctctcttttttagatggtggaatcttttacttgtttatttttcatgcttcagtgttagaagacatggccatgaattttacttagcagatgtagtgtgattgcttcttctagaaacaagtttcttgcaacttagcaatttaaaatttgaaatattagttcttgaaaattttgctgttttggatttgttcataa

SEQ ID NO: 3915 - DNA, 638 bp, Picea glauca
gacgacgacgaggttatcagcggctccgcgtggatcgtagcaatggtcaatgttccgaagaccaagaaactttttgcaagacaagcttgcaaaagcacactttgcacaaggttgctcagtataagaaggaggcagcctttctgcccaaggaaaacgacggtatgatcgaaacatcaggttatggaggccaaacaaaacctgtgtttcacaagaaggcaaaaacaacaaagaagattgtgttgatgctgcaatgtcggtcttgcaagctctattctcaacatgcgatctagcgttgcttacattttgagattggtgaagacaataagggcaagggaacgtcccttttctaaactttcagctatgttccagctttctatcgatcattttacattcttgtttgcatatctgtttgaagacagaagttgtgttgtttattaataaattggtggacacaaggggaagggaacgccccttttctaaactttctactatgttccagctttctatcgatcattttacatttttgtttgcttatctgttcgaggacggaagttttgatgtgttgtttattagtaaatagagtcaaaccaactgaatatgccaatttaattttgcctgtctacaggcctcttgcactt

SEQ ID NO: 3916 - DNA, 640 bp, Gossypium hirsutum
caatacagagctagagtactctcatgttcagcctcaggcatggtgaacgtacctaagaccaacattacctactgctacaacaaggagggcatgaagcacactttgcacaatggttacacactacactaagggcaaagatagtttggctgctcaagggaagcgccgttaccatcgcacacaatcaggttatggtggtcaaaccaaaccattgttgcacaagaaggccataaccaccaagaaaattgtgctgaggctgcaatgccagggtagcaagcatgtattccaacatccaatcaagaggtgcaagcatttcgaaattggtggcgacaagaaggggaagggaacatctcttttctaaatggtgtttatttatttcatgtcatgtgatgttgtggggaaccttttaagacagaatggcattatcgtttttgtaatgtaatgttttccaagggatatggtgttctttaagcacttaataggtaatggcatcgtctgatctcattgtcgccattatgtttaaatactgtattttaattcaattgctgctggaacttcaataatctatgctatattttacatgaacgacgaattgaattttgcccactacaccaacaaatttttgaaacgaatgtggaatcct

SEQ ID NO: 3917 - DNA, 504 bp, Flaveria ramosissima
tgtgcggctgtcaatctcatctctttcggtcgattttcaggagctcttcaaccatggttaacgttcctaagaccaaaaagacttactgcaagaacaaggaatgccgaaagcataccttgcataaggtgacgcagtacaagaaggggaaagacagcttggctgcacaaggaaagcgtcgttatgacaggaaacaatccggttatggtggtcaaaccaagccagtgtttcacaagaaggcaaaaaccaccaagaagattgtgctaaggttgcaatgccaaggctgcaagcatgtctcccagcacccaatcaagagatgcaagcattttgaaattggtggagacaagaagggcaagggaacatctctttttctgagcaatttgttacaggcttgcttgcagctactatatcgtatttttttgttttagcggaccattcaggtttttaagtgtttgaagtttgtattgcaagggcctattttgttttgacacatctgtctggagaaat

SEQ ID NO: 3918 - DNA, 355 bp, Brassica rapa
cccacgcgtccgcgcgcttcaccggcagtatttcagaggcagcagaaaatggtgaacattcccaagacaaagaaaacttactgccaagtaacaaggtaatgcaagtaaacataccttgcacaagagttgcccaatacaagtaagggtaaagacagacttgctgctcaaggaaagcgtcgttatgaccgtaagcaatctggttatggtggtcagaccaagcctgtcttccacaagaaggctaagaccacgaagaagattgtcttgaagcttcagtagccaaacctgcaagcacttctctcagcactcgatcaagaggtgcaagcatttcgaaatcggcggagactagacgggcaat

SEQ ID NO: 3919 - DNA, 311 bp, Brassica juncea
cagagctcaggttctctctcttcgtctgcagccatggtgaacgtacccaagaccaagaagacttactgcaagagcaaggattgcagaaagcacactttgcacaaggttacacagtataagaagggtaaggatagtttggctgcccaagggaaacgccgttatgatcgcaaacagtcaggttatggtgggcagaccaaaccagtgttccacaagaaggcaaagaccaccaagaagattgtgctaaggctgcaatgccagggttgcaagcatgtctcccagcatccaatcaagaggtgcaagcactttgagat

SEQ ID NO: 3920 - DNA, 588 bp, Carpinus betulus
tttgttcaccgccgagggttttctgaagcagcgcagacctcaattcttcgccatggtgaacgttcctaagacaaagaagacctactgcaagaacaaggaatgcaagaagcataccttgcataaggttacacaatacaagaaaggtaaggatagccttgctgctcagggaaagcggcggtatgaccgcaagcaatctggatatggaggacagaccaaacccgtcttccacaagaaggctaagactaccaagaagattgtgctgaggttgcagtgccagagttgcaagcatgtgtcccagcatgcaatcaagaggtgcaagcattttgaaattggtggagataagaagggaaagggacctctcttttctaaaggcattttgttggtcttgttttactttgtttttcttttcaatgttgttggagcttgaaagatacaatcggataactcttcattttgttctgttagtctaatgttgtcttagcaaaataccatgttgtttctgatcactgtttatgatatcagctttggttagagattgaatttgatgatcattattgtagttgtgcttaatattttgtttaaacaagt

SEQ ID NO: 3921 - DNA, 356 bp, Medicago truncatula
gtgcgagagagcaggcaccatggtgaacgtccccaagacaaagagggcgttctgcaaggacaagaactgcaagaagcacactgtgcacaaggtcacccagtacaagaccggaaaggccagcctgtacgctcagggtaagaggagatacgaccgcaagcagagtgggtacggaggtcagacaaagcccgtcttccacaagaaggcaaagaccaccaagaagattgtgctgaggctgcagtgccagctgtgcaaggcggtgcacatgcaccccatcaagcggtgcaagcacttcgagattggaggagacaagaagggcaagaaccagatgtactagatgtaaagtaatttacgccagc

SEQ ID NO: 3922 - DNA, 379 bp, Sarracenia psittacina
cccgttttccaggtggatagcctctgagggcgatttcgagagactgggaagcgtttgagggggcagcaaccatggtcaacgtccccaagacaaagagggcgttctgcaaggacaagaactgcaagaagcacacggtacacaaggtcacccagtacaagaccgggaaggccagcttgtacgcacaggggaagaggagatacgaccgcaagcagtcagggtatggaggtcagaccaagcccgtcttccacaagaaggcaaagaccaccaagaagatcgtgctgcggctgcagtgccagctgtgcaaagcggtgcacatgcaccccatcaagaggtgcaagcacttcgagatcggtggagacaagaagggcaagaaccagat

SEQ ID NO: 3923 - DNA, 434 bp, Taxus baccata
cgaagaaattcgacttacagaatcgtcaaaatggtcaatgttccaaagactcgaaagacctactgcaagggcaaggcttgcaagaagcacactcaacacaaagtcacacaatacaaggctggcaaggcttccctcttcgcccaaggaaagagacgttatgaccgaaagcagtcaggttatggtggtcagacaaaaccagtcttccacaagaaggctaagacaaccaagaaggtcgtgctgagattggaatgtgtctcctgcaagactaagtcacaactgtcattgaaacgatgcaagcatttcgaacttggtggtgacaagaagaccaagggtgctgcgcttgtcttctagattgcttttggtgatgatgtgtttatggtcaaattctttgtcatacacaatgatggacggacgagacggatgaggcacgcgta

SEQ ID NO: 3924 - DNA, 1588 bp, Zea mays
gtttccccgtttcgttgttttcggttctcctttgcctttgtttcccttttctgttctttgggggttgagctctgaggttttcatacggggtttcatctctagcctaccccaacgtgcttgggacaaaaaggctttgttgttgttgttgttgttgtatctgtatcctaaaaggtgagagagaagggttattaagaaaaaccctcgtcgctggccactgaaggccgggcccaatttagaacctagacctgctgccaccgcactacaagaccgaggcctaaaaggcccatcaggaggcgcatcggcgaatgccccaaactaaaaccctaccccggcaagtatatatatcctcccaacctcagttcttgttcccattatcacggcggcggtggcggagcggaaggcgaaggagtagcagcagcaggcggcgccgagtagcggctccccacctcgagcttgccaccatggctagaggattgaagaagcatttgaagaggctcaatgcgcccaagcattggatgctggacaagcttggcggagcttttgctcccaagccatcttctggacctcacaagtctagggagtgcctgccactgatcctcatcatcaggaacaggctcaagtatgctcttacataccgtgaggtcatttccatcctgatgcaacgccatgtacttgttgatggcaaggtcaggacagacaagacctaccctgctgggttcatggatgtcatttccatccccaagaccaatgagaactacaggctgctgtacgataccaagggccgcttccgccttcacccaatcagggatgaggatgctaagttcaagctttgcaaggttaggtctgttcagtttgggcagaagggcatcccgtacctgaacacgtatgacggccgcaccatccgctaccctgacccgctcatcaaggccaacgacaccatcaagatcgatctggagaccaacaagattgtggacttcatcaagtttgatgttggcaacgtcgtcatggtgactggcggaaggaacactggccgcgtgggtgttatcaagaacagggagaagcacaagggcagctttgagaccattcacgtggaggactccctgggccaccagttcgccacccgtatgggcaacgtgttcaccatcggcaagggtaataagccgtgggtgagcctgcccaagggcaagggaatcaagctgagcatcatagaagagcaaaggaagcgggatgccgctgcccaggctgctgccaacgcataaatcctctgaatgtgctgtgttgagagttttttctagttgctctgcaaggatatagaacaatgttctaagactaccatgtttttaagtctgcctgatgcttataattcatgaacgatttttgcagctagctgtaatgtgactatttatcttatctgcttgttcaaccctgttgtcgtgtgttgattctctgtttcatggtcttttcactcgacagaaacagttatttcttaagaacttcaccattatattcacagctgtgaactatgatattggaagtctttggtcatttttcgttgaactattttgctgaaagttttttccgagaaaga

SEQ ID NO: 3925 - DNA, 1408 bp, Sorghum bicolor
ttaaaaaaatcatcgtcgctggccagtgaatgtcgggcccaatttagaacgtaggcctgctgccaccgcactacagagcctaggcccaaaaggcccatcaggggggcaaatcggtgaatcccgcaaactaaaaccctaccccagtatgtatatatatacccttccaaccttagtcctcgctctcgttatcccggcggcggcggcggactggaaggcgcaggaggaggaggaggagcagcagcaggcggcgccgaggagcggcttcccaccccgagcttgtaaccatggctaggggattgaagaagcatctcaagaggctcaatgcgcccaagcattggatgctggacaagcttggcggagcttttgcccccaagccatcttctggtcctcataagtccagagagtgcctgcctctgatcctcatcatcaggaacaggctcaagtatgctctgacataccgtgaggtcatttctatcctgatgcaacgccatgtacttgtggatggcaaggtcaggactgacaagacctaccctgctgggttcatggatgtcatttccatccccaagaccaacgagaactacaggctgctgtatgacaccaagggccgcttccgtcttcacccaatcagggatgaggatgctaagttcaagctctgcaaggttaggtctgttcagtttggccagaagggcatcccgtacctgaacacctatgatggccgcaccatccgctaccctgacccgctcatcaaggccaatgacaccatcaagattgatttggagaccaacaagattgtggacttcatcaagtttgatgttggcaatgttgtcatggtgactggtggtaggaacactgggcgtgttggtgttatcaagaacagggagaagcataagggcagctttgagaccatccacgtcgaggactctctgggccaccagtttgccacccgtatgggtaatgtgttcactattggcaagggcaacaagccgtgggtgagcctgcccaagggcaagggtatcaagctaagcatcatcgaggaacaaaggaagcgggatgccgctgcccaggctgctgccgcataaatcctcagaatgtgcttggagttttgcttatgtctagtttgtctgcaaggatatagaactctctgttgccagactatatcatgtttaagtttttgcctgatggttgttgattcgtgaacgatgtttgcagctagctctaatgctgtaacgcgactatctatcttattgaactgttgtcgactacaagcctacttgttttggttccctgtttgattgagccatggtggttattgttatgttgtttcatggtgtttgccctatgatattatgaattctgtcactagaagcaggaacggttatttcttgaaaatatttgggttttaccattg

SEQ ID NO: 3926 - DNA, 1433 bp, Sorghum bicolor
aaaaaaatcatcgtcgctggccagtgaatgtcgggcccaatttagaacgtaggcctgctgccaccgcactacagagcctaggcccaaaaggcccatcaggggggcaaatcggtgaatcccgcaaactaaaaccctaccccagtatgtatatatatacccttccaaccttagtcctcgctctcgttatcccggcggcggcggcggactggaaggcgcaggaggaggaggaggagcagcagcaggcggcgccgaggagcggcttcccaccccgagcttgtaaccatggctaggggattgaagaagcatctcaagaggctcaatgcgcccaagcattggatgctggacaagcttggcggagcttttgcccccaagccatcttctggtcctcataagtccagagagtgcctgcctctgatcctcatcatcaggaacaggctcaagtatgctctgacataccgtgaggtcatttctatcctgatgcaacgccatgtacttgtggatggcaaggtcaggactgacaagacctaccctgctgggttcatggatgtcatttccatccccaagaccaacgagaactacaggctgctgtatgacaccaagggccgcttccgtcttcacccaatcagggatgaggatgctaagttcaagctctgcaaggttaggtctgttcagtttggccagaagggcatcccgtacctgaacacctatgatggccgcaccatccgctaccctgacccgctcatcaaggccaatgacaccatcaagattgatttggagaccaacaagattgtggacttcatcaagtttgatgttggcaatgttgtcatggtgactggtggtaggaacactgggcgtgttggtgttatcaagaacagggagaagcataagggcagctttgagaccatccacgtcgaggactctctgggccaccagtttgccacccgtatgggtaatgtgttcactattggcaagggcaacaagccgtgggtgagcctgcccaagggcaagggtatcaagctaagcatcatcgaggaacaaaggaagcgggatgccgctgcccaggctgctgccgcataaatcctcagaatgtgcttggagttttgcttatgtctagtttgtctgcaaggatatagaactctctgttgccagactatatcatgtttaagtttttgcctgatggttgttgattcgtgaacgatgtttgcagctagctctaatgctgtaacgcgactatctatcttattgaactgttgtcgactacaagcctacttgttttggttccctgtttgattgagccatggtggttattgttatgttgtttcatggtgtttgccctatgatattatgaattctgtcactagaagcaggaacggttatttcttgaaaatatttgggttttaccattggctactgagtgatcagcttgttatctg

SEQ ID NO: 3927 - DNA, 1314 bp, Setaria italica
cccaataaggcccgtcacggggggcaaaccggtgaatcccgcaaactaaaaccctaccccaaccagtatatatagcctcccaacctcttcgctctcccactcttgtcatcccggcggcggcggcgcggaagcagaaggaggaggagcagctgcaagcgacgccgaggagcggctacccaccccaagctcgcaaccatggctaggggtctgaagaagcatctcaagaggctcaatgcgccgaagcattggatgttggacaaacttggtggagcttttgcccccaagccatcttctggtcctcacaagtccagggagtgccttcccctgatcctcatcatcaggaacaggctcaagtatgctctgaattaccgtgaggttatttctatcctgatgcaacgccatgtcttggttgatggcaaggtcaggactgacaagacctaccctgctgggttcatggatgtcatttccatccccaagaccaatgagaactacaggcttctgtatgacaccaagggccgcttccgtcttcaccccatcagggatgaggatgccaagaccaagctctgcaaggttaggtctgttcagtttggccagaagggcatcccatacctgaacacctatgatgggcgcaccatccgctaccctgacccgctcatcaaggccaacgacaccatcaagatcgacctggagaccaataagattgttgacttcatcaagtttgatgttggcaacgttgtcatggtgactggtggaagaaacactggtcgtgttggtgtgatcaagaacagggagaagcataagggcagctttgagaccatccacgttgaggatgccctgggccaccagttcgccacccgtcttggcaatgtgttcaccatcggcaagggcaacaagccgtgggtgagcctgcccaagggcaagggtatcaagctcagcattattgaggagcagaggaagcgggatgctgctgcccaggctgctgccaacgcataaattcctcagaatgtgccttgagttttgctatagcgagtttatctgcaaggatatagaactatcttcccagactatcctgttttaagttttgcctgatggttgttgattcgcgaacatgtgtttgcagctagctgtaatgcgactatttatcttatcaagtgcgttttcgagaacatgtctcttgttgtgtttgccctggttgctctgaaatgcttctgtgaattatgagtatcattgtcattgttgctgtggttgttcgtactcggttatgttaatgttaatttcctgggatgatatgaattctgttggtttagattctta

SEQ ID NO: 3928 - DNA, 1174 bp, Panicum virgatum
gcactcttggcatcccggcggcggcggcgcgaaaggagaaggaggaggagcagcagcaggcggcgccgaagagcaagctacccacccccagcccgcaaccatggctaggggattgaagaagcatctcaagaggctcaatgcgcctaagcattggatgctggacaaacttggtggagcttttgcccccaaaccatcttctggtcctcacaagtccagggagtgccttcccctcatccttatcatcaggaacaggctcaagtatgctctgacataccgtgaggttatttctatcctgatgcaacgccatgtcttggttgatggcaaggtcaggactgacaagacctaccctgctgggttcatggatgtcatttccattcccaagaccaatgagaactacaggcttctctatgacaccaagggtcgcttccgtcttcaccccatcagggatgaggacgccaagttcaagctctgcaaggttaggtctgttcagtttggccagaagggcatcccctaccttaacacctatgatggtcgcaccatccgctaccctgacccgctcatcaaggccaacgataccatcaagatcgaccttgagaccaacaagattgttgacttcatcaagtttgatgttggcaatgttgtcatggtgactggtggaaggaacactgggcgtgttggtgtgatcaagaacagggagaagcataagggcagctttgagaccatccacgttgaggatgcccagggccaccagttcgccacccgtctgggcaatgtgttcaccattggcaagggcaacaagccgtgggtgagcctgcccaagggcaagggtatcaagctcagcatcatcgaggagcagaggaagcgggatgccgctgcccaggctgccgccaacgcataaattcctcagaatgtgcttttgagtttttctatagcgagtttatctgcaaggatatagaactatctacccagactatcctgttttaagttttgccctatggttgttgattcgcgaactgatgtttgcagttagctgtaatgcgactatttacttattgaagtgcattttcgagaacatgtcttcctgttttgtttaccctggtttctctgaaatgttactgtacgtgtatcattgtgatctgttcttactccgattcagtaatatgctcctaatgtc

SEQ ID NO: 3929 - DNA, 1218 bp, Panicum virgatum
ccaggcggcggcggcgcggtaggagaaggaggaggagcagcagcagcagcaggcggcgccgaagagcagctacccacccccaacccgcaaccatggctaggggattgaagaagcatctgaagaggctcaatgcgccgaagcattggatgttggacaaacttggtggagcttttgcccccaaaccatcttctggtcctcacaagtccagggagtgccttcccctcatcctcatcatcaggaacaggctcaagtatgctctgacttaccgtgaggttatttctatcctgatgcaacgccatgtcttggttgatggcaaggtcaggactgacaagacctacccagcagggttcatggatgtcatttctattcccaagaccaatgagaactacaggcttctgtacgacactaagggtcgcttccgtcttcaccccatcagggatgaggatgccaagttcaagctctgcaaggttaggtctgttcagtttggccagaagggcattccctacctgaacacttatgatggtcgcaccatccgctaccctgacccactcatcaaggccaacgacaccatcaagatcgaccttgagaccaacaagattgttgacttcatcaagtttgatgttggcaacgttgtcatggtgactggtggaaggaacactgggcgtgttggtgtgatcaaaaacagggagaagcataagggcagcttcgagaccatccatgttgaggatgccctaggccaccagtttgccacccgtctgggcaatgtgttcaccatcggcaagggcaacaagccgtgggtgagcctgcccaagggcaagggtatcaagctcagcatcatcgaggagcagcggaagcgggatgccgctgcccaggctgctgccaacgcataaaatcctcagaatgtgctttgagttttgctatagcgagtttatctgcaaggatatagaactacccagactatcctgttttaagttttgccctatggttgttgattcgcgaactgatgtttgcagttagctgtaatgcgactatttacttattgaagtgcgttttcgagaacatgtctttctgttttgtttacccgggttgctcttgaatgtacctgcatgtgtatcattgtggtctatggttgatcatactcggattcagtaatatcctcctaatatcatgtcctataggccagatcaaagcaactaagcaagcaagaattttgccttg

SEQ ID NO: 3930 - DNA, 1100 bp, Cenchrus ciliaris
ccggcggcggcggcggcgcggaagcagaaggaggagcagcagctgcaggcgacgccgaggagcggctaccccaacccaagcgcgcaaccatggctaggggtctgaagaagcatctcaagaggctcaatgcgccgaagcattggatgttggacaaacttggtggagcttttgcccccaagccatcttctggtcctcacaagtccagggagtgccttcccctgatcctgatcatcaggaacaggctcaagtatgctctgacttacggtgaggttatttccatcctgatgcaacgccatgtcttggttgatggcaaggtcaggactgacaagacctaccctgctgggttcatggatgtcatttccatccccaagaccaatgagaactacaggcttctgtatgacaccaagggccgcttccgtcttcaccccatcagggatgaggatgccaagaccaagctctgcaaggttaggtctgttcagtttggccagaagggtatcccgtacctgaacacctatgatggccgcaccatccgctaccctgacccgctcatcaaggccaatgacaccatcaagatcgacctggagaccaacaagatcgttgacttcatcaagtttgatgttggcaatgttgtcatggtgactggtggaagaaacactggccgtgttggtgtgatcaagaacagggagaagcataagggcagctttgagactatccacgttgaggatgccttgggccaccagttcgccacccgtctgggcaatgtgttcaccatcggcaagggcaacaagccgtgggtgagcctgcccaagggcaagggtatcaagctcagcatcattgaggagcagaggaagagggatgctgctgcccaggctgctgccaacgcataaattcctaagaatgttccttgagttttgctatagcgagttaatctgcaaggatatagaactatcttcccagactatcctgtttttaagttttgcctgatggttgttgattcgcgaacatgtgtttgcagctagctgtaatgcgactatttatcttatcaagtgcgttttcgagaacatgtctatctggtttgcgtgccttggtgattgctctga

SEQ ID NO: 3931 - DNA, 1194 bp, Sorghum bicolor
ggacaaaaccgtaaaacaaaacgaaaaccctactgccgcagcttataacctgtcgccgtgctcctttcgcctcccttcttccagcggcggcaccggcacgaagcagagcgaaccaccaggcctcagcgtgcggtggacggcgagagctctggcgccctagcccgagctcgcaaccatggcgaggggattgaagaagcatctgaagaggctcaatgcacccaagcactggatgctagacaagctcggtggagcctttgctcccaagccatcatctgggcctcacaagtccagggagtgcctgcccctgattctgatcatcaggaaccggctcaagtatgccttgacataccgtgaggtgatatccatcttgatgcagcgccatgtgttggttgatggcaaggtcaggactgacaagacctacccttctggcttcatggatgtcatttccattccaaagactggtgagaactacagacttctctatgacaccaagggtcgcttccgccttcactctgttagggatgaggacgcaaagttcaagctttgcaaggtccgttctgtccagtttggtcagaagggcattccgtatctgaacacatatgatgggcgcaccatccgctatcctgatcctcttattaaggcaaatgacacaatcaagattgatctggagacaaataagatcgttgatttcatcaagtttgacgtgggcaatgtcgttatggtcactggagggaggaacactggtcgtgttggtgtgataaagaacagggagaagcacaagggaagctttgagaccattcatgtggaggatgccttgggccatgccttcgccacccgtatgggcaatgtgttcacaattggcaagggcaacaaaccatgggtgagtctccccaagggcaagggtattaagctcagcatcattgaggagcagagaaagcgggatgctgctgctcaggctgctgcgaatgcttaagtagtttgcataaagtttgctgaaacattcaatgaaaatatgccttgcatccgagtttgggactgaaatgtaacccttttaggctagtagttattagtattttgaaatactctagacatctatctatcaggttagcattatctcatggcaagtcattacagaatgtttaatttggttccattctagattttgttgtgctatcttaattgcgctgttcaatt

SEQ ID NO: 3932 - DNA, 1346 bp, Sorghum bicolor
aaaaccgtaaaacaaaacgaaaaccctactgccgcagcttataacctgtcgccgtgctcctttcgcctcccttcttccagcggcggcaccggcacgaagcagagcgaaccaccaggcctcagcgtgcggtggacggcgagagctctggcgccctagcccgagctcgcaaccatggcgaggggattgaagaagcatctgaagaggctcaatgcacccaagcactggatgctagacaagctcggtggagcctttgctcccaagccatcatctgggcctcacaagtccagggagtgcctgcccctgattctgatcatcaggaaccggctcaagtatgccttgacataccgtgaggtgatatccatcttgatgcagcgccatgtgttggttgatggcaaggtcaggactgacaagacctacccttctggcttcatggatgtcatttccattccaaagactggtgagaactacagacttctctatgacaccaagggtcgcttccgccttcactctgttagggatgaggacgcaaagttcaagctttgcaaggtccgttctgtccagtttggtcagaagggcattccgtatctgaacacatatgatgggcgcaccatccgctatcctgatcctcttattaaggcaaatgacacaatcaagattgatctggagacaaataagatcgttgatttcatcaagtttgacgtgggcaatgtcgttatggtcactggagggaggaacactggtcgtgttggtgtgataaagaacagggagaagcacaagggaagctttgagaccattcatgtggaggatgccttgggccatgccttcgccacccgtatgggcaatgtgttcacaattggcaagggcaacaaaccatgggtgagtctccccaagggcaagggtattaagctcagcatcattgaggagcagagaaagcgggatgctgctgctcaggctgctgcgaatgcttaagtagtttgcataaagtttgctgaaacattcaatgaaaatatgccttgcatccgagtttgggactgaaatgtaacccttttaggctagtagttattagtattttgaaatactctagacatctatctatcaggttagcattatctcatggcaagtcattacagaatgtttaatttggttccattctagattttgttgtgctatcttaattgcgctgttcaatttgcaacttagatcaatgagttccaaggtttggttttgttcttgacagctcatttcgtgacgaaggaatgaatttatctgttcatgtggctttgtttgttgttgagaagaatccaatgactgcactaaacaatgctcacacaagtatgtatcaacgt

SEQ ID NO: 3933 - DNA, 2519 bp, Pennisetum glaucum
acgtaacaaccacagacaaattgatgacgataattcacagaagcatcagaggaaccaagacacgcaaaccagacatgttctagaaaatgcacttgataagataaatagtcgcattacagctagctgcaaacacaggttcgcaaatcaacaaccatcaggcaaaacttaaaaacaggatagtctgggaagatagttctatatccttgcagattaactcgctatagcaaaactcaaggcacattatgaggcatttatgcgttggcagcagcctgggcagcggcatccctcttcctctgctcctcaatgatgctgagcttgatacccttgcccttgggaaggctcacccacggcttggtacccttgccgatggtgaacacattgccaagacgggtggcgaactggtggcccagggcatcctcaacgtggatggtctcaaagctgcccttatgcttctccctgttcttgatcacaccaacacggccagtgtttcttccaccagtcaccatgacaacattgccaacatcaaacttgatgaagtcaataatcttgttggtctccaggtcaatcttgatggtgtcattggccttgatgagcgggtcagggtagcggatagtgcggccatcataggtgttcaggtaggggatgcccttctggccaaactgaacagacctaaccttgcagagcttggtcttggcatcctcatccttgatggcatgaagacggaagcggcccttggtgtcatacagaagcctgtagttctcattggtcttggggatggaaatgacatccatgaacccagctgggtaggtcttgtcagtcctgaccttgccatcaaccaagacatggcgttgcatcaggatagaaataacctcacggtaggtcagagcatacttgagcctgttcctgatgatgaggatcagaggaaggcactccctggacttgtgaggaccagaagatggcttgggggcaaaagctccaccaagtttgtccaacatccaatgctttggcgcattgagcctcttgagatgcttcttcagacccctagccatggttgcgagcttggggtggggtcgccgctcctcggcgtcgcctgcagctgccgctcctccttctgcttctgcgccgccgccgccgggccatgggcaaggagaagagtcacattaacatcgtggtcattggccatgtcgactctggcaagtcgaccaccactggccacctgatctacaagcttggaggtattgacaagcgtgtgatcgagaggttcgagaaggaggccgcagaaatgaacaagaggtccttcaagtacgcgtgggtgctcgacaagctgagaggtatcaccatcgacattgccctgtggaagtttgagaccaccaagtactactgcacggtcatcgatgcccctggtcaccgtgacttcatcaattaccggtacctcccaggccgactgtgctgtcctcatcattgactccaccactggtggttttgaggctggtatctctaaggatggccagacccgtgagccttgctttcactcttggagtgaagcaaatgaactcccaagtactccaaggcccgttatgatgagattgttaaggaagtctcctcgtacctcaagaaggtgggttacaacccagacaagattgccttcgtccccatctccggtttcgagggtgacaacatgattgagaggtccaccaaccttgactggtacaagggcccaaccctgcttgaggctctggaccagatcaacgagcccaagaggccctccgacaagcccctgcgtctcccccttcaggatgtgtacaagatcggtggtattggaactgtccctgttggccgtgttgagactggtgtgatcaagcctggtatggttgtcacctttggtccaactggcctgactactgaggttaagtctgttgagatgcaccacgaggctctccaggaggcccttcccggtgacaatgttgggttcaacgtgaagaatgttgctgtgaaggatctcaagcgtggttatgtggcctccatcatcatgaaccaccctgggcagatcggcaatggctatgccccagtgctcgactgccacacctcccacattgctgtcaagtttgctgagcttgtcaccaagatcgacagacgatctggtaaggagcttgagaaggagcccaaattcctgaagaatggtgatgctggtatggtgaagatgattcccacgaagcccatggttgttgagacattctctctcctcttggccgctttgctgttcgtgacatgaggcagtggtgtcatcaagaggaaggatcccaccggtgccaaggttaccaaggctgctgccaagaagaaatgagaggtgttttaagctttgttaggccattgtttttgcagttggtagcaactgtaatttctgctggcaatgtgccctagttgtcctgtaaacgctactgttattttggttgtggttaaacctggctactttgagtgagttaaacgctctgtagtaacaatcttgctgttctgcacct

SEQ ID NO: 3934 - DNA, 1129 bp, Pennisetum glaucum
ggcgcagaagcagaaggaggagcggcagctgcaggcgacgccgaggagcggcgaccccaccccaagctcgcaaccatggctaggggtctgaagaagcatctcaagaggctcaatgcgccaaagcattggatgttggacaaacttggtggagcttttgcccccaagccatcttctggtcctcacaagtccagggagtgccttcctctgatcctcatcatcaggaacaggctcaagtatgctctgacctaccgtgaggttatttctatcctgatgcaacgccatgtcttggttgatggcaaggtcaggactgacaagacctacccagctgggttcatggatgtcatttccatccccaagaccaatgagaactacaggcttctgtatgacaccaagggccgcttccgtcttcatgccatcaaggatgaggatgccaagaccaagctctgcaaggttaggtctgttcagtttggccagaagggcatcccctacctgaacacctatgatggccgcactatccgctaccctgacccgctcatcaaggccaatgacaccatcaagattgacctggagaccaacaagattattgacttcatcaagtttgatgttggcaatgttgtcatggtgactggtggaagaaacactggccgtgttggtgtgatcaagaacagggagaagcataagggcagctttgagaccatccacgttgaggatgccctgggccaccagttcgccacccgtcttggcaatgtgttcaccatcggcaagggtaccaagccgtgggtgagccttcccaagggcaagggtatcaagctcagcatcattgaggagcagaggaagagggatgccgctgcccaggctgctgccaacgcataaatgcctcataatgtgccttgagttttgctatagcgagttaatctgcaaggatatagaactatcttcccagactatcctgtttttaagttttgcctgatggttgttgatttgcgagcctgtgtttgcagctagctgtaatgcgactatttatcttatcaagtgcattttctagaacatgtctggtttgcatgtcttggttcctctgaatgcttctgtgaattatcgtcatcaatttgctgtggttgttcgtatccgt

SEQ ID NO: 3935 - DNA, 1015 bp, Pennisetum glaucum
gcagaagcagaaggaggagcggcagctgcaggcgacgccgaggagcggcgaccccaccccaagctcgcaaccatggctaggggtctgaagaagcatctccagaggctcaatgcgccaaagcattggatgttggacaaacttggtggagcttttgcccccaagccatcttctggtcctcacaagtccagggagtgccttcctctgatcctcatcatcaggaacaggctcaagtatgctctgacctaccgtgaggttatttctatcctgatgcaacgccatgtcttggttgatggcaaggtcaggactgacaagacctacccagctgggttcatggatgtcatttccatccccaagaccaatgagaactacaggcttctgtatgacaccaagggccgcttccgtcttcatgccatcaaggatgaggatgccaagaccaagctctgcaaggttaggtctgttcagtttggccagaagggcatcccctacctgaacacctatgatggccgcactatccgctaccctgacccgctcatcaaggccaatgacaccatcaagattgacctggagaccaacaagattattgacttcatcaagtttgatgttggcaatgttgtcatggtgactggtggaagaaacactggccgtgttggtgtgatcaagaacagggagaagcataagggcagctttgagaccatccacgttgaggatgccctgggccaccagttcgccacccgtcttggcaatgtgttcaccatcggcaagggtaccaagccgtgggtgagccttcccaagggcaagggtatcaagctcagcatcattgaggagcagaggaagagggatgccgctgcccaggctgctgccaacgcataatgcctcataatgtgccttgagttttgctatagcgagttaatctgcaaggatatagaactatcttcccagactatcctgttttaagtttgcctgatggttgttgatttgcgaacctgtcgtttgcagctaggctgtaatgcgactt

SEQ ID NO: 3936 - DNA, 1903 bp, Oryza sativa
gcttgcgcactaaaactggggcatctctatcaacatattactcctaccgataaaattactcgttaatatgatctgatccttcacgacgattgagaagcactcgaaatgtggaataggcggaacgggaatcgacttcgctcaccctgcccttggagaagagctcgagtcccaggttgacgcacgactccgccgtcgggacagccaccgcctccttccccggcgatggcgggggagacggagacgaagaggccttggagcggagcacgcagcggcgtcgtcggccgcaatgagggaggaggggcgagacgaaggatagcgcttggagggcatagctacgggttccgccgcctccgcctccaccgccgccggcggggagaagggcgaggtgtggccggagagccgatgctccggcggccgccattgccggtttcgtgaggtgaggtggtcgtttttctcgttatccaaactagtatttgtggtcgaggaggaacgagttgggccgaagaagatgcaaaacccagcccatttactcatcacgtgtaaaaaagaaaagcccaaaccggcccaccacggaaaccctacttgcgctgcgcctccgcagcatataacctctcccacctctcgccctccgccatccctctctcctctttggcggcggcggcggaagagagcgacgcagacggacggcgtggtggtctccccctccggcgacgtagctcgagctcgcaaccatggcgaggggattgaagaagcatctcaagaggctcaatgcgcccaagcactggatgctcgacaagctcggcggagcttttgcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatggatgtgatttccattccaaagactggtgagaactacaggcttctctatgacaccaagggtcgcttccgccttcagtccgtcaaggatgaggatgccaagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggagggaggaacactggtcgtgttggagtaattaagaacagggagaagcacaagggcagttttgagaccatccatgtggaggacgcattgggccatgccttcgccacccgtctgggcaatgtgttcaccatcggcaagggcaacaagccatgggtgtctctccctaagggcaagggtatcaagctcagcatcatcgaggaacagaggaagcgagatgctgctgctcaggctgctgcaaatgcttaaatacatttctatcttcaaaatttgagttttgtttgggttgacagaattttccatcctagttgaaatgtagttcacagtaatactgttaagttgcagagatgcatccttttctactgttatttcatgttatcgagccattttattgtgttcatcttttggccttgaagctaccaaaatggctgagaccgttatcatcatgcagtcattataatgaacagtagcaattagccatcacttgtttagagcgagatttgttttcaggcaactgctgctttactgaagctacatggctaatcttggtttattcaaacgagactattggcatccttccagcttggcattcaaagggagtcttggtttaatcaaataggctt

SEQ ID NO: 3937 - DNA, 1129 bp, Oryza sativa
atccctctctcctctttggcggcggcggcggaagagagcgacgcagacggacggcgtggtggtctccccctccggcgacgtagctcgagctcgcaaccatggcgaggggattgaagaagcatctcaagaggctcaatgcgcccaagcactggatgctcgacaagctcggcggagcttttgcccccaagccatcgtctggacctcacaagtccagggaatgcctgcccctgatcctcatcatcaggaacaggttgaagtatgcgctgacataccgtgaggttatctctatcctgatgcagcggcatgtcttggttgatgggaaggtcaggactgacaagacctaccctgctggtttcatggatgtgatttccattccaaagactggtgagaactacaggcttctctatgacaccaagggtcgcttccgccttcagtccgtcaaggatgaggatgccaagttcaagctttgcaaagttcggtctgtccagtttggacagaagggcattccctatctgaacacctatgatggacgcaccatccgctacccggaccctttgattaaggctaacgacacaatcaagattgatcttgagaccaacaagattgttgacttcatcaagtttgatgtgggcaatgtcgttatggtcacaggagggaggaacactggtcgtgttggagtaattaagaacagggagaagcacaagggcagttttgagaccatccatgtggaggacgcattgggccatgccttcgccacccgtctgggcaatgtgttcaccatcggcaagggcaacaagccatgggtgtctctccctaagggcaagggtatcaagctcagcatcatcgaggaacagaggaagcgagatgctgctgctcaggctgctgcaaatgcttaaatacatttctatcttcaaaatttgagttttgtttgggttgacagaattttccatcctagttgaaatgtagttcacagtaatactgttaagttgcagagatgcatccttttctactgttatttcatgttatcgagccattttattgtgttcatcttttggccttgaagctaccaaaatggctgagaccgttatcatcatgcagtcattataatgaacagtagcaattagccatc

SEQ ID NO: 3938 - DNA, 1340 bp, Oryza sativa
accaactagtatatatagcctctccaaccctcgctctcccactcttgtcatctcggcggcggcgcggcgcggagcagaggaggacgaagcagcaggcggcggcggcagagcacggcgacctagcccgacctcgcaaccatggcaaggggtttgaagaagcatctgaagaggctcaatgcgcccaagcattggatgctcgacaagcttggtggagcttttgcccccaagccatcttctggtcctcacaagtccagggagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatggatgtcatttccatccccaagactggtgagaactacaggcttctgtacgacaccaagggacgtttccgccttcagtctgtcaaggatgaggatgctaagttcaagctttgcaaggttcggtctgtgcagtttggccagaagggaatcccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgggccaccaattcgccacccgtctgggcaatgtgttcaccattggcaagggcaacaagccttgggtgagcctgcccaagggcaagggcatcaagctcagcatcatcgaggagcaaaggaagcgggatgctgccgcccaggctgctgccaacgcttaaaatctgctgctgcgtctgcctggagttttgctatagcgagttgtttgcaaggatatagaactatctgccccagactatccttttttgagctcttttgcctaatgttatgttgatcaattcgcgaactcatgtttgctgctagctgtaatgcgactgtttaccttatttaaggcgccttttaagaacctccaaaccaaattgtctttgcctgttgctgagatggtatggttttgagcattcagcctatggcctttttgttcatagtcgcgttgcttctgttctgtttgcccgttgcatcattgttctgttagtctctattcgaagctcgtatactcgagcttaattactgggtgtcagttgttcgccattgaggatggatggagtagcatgctgtttgtctccgt

SEQ ID NO: 3939 - DNA, 1307 bp, Oryza sativa
tctcccactcttgtcatctcggcggcggcgcggcgcggagcagaggaggacgaagcagcaggcggcggcggcagagcacggcgacctagcccgacctcgcaaccatggcaaggggtttgaagaagcatctgaagaggctcaatgcgcccaagcattggatgctcgacaagcttggtggagcttttgcccccaagccatcttctggtcctcacaagtccagggagtgcctgcctctgatcctcattatcaggaacaggctcaagtatgctctgacataccgtgaggttatttctatcctcatgcagcgccatgtcttggttgatggcaaggtcaggactgacaagacctacccagctggtttcatggatgtcatttccatccccaagactggtgagaactacaggcttctgtacgacaccaagggacgtttccgccttcagtctgtcaaggatgaggatgctaagttcaagctttgcaaggttcggtctgtgcagtttggccagaagggaattccctacctgaacacctatgatggtcgcaccatccgctaccctgacccgatcatcaaggcaaacgacacaatcaagatcgatctggagaccaacaagattgtcgacttcatcaagtttgatgttggcaatgttgtcatggtgactggaggaaggaacacaggccgtgttggtgtgatcaagaacagggagaagcataaaggcagcttcgagaccatccacgttgaggatgccctgggccaccaattcgccacccgtctgggcaatgtgttcaccattggcaagggcaacaagccttgggtgagcctgcccaagggcaagggcatcaagctcagcatcatcgaggagcaaaggaagcgggatgctgccgcccaggctgctgccaacgcttaaaatctgctgctgcgtctgcctggagttttgctatagcgagttgtttgcaaggatatagaactatctgccccagactatccttttttgagctcttttgcctaatgttatgttgatcaattcgcgaactcatgtttgctgctagctgtaatgcgactgtttaccttatttaaggcgccttttaagaacctccaaaccaaattgtctttgcctgttgctgagatggtatggttttgagcattcagcctatggcctttttgttcatagtcgcgttgcttctgttctgtttgcccgttgcatcattgttctgttagtctctattcgaagctcgtatactcgagcttaattactgggtgtcagttgttcgccattgaggatggatggagtagcatgctgtttgtctccgtg

SEQ ID NO: 3940 - DNA, 1342 bp, Eragrostis curvula
cggtggttcttcgggggcggcggcgcggaaggagaagcagcagcagcaccaggcggcgaggcgcggcgacccagcccgagctcgcaaccatggctaggggtttgaagaagcatttgaagaggctcaatgccccgaagcattggatgttggacaaacttggtggagctttcgcccccaagccatcctctggtccccacaagtccagggagtgccttcccctgatcctgatcatcaggaacaggctcaagtatgccctgacataccgtgaggtcatttctatcctgatgcagcgccacgtgttggttgatggcaaggtcaggactgacaagacctaccctgctgggttcatggatgtgatttccattcccaagaccaatgagaactacaggcttctgtatgacaccaagggacgcttccgtcttcacccaatcaaggatgaggattccaagtggaagctctgcaaggttaggtctgtccagtttggccagaagggcatcccgtacctgaacacctatgatggtcgcaccatccgctaccctgaccctctcatcaaggccaatgacaccatcaagattgatctggagaccaacaagattgttgacttcatcaagttcgatgttggcaacgtcatcatggtgactggtggaagaaacactggccgtgttggtgtgatcaagaacagggagaagcataagggaacctttgagaccatccacgttgaggacgccctgggccaccagttcgccacccgtctgggtaatgtgttcaccattggcaagggcaccaagccgtgggtgagcctgcccaagggcaagggtatcaagctcagcatcattgaggagcagaggaagcgggatgctgctgcccaggctgctgctgcttaaagaatgtgccttgaattttgctgtagtagcgagttatctgcaaggatatagaactatcttcccaaaccatgttttaagttttgcctgatgcatgttgattcctgaactgatgtttgctgttactgttatgccactaattatgttacccaattccttttaaaaaaaatcccttacttgctctgcaaaaaaaaaaaaaaaaaaaaaaaaaaaaaaaataatctggcgttaatacccctggttaaccaaattcccccggcccccatgggggcccgggaaaaggccaagtcgggccccattttccccaaaagggaattcaaaattaaatttttccggggccccctttttaaaaactttcggggaggggggaaaaacccctgggcgttttcccccaacttttaaccccccctttttccaaccccaacccccccccctttttcctcccccccccgggggggggg

SEQ ID NO: 3941 - DNA, 1081 bp, Cynodon dactylon
gccgggggtcatcccggcggcggcggcgcggaaggagcagcagcagtagaagcagcagcgcgccgaggagcggcgacccggcccgagctttcagccatggctaggggtttgaagaagcatctcaagaggctcaatgcccccaagcactggatgctggacaaacttggcggtgcctttgcccccaagccatcctctggtccccacaagtccagggagtgccttcctctgatcctcatcatcaggaacaggctcaagtatgctctgacgtaccgtgaggtcatttctatcctgatgcagcgccatgtgttggttgatggcaaggtcaggactgacaagacctaccctgctgggttcatggatgtgatttccattcccaagaccaatgagaactacaggcttctgtatgacaccaagggacgcttccgtcttcaccctgtcaaggatgaggatgctaagtggaagctgtgcaaggttaggtctgtccagtttggccagaagggtatcccctacctgaacacctacgatggccgcaccatccgctaccctgaccctctcatcaaggccaacgacaccatcaagattgatctggagaccaacaagatcattgacttcatcaagtttgatgttggcaatgtcatcatggtgactggtggaaggaacactgggcgtgttggtatcatcaagaacagggagaagcataagggtacctttgagaccatccacgttgaggatgccactggccaccagtttgccacccgtctgggtaatgtgttcaccattggcaagggcaccaagccgtgggtcagccttcccaagggcaagggtatcaagctcagcatcatcgaggagcagaggaagcgtgatgccgctgcccaggctgctgctgcataaatctgaatgctgcttgagttttgctatagtgagctatctattcaaggatatagaactatgttgccagactatcctttttaagttttgcctgatgcttgtcgaatcgtgaactgattgttttcagttagctgtaatgcaactatttatgttatccaagtcgttttcgagaacaaaaaaaaaaaaaaaaaaa

SEQ ID NO: 3942 - DNA, 1312 bp, Hordeum vulgare
ctctctcgccccatcgcttcgtcctcattctttgtcatcccggcggcggcgcgtagcagaggagaaggagcaggcggcgggggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggaatgcctgcctctgatcctcatcctgaggaacagactgaaatatgctctcacgtaccgtgaagtgcaatctatccttatgcagcgtcatattatggttgatggaaaggtccgcactgacaagacctaccctgctggtttcatggacattatttctattcccaagactggtgagaactacaggcttctgtatgacaccaagggccgcttccgccttcactctgtcagggatgaggatgctaagttcaagctctgcaaggtcaggtctgtccagttcggccagaagggcatcccatacctgaacacctatgatggccgcaccatccgctacccagacccactcatcaaggccaacgacaccatcaagctcgacctggagaccaacaagattgttgacttcatcaagtttgacgtcggcaacgtcgtcatggtgactggtgggcgcaacactgggcgtgttggtgtgatcaagaacagggagaagcataagggaacctttgagaccatccacgttgaggatgcccagggtcaccagtttgccacccgtctgggcaacgtgttcaccattggcaagggcaccaagccttgggtgagcctccccaagggcaagggtatcaagctcaccatcattgaggagcagaggaagagggatgccgcagctcaggctgctgccaaggcctgattctgaggcattgagtcgttttgctatagccagttatctgcaaggatatagaactatgttcctggaaccatcttttttaagttttgcctgatgtttgttgatttgcgaacccatggatgctgctagatgtaatgtggatgtttaccttattaagtgctatttcgagacctcatctggttatcttaatgtttgagataagtttaggcattatctagtatttgctgtttaatttctagttgaatttagcatcgcagataatcctcgacgacgtcttctctgtactagggaagccaggtctcgcctggctcgtgatccacaaccgcccgataatgtctggactaccgacatgcctcaaattaatctgaggacgcctggtcacggtcgac

SEQ ID NO: 3943 - DNA, 1514 bp, Triticum aestivum
ctccatccatagtggagatagatgaagcaattacagggagacatgcgcacacacatacacacaaggacaccatggacagagcataggcggagagcgagcaagcaaatcacacgcacacgcacccttgctcgactccatcagatcagacgctcgttattcaagtatactctcacaccatcacacgtacgtacgtacgagtgcatgcagcttaacagttgcaggggttgcacttgcagttgtcgccgcagctgcagccctcgccggactgcccggcggccacctcgaactgccccgccttgttctcaggagccacgccgaacacgaccacggcggcgacctgggcggcggcgctgccctgctctgtcagatcagggtacatcttcccgcacttgcagtctgagccgcagctgcaaccggatccacagttgcaagacatcctccaaatctgtgaacccaaaaagatttcaaggagaagaagatgggctttggtatcgcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaaccttcgagaccatccacgttgaggatgcccagggccaccagttcgccacccgtctgggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggtgttgagtcgttttgctatagccagttatctgcaaggatatagacctatgttcctggaaccatcgtttttaagttttgcctgatgtttgttgatttgcgaactcgtggttgctgctagatgtaatgtggatgtttaccttattaagcgctatttcgagac

SEQ ID NO: 3944 - DNA, 1215 bp, Brachypodium distachyon
ctccactctttctcaacccggcggcggcgcgcagagaaggcagaagaccaggcggcggcgcacgaagcagagaagcaggacggcgacctagcccgacctttcaaccatggctaggggtttgaagaagcatctgaagaggctcaatgcgccatcgcattggatgctggacaagcttggtggagcatttgcccccaagccctcttctggtcctcacaaggccagggagtgcctgcctctgatccttattctcaggaataggctgaagtatgctcttacttaccgtgaggtgcagtctatcctcatgcagcgccaaattttggttgatggcaaggtcagaactgacaagacctacccagctggtttcatggatatcatttccatccccaagactggtgagaactacaggctcctatatgatacaaaggggcgtttccgcctccactctgtcagggatgaggattctaagttcaagctttgcaaggttaggtctgtccagtttgggcagaagggcattccctacctgaacacctatgatggccgtaccatccgctaccctgaccccctcatcaaggccaacgacaccatcaagatcgacctggagaccaacaagattgtggacttcatcaagttcgatgtcggtaatgttgtgatggttactggtgggcgcaacactgggcgtgttggtgtcatcaagaaccgtgaaaagcacaagggtacctttgagaccatccacgttgaggatgctcagggccaccaatttgccacccgtcttggcaacgtcttcaccattggcaagggcaccaagccatgggtgagcctccccaagggcaagggtatcaagctcaccatcattgaggagcagaggaagagggatgccgctgcccaggctgctgccaaggcctaaatcagtttagtgccgagtttatctgcaaggatatagaattatgttccaagaactacctccgttaagttttgcctgatgtttgttggtttgtgaactcgtggttgctcttagatgtattgcgacagtttaccctattcaagtgctatttcgaggacatcccatccttagtttcttcctgttcgtgcattgtgcaatgatcatgtgtttatcatctttttacattcagtagaattgacagttttgattggttgaccgttgttttttgtaatgccttttcttattttctagtggaatgttagctacgacggctt

SEQ ID NO: 3945 - DNA, 1241 bp, Brachypodium distachyon
cctcgcatcctccactctttctcaacccggcggcggcgcgcagagaaggcagaagaccaggcggcggcgcacgaagcagagaagcaggacggcgacctagcccgacctttcaaccatggctaggggtttgaagaagcatctgaagaggctcaatgcgccatcgcattggatgctggacaagcttggtggagcatttgcccccaagccctcttctggtcctcacaaggccagggagtgcctgcctctgatccttattctcaggaataggctgaagtatgctcttacttaccgtgaggtgcagtctatcctcatgcagcgccaaattttggttgatggcaaggtcagaactgacaagacctacccagctggtttcatggatatcatttccatccccaagactggtgagaactacaggctcctatatgatacaaaggggcgtttccgcctccactctgtcagggatgaggattctaagttcaagctttgcaaggttaggtctgtccagtttgggcagaagggcattccctacctgaacacctatgatggccgtaccatccgctaccctgaccccctcatcaaggccaacgacaccatcaagatcgacctggagaccaacaagattgtggacttcatcaagttcgatgtcggtaatgttgtgatggttactggtgggcgcaacactgggcgtgttggtgtcatcaagaaccgtgaaaagcacaagggtacctttgagaccatccacgttgaggatgctcagggccaccaatttgccacccgtcttggcaacgtcttcaccattggcaagggcaccaagccatgggtgagcctccccaagggcaagggtatcaagctcaccatcattgaggagcagaggaagagggatgccgctgcccaggctgctgccaaggcctaaatcagtttagtgccgagtttatctgcaaggatatagaattatgttccaagaactacctccgttaagttttgcctgatgtttgttggtttgtgaactcgtggttgctcttagatgtattgcgacagtttaccctattcaagtgctatttcgaggacatcccatccttagtttcttcctgttcgtgcattgtgcaatgatcatgtgtttatcatctttttacattcagtagaattgacagttttgattggttgaccgttgttttttgtaatgccttttcttattttctagtggaatgttagctacgacggcttagttctttgttatgcca

SEQ ID NO: 3946 - DNA, 1164 bp, Leymus cinereus x Leymus triticoides
  misc_feature (4)..(7): n is a, c, g, or t
ccgnnnntgtcgggcggcggcgcgtagcacaggagaaggagcaggcggcagcggtgcccgaagagaagaagcacggcgacctagcccgagctcgcaaccatggctaggggtttgaagaagcatctgaagaggctcaatgccccgtctcattggatgctggacaagcttggtggagcttttgcccccaagccatcatctggtcctcacaaggccagggagtgcctgcctctgattctcatcctgaggaacagactgaaatatgctctcacctaccgtgaagtgcaatctatccttatgcagcgtcatatcatggttgatggaaaggtccgaactgacaagacctaccctgctggtttcatggacatcatttcaattcccaagactggtgagaactacaggcttctttatgacaccaagggccgcttccgcctgcactctgtcagggacgaggatgccaagttcaagctctgcaaggtcaggtctgtccagttcggccagaagggcatcccctacctcaacacctatgatggccgcaccatccgctacccagacccactcattaaggccaacgacaccatcaagctcgacctggagaccaacaagattgttgacttcatcaagttcgacgtcggcaacgtggtcatggtgactggtgggcgcaacactgggcgtgttggtgtgatcaagaacagggagaagcataagggaaccttcgagaccatccacgttgaggatgcccagggccaccagttcgccacccgtctcggcaatgtgttcaccatcggcaagggcaccaagccgtgggtgagcctccccaagggcaagggtatcaagctcaccatcattgaggagcagaggaagagggatgccgccgctcaggctgctgccaaggcctgattgcgaggcgtcggttcgttttgctatagccagttatctgcaaggatatagaactatgttcctggaaccatcgtttttaagttttgcctgatgtttgttgatttgcgaaccaatggttgctgctagatgtaatgtggatgtttaccttgttaagtgctatttcgagaccttatctggttatcttaaatgtttgagttcaagtttaggcattatctgataaaatgctctcttgaagatagaaagtttgcaacctctgattttgcttca

SEQ ID NO: 3947 - DNA, 1073 bp, Avena sativa
agaagagaaggtgctcgacgacctagtccgagctcgcaaccatggctcgtggtctgaagaagcatttgaagaggctcaatgccccatcacactggatgctggacaagcttggtggagcttttgcccccaagccatcatctggtcctcacaaggccagggagtgcttgcctctgatcctcatcctcaggaacaggctcaagtatgctcttacctaccgtgaggtgcagtccatcctgatgcagcgccatatccaggttgatggcaaggtccgcactgacaagacctaccctgctggtttcatggatatcatctccatccccaagactggtgagaactacaggcttctgtatgacaccaagggccgcttccgccttcatgctgtcagggatgaggatgccaagttcaagctgtgcaaggttcggtctgtccagttcggacagaagggcattccctacctgaacacctatgatggccgcaccatccgctaccctgaccccctcatcaaggccaacgacaccatcaagctcgaccttgagaccaacaagattgttgacttcatcaagttcgatgtcggcaatgttgtcatggtgactggtgggcgcaacactgggcgtgttggtgtgatcaagaacagggagaagcataagggaaccttcgagaccatccacgttgaggatgcccagggccaccagtttgccacccgtctcggcaacgtgttcaccatcggcaagggcaccaagccgtgggtgagcctccccaagggcaagggtatcaagctcaccatcattgaggagcagaggaagagggatgctgccgctcaggccgccgccaaggcttgattctgatgcgtcgattcgttttgctatagcttgagtttatctgcaaggatatagaactatgttcccagaactattgtttttaagttttgcctgatgttatgttggtttgtgaaccaatggctgctgctaggtgtaatgtgacagtttaccttgttcaagtactatttcgatctgcctctggttctgtacatgtttgtgattcaagttgggcattttctgtttaagataagatgc

SEQ ID NO: 3948 - DNA, 1137 bp, Avena sativa
gactctttgtcatctcggcggcggcgcacagaagtagaagcaggaggcggcggcgcgcgaagagaaggtgcacgtcgacctagtccgagctcgcaaccatggctcgtggtctgaagaagcatctgaagaggctcaatgccccatcacactggatgctggacaagctcggtggagcttttgcccccaagccatcatctggtcctcacaaggctagggagtgcttgcctctgatcctcatcctcaggaacaggttgaagtatgctcttacctaccgtgaggtgcagtccatcttgatgcagcgtcatatccaggttgatggcaaggtccgcactgacaagacctaccctgctggtttcatggatatcatctccatccccaagactggtgagaactacaggcttctgtatgacaccaagggccgcttccgccttcacgctgtcagggatgaggatgccaagttcaagctttgcaaggttcgttcagtccagttcggacagaagggcatcccctacctgaacacctatgatggccgcaccatccgctaccctgaccccctcatcaaggccaacgacacaatcaagctcgaccttgagaccaacaagattgttgacttcatcaagtttgatgtcggcaacgttgtcatggtgactggtgggcgcaacactgggcgtgttggagtgatcaagaacagggagaagcataagggaaccttcgagaccatccatgttgaggatgcccagggccaccagtttgccacccgtctgggtaatgtgttcaccatcggcaagggcaccaagccatgggtgagcctccccaagggcaagggtatcaagctcaccatcatcgaggagcagaggaagagggatgctgctgctcaggctgctgccaaggcttgattctgatggcgttgattcgttttgctatagcattgagtttatctgcaaggatatagaactatgttcccctgaactattgtttttaagttttgcctgatgctatgttggtttgtgaacctatggttgttgctaggtgtaatgtagtttaccttgttcaagtactatttcggcacacctctttggttctttccatggtttgtgatccaagttaggctttatctgttttaattttcttttggtt

SEQ ID NO: 3949 - DNA, 1164 bp, Avena sativa
ccccccactctttgtcatctcggcggcggcgcacagaagtagaagcaggaggcggcggcgcgcgaagagaaggtgcacgtcgacctagtccgagctcgcaaccatggctcgtggtctcaagaagcatttgaagaggctcaatgccccatcacactggatgctggacaagcttgggggagcttttgcccccaagccatcatctggtcctcacaaggccagggagtgcttgcctctgattctcatcctcaggaacaggctgaagtatgctcttacctaccgtgaggtgcagtccatcctgatgcagcgccatatccaggttgatggcaaggtccgcactgacaagacctaccctgctggtttcatggatatcatctccatccccaagactggtgagaactacaggcttctgtatgacaccaagggccgcttccgccttcatgctgtcagggatgaggatgccaagttcaagctttgcaaggttcggtcagtccagttcggacagaagggcatcccttacctgaacacctatgatggccgcaccatccgctaccctgaccccctcatcaaggccaacgacaccatcaagctcgaccttgagaccaacaagatcgttgacttcatcaagttcgatgttggcaacgtcgtcatggtgactggtgggcgcaacactgggcgtgttggtgtgatcaagaacagggagaagcataagggaaccttcgagaccatccacgttgaggatgcccagggccaccagtttgccacccgtctcggcaacgtgttcaccatcggcaagggcaccaagccgtgggtgagcctccccaagggcaagggtatcaagctcaccatcattgaggagcagaggaagagggatgctgctgctcaggctgctgccaaggcttgattctgatgcgccgattcgttttgcatgagtttatctgcaaggatatagaactatgttcccagaactattgtttttaagttttgcctgatgttatgctggtttgtgaaccaatggctgctgctaggtgtaatgtgacagtttaccttgttcaagtagtatttccatcctccttgttctgttcttgtttgtgtcaagttgggcattattatctcgttaagttacgatgattttgattagatgcactgaagtgaagcttttctaac

SEQ ID NO: 3950 - DNA, 1185 bp, Avena sativa
ctccactctttgtcatcccggcggcggcgcacagaagaagaagcaggaggcggcggcgcgcgaagagaaggtgcacgttgacctagtccgagctcgcaaccatggctcgtggtctcaagaagcatttgaagaggctcaatgccccatcacactggatgctggacaagcttggtggagcttttgcccccaagccttcatctggtcctcacaaggccagggagtgcctgcctctgatcctcatcctcaggaataggcttaagtatgctcttacctaccgtgaggtgcagtctatcctgatgcagcgccatatccaggttgatggcaaggtccgcactgataagacctaccctgctggtttcatggatatcatctccatccccaagactggtgagaactacaggcttctgtatgacaccaagggccgcttccgccttcatgctgtcagggatgaggatgccaagttcaagctttgcaaggttcggtctgtccagtttggacagaagggcattccctacctgaacacctatgatggccgcacaatccgctaccctgacccactcatcaaggccaacgacaccatcaagcttgaccttgagaccaacaagattgttgacttcatcaagttcgatgttggcaacgttgtcatggtgactggtgggcgtaacactgggcgtgttggtgtgatcaagaacagggagaagcataagggaacctttgagaccatccacgttgaggatgcccagggccaccagtttgccacccgtcttggcaacgtgttcaccatcggcaagggcaccaagccatgggtgagcctccccaagggcaagggtatcaagctcaccatcattgaggagcagaggaagagggatgctgctgctcaggctgctgccaaggcttgattctgatgcgtcgattcgttttgctatagcatgagtttatctgcaaggatatagaactatgttcccagaactattgtttttaagttttgcctgatgttatgctggtttgtgaaccaatggctgctgctaggtgtaatgtgacagtttaccttgttcaagtagtatttccatcctcctggttctgttcttgtttgtgtcaagttgggcattattatctcgttaagttacgatggtttttgattagatgcactgaagtgaagcttttctaatatttgctctttgcttc

SEQ ID NO: 3951 - DNA, 1168 bp, Avena sativa
gggtctcttcgcccctcgcttcctcccactctttgtcatctcggcggcggcgcacagaagaagaagaagcaggaggcggcggcggcgcgcgaagagaaggtgcacgtcgacctagtccgagctcgcaaccatggctcgtggtctgaagaagcatttgaagaggctcaatgccccatcacactggatgctggacaagcttggtggagcttttgcccccaagccatcatctggtcctcacaaggccagggagtgcttgcctctgatcctcatcctcaggaacaggctcaagtatgctcttacctaccgtgaggtgcagtccatcctgatgcagcgccatatccaggttgatggcaaggtccgcactgacaagacctaccctgctggtttcatggatatcatctcaatccccaagactggtgagaactacaggcttctgtatgacaccaagggccgcttccgccttcacgctgtcagggatgaggatgccaagttcaagctttgcaaggttcgctctgtccagttcggacagaagggcatcccctacctgaacacctatgatggccgcaccatccgctaccctgacccactcatcaaggccaatgacaccatcaagcttgaccttgagaccaacaagattgttgacttcatcaagttcgatgttggcaatgtcgtcatggtgactggtgggcgcaacactgggcgtgttggtgtgatcaagaacagggagaagcataagggaaccttcgagaccatccacgttgaggatgcccagggccaccagtttgccacccgtctcggcaacgtgttcaccatcggcaagggcaccaagccgtgggtgagcctccccaagggcaagggtatcaagctcaccatcattgaggagcagaggaagagggatgctgccgctcaggccgccgccaaggcttgattctgatgcgtcgattcgttttgttatagcttgagtttatctgcaaggatatagaactatgttcccagaactattgtttttaagttttgcctgatgctatgttggtttgtgaaccaatggctgctgctaggtgtaatgtgacagtttaccttgttcaagtactatttcgatctgcctctggttctgtacatgtttgtgattcaagttgggcattttctgtttaagataggatgcttttga

SEQ ID NO: 3952 - DNA, 1100 bp, Avena sativa
ggaggcggcggcggcgcgagaagagaaggcgcacgtcgacctagtccgagcccgcaaccatggctcgtggtctgaagaagcacttgaagaggctcaatgccccatcacactggatgctggacaagcttgggggagcttttgcccccaagccatcatctggtcctcacaaggccagggagtgcttgcctctgatcctcatcctcaggaacaggttgaagtatgctcttacctaccgtgaggtgcagtccatcctgatgcagcgccatatccaggtggatggcaaggtccgcactgacaagacctaccctgctggtttcatggatatcatctccatccccaagactggtgagaactacaggcttctgtatgacaccaagggccgcttccgccttcatgctgtcagggatgaggatgccaagttcaagctttgcaaggttcggtcagtccagtttggacagaagggcatcccttacctgaacacctatgatggccgcaccatccgctaccctgaccccctcatcaaggccaacgacaccatcaagctcgaccttgagaccaacaagatcgttgacttcatcaagtttgatgttggcaacgtcgtcatggtgactggtgggcgcaacactgggcgtgttggtgtgatcaagaacagggagaagcataagggaaccttcgagaccatccatgttgaggatgcccagggccaccagtttgccacccgtctcggcaacgtgttcaccatcggcaagggcaccaagccgtgggtgagcctccccaagggcaagggtatcaagctcaccatcattgaggagcagaggaagagggatgctgctgctcaggctgccgccaaggcttgattctgatgcgtcgattcgttttgctatagcatgagtttatctgcaaggatatagaactatgttcccagaactattgtttttaagtttgatgttatgttggtttgtgaaccaatggctgctgctaggtgtaatgtgacagtttaccttgttcaagtagtatttccatcatcctcgttctgttcttgtttgtgtcaagttgggcattattatctctttaagttacgatggttttgattagatgac

SEQ ID NO: 3953 - DNA, 1084 bp, Pseudoroegneria spicata
ccgttgctgtcgcccggcggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggggagaactacaggcttctttatgacaccaagggccgcttccgccttcactctgtcagggacgaggatgctaagttcaagctctgcaaggtcaggtctgtccaattcggccagaagggcatcccctacctgaacacctatgatggccgcaccatccgctacccagacccactcatcaaggccaatgacaccatcaagctcgacctggagaccaacaagattgttgacttcatcaagttcgacgtgggcaacgtggtcatggtgactggtgggcgcaacactgggcgtgttggtgtgatcaagaacagggagaagcataagggaaccttcgagaccatccacgttgaggatgcccagggccaccagttcgccacccgtcttggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggcgttgagtcgttttgctatagccagttatctgcaaggatattatagaactatgatcctggaaccatcgttttttaagttttgcctgatgtttgttgatttgcgaacccgttgttgctgctagatgtaatgtggatgtttaccttattaagtgctatttcgagacctcctctggtta

SEQ ID NO: 3954 - DNA, 1069 bp, Triticum aestivum
cggcggcggcgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaaccttcgagaccatccacgttgaggatgcccagggccaccagttcgccacccgtctgggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggtgttgagtcgttttgctatagccagttatctgcaaggatatagacctatgttcctggaaccatcgtttttaagttttgcctgatgtttgttgatttgcgaactcgtggttgctgctagatgtaatgtggatgtttaccttattaagcgctatttcgagacctcatccggttacct

SEQ ID NO: 3955 - DNA, 1086 bp, Triticum aestivum
cggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacactgggcgtgttggtgtgatcaagaacagggagaagcataagggaaccttcgagaccatccacgttgaggatgcccagggccaccagttcgccacccgtctgggcaatgtattcaccattggcaagggcaccaagccatgggtgagcctccccaagggcaagggtatcaagctcaccatcattgaggagcagaggaagcgggatgccgctgcccaggctgctgccaaggcctgattctgaggcgttgagtcgttttgctatagccagttatctgcaaggatatagaactatgttcctggaaccatcgtttttaagttttgcctctagatgtaatgtttttaagttttgttgatttgcgaactcgtggttgcctctagatgtaatgtggatgtttatcttattaagtgctatttcgagacctcatccggttatct

SEQ ID NO: 3956 - DNA, 1069 bp, Triticum aestivum
cggcggcggcgcgtagcacaggagaaggagcaggcggcggtggtgcccgaagacgagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgccttcctctgatcctcatcctgaggaacagactgaaatatgctctcacctaccgtgaagtgcagtctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacactgggcgtgttggtgtgatcaagaacagggagaagcataagggaaccttcgagaccatccacgttgaggatgcccagggccaccagttcgccacccgtctgggcaatgtattcaccattggcaagggcaccaagccatgggtgagcctccccaagggcaagggtatcaagctcaccatcattgaggagcagaggaagcgggatgccgctgcccaggctgctgccaaggcctgattctgaggcgttgagtcgttttgctatagccagttatctgcaaggatatagaactatgttcctggaaccatcgtttttaagttttgcctgatgtttgttgatttgcgaactcgtggttgcctctagatgtaatgtggatgtttatcttattaagtgctatttcgagacctcatccggttatct

SEQ ID NO: 3957 - DNA, 1103 bp, Triticum aestivum
cggcggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtgttggtgtgatcaagaacagggagaagcataagggaaccttcgagaccatccacgttgaggatgcgcagggccaccagtttgccacccgtctgggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggcgttgagtcgttttgctatagccagttatcttcaaggatatagacctatgttcctggaaccgtcgtttttaagttttgcctgatgtttgttgatttgcgaactcgtggttgctgctagatgtaatgtggatgtttaccttattaagtgctatttcgagacctcatctggttatctaatatgtttcagataaaggttaggcattatctga

SEQ ID NO: 3958 - DNA, 1105 bp, Triticum aestivum
ggcggcgcgtagaacaggagaaggagcaggcggcggcggtgcccgaagaggagaagcacggcgacctagcccgagctcgcaaccatggctaggggtttgaagaagcatctgaagaggctcaatgccccgtctcactggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctttatgacaccaagggtcgcttccgccttcactctgtcagggatgaggatgctaagttcaagctctgcaaggtcaggtctgtccagttcggccagaagggcatcccctacctgaacacctatgatggccgcaccatccgctacccagacccactcatcaaggccaatgacaccatcaagctcgacctggagaccaacaagattgttgacttcatcaagtttgacgtcggcaatgtggtcatggttactggtgggcgcaacactgggcgtgttggtgtgatcaagaacagggagaagcataagggaaccttcgagaccatccacgttgaggatgcgcagggccaccagtttgccacccgtctgggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggcgttgagtcgttttgctatagccagttatcttcaaggatatagacctatgttcctggaaccgtcgtttttaagttttgcctgatgtttgttgatttgcgaactcgtggttgctgctagatgtaatgtggatgtttaccttattaagtgctatttcgagacctcatctggttatcttaaatgtttgagatccaagtttaggcattatctgataaaa

SEQ ID NO: 3959 - DNA, 1055 bp, Triticum aestivum
cggcggcggcgcgttgcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatattatggttgatggaaaggtccgcactgacaagacctaccctgctggtttcatggacatcatttccattcccaagactggtgagaactacaggcttctgtatgacaccaagggtcgcttccgccttcactctgtcagggacgaggatgctaagttcaagctctgcaaggtcaggtctgtccagtttggccagaagggcatcccatacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaaccttcgagaccatccacgttgaggatgcccagggccaccagttcgccacccgtctgggcaacgtgttcaccatcggcaagggcaccaagccgtgggtgagcctccccaagggcaagggtatcaagctcaccatcattgaggagcagaggaagcgggatgccgctgcccaggctgctgccaaggcctgattctgaggtgttgagtcgttttgctatagccagttatctgcaaggatatagacctatgttcctggaaccatcgtttttaagttttgcctgatgtttgttgatttgcgaactcgtggttgctgctagatgtaatgtggatgtttaccttattaagcgctatttcgagacc

SEQ ID NO: 3960 - DNA, 1212 bp, Triticum aestivum
aggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatccggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcagggatgaggatgctaagttcaagctctgcaaggtcaggtctgtccagttcggccagaagggcatcccctacctgaacacctatgatggccgcaccatccgctacccagaccctctcatcaaggccaatgacactatcaagctcgacctggagaccaacaagattgttgacttcatcaagttcgacgttggtaacgtggtcatggtgactggcgggcgcaacactgggcgtgttggtgtgatcaagaacagggagaagcataagggaaccttcgagaccatccacgttgaggatgcccagggccaccagttcgccacccgtctgggcaatgtattcaccattggcaagggcaccaagccatgggtgagcctccccaagggcaagggtatcaagctcaccatcattgaggagcagaggaagcgggatgccgctgcccaggctgctgccaaggcctgattctgaggcgttgagtcgttttgctatagccagttatctgcaaggatatagaactatgttcctggaaccatcgtttttaagttttgcctgatgtttgttgatttgcgaactcgtggttgcctctagatgtaatgtggatgtttatcttattaagtgctatttcgagacctcatccggttaccttaaatgtttgagatctaagttagccattatctgataaaagctctcttcaaagttaagtttgcaacctctgttcttttgggtttgacttctgcagtgtgctaaattcctttttgatatttgtcaacaagaggagtatgatttgttag

SEQ ID NO: 3961 - DNA, 1115 bp, Secale cereale
cctcattctttgtcatcccggcggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccgaagggccgcttccgccttcactctgtcaaggatgaggatgctaagttcaagctctgcaaggtcaggtctgtccagtttggccagaagggtatcccctacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaacctttgagaccatccacgttgaggatgcccaaggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctgctcgtttttaagttttgttggatgtctgttgatttgcgaactcgtggttgctgctagatgtactgtggatgtttaccttattaagtgctatttcgagacctcatctggttatcttaaatgtttgagatccaagtttaggcattatctgataaaatgttatctgttcaaagttgcaagatagaaagtt

SEQ ID NO: 3962 - DNA, 1302 bp, Secale cereale
tgcgttagttaaagttaaaattaaattaaattaaattagaatacaatttcctgtagttgtgcagaagttaaaccaagagtttcacaattagattcccttccatctttttcctctggggatgggaaggacctttttacatttgtcctttcacagcatagcaatttccccccattgtcacatattgcacataaattatcagtagcatcaccaccaccaccatcatcattgtcaatatcatcaccatcatcgttgctatcatcatcggtgcagctgtaatcatcactgctctgtcatcccggcggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctgtatgacaccaagggccgcttccgccttcactctgtcaaggatgaggatgctaagttcaagctctgcaaggtcaggtctgtccagtttggccagaagggtatcccctacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgcgatgccgctgcccaggctgctgccaaggcctgattctgatgcgttgagtcgttctgctcgttttaagtttgttggatgtctgttgatttgcgaactcgtggttgctgctagatgtactgtggatgtttaccttattaagtgctatttcgagac

SEQ ID NO: 3963 - DNA, 1117 bp, Secale cereale
atccccgcggcggcgcgtagcacaggagaaggagcaggcggcggcggtgcccgaagaccagaagcacggcgacctagcccgagcttgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggtcagaagggcatcccctaccttaacacctatgatggccgcaccatccgctaccctgacccactcatcaaggccaacgacactatcaagcttgacttggagaccaacaagattgttgacttcatcaagtttgacgtgggcaatgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctgctcgtttttaagttttgttggatgtctgttgatttgcgaactcgtggttgctgctagatgtactgtggatgtttaccttattaagtgctatttcgagacctcatctggttatcttaaatgtttgagatccaagtttaggcattatctgataaaatgttatctgttcaaagttgcaagatagaaagttcgcaacctctgattttg

SEQ ID NO: 3964 - DNA, 1037 bp, Secale cereale
aggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgccatatcatggttgatggaaaggtccgcactgacaagacctaccctgctgggttcatggacatcatttccattcccaagactggtgagaactacaggcttctgtatgacaccaagggccgcttccgccttcactctgtcaaggatgaggatgctaagttcaagctctgcaaggtcaggtctgtccagtttggccagaagggtatcccctacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgcgatgccgctgcccaggctgctgccaaggcctgattctgatgcgttgagtcgttctgctcgtttttaagttttgttggatgtctgttgatttgcgaactcgtggttgctgctagatgtactgtggatgtttaccttattaagtgctatttcgagacctcatctggttatcttaaatgtttgagatccaagtttaggcattatct

SEQ ID NO: 3965 - DNA, 1093 bp, Secale cereale
ccggcggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctgtatgacaccaagggccgcttccgccttcactctgtcaaggatgaggatgctaagttcaagctctgcaaggtcaggtctgtccagtttggccagaagggtatcccctacctcaacacctatgatggccgcaccatccgctacccagacccactcatcaaggccaatgacaccatcaagctagacctggagaccaacaagattgttgacttcatcaagtttgacgtcggcaatgtggtcatggtgactggtgggcgcaacactgggcgtgttggtgtgatcaagaacagggagaagcataagggaaccttcgagaccatccacgttgaggatgcccagggccaccagttcgccacccgtctgggcaacgtgttcaccatcggcaagggcaccaagccgtgggtgagcctccccaagggcaagggtatcaagctcaccatcattgaggagcagaggaagcgggatgctgctgcccaggctgctgccaaggcctgattctgaggcgttgagtcgttttgctatatagaactatgttcctggaaccatcgttttttaagttttgcctgatgtctgttgatttgcgaactcgtggttgctgctaggtgtactgtggatgtttaccttattaagtgctatttcgggacctcatctggttatcttaaatgtttgagatccaagtttaggcaatatctgataaaata

SEQ ID NO: 3966 - DNA, 1084 bp, Secale cereale
ttctttgtcatcccggcggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaagtatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacacgaagggccgcttccgccttcactctgtcaaggatgaggatgctaagttcaagctctgcaaggtcaggtctgtccagttcggccagaagggcatcccctacctgaacacctatgatggccgcaccatccgttaccctgacccactcatcaaggccaacgacaccatcaagcttgacctggagaccaacaagattgttgacttcatcaagtttgatgtcggcaatgtggtcatggtgactggtgggcgcaacactgggcgtgttggtgtgatcaagaacagggagaagcacaagggaacctttgagaccatccacgttgaggatgcccagggccaccagtttgccacccgtctgggcaacgtgttcaccatcggcaagggcaccaagccgtgggtgagcctccccaagggcaagggtatcaagctcaccatcattgaggagcagaggaagcgcgatgccgctgcccaggctgctgccaaggcttgattctgatgcgttgagtcgttttgctcgtttttaagttttgttggatgtctgttgatttgcgaactcgtggttgctgctagatgtactgtggatgtttaccttaagtgctatttcgagacctcatctggttatcttaaatgtttgagatccaagtttagtcattatctgataaaatgttatctgtt

SEQ ID NO: 3967 - DNA, 1107 bp, Secale cereale
tcccggcggcggcgcgtagcataggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgccatatcatggttgatggaaaggtccgcactgacaagacctaccctgctgggttcatggacatcatttccattcccaagactggtgagaactacaggcttctgtatgacaccaagggccgcttccgccttcactctgtcaaggatgaggatgctaagttcaagctctgcaaggtcaggtctgtccagtttggccagaagggtatcccctacctcaacacctatgatggccgcaccatccgctacccagacccactcatcaaggccaatgacaccatcaagcttgacctggagaccaacaagattgttgacttcatcaagtttgacgtaggcaacgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctgctcgtttttaagtttgttggatgtctgttgatttgcgaactcgtggttgctgctagatgtactgtggatgtttaccttattaagtgctatttcgagacctcatctggttatcttaaatgtttgagatccaagtttaggcattatctgataaaatgttatctgttcaaagttgcaagatagaaagttcgcaacctc

SEQ ID NO: 3968 - DNA, 1191 bp, Secale cereale
agcctcccttccttcccacgacgagaaaagaaatccaaaaatccccaaactcccctccccttccacgcgtgctacgccctcatctttgtcatcccggcggcggcgcgtagcacaggagaaggagcaggcggcggcggtgcccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggtcagaagggcatcccctaccttaacacctatgatggccgcaccatccgctaccctgacccactcatcaaggccaacgacactatcaagcttgacttggagaccaacaagattgttgacttcatcaagtttgacgtgggcaatgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctgctcgttttaagtttgttggatgtctgttgatttgcgaactcgtggttgctgctagatgtactgtggatgtttaccttattaagtgctatttcgagacctcatctggttatcttaaatgtttgagtatccaagtttaggcattatctgataaaatgttatctgttcaaagttgcaagatagaaagttcg

SEQ ID NO: 3969 - DNA, 1007 bp, Secale cereale
gcggcgcgtagcacaggagaaggagcaggcggcggcggtgcccgaagaccagaagcacggcgacctagcccgagcttgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggtcagaagggcatcccctaccttaacacctatgatggccgcaccatccgctaccctgacccactcatcaaggccaacgacactatcaagcttgacttggagaccaacaagattgttgacttcatcaagtttgacgtcggcaatgtggtcatggtgactggtgggcgcaacactgggcgtgttggtgtgatcaagaacagggagaagcataagggaaccttcgagaccatccacgttgaggatgcccagggccaccagttcgccacccgtctgggcaacgtgttcaccatcggcaagggcaccaagccgtgggtgagcctccccaagggcaagggtatcaagctcaccatcattgaggagcagaggaagcgggatgctgctgcccaggctgctgccaaggcctgattctgaggcgttgagtcgttttgctatatagaactatgttcctggaaccatcgttttttaagttttgcctgatgtctgttgatttgcgaactcgtggttgctgctagatgtactgtggatgtttac

SEQ ID NO: 3970 - DNA, 1085 bp, Secale cereale
  misc_feature (1064)..(1064): n is a, c, g, or t
ccacgcgtccgcggcggcggcgcgtagcacaggagaaggagcaggcggcggcggtgcccgaagaccagaagcacggcgacctagcccgagcttgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggtcagaagggcatcccctaccttaacacctatgatggccgcaccatccgctaccctgacccactcatcaaggccaacgacactatcaagcttgacttggagaccaacaagattgttgacttcatcaagtttgacgtgggcaatgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctgctcgtttttaagttttgttggatgtctgttgatttgcgaactcgtggttgctgctagatgtactgtggatgtttaccttattaagtgctatttcgggacctcatctggttatcttaaatgtttgagatccaagtttaggcaatntctgataaaatgctttctgtt

SEQ ID NO: 3971 - DNA, 858 bp, Secale cereale
agaccagaagcacgcgacctagcccgagcttgcaaccatggctagggtttggaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggtcagaagggcatcccctaccttaacacctatgatggccgcaccatccgctaccctgacccactcatcaaggccaacgacactatcaagcttgacttggagaccaacaagattgttgacttcatcaagtttgacgtgggcaatgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctg

SEQ ID NO: 3972 - DNA, 1022 bp, Cleome gynandra
agcgacgaaggcgtttagcaagcagacgacgggtgaaggccgcttagcagcagacgactctctcttcctgcaaacatggctaggggattgaagaaacatttgaagaggcttaatgctccaaagcactggatgcttgacaagcttggtggtgcttttgcccccaagccctcttctggaccccacaagtcgagggagtgccttcccctcattcttatcatccgaaacaggctgaagtatgctctgacataccgtgaggtgattgccatcttgatgcaaaggcatgtccttgttgatggaaaagttaggactgacaagacatacccagctggtttcatggatgttgtgtctattcctaagacaaatgagaacttccgtctactctatgacaccaagggacgtttccgtctccactccatcagggatgaggaagcaaagttcaagctctgcaaagtccgctcagtccagtttggtcagaagggcattccttacctgaacacctatgacggtcgcactatccgttaccctgacccgctcatcaaggccaatgacaccatcaagctcgaccttgagtccaacaagattgttgactttatcaagtttgatgttggtaatgttgtgatggtcactggaggaagaaacagagggcgtgtcggtgtgatcaagaacagagagaagcacaagggaagctttgaaaccatccatgtccaagatgctacagggcacgagtttgccactaggatgggcaatgtgttcaccattggcaaaggaacaaagccgtgggtgtctcttcctaagggcaaaggtattaagttgagcatcattgaggaagccaggaagaggcttgctgcccaacaagctgcttgaggatctttgtttactatctgcgtcaggacatgctttacagtttttctttcctagaatgactcgcttgtcttttttaagttctggactttgagctcaattttgtaatttcctgctgtgttttattatctgcttaggaccaatggacatgttgaaagttc

SEQ ID NO: 3973 - DNA, 951 bp, Cleome gynandra
gggttttggccatttgctctctccagccgctgcagttcgtctttctccacaggcgtttggagctacaccagcaaacatggctaggggactgaagaaacatttgaagaggcttaatgccccaaagcactggatgcttgacaaacttggcggtgcttttgcccccaagccgtcttctggaccccacaagtcgagggagtgccttccgctcatcctcatcattcgaaacaggttgaagtatgctttgacataccgtgaggtgattgccattttgatgcaaaggcatgttcttgttgatggaaaagttaggactgacaaaacatacccagctggtttcatggatgttgtgtctatccctaagacgaatgaaaacttccgtcttctctatgacaccaagggacgtttccgtctccactccatcagggatgaggaagcaaagttcaagctctgtaaggtccgctctgtccaatttggtcaaaagggtattccatacctaaacacttatgacggacgcaccatccgttaccctgacccactcatcaaagccaacgacacaatcaagcttgacctcgagtccaacaagatcgtggatttcatcaagtttgacgttggtaacgtcgtgatggtcacgggaggtagaaacagagggcgggtcggtgtgattaagaacagagagaaacataagggtagtttcgagacgatccacgtgcaagatgctacgggccacgagtttgctacgaggatggggaatgtgtttaccattggcaaaggaacaaagccgtgggtgtcccttccaaagggtaaaggtattaagttgagcattattgaagaagccaggaagaggcttgctgctcaacaagctgcttaagtcataattggtttttatttccatattcagaaacttttggctttactgttttttatttcctagagagactttgtctttccttccta

SEQ ID NO: 3974 - DNA, 1047 bp, Olea europaea
gagctagggtttattatttctccacagctttaaagaagagttgcgcaccgagatagagagagaggggaagagagagacgccgcctggtagattgttgccaccaccagcaaaatggcgagaggtttgaagaaacacttgaagaggctcaatgccccaaaacattggatgttggacaaacttggtggtgcttttgcacccaaaccatcttctggaccccacaaatccagggagtgcttgccgttgattctgattctgcgcaacaggctgaagtatgctctgacataccgtgaagtaatttccatcttgatgcaacgccatgtcctagttgatgggaaggttaggactgataagacctatcctgctggttttatggatgttgtttctattccaaagaccaatgagaatttccgtctactctatgataccaagggtcgattcagactccattccatcagggatgaggaggccaagtttaagctttgcaaagtccgatcggttcagtttggaaagaaaggaattccctacctcaacacctatgatggaaggacaattcgctatccagatccactcatcaaggcaaatgacaccattaaacttgacctcgagacaaacaaaattgttgatttcatcaagtttgatgttgggaatgttgtgatggtgactggtggaagaaacagaggacgtgttggagtcatcaagaaccgtgagaagcacaagggaagttttgaaactatccacgtccaggatgctgttgggcatgagtttgcaacccgtctaggcaatgttttcactattgggaaaggtacaaagccttgggtgtctcttccaaagggcaagggtatcaagttgtccatcatcgaggaggccaggaagcggcttgctgcccaatcagcggccacggcatagattatattattcgaagttattcgaagttctcttttggtcatgttaaattagtctgtacttttcccttctggatttgtatgctggttgatggcgcacaatgttggttattataggatctatgctggaaaatctgttttgttt

SEQ ID NO: 3975 - DNA, 1189 bp, Carica papaya
gtactctacaattgccttcacaactacgagtcctcaccctaaaaccctaacctcctgcgtgatagaaggaattggcggcagccaggtcgagaggctattggggaggagatttgaagaggagtaaaaacagctggaaaaatggcgagagggctgaagaaacatttgaagaggcttaatgccccaaagcactggatgcttgacaagctcggtggtgcatttgcacccaagccatcatctggtccacacaagtccagagaatgccttcccttgattcttatcctgaggaacaggctcaaatatgcacttacttaccgggaagtcattgctatcctgatgcaacgacatgttcttgttgatggaaaagttaggactgataaaacgtatcctgctggtttcatggatgttgtgtcaattcccaagacaaatgagaacttccgtctcttatatgataccaagggacgcttccgtcttcacaccatcagagatgaagaggcaaagttcaagctttgcaaggttcgatcggtacagtttggccagaaaggtatcccctacctcaacacctatgatggtcgtaccatccgctaccctgacccccttatcaaggccaatgatactattaaacttgacttggagactaacaagattgttgacttcatcaagtttgatgttgggaatgttgtgatggtgactggcggaaggaacagagggcgtgttggagtcatcaagaacagagagaaacataagggtagctttgagaccatccatgttcaagatgcagttggtcatgagtttgccacgcgaatgggtaatgtgtttacaattggtaaaggagcaaagccatgggtgtcccttccaaagggcaagggtataaaattatcaatcatcgaggagtctaggaagaggcttgctgctcaacaggctgcctaatctgatgataaattttgagcccatgttttgaggtactttcattttgtggattaatacctgtttggatgcttccaatttaagctgcgattcgaggatttgttttgctgtgatttgagttattgtttttaggataaagatggttggatgctttttcatttagctgcctttaaatttatgttagaaagactttatatacatctaaatgttggtgatgtgatctgagttacttatatagagtttcgatgctaattacagtcttttg

SEQ ID NO: 3976 - DNA, 1021 bp, Cleome spinosa
ccctagttcgagtgaagcgccgcggccgcttaggcgaagaggaatccgaaggcgttcggagctacagctgcaattatggctagaggattgaagaaacatctgaagaggcttaatgccccaaagcactggatgcttgacaagcttggcggtgcttttgcccccaagccgtcgtctggaccccacaagtcaagggagtgccttcctctcatcctcatcatccgaaacaggttgaagtatgccctgacataccgggaggtgattgccatcttgatgcaaaggcatgttcttgtcgatggaaaagttaggactgacaagacataccctgctggtttcatggatgttgtctccatcccaaagacgaatgagaacttccgtcttctgtatgataccaaggggcgtttccgtctccactccatcagggatgaggaggcaaagttaaagctgtgcaaggtgcgatctgtccagtttggtcagaagggcattccttacctgaacacctatgatggtcgcaccatccgttaccctgacccactcatcaaggccaacgacaccatcaagcttgaccttgagaccaacaaaatcgtcgacttcatcaaatttgacgtgggcaatgttgtgatggtcacagggggtaggaacagaggcagggtgggagtgataaagaacagggagaagcataagggaagctttgatacaattcacattcaagatgcaactgggcatgagtttgctacaaggatggggaatgtgttcaccattggcaaaggaacaaagccatgggtgtctcttccaaagggcaaaggtattaagctgagcatcattgaagaagccaggaagaggcttgttgcccaacaagctgcttgagagtaacttttgttttccatgtctgaaacttgcgtttacagtcttttttattcctagaacgacttgcttttatcctatttaggaccttgggttttgcagaatctacctcccagtttgaatatcgattactcttttttttatttaacagtggacgaaa

SEQ ID NO: 3977 - DNA, 1057 bp, Cleome spinosa
ttcatcgttctcataccttgggttcgactcgacaccgtcggcgcttagcctcagaggaatccgggggcgtttggagctacacctgcaaatatggcgaggggattgaagaaacacttgaagaggcttaatgcccccaagcactggatgctcgacaagcttggcggtgcttttgcccccaagccgtcttctggacctcacaagtcgagggagtgccttcctctcatccttatcatccgaaacaggttgaagtatgctcttacataccgtgaagtgattgccatcttgatgcaaaggcatgtccttgttgatggaaaagttaggacggacaagacatacccagctggtttcatggatgtcgtgtctatcccgaagacaaatgagaatttccgtcttttgtatgacaccaagggacgtttccgtctccactccatcagggatgaggaagcaaagttcaagctctgcaaggtcaggtcagtccagtttggtcagaagggcattccttacctgaacacctatgacggtcgcaccatccgatacccagacccgctcatcaaggctaacgacaccatcaagctggacctggagagcaataagattgtagacttcatcaagtttgatgtggggaatgtggtgatggtgactggagggagaaacagaggtagggtgggtgtgataaagaacagggagaagcataagggaagctttgacaccattcacattcaggatgctacagggcatgagtttgcgacaaggatggggaatgtgttcaccattggcaaaggaacaaagccatgggtgtctcttccaaagggtaaaggaattaagctgagcatcattgaggaagccaggaagaggcttgcatcccagcaagctgcttgagcactactctccttttcttattcccatgtctggacaagtgatgcttttacgttttcttattcctagaaggattcggtttactcttttttttctttgggattctgagcttcggttttggacttgttatgtgttcttacttatcatcgagttatggatattatctgggtactttaaaccg

SEQ ID NO: 3978 - DNA, 1258 bp, Musa acuminata
agggtttctccgtcgggcttattcggtatttagaggtggattcggcgcttccgagtgctagagaggaggcggaggaaggaaccggagatccgaaaatatggcaaggggattgaagaagcatctgaagaggctcaatgccccaaagcactggatgctggataagcttggtggagcattcgctcccaagccgtcgtctggccctcataaagccagggaatgcttgcccttgatccttattttaaggaacaaactgaaatatgctcttacctaccgtgaagtcattgctattctgatgcaacgccatgtgatggtggatgggaaagtcaggactgacaagacttaccctgctggtttcatggatgttgtttcaatacctaagacaaatgagaactttcgactcctttatgacaccaagggacgctttcgtctccactcagttagggatgaagaggcaaagttcaagctctgcaaggttcgctccgtgcagtttggacagaagggcattccctacctgaacacatatgatggtcgtaccattcgctaccctgatcctcttattaaggccaatgacaccatcaagcttgacttggaaaccaacaagatcgtcgacttcatcaagtttgatgttggaaatgttgtgatggtgactggtgggagaaacaccggtcgtgtcggtgtgattaagaacagggagaagcacaaggggagctttgacaccatccacgtccaagatgccactggccatgagtttgcgactcgcatgggcaacgtcttcacgatcggcaaggggacaaagccatgggtgtctcttccaaagggcaagggaatcaagctcagcatcattgaggaggcacgaaagcgcttggctgctgctggcgcaactgccactgcttagttctatgctctgcatccatctgaattttgttatagggctctttgtttactggattagaaccttgcctcaaattttatcacttgcatgtcagtttctctttggacataagtggaagatgaaataattgccataatcatggctataggatcctctacattttgccactctattctttactgctaattaacttagacattgttatttggttttatcaatgactatttgtgttttccttttattttgatgttgctttctaggtttcggcttgtggacagacttgagtagttgtgttggcacaaataattgaaaaaatcttgtgcttgtacatagcatagatgaataaggcattagcacaaaacaaag

SEQ ID NO: 3979 - DNA, 934 bp, Fraxinus spp
agaggggaagagagagacgccgcctggtagattgttgccaccaccagcaaaatggctagaggtttgaagaaacacttgaagaggctcaatgccccaaaacattggatgttggacaaacttggcggtgcttttgcacccaaaccatcttctggaccccacaaatccagggagtgcttgccattgattcttatcatgcgcaacaggctgaagtatgctctgacataccgtgaagtaattgccatcttgatgcaacgccatgtcctagttgatgggaaggttaggactgataagacctatcctgctggttttatggatgttgtttctattccaaagaccaatgagaatttccgtctactctatgataccaagggtcgattcaggctccactccatcagggacgaggaggccaagtttaagctttgcaaagtccgatctgttcagtttggaaagaaaggaattccctacctcaacacctatgatggaaggacaattcgctatccagatccgcttatcaaggcaaatgacaccgttaaacttgatctcgagacaaacaaaattgttgatttcatcaagtttgatgttgggaatgttgtgatggtgacgggtggaagaaacagaggacgtgttggagtcatcaagaaccgtgagaagcacaagggaagcttcgaaactatccacgtccaggatgctgttgggcatgagtttgctacccgtctaggcaatgttttcactattgggaaaggtacaaagccttgggtgtctcttccaaagggcaagggtatcaagctgtccatcatcgaggaggccaggaagcggcttgctgcccaatctgcggccacagcataaattatcttattttattcgaagttgtcttttggtcatgttaattagtttgtacttttccttctggatttgtatgctggttgatggcaca

SEQ ID NO: 3980 - DNA, 931 bp, Olea europaea
aattgttgccaccaccagacaaaaatggctagaggtttgaagaaacatttgaagaggctcaatgccccaaaacattggatgttggacaaacttggtggtgcttttgcacccaaaccatcttctggaccccacaaatccagggagtgcttgccgttgattcttattatacgcaacaggctgaagtatgctctgacataccgtgaagtaattgccatcttgatgcaacgccatgtcctagttgatgggaaggttaggacggataagacatttcctgctggttttatggatgttgtttctattccgaagaccaatgagaatttccgtctactctatgataccaagggtcgattcaggctccactccatcagggatgaggaggccaagtttaaactttgcaaagtccgatcagtccagtttggaaagaaagggattccctacctcaacacctatgatggaaggacaattcgctatccagacccgctcatcaaggcaaatgacaccattaaacttgatctcgagacaaacaaaattgttgatttcatcaagtttgatgttgggaatgttgtgatggtgactggcggaagaaacagaggacgagttggagtcatcaaaaaccgtgagaagcacaagggaagtttcgaaactatccacgtccaggatgctactgggcatgagtttgctacccgtctaggcaatgttttcactattgggaaaggtacaaagccctgggtgtctcttccaaagggcaagggtatcaagctgtccatcatcgaggaggccaggaagaggcttgctgcccaatcagcagtcacagcatagattatttattttgtacttctccattctggatatctatgctggttttggttatcataggatctatgccagaaagtctatgttttgtttcaaatacaatttggacctctcaccc

SEQ ID NO: 3981 - DNA, 1087 bp, Carica papaya
gtagtcgcgcatctcagagaccgtagcagctgggagtttcagcctcctgcatcggggacgttcggcgagaagactctttgaggtcgagccagcaccagcaaaatggcgagggggttgaagaaacatttgaagaggctcaatgccccaaagcattggatgcttgacaagctaggtggtgcatttgcacccaagccatcatctggtccgcacaaatccagagaatgcttacccttgattctgatcctgaggaacaggctcaaatatgcactgacttaccgtgaagtcattgctatcctgatgcaacgacatgtgcttgttgatggaaaagttaggactgataagacataccctgccggtttcatggatgttgtgtcaatccccaagacaaatgagaacttccgtctcttatatgataccaagggccgcttctgcctccacactgtcagggacgaggaagccaagtttaagctttgcaaggttcgatctgtccaatttggccagaagggtatcccatacctgaacacatatgatggccgcaccattcgctacccagaccctcttatcaaggccaatgataccattaaacttgacctggagactaacaagattgttgacttcattaagtttgatgttgggaatgttgtgatggtgactgggggaaggaacagagggcgtgtcggagtcatcaagaacagagagaaacataagggtagctttgagaccatccatgttcaagatgcagttggtcatgagtttgcaacccgtatgggcaatgtgttcactattggtaaaggctcaaaaccatgggtgtcccttcccaagggcaagggcatcaagttatcaatcattgaggagtctaggaagaggcttgctgctcaacaggctgcatgatctagtgataaattttgagttatttttctttcaatgttctgagttgtaactgttggatggatgcagtaggattcttcggattcaaggtggaattagtttatcacataatatgactttttacatcactttttgtattactagcacaatttggactagctttcatcattgcaattttctagttcaatcttttgaatga

SEQ ID NO: 3982 - DNA, 1331 bp, Panicum virgatum
gcgggcaataaagctctcgccccgacccagcgccgtcgcattccctagggtttatcaccgtctcacagccctccgtagcgagctcgccgccgccgccgtcttcgcccgctccagcgcggacgaaccctaggcgccgaacaagatggcgaggggtttgaagaaacatctgaagaggctcaatgctccaaagcattggatgcttgacaagcttggtggagcatttgcacccaagccttcatcaggtccccacaaagccagggagtgcttgcctttgatccttatcctcaggaacaggttgaagtatgctctgacctatcgtgaagttatttcaatcttgatgcagcgccaagttatggttgatggcaaggtcaggactgacaagacatatccatctggattcatggatgttgtgtcaattccaaagactggagagaatttccgccttctctacgacaccaagggacgcttccgtctccacagtatcagggatgatgaggctaagttcaagctttgcaaggtgaggtctgtgcagtttgggcagaagggcatcccttttctgaacacctatgatgggcgcactatccgctacccagaccctctcatcaaggccaatgacaccatcaagattgacctggagaccaacaagattgtagacttcatcaagtttgatgttgggaatgttgtgatggtgactggcggaaggaacactgggcgtgttggggtgataaagagcagggaaaagcacaagggcagctttgagaccatccatgttgaggattcactcggccaccagtttgccacccgcatgggcaatgtgttcaccattggcaaggacaagaagccgtgggtatctcttcccaagggcaagggcatcaagctcagtatcattgaggaggcgcggaagcgcaatgctgaggctgctgctgaggcttgatttctttcatgtttggctactgaaaaccgttgctgtaagcatttctatcggaagatgtagaccgctgggcgcaagtgctatcatggagctgttctgaacagtgaagtcttgtgctattttgaacactgaagtagttggtccacaattctttttggatacttagctttgtcatgtgatttcatttcttgagcaaattagaggctacaatgtgttttgtttctgaatctcaacctgatcacgtttacctctcaagtggctctcagttattaatagcagggttgtgcatagcaagtaaaccgcccattgatatattggaagtgtcgagcttttccttttagaaattgaggaataatttgcatagttacttttcttaatgagtaaatgagttttgttccca

SEQ ID NO: 3983 - DNA, 1680 bp, Ricinus communis
aaataagatgggcctaatgcagagaagtgaaggggcaaatatgtaaataaaagaagatgaaattagggtttttagaaggttcatatattaattatatttatagtctccgaactctcgaataacagctccccagtctgctgctctctcctgcttggctctggaagaggatttgtctaataatatagccttcgaagcgaagaagagcgcaaaatggcaagagggttgaagaagcacttgaagaggcttaatgccccaaaacattggatgcttgacaaattgggtggcgcatttgcacccaaaccatcatctggacctcacaagtctagggaatgcttgcccttgatccttatcctgcgtaacaggttgaaatatgctctcacatatcgtgaagttattgccattctgatgcagcgacatgtccttgttgatgcgaaggttaggacggataaaacctatcctgctggtttcatggatgttgtgtcaattcccaagacaaatgagaacttccgtctcctttatgatactaaaggccgattccgtcttcactcaatcagagatgatgaagcaaagtttaagctttgcaaagtccgatctgttcaatttggccaaaagggaatcccatacctcaacacttatgatggacgtactattaggtatccagatccacttatcaaggccaatgatacaatcaagctagaccttgagagcaacaaaattactgacttcatcaagtttgatgttggaaatgttgtcatggtcactggagggagaaacagaggacgagttggagtgattaagaatagggaaaagcacaagggaagttttgagactattcacgtccaagatgcaactggccatgagtttgctactcgcatgggcaatgtcttcactattggaaagggaaccaagccatgggtttctcttcccaagggcaagggtattaaattgtcaatcattgaggaggccagaaagaggcttgcagcagcacaagcggttgcataagaggggttgtcttggttgtgttgctagtggcgattgacgagggttagttgtttcatttcattttaggttcatgggaagactaatgctttttatttcggattcatttacatgcacaattttgaaactatgtggtattttgaatttgtcaaaacttgtgttgttttgcagaaatttatgttaagatatttagatgtgtattttcttttgcttgtccattagtagtattgaaacaaagggtttttttttttctaagacgtagcacatgccaaaagctaaacctttcacaaatatgttgattaatggaaggggtgtttagacagtggataaatatgatagaggggaactaaaccctgtgctgagcacggaagagtccaattacaaggctagttacgagtatgacctaagctcagtttggaatgattccaacctggaacaaatagtggatgatagcgctatagtcgatgaaggtgcgctcgtttccagatttaagtccttagaagaacgaaaattattaaggctttacaagaatagtaggtcgtccacccgcgttactacgcgtttaattttttctatcacgtctaatattttcatgagaaatgacgctaaaagaaaaaaattaagaaaaaatctagcatgtattttggaataattatgtttttagtatttaaatttattaaa

SEQ ID NO: 3984 - DNA, 1417 bp, Coffea canephora
cggccgggggaaccctgcagcgagagagtgagggagagagaagaagcgccgctcagccgaaggagcctgatccccccttccccaactcctatccgtaacaatggctcgaggtttgaagaagcacttgaagaggctcaatgccccaaaacactggatgttggacaagcttggtggtgcttttgcaccgaagccctcatcagggccacacaaatctagggagtgcttgcctctgattctcattctgcgtaacaggctgaagtatgccctcacatatcgtgaagtcatttctatcttgatgcaacgccatattcttgttgatggcaaagttaggactgacaaaacctacccttctggtttcatggatgttgtatctatcccgaagaccaatgagaatttccgtctgctatatgatacaaagggtcgattccgacttcactccatcagggatgaggaggcaaagtttaagctgtgtaaggttcgatcagtacagtttggacagaagggcattccatacctgaatacctatgatggtcgtaccattcgttacccagacccactcatcaaggccaatgacaccatcaaacttgacctggagagcaacaagattactgatttcatcaagttcgatgttgggaatgttgtcatggtgactgggggaaggaacagaggtcgtgttggagtaatcaagaatagagagaaacataagggaagctttgagaccatccatgtccaagatgccacaggtcacgagtttgcgactcgtttgggtaatgtcttcatcattggaaaaggtgcaaaaccctgggtgtctcttccaaagggcaaaggtatcaagttgtcagttatagaggaacaaaggaagaggattgctgcccaggcggctactactgcctaaattttctactattagcgtctttgggagggtaacattttacttgcaaaactggtattaagatgttgcaatttttgagttgggtttaatgttttatttgtcttgtttagttacagttttggacattaaatattgtgttggcgcggtgattgcactgctatctagaacctatagttacaggtttaaaagccttggcttgacgtttgttagtcttccaattactggggctgatcagagaattttcattcatctttgaattccttcgccatgtgcagacgacactgattaattaggttcaagtgattgtagatctgagcggagttttgttctacttttgactgaaaacctggtcaacacagcgagtagcatggtttgcagatgagatgaaactagtggggttgaacgggtatctgctagtcggaccagctttcatgcctgtaatgtcatgtagttcatacttgcagtctctcttaaagcctccagtaaactggatgttttcatccagagtcttcatggatattttct

SEQ ID NO: 3985 - DNA, 1165 bp, Eucalyptus grandis
gacgtccccgcctcattcgtcgtctcccctcgagcctttcaggaactccgcagcgcgaagggaagctccgccgccggtcggtccgagccgagcacccgaaaatggcgcgaggtttgaagaagcatttgaagaggctcaatgctcccaagcattggatgcttgacaagctaggcggtgcattcgcaccgaagccatcttctggacctcacaagtccagggaatgtttgcctttgatccttattctgcggaacaggctgaagtatgctcttacatatcgtgaagtcattgccatcttgatgcagcgacatgtcctggttgacaacaaagtcaggacagataagacttaccctgctggtttcatggatgttgtctcaattcccaagacaaatgagaacttccgtctcctctatgacactaagggccgattcaggctccacagcatcagggatgatgaggcaaagttcaagctttgtaaggttcgctcagtccagtttgggcagaaaggcatcccatacctcaatacctatgatggccgtaccatccgctatcccgaccctctgatcaaggctaatgacactgtcaagcttgaccttgagaccaacaagataactgacttcatcaagttcgatgtcggaaatgttgtcatggttaccgggggaaggaataggggacgtgtcggagttatcaagaatcgtgaaaagcataagggaacttttgagaccattcacgtccaggactcacagggccatgagtttgctactcgattgggcaatgtgtacacgatcggaaagggaaccaagccatgggtctccctgcctaagggcaagggtatcaagttgtctatcattgaggaggcgaggaaaaggcttgcagcccaagcatctgcgactgcgtgagttttactattgatgcatgtattgaattatctgactggcgcttcctgttatttagctgtaagaggatttttggggaatgagcatcttgtttttgttccggtacaattctggcgaagttttgctccggcaatttagggtttatctgttgttttggatgttatagatgatggcgatttgaggttctttttatcctttacagtgtgtattcaaatgcatgcttgatttctcttcaagcattgaagaaaaaaaaaagattgagagaggagtca

SEQ ID NO: 3986 - DNA, 1057 bp, Fraxinus spp
agagtcgcgcaccgtgaaagagagggagaggggaagagagagacgccgcctggtagattgttgccaccaccagcaaaatggctagaggtttgaagaaacacttgaagaggctcaatgccccaaagcattggatgttggacaaacttggtggtgcttttgcacccaaaccttcttctggaccgcacaaatccagggagtgcttgccattgattcttattttgcgcaacaggctgaagtatgctctgacataccgtgaagtaattgccatcctgatgcaacgccatgtcctagttgatgggaaggttaggactgataagacctatcctgctggttttatggatgttgtttctattccaaagaccaatgagaattttcgtctactctatgatacaaagggtcgattcaggctccactccatcagggacgaggaggccaagtttaagctttgcaaagtccgatctattcagtttggaaagaaaggaattccctacctcaacacctatgatggaaggacaattcgctatccagatccgctcatcaaggcaaatgacaccgttaaacttgatcttgagacaaacaaaattgttgatttcatcaagtttgacgttgggaatgttgtgatggtgactggtggaagaaacagaggacgtgttggagtcatcaagaaccgtgagaagcacaagggaagcttcgaaactatccacgtccaggatgctgttgggcatgagtttgctacccgtctaggcaatgttttcactattgggaaaggtacaaagccttgggtgtctcttccaaagggcaagggtatcaagctgtccatcatcgaggaggccaggaagcggcttgctgcccaatctgcggccacagcataaattatcttattttattcgaagttgtcttttggtcatgttaattagtttgtactttttccttctggatttgtatgctggttgatggcacaatgttggttattataggatctatgctggaaaatctgttttgtttcaaatacaatttttacctgtcttgtttcaaatttggattagttgggtaacaa

SEQ ID NO: 3987 - DNA, 1063 bp, Pennisetum glaucum
cacccctccgcagccagctcgctcgccgccgccgccgccgcccgctcgagcgcggaagaaccctaggcgccgagcaagatggcgaggggtttgaagaaacatctgaagaggctcaatgctcctaagcattggatgcttgacaagcttggtggagcatttgcacccaagccttcatctggtccccacaaagccagggagtgcttgcctttgatccttatcctcaggaacaggttgaagtatgccttgacctaccgtgaagttatttcaatcttgatgcagcgtcaggttatggttgatggcaaggtcaggactgacaagacatatccatctggattcatggatgttgtatcgattcctaagactggagagaatttccgccttctctatgacactaaggggcgcttccgtctccatagtctcagggatgatgaggctaagttcaagctttgcaaggtgcggtctgttcagtttgggcagaagggcatcccttacctgaacacctatgatggacgaacaatccgctacccagaccctctcatcaaggccaatgacaccattaagatcgacttggacaccaacaagattgttgacttcatcaagtttgatgttgggaatgtcgtgatggtgactggtggaaggaacactgggcgtgttggggtgatcaagagcagggagaagcacaaaggcagttttgagaccatccacgtcgaggattcgcttggccaccagtttgctacccgcatgggcaacgttttcaccattggcaaggacaagaagccgtgggtgtctcttcccaagggcaagggtatcaagcttagcatcattgaggaggcgcggaagcgcaatgcagaggctgctgcagaggcttgattttttgcattttaggctacagaaaaaccattcctttaagcattatatcaaaagatgtagaagtgcctgctggacacatgtcttgccatgggctgttctgaacagtgaagttgtgctattttgaaccttcaagtagttgatatgcggttatagtattgatgcttgttttctaatgtgatttcattttaagcat

SEQ ID NO: 3988 - DNA, 1091 bp, Arachis hypogaea
gcttgccattgagaccctagcttagagcttagtttctcttcagatctcagagctcgcaaactcaacatggcaaggggattgaagaagcatttgaagaggctcaatgcccccaagcattggatgcttgacaaattgggtggtgcttttgcacctaagccctcatctggaccacacaagtctagggagtgcctcccactgatactcatcctgagaaacaggttgaagtatgccctcacataccgtgaagtcattgctattctgatgcagcgtcatgtgcttgttgataacaaggtcaggactgacaagacatatccagctggttttatggatgttgtatcaattcccaagacaaatgagaactttcgccttctctatgacaccaagggccgattccgtctccattcaatccgggatgaggaggccaagtttaagctctgtaaagttcgttcagttcaatttgggcaaaagggtatcccatacctgaacacctatgatggtcgcaccatccgctatcctgatcctctcatcagggctaatgacaccattaagttggatcttgaggaaaacaagattgttgatttcatcaaattcgatgttgggaatgttgttatggtcactggtggaaggaacagagggcgtgttggagtgatcaagaacagggagaagcataagggaagttttgagacaatccatgttcaggatgccatgggacatgaatttgcaacccgtatgggcaatgtgttcaccattggcaagggatcaaagccgtgggtgtcacttccaaagggcaagggtatcaagcttacaatcattgaggaagctaggaaaaggactgccgcacaacaggccgtcactgcttaaaatctcgaaggaatagacatgagtgcttggtagttttatgattcactgttttttgttttctcttggctcaagatcttttatctattgaattttgaatgttttgaattttgctctacactaatgacttcattccgcctgctatatttgtgaacaaatattatccttccaaaacctatctttgatatccttttgtctttcgttgcgacataattgaggaaacggagtaggtt

SEQ ID NO: 3989 - DNA, 1089 bp, Lippia dulcis
cactaccgccgagtgaaggacggacagggagtcgccgccgttgattaccctccaccaatatggctagaggtttgaagaagcatttgaagaggctcaatgccccgaaacattggatgttggacaagctgggtggtgcgtttgcccccaaaccgtcatctggaccccacaaatctagggagtgtttgcctttgattctcattctccgaaacaggcttaagtatgcattaaactaccgtgaggtcatctctatcttgatgcaacgccatgttctcgttgatgggaaagttaggacagacaagacttatccttctggtttcatggatgttgtttctattccaaaaaccaatgagaatttccgtcttctgtatgataccaagggacgattcaggctgcattccattcgtgatgaggaggctaagtttaagctatgcaaggttcgctcagttcagtttgggaagaaaggcattccatacctcaacacatacgatgggaggacaattcgctatcccgacccacttatcaaggcaaatgacaccattaaattcgacttagagagcaacaagattgttgatttcatcaagtttgatgtaggaaatgttgttatggtgactggtggtaggaacaggggacgtgttggagtgatcaagaaccgtgagaagcataagggaagtttcgagaccatccacattcaggatgctacaggccatgagtttgccactcgattgggcaacgtcttcacgattggaaagggtacaaagccgtgggtgtctcttccaaagggcaagggtattaagttatccattattgaggaggccaggaagaggctcgctgctcaggccgcaacagcttaagtagatatatccatgttttcccttctgaatgtgtcaaaaagtcgcaccatgagatgttatccttttgctattataggatctttcttgggtgaatttatgttgtttcaatcctaagttttgacattgatattgttttcaagttttggaatgcttttattttttctggatattggcttatattttgataatcttaattgttttcttccctagaaaaaaagaaaaagtaccgactgcgact

SEQ ID NO: 3990 - DNA, 1292 bp, Sorghum bicolor
cacaggctcgggcaataaagaggtctcattcccactccgccgtcgcatttcctagggtttagcaccttcgcacacccgcgcagcgagctcgccccgccgccgccatctttcgtccgctcgtgcccgcgaaggagccgtaggcaccgagcaagatggcgaggggtttgaagaaacatctgaagaggctcaatgctccgaagcattggatgcttgacaagcttggtggagcatttgcacccaagccttcatctggtccccacaaagccagggagtgcttgcctttgatcctcatcctcaggaacaggttgaagtatgccctgacctaccgtgaagtcatttcaatcttgatgcagcgacttgttatggttgatggaaaggtcaggactgataagacatatccatctggattcatggatgttgtgtcaattccgaagactggggaaaatttccgccttctctatgataccaagggacgcttccgtctccacagtatcagggatgatgaggccaagttcaagatgtgcaaggtgcggtctgtgcaatttgggcagaagggcatccctttcctgaacacctatgatggccgcacaatacgctacccagaccccctcatcaaggccaacgacaccatcaagatcgacctggagaccaacaaaattgttgacttcatcaagtttgatgttgggaatgtcgtgatggtgactggtggaaggaacactgggcgtgttggggtgataaagagcagggagaagcataagggcagcttcgagaccatccacgttgaggattcccttggccaccagtttgccacccgcatgggcaatgtgttcaccattggcaaggacaagaaaccgtgggtgtctcttcccaagggcaagggtatcaagcttagcatcattgaggaggcaaggaagcgcaatgctgaggctgctgctgaggcttgattctcacaacttagctacagataaaccattgctgtaagcattttccataggtgcagacatgagactaatggtacactagtgttatcatggagctgttttgaacaccgaagctgctggttcacatttctttttttcccccctttgtgatttggatactatatttatcatgagttttcgtttattgagcaaatgaaacattacaagtttggcgacctttgttcacttgttatgatgctattctacttgttctgctccctgaagcacctccatccatgttaggtttagccctgtagtacatgtgtggcttgtttatctgctatatacatgtttgtgtttcatttgatgata

SEQ ID NO: 3991 - DNA, 1449 bp, Sorghum bicolor
ccgaaatcctcacttgtgttggcccgctccaacccagagcccaaaagctccacaacacagatctgcgccgttaacgccacatcagacggccactagcacaggctcgggcaataaagaggtctcattcccactccgccgtcgcatttcctagggtttagcaccttcgcacacccgcgcagcgagctcgccccgccgccgccatctttcgtccgctcgtgcccgcgaaggagccgtaggcaccgagcaagatggcgaggggtttgaagaaacatctgaagaggctcaatgctccgaagcattggatgcttgacaagcttggtggagcatttgcacccaagccttcatctggtccccacaaagccagggagtgcttgcctttgatcctcatcctcaggaacaggttgaagtatgccctgacctaccgtgaagtcatttcaatcttgatgcagcgacttgttatggttgatggaaaggtcaggactgataagacatatccatctggattcatggatgttgtgtcaattccgaagactggggaaaatttccgccttctctatgataccaagggacgcttccgtctccacagtatcagggatgatgaggccaagttcaagatgtgcaaggtgcggtctgtgcaatttgggcagaagggcatccctttcctgaacacctatgatggccgcacaatacgctacccagaccccctcatcaaggccaacgacaccatcaagatcgacctggagaccaacaaaattgttgacttcatcaagtttgatgttgggaatgtcgtgatggtgactggtggaaggaacactgggcgtgttggggtgataaagagcagggagaagcataagggcagcttcgagaccatccacgttgaggattcccttggccaccagtttgccacccgcatgggcaatgtgttcaccattggcaaggacaagaaaccgtgggtgtctcttcccaagggcaagggtatcaagcttagcatcattgaggaggcaaggaagcgcaatgctgaggctgctgctgaggcttgattctcacaacttagctacagataaaccattgctgtaagcattttccataggtgcagacatgagactaatggtacactagtgttatcatggagctgttttgaacaccgaagctgctggttcacatttctttttttcccccctttgtgatttggatactatatttatcatgagttttcgtttattgagcaaatgaaacattacaagtttggcgacctttgttcacttgttatgatgctattctacttgttctgctccctgaagcacctccatccatgttaggtttagccctgtagtacatgtgtggcttgtttatctgctatatacatgtttgtgtttcatttgatgatagcattggtgcagagctttagtgtggactagcagattctttttgaaactgaataatttccag

SEQ ID NO: 3992 - DNA, 1297 bp, Saccharum officinarum
gacacacgcgtctgaaagaggtctcattccgactccgccgtcgcatttcctagggtttagcaccttcgcacagccgcgcagcgagctcgccgccgccatctttcgtccgctcctgcgcgcgaaagaaccctaggcaccgagcaagatggcgaggggtttgaagaaacatctgaagaggctcaatgctccgaagcattggatgcttgacaagcttggtggagcatttgcacccaagccttcatctggtccccacaaagccagggagtgcttgcctttgatcctcatcctcaggaacaggttgaagtatgctctgacctaccgtgaagtcatttcaatcttgatgcagcgacatgttatggttgatggaaaggtcaggacggataagacatatccatctggattcatggatgttgtgtcaattccgaagacgggggagaatttccgccttctctatgataccaagggacgcttccgtctccacagtatcagggatgatgaggccaagttcaagatgtgcaaggtgcggtctgtgcaatttgggcagaagggcatccctttcctgaacacctatgatgggcgcacaatccgctacccagaccccctcatcaaggccaacgacaccatcaagatcgacctggacaccaacaaaattgttgacttcatcaagtttgatgttgggaatgtcgtgatggtgactggtggtaggaacactgggcgtgttggggtgataaagagcagggagaagcacaagggcagctttgagaccatccacgttgaggattccctgggccaccagtttgccacccgcatgggcaacgtgttcaccattggcaaggacaagaaaccatgggtgtctcttcccaagggcaagggtatcaagcttagcatcattgaggaggcaaggaagcgcaatgctgaggctgctgctgaggcttgattctcgcaacttaggctacagataaaccattgctataagcattcgattcataggtgcagacatgagactgatgggacacaagtgttatcatggagctgttttgaacaccgaagctgctggttgacatttcttcttgttttttttacgattttgatactatatttatcatgtgttttcgtttattgagcaaatgagacattacaagtttgcgacctttgttcacttgtgatgatgctattctacttgttctgctccttgaagctccaactatgttaggtttagggctacaggtggcttgtttatcagatacatgctatacgtgtttgtgtttcagatgatgatacacccttgatatctttg

SEQ ID NO: 3993 - DNA, 1083 bp, Amsonia hubrichtii
actcccggcggcagaggaaccatcacctggcggcggaggcacaaccaccagttggtaaagcgattcgcatttttggttaacagatatggcgagagggttgaagaaacatttgaagaggctcaatgcccccaagcattggatgcttgacaagcttggaggagcatttgctcccaagccatcctctgggccacataaatcaagagagtgtttgcccttgatccttatcttgcgaaacaggctaaagtatgctctcacctaccgtgaggtcattgccattttgatgcagcgccatgttttggtggatgggaaggttaggacggacaagacttacccttctggcttcatggatgttgtctcaattccgaagacaaatgagaactttcggctcctttatgacaccaagggacgtttccggctgcattcaatcagggatgaggaagcaaagttcaagctttgcaaggttcgatctgtgcagtttgggcagaaggggatcccatacctaaacacttatgatggtagaaccatccgctatccagatcctctcatcaaggctaatgatacaatcaagttggatttggagactaacaagattgtggacttcatcaaatttgacgttggaaatgttgtcatggtgactggtggaagaaacaggggacgtgttggagtcattaagaacagagagaagcataagggtagctttgagacaatccacattcaagatgctaccgggcatgagtttgctacccgattgggcaatgtctttacaattggaaaaggtactaagccctgggtatctctaccgaagggaaaaggtattaaattgtccattatagaggaggcacgcaagagaaatgccagccaatcagctacaactgcctaatagctttgttccctcttcttgtccttgttctgctattatgtgggcaagtttagatggaattggttttgcagcttaaactttgttattttttcatatgtgctgttactttgtgttgctttgagttggttagagaattttgagtttaaatatgttgatttggcacttttcaccatgatcctgattttgggttataagaagagata

SEQ ID NO: 3994 - DNA, 932 bp, Musa acuminata
ggcggagaggaggccgagttccggaaaaatggcgaggggattgaagaaacatctgaagaggctcaatgccccgaagcactggatgctggacaagctcggcggagctttcgctccgaagccatcatctggccctcataaagctagagaatgcttgcccttgattcttattctaagaaacaaactgaagtatgctctcacataccgtgaagtcattgctattcttatgcaacgccatgtaatggtggatggaaaagtcaggaccgacaagacgtaccctgctggtttcatggatgttgtttcaattccgaagacaaatgagaactttcgtcttctttatgacaccaaggggcgcttccgtctccattcagtaagagatgaagaggcaaagttcaagctctgcaaggttcgctctgtccagtttggccagaagggcatcccctacctgaacacctacgatggtcgaaccattcgctacccagaccctcttatcaaggccaatgacaccatcaagctcgacctggaggccaacaagatcgtagacttcatcaagttcgatgtgggaaacgttgtgatggtgaccggcgggaggaacactggccgagttggcgttatcaagaacagggagaagcacaagggcagcttcgagaccatccatgtccaagatgccaccggccacgagtttgcaactcgcatgggcaatgtcttcaccattggcaaggggacgaagccatgggtgtctcttcccaaaggcaagggtatcaagctcagcatcatcgaggaggcaagaaagcgcttggctgccgctggcgcaactgccactgcttagttgtgcgctgttccaccatctgagtctaagaggctatttatttgctgtgtaattggatgatgcattctggatttcaatgttgtctttagtctatttgcattgtcgg

SEQ ID NO: 3995 - DNA, 929 bp, Vaccinium corymbosum
agcagacagccgcagcggagtggtgaagtctcgagcggactcatctccgaccctactgaacaaccatggcaagaggtttgaagaagcatttgaagaggctcaatgccccaaaacattggatgcttgacaagcttggcggtgcatttgcgcctaagccatcatctggtccccataaatcaagggaatgcctgcccttgattcttatcattcgaaataggctgaaatatgctctcacataccgtgaagtcattgcaatcttgatgcaacgccaggttcttgttgatcagaaggtcaggactgataagacctaccctgctggtttcatggatgttgtttccattcccaagacaaatgagaatttccgtctcctttatgacacaaagggtcgattccgtcttcattccatcagagatgaagaggccaagttcaagctttgcaaggttcgctcagtacaattcggttcaaagggtatcccatacatcaacacttatgatgggcgcactatccgttaccctgatccactcatcaaggccaacgacaccatcaaatttgacctagagaccaataagatcactgacttcatcaagtttgatgttggaaatgttgtgatggtgactggaggaaggaataggggtcgtgttggagtgatcaagagtcgggagaagcacaagggaagctttgaaaccattcacgtccaagatgccactggtcacgagtttgctactcgcatgggcaacgttttcacaatcggaaaaggttcaaagccgtgggtgtcgcttcctaagggcaagggtatcaaattgtccatcattgaggaggctaggaagaggcttgctgcccaaacaggtgccgctgcataaactccaagaatcaagatctgtttcttgacagtgtttcgttcctgaaaggggttatgaaagagctggtta

SEQ ID NO: 3996 - DNA, 1154 bp, Vaccinium corymbosum
ctctatccgaagaaacgcagcagacagccgcagcggagtggtgaagtctcgagcggactcatctccgaccctactgaacaaccatggcaagaggtttgaagaagcatttgaagaggctcaatgccccaaaacattggatgcttgacaagcttggcggtgcatttgcgcctaagccatcatctggtccccataaatcaagggaatgcctgcccttgattcttatcattcgaaataggctgaaatatgctctcacataccgtgaagtcattgcaatcttgatgcaacgccaggttcttgttgatcagaaggtcaggactgataagacctaccctgctggtttcatggatgttgtttccattcccaagacaaatgagaatttccgtctcctttatgacacaaagggtcgattccgtcttcattccatcagagatgaagaggccaagttcaagctttgcaaggttcgctcagtacaattcggttcaaagggtatcccatacatcaacacttatgatgggcgcactatccgttaccctgatccactcatcaaggccaacgacaccatcaaatttgacctagagaccaataagatcactgacttcatcaagtttgatgttggaaatgttgtgatggtgactggaggaaggaataggggtcgtgttggagtgatcaagagtcgggagaagcacaagggaagctttgaaaccattcacgtccaagatgccactggtcacgagtttgctactcgcatgggcaacgttttcacaatcggaaaaggttcaaagccgtgggtgtcgcttcctaagggcaagggtatcaaattgtccatcattgaggaggctaggaagaggcttgctgcccaaacaggtgccgctgcataaactccaagaatcaagatctgtttctgacagtgtttcgttcctgaagggtttatgaaagagctggttatgttttgtcctttctttatcttagtgcaattttgaactgattttgttgttgcaaatttggtttgacttttgctttcatgggatgatttatttgcagtgttttaagtttgatacagttaagattttattgccgacaattagtaccatggcagttcgaaaccttgttattctacagtgtttaagggtatctgaggcacatcagtcttggat

SEQ ID NO: 3997 - DNA, 1026 bp, Cenchrus ciliaris
caccgtctcacacgccccgcagccagctcgccgccgccgccgccgccgtccgctcgagcgcggaagaaccctaggcgccgagcaagatggcgaggggtttgaagaaacatctgaagaggctcaatgctcctaagcattggatgcttgacaagcttggtggagcatttgcacccaagccttcgtctggtccccacaaagccagggagtgcttgcctttgatccttatcctcaggaacaggttgaagtatgccttgacctaccgtgaagttatttcaatcttgatgcagcgtcaggttatggttgatggcaaggtcaggactgacaagacatatccatctggattcatggatgttgtatcaattcctaagactggagagaatttccgccttctctatgacactaaggggcgcttccgtctccacagtctcagggatgatgaggctaagttcaagctttgcaaggtgcggtctgtgcagtttgggcagaagggcatcccttttctgaacacctatgatggacgcacaatccgctacccagaccctctcatcaaggccaatgacaccattaagattgacctggacaccaacaagattgttgacttcatcaagtttgatgttgggaatgttgtgatggtgactggtggaaggaacactgggcgtgttggggtgatcaagagcagggagaagcacaagggcagctttgagaccatccacgtcgaggattcgctcggccaccagtttgccacccgcatgggcaatgtgttcaccattggcaaggacaagaagccgtgggtgtctcttcccaagggcaagggtatcaagcttagcatcatcgaggaggcgcggaagcgcaatgctgaggctgctgctgaggcttaatttcttacattttaggctacagatattgctgtaagcattctatcaaaagatgtagacgtgcctgctggacccatgcattgccatggggctgttctgaacagtgtagtcatgtcctattttggaccctgaagtaatttatccacaatca

SEQ ID NO: 3998 - DNA, 954 bp, Cyamopsis tetragonoloba
cacgagggggagagctctagttcgaacaacgaaatggctagagggttgaagaagcatttgaagaggctcaatgcccccaagcattggatgcttgacaaattgggcggtgcatttgcacctaagccctcgtctggtccacacaaatctagggagtgcttaccactcattctcatattgcgaaaccggctgaagtatgctctgacataccgtgaagtcattgctatccttatgcagcgacatgtccttgttgatggaaaagtcaggactgacaagacatatcctgctggtttcatggatgttgtatcaatccctaaaactaatgagaacttccgcctgctctatgacaccaaaggacgattccgtcttcactcagtcagggatgaggaggcaaagtttaagctttgcaaggttagatcagtgcagtttgggcaaaaaggtattccatacctgaatacctatgatggacgcaccatccgctacccagacccaatcatcagggctaatgacacaatcaagctggatcttgaggaaaacaagatcgtggatttcatcaaatttgatgttgggaatgtggttatggtaactggtggtaggaacagggggcgtgttggagtgatcaagaacagggagaagcacaagggaagctttgagacaattcacgttcaagatgccactgggcatgaatttgcaactcgtttgggcaatgtgttcactatcggcaagggtaacaaaccatgggtgtctcttcccaaggggaagggtattaagctatcaatcattgaggaagctaggaaaaggattgctgcccaacaagcaactgctgcttaaatctcttataatgttggacttgagtgcttggtagttatatgcctttagtttctaaatttttgtatcagattgtcagtttaatttttgacttatgcactatacatcatttattacttttatcgtgct

SEQ ID NO: 3999 - DNA, 1114 bp, Fraxinus spp
cggccgggggacagctttaaagaagagtcgcgcaccgtggaagagagggagaggggaagagagagacgccgcctggtagattgttgccaccaccagcaaaatggctagaggtttgaagaaacacttgaagaggctcaatgccccaaagcattggatgttggacaaacttggtggtgcttttgcacccaaaccttcttctggaccgcacaaatccagggagtgcttgccattgattcttattttgcgcaacaggctgaagtatgctctgacataccgtgaagtaattgccatcctgatgcaacgccatgtcctagttgatgggaaggttaggactgataagacctatcctgctggttttatggatgttgtttctattccaaagaccaatgagaattttcgtctactctatgatacaaagggtcgattcaggctccactccatcagggacgaggaggccaagtttaagctttgcaaagtccgatctattcagtttggaaagaaaggaattccctacctcaacacctatgatggaaggacaattcgctatccagatccgctcatcaaggcaaatgacaccgttaaacttgatctcgagacaaacaaaattgttgatttcatcaagtttgacgttgggaatgttgtgatggtgactggtggaagaaacagaggacgtgttggagtcatcaagaaccgtgagaagcacaagggaagcttcgaaactatccacgtccaggatgctgttgggcatgagtttgctacccgtctaggcaatgttttcaccattgggaaaggtacaaagccttgggtgtctcttccaaagggcaagggtatcaagctgtccatcatcgaggacgccaggaagcgacttgctgctgcccaatcagcggccacagcataaattatcttgttttattcgaagttgtcttttggtcatgttaattagtttgtacttttcccgtctggatttgtatgctggttgatggcacaatgttggttattataggatctatgctggaaaatctgttttgtttcaagtacaatttttacctgtcttgtttcaaatttggattagttgggtaacaaatattggaaactaaggttttctaaacttaga

SEQ ID NO: 4000 - DNA, 1094 bp, Lippia dulcis
taggagagaggtgagggagagagacggccaccgtcgattctgacatccaccagcgaaaatggctagaggtttgaagaaacacttgaagaggctcaatgccccgaaacattggatgttggacaagcttggtggcgcttttgcacctaaaccatcatctggaccccacaaatccagagagtgcttgcccctgattctcattttgaggaataggctgaaatatgctctcaattaccgtgaagttatttccatcttgatgcaacgccatgtccttgttgatgggaaggtcaggactgataagacatatccatctggtttcatggatgttgtttcgatcccaaagactaatgagaacttccgtctgctgtatgacaccaagggtcgattccggcttcactctatcagagatgaggagtccaagtttaagctgtgcaaagtccgttctgtccaatttggcaaaaaaggcattccgtacctcaacacctatgatggaaggacaattcgctacccggaccccctcatcaaggccaacgacaccataaaattcgaccttgaggctaacaaaattgttgatttcatcaaatttgatgtcgggaatgttgttatggtgacaggtggaagaaacagggggcgtgttggtgtaatcaagaaccgtgagaagcataagggtagcttcgagaccatccacatccaggacgctactggccatgagttcgctactcgattgggaaatgtctttacaatcggaaagggtacaaagccttgggtatctcttccaaagggcaagggtatcaagttgtctatcattgaggaggctaggaagaggcttgctgcccaagctgcaacatcttagagattatgaaagttttaaagctttacttttggtgatgtgttgggagtacatttagctcttaccggctatagactttgtgtttggaagatgtcattttagctaattatcatggaggtttgttgtgttccccttctgaagttttggcttctatgtcttgagtatgggatgttcgaggagatttcatgttttggaccatttgatttggatatttgttgcaaattttaatgaagttacgtttccttaa

SEQ ID NO: 4001 - DNA, 1070 bp, Lippia dulcis
ctctcagagaggagggaggcagaagcgccgccgggggacctcacatcaatcagcaaaatggcgagagggttgaagaaacacttgaagaggctcaatgccccaaagcactggatgcttgacaaacttggtggtgcctttgcccccaaaccatcatctggacctcacaaatccagggagtgcttaccattgattcttattctgcgaaataggctgaaatatgctcttaattatcgtgaagtcatttccattttgatgcaacgtcatgtcctcgttgatggaaaggtcaggacggataagacatatccctctggttttatggatgttgtctctatcccaaagaccaatgagaacttccgacttctgtatgacaccaagggtcgattcaggctgcactcaatcagagatgaggaggccaagttcaagctatgcaaagtccgctcagttcagtttggaaagaaaggcattccatacctcaacacttatgatgggaggacaatccgctatccggacccactaatcaaggcaaatgacacaatcaaattcgatttggaaagccaaaagattgttgatttcatcaagtttgatgtaggaaatgttgttatggtaactggtggtaggaacaggggacgtgttggagtaatcaagaaccgtgagaagcataagggaagttttgagacaattcacattcaagatgctactggacacgagtttgctacccgattgggcaacgtttttactattggaaagggtacaaagccgtgggtgtcacttccaaagggcaaaggtataaaattgtccatcattgaggaggcaaggaagaggctggccgctcaagctgctactgcttagaaagaaatagagcatcgttataggatttttgtttcttagaagatctttgtctgaagttctgatatttacctttatattgttttcagcaaattgaaattattgacttttgtatggttaattttggtttatttggtggaagtttggtatgtttttaaattctgtatacagaaggcgatttgcagcttaatttagtttctaatttaattcaatcaaaaaaaaag

SEQ ID NO: 4002 - DNA, 1107 bp, Plantago ovata
cccatccagctgaaatctcagctaacacacagccagccgctgtcctctattcgcatccgtaatcctccaacatggctaggggtttgaagaaacatttgaagaggctcaatgccccgaagcattggatgttggacaagcttggtggtgcttttgcccccaaaccatcatctggaccccataaatctagggagtgcttgcctttggtgcttatcatccgtaataggctcaagtatgctcttacctaccgtgaggttattgccattctgatgcaacgtcatgtgcttgttgatggcaaggtcaggactgacaagacgtatcctgctggtttcatggatgttgtttccatccccaagaccaatgagaatttccgtcttctctacgacaccaagggacgattccgcttgcactctgttagagatgaggaagcaaagtttaagctttgcaaagtccgatcaattcagtttggcaagaaaggtattccatacctcaatacctatgatggaaggaccatccgctacccagaccccttgatcaaggcaaatgacaccatcaagcttgaccttgaggccaacaagattgttgatttcatcaagttcgatgttggtaatgttgtcatggtgactggtggtaggaataggggacgtgttggtgtgatcaagaaccgtgagaagcataagggtagctttgagactattcacgtacaggactccactggacacgagtttgctactcgtttgggtaatgtgttcactattggtaagggaactaagccatgggtgtctctccccaagggcaagggtatcaagttgtcaatcatcgaggaggccaggaagaggctcgctgctcaagctgccacagcttagaaacatctttgaagttattttactataaacatcaaacctgatttcagttttttttgcagttgatgtaatgtcaatgtaggatcatccttgttcggagcatttgagttctatttagtgtttttggattttgtatggtttacttgttgaactaaacatcttcgttttgttatcattaaattcgagtttcatcacatcatgtttcggctagctggcttgatatttgctattgagcttgattttggcc

SEQ ID NO: 4003 - DNA, 1044 bp, Platanus occidentalis
agaggcgtagtacgtggagggtcgaagacagaggcgagagatttccaggagaatagcgcaagcatggctcgagggttgaagaaacatttgaagaggcttaatgctccgaagcattggatgctagacaagcttgggggtgcatttgctcccaagccatcatctggaccccacaaatccagggaatgcttgccattgatcctaatcctgcgaaatagattgaaatatgctctcacataccgtgaggtcattgctattttgatgcaaaggcatgttcttgttgacgggaaggttaggactgataagacgtaccctgctggcttcatggatgttgtatcaattcctaaaacgaatgagaacttccgtctcctttacgacaccaagggccgctttcgtctacactcaattaaggatgaagaagccaagtttaagctctgcaaggtccggtctgtgcaatttgggcaaaagggcatcccatacattaacacttacgatggtcgtacaatccgctacccagatccgctcatcaaggccaatgacaccatcaagctcgacctcgagagcaacaagatcattgactttattaagtttgatgtcgggaatgttgtcatggtgactgggggaaggaacagggggcgtgttggagtcatcaagaatagggaaaaacacaaggggagttttgagaccatacacgtccaggatgccactggccatgagtttgccactcgcttgggcaatgtctacaccattggcaaggggacgaagccatgggtatctcttcccaagggcaagggtatcaagttgtcaatcattgaagaggccaggaagaggcttgcagctcaagcagcttccaccgcgtaactttacaatgacaatagctttcaaatttggttgcagggtgttataggttgttcttaattttgcaggttgatctactgttagctggaggattagtgatcttgctttgttttttctttgttcttgtgttaaagcaatttttgtagttctaaactcggtttaaattgtgttgtggactgaggttggaga

SEQ ID NO: 4004 - DNA, 1152 bp, Platanus occidentalis
gaggcgcagtccgtcgagggtcgaagacagaagcgagagattttcaggcgaagagagcaaacatggctcgtgggttgaagaaacatttgaagaggctcaatgccccaaagcattggatgttagacaagcttggtggtgcatttgctcccaagccatcatctggaccccacaaatccagggaatgcctgccattgatcctaattctgcgaaacaggttgaaatatgctctcacttaccgtgaggtcatagccatcttgatgcaacggcatgttctcgttgatgggaaggttaggactgataagacataccctgcaggcttcatggatgtggtatccatacccaaaaccaacgagaacttccggctcctttatgacaccaagggtcgtttccgtctgcactcaattaaggatgaagaggccaagtttaagctgtgcaaggtccggtctgttcaatttgggcagaaagggatcccatatattaacacctatgatggtcgtacaatccgctaccctgacccactgatcaaggccaatgacaccatcaagcttgaccttgaaagtaacaagatcattgacttcatcaagtttgatgtcgggaatgttgtcatggtgactgggggaaggaacagggggcgtgttggagtcatcaagaacagggagaagcacaaggggagcttcgagaccatccatgtccaggatgccactggccatgagtttgcaactcgtctcggcaacgtctataccattggcaagggtacaaagccatgggtatccctccccaagggcaagggtatcaagttgtccatcatcgaagaggccaggaagaggcttgcagcacaagcggcgaccactgcttaaacttctatcatgacaataacattcaggtacagttgcagagttccatagccgtagttttgaaattgcattttggcccgaattttaggtttaagatttgtgttcttgctttcttttttttactttcatgtcgaacaattttttgtagttcgaaacttttagttaagttttatgttgtggactgatatggaagagagatcagatcatgttagttatttttgctctatgatccttctctgttttgcatcagggaaagactagaaagtgtcttttacttttcagccctcttaaactatta

SEQ ID NO: 4005 - DNA, 1166 bp, Oryza sativa
atcgccattctctagggtttattccacgcctcccgtcgccgccgccgccgccgtcgttgtcctcgcccgcgcgcgaggagaacgctaaactccggtcaagatggcgaggggtttgaagaagcatctgaagaggctcaatgcccccagccattggatgcttgacaagcttggtggagcatttgcacccaagccttcttctggtccccacaaagctcgggagtgcttgcctttgatccttatcctcaggaacaggttgaagtatgctctgacctaccgtgaggttatttccatcttgatgcagcggcatgttatggttgatggaaaggtcaggactgacaagacttatccggctggattcatggacgttgtgtcaattgcaaagactggggagaatttccgccttctgtatgacaccaagggtcgcttccgtctccacagcatcaaggatgaggacgctaagttcaagctctgcaaggtccggtctgtacagtttggacagaagggtattcctttcctgaacaccaacgacgggcgcacgatccgctacccagacccactcatcaaggccaacgacaccatcaagattgacttggagaccaacaagatcgtggacttcatcaagtttgatgttggaaacatcgtgatggtgaccggtgggaggaacacggggcgcgtcggggtgatcaagagcagggagaagcacaagggcagctttgagaccatccatgtcgaggatgccctcggccaccagttcgcgactcgcatgggcaacgtcttcaccatcggcaaggagaggaagccgtgggtatctctccccaagggcaagggcatcaagctcagcatcattgaggaggcgaggaagcgcaatgccgaggctgccgctgaggcttgatttctgaaaatctccatgaatgaaactgttgatttgagcagtctatttatatagattatttagctcttaagatcatatgtccattggagaccgtcaattggcgcttcattgttcgatacttgtcgagctgttttgaaactatgaattcatcatctgttaccttcagcataatagatccagaatccttttttagcttgtgtaatctttcccaaatgagaagctaccttgcatactgaaatgaattccacatgatgtttggatttgcaagttcgta

SEQ ID NO: 4006 - DNA, 1359 bp, Sarracenia psittacina
ggccccaaagtcggcgctgggttggttattgattttaaaaaaaaaatttgttcctctattggagaacctgaagccgaagcagaggaacccccagccgcccgccccccaaccggcgctggtactccttgccgcagtctctttgccacctgagagagagagaaacagggggtcggcagcagcattttttaggccataccagtccgatttttctactcttttggcttgacatcaggcgacggcgaaggaagaagtttctgagcttacgaatccaagatggctaggggtttgaagaaacatttgaagaggcttaatgccccaaaacattggatgctcgacaagcttggtggtgcatttgcccccaagccatcatctggaccccacaagtcgagggaatgcctgccgttgattcttatcctgcgaaaccgactgaagtatggtctcacataccgtgaagtcatttccattctgatgcagcgtcatgttcttgttgatgggaaggttaggacagataagacttatcctgctggtttcatggatgttgtttcgattccgaagacaaatgagaatttccgtctcctttatgacacaaagggtcgattccgtctccattctctcagagacgaagaggctaagtttaagctatgcaaagttcgctctgtacagtttggccaaaaaggtatcccatacctgaatacttacgatggacgaaccattcgttaccctgacccgcttatcaaggccaacgacactatcaaacttgacctagagacaaacaagattgccgatttcataaaattcgatgttgggaacgttgtcatggtgactggaggtaggaacaggggtcgtgttggagtcatcaaaaacagggagaagcacaagggaagctttgaaaccgttcacatccaggatgccaccggtcacgagtttgctactcgaatgggcaatgtttttaccattggaaaaggtacgaagccgtgggtgtcgcttcccaagggcaaggggataaagttgtccatcatcgaggaggctaagaagcggctagcagcaacccaagcaggtgcaacggcgtaaggttatgtaggatttgtttgtgagaatttatgtttttatcttttccgtttctcactaagacaaagactaatttttggttaagagtgttggatgttttgaaagtagaacaatgttgctcaacttgcctaatttaatgggatgatttatgattatctttggaacgggcgaacggcaagagatttgcacaagccattttggcaaaaataatgcatcatcttttgaggtgatggactggagatgttctgttagggcctattggataaaagtgaacttattttgattatcgac

SEQ ID NO: 4007 - DNA, 1195 bp, Glycine max
accttaagtgccgcagcaactctttttgtttcttcagtttggtataaccttagccgaggtcacgaggagcactagctagtttcacaatttccaaatggctaggggattgaagaagcatctcaagaggctcaatgctcctaagcattggatgcttgacaaactgggtggtgcatttgcgcccaaaccctcatctggaccacacaaatctagggagtgccttcccctcatactcatcctacgaaaccggctaaagtatgctctgacttaccgtgaagtcatcgctattctgatgcagagacatgttcttgttgatggaaaagtcaggactgacaagacttaccctgctggtttcatggatgttgtttcaatcccaaaaaccaatgagaacttccgcctgctctatgacactaaaggccgattccgtctccattctgtcagggatgatgaggcaaagttcaagctctgcaaggttaggtcagtgcagtttggccagaaaggtatcccatacctgaacacctatgatggtcgcaccatccgttacccagaccctctcatcagggccaacgacaccattaagctggatctggaggaaaacaagattgttgattttatcaaatttgatgttgggaatgtagttatggtaacaggtgggagaaacagggggcgtgttggagtgatcaagaacagggagaagcataagggtagctttgagacaattcacgtgcaggattccactggacatgaatttgctactcgcatgggcaatgtgttcactattggcaagggcacaaagccatggatatcactgcccaagggtaagggtattaagctatcaatcattgaagaagctaggaaaaggattgccgcccagcaagcaactgctgcttaaaccccttttggatgaatagacttgagtgcttggtagttttattcaatgtttttgttttctaatttcttttggctaagagattttaatcgttgaattttgactcttgcactatacaactttattgtggctgttatattcatgaagtaatctttctattccttacctagtatttgactgggtttttggttttcgtacaaaatcaccgaatcaatttcaccatataacaaaatgccgcagctgtagtaagatggtattgcttgctattgaagtgaatatggatgttttagtaaattattcaatgtgtgc

SEQ ID NO: 4008 - DNA, 1184 bp, Musa acuminata
cgatcgcgagtccgcgctagggtttctctctcggcttcggtactttaaaggcccccctcgacgcttccgagttctcgaggaggaggcgcgcaaacaggaggccgacatccgaaaaagatggccaggggattaaagaaacatctaaagaggctcaatgcccccaagcattggatgctggacaagcttggtggagcctttgctcccaaaccatcatctggccctcataaagccagggaatgcttgcccttgattcttatattaagaaacaaactgaaatacgcacttacgtatcgtgaagtcattgctattctgatgcaacgtcatgtaatggtggatggaaaagtcaggactgacaaaacttacccagctggtttcatggatgttgtctcaattcccaagacaaatgaaaacttccgcctcctgtatgacaccaagggacgcttccgtctccattcgataagggatgaagaggcaaagttcaagctctgcaaggttcgctctgtccagtttggacagaagggcatcccctatttaaacacctacgatggtcgtaccattcgctaccccgaccctctcatcaaggccaatgacaccatcaagcttgatctggaaaccaacaagattgtagacttcatcaagttcgatgttggaaatgttgtgatggtgaccggcggaagaaacaccggtcgtgtcggcgtgattaagaacagggagaagcacaaggggagttttgagaccatccacatccaagatgctactgggcatgagtttgcgactcgcttgggcaatgtcttcaccattggtaaggcgactaagccatgggtgtctcttcccaagggcaagggtatcaagctcagcatcattgaagaggcaagaaagcgcttggctgctgctaatgcaactgccactgcttaatcctatgctctgcacccatcagaatcttgttcttggatctttgatggactcggcctttgattttagctctctgttacttgcatttcaattttgctttggagattttgagtagaagatacgattcttatcataattctgacatgtagtttcctgatgagggttttcttgaagttcaccaccctgttcttactgctggatcttggcatttttatttggcataatcaaagaactagttgaattataaatttatttctatttggtctcctcaa

SEQ ID NO: 4009 - DNA, 1550 bp, Musa acuminata
caacggacgattgctgggttcggtcttttaacaggatccgatcggaccgtaaagaacccaatcggagggtattacggtcattgaacaaccatctcttcttaagaagcgatagggtttgtttgtctgcggcggttccttgagaggcggcggagaggaggccgagttccgggaaaatggcgaggggattgaagaaacatctgaagaggcttaatgccccgaagcactggatgctggacaagctcggcggagctttcgctccaaagccatcatctggccctcataaagctagagaatgcttgcccttgattcttattctaagaaacaaattgaagtatgctctcacataccgcgaagtcattgctattcttatgcaacgccatgtaatggtggatggaaaagtcaggaccgacaagacgtaccctgctggtttcatggatgttgtttcaattcctaagacaaatgagaactttcgtcttctttatgacaccaagggacgcttccgtctccattcagtaagagatgaagaggcaaagttcaagctgtgcaaggttcgctctgtccggtttggccagaagggcatcccctacctgaacacatatgatggtcgaaccattcgctacccggaccctcttatcaaggccaatgacaccatcaagctcgacttggaggccaacaagatcgtagacttcatcaagtttgatgtcggaaacgttgtgatggtgaccggcgggaggaacactggccgagttggtgttatcaagaacagggagaagcacaagggcagcttcgagaccatccatgtccaagatgccaccggccacgagtttgcaactcgcatgggcaatgtcttcaccatcggcaaggggacgaagccatgggtgtctcttcccaagggcaagggtatcaagctcagcatcatcgaggaggcaagaaagcgcttggctgccgctggcgcaactgccactgcttagttgtgcgctgttccaccatctgagttatgctaagagggctttttatttgctgtgtaattggatgatgcattctggatttcaaacgttgtctttagtcaatttgcatgttggttttctttggagatttgtagaagatgatagacattgtagtacttcaacccattcaagtaatatgtatgtatatggcattataagccgtgaactatagtgtcggggtgctaaaaagttttcgacagcgggtgcttccggcggaggtgctgcccgtgctgctgtcgagcaccttctgtgcctggagatgttcgtgttccatggaggttgtctgctggagtggctgaagaagaaccgagccgtcactgccggctctaccgaaataaaatttagaagacggcctctgaaatcatagatagcaatgtagaaatgtaaatgtagatgtctagatagcaatgtagaaatgtaaatgtagatgtccggaaacatagtgatcatctttttcggattggcttttgtcgatagatccatagcaggatccacgctacctgatcgagtctattacctatgttggtttgactgttcccacaa

SEQ ID NO: 4010 - DNA, 1182 bp, Vaccinium corymbosum
tccataccgcatacagtgaaggaacgcaggcactgcggagtcgaagttgagtccaagttccgaggggactcatctctccgcttttgcttccacttccaacatggctaggggtctgaagaaacatttgaagaggctcaatgcccctaaacattggatgcttgacaaacttggtggtgcatttgcccccaagccatcatctggaccccataaatcaagggaatgcttgcctttgattcttatcttgcgaaataagctgaagtatgccctcacgtaccgtgaagtcattgcaatcttgatgcagcgccatgtttttgttgatgggaaggttaggactgataagacctaccctgctggtttcatggatgttgtatcaattcccaagacaaatgagaatttccggctcctttatgacacaaagggtcgattccgactccattccgtcagagatgaagagtccaagtttaagttatgcaaagttcgctctgttcagtttgggcagaaggggatcccatacataaacacttatgatgggaggaccattcgttacccagacccacttatcaaggccaatgatactataaaacttgacctagaaacaaacaagatcactgatttcatcaagtttgatgtggggaatgttgtcatggtgactggaggaaggaataggggccgtgttggagtcatcaagaacagggagaagcacaagggaagctttgaaacaattcatgtccaggattcggttggtcacgagtttgctactcgcatgggcaatgtgtttacaattggaaaaggttcaaagccatgggtgtctcttcctaagggcaagggaatcaagttgtccattattgaggaggctaggaagcggcttgctgcccaaacaagtgcaactgtgtaaattgccagataaggatttgttgctggtatcgtctagctgatgtaggatttgtgttgatggagagtcttcttgtcttttttcatattgcgctataatggttaactgaattttggcactgcatcttgggtgattttagaaattgaacaatctagctcaattgccatctgtcaggagactatctattgattatgtttggtaatggggcgatttaatgagtagtagtttggcggttttatggaatattgtccaattttgggccaagatgcaagtattccttgttaaccttt

SEQ ID NO: 4011 - DNA, 1179 bp, Elaeis guineensis
tggcattaaaataaaacacaaaatgctgcctgatcgggtccgaacgtttcaggaggggtgggaggggaaggctgctgcgttaggagaacaaaatggctaggggattgaagaagcatttgaagaggctcaatgccccaaagcattggatgctagacaagcttggtggtgcttttgcccccaaaccatcttctggcccacataaggctcgtgaatgtttaccattaatccttatcctaagaaacagattgaaatatgctcttacttaccgtgaagtcattgcaattctgatgcaacgacatgtactggttgatggaaaggtcaggactgacaaaacctatccagctggtttcatggatgttgtatcgataccaaagacaaatgagaattttcggcttctttacgacaccaaggggcgttttcgtctccactcaatcagagatgaggaggctaagttcaagctatgcaaggtccggtctgttcaatttgggcataaaggcattccttatctgaatacttatgatggtcgtacaattcgttatcctgaccctcttatcaaggcaaatgacaccattaagcttgatctggagacttacaagattgtggatttcatcaagtttgatgttggaaatgtggtgatggtgactggtggaaggaacaggggccgtgttggtgtcatcaagaacagggagaagcacaagggtagttttgagacaatccacctccaagacgcaactggtcatgagtttgcaactcgccttggcaatgtattcaccattggcaaggggacaaagccatgggtttcccttcccaaaggcaaaggtatcaagctcagcatcattgaggaggctaggaagcgacttgctgcttctggcgctgctgccactgcctgatcatattgattgctttcatattttgtgtggggtatagttggagttctttgtggacatgtagggggtggatgttgcaaatcctttcacctgattttggtagttaaacttaagttttcttttgaatagggatattagttcgcttaaatttgatcggcagctggacattggttttgcattggacactaattgacattttattgcgtctgctcataccaatatttttcccgacttcttaggctacttgtgtttttctgtgtccttcagcagtttggtgatgattatatctagt

SEQ ID NO: 4012 - DNA, 1148 bp, Plantago ovata
ataaacaagtattgttcggcccaattgcacgcttaagttgggtccagaaaagtaagaagttgggccgatggttgagctaagcccaataagggccgactagttaatagggtttatgtgttctttcttttacctccttcactattttaactccccatccggcagaaatctcagctaagcacagccgccgtgccctgtttccgcatctaccaatatggctaggggtttgaagaagcatttgaagaggctcaatgccccaaaacattggatgttggataagcttggtggtgcttttgcccccaaaccatcatctggaccacataaatctagggagtgcttgcctttggtgctgatcatccgtaacaggctcaagtatgctcttacataccgtgaggttattgcgattctgatgcaacgtcatgtgcttgttgatggcaaggtcaggactgacaagacttatcctgctggcttcatggatgtggtttccatccccaagaccaatgagaatttccgtcttctctatgacaccaagggtcgattccgcttgcactctgttagagacgaggaagctaagtttaagctttgcaaagtccggtcgattcagtttggcaagaaaggcattccatacctcaatacctatgatggaaggaccattcgctacccagaccctctgatcaaggcaaacgacaccatcaaactggaccttgaggccaacaagattgttgatttcatcaagttcgatgttggtaatgttgtgatggtgactggtggtaggaataggggtcgtgttggagtgatcaagaaccgtgagaagcataagggtagctttgagacaattcacgtccaagatgcaactggacacgagtttgctactcgtttggggaatgtgttcacgattggaaaggggactaagccatgggtatctcttcccaagggtaaaggtatcaagttgtccattattgaggaggccaggaagaggctagctgctcaagctgccacagcttagaaacatgttttcaagttattttactatgaacttcatcaagcctaatttcagttttttgcagttgatgtaatgtcaatgtaggatccatacataaaagctttgataaagtatgatgagtttgaatatatttgctgcagtaatctac

SEQ ID NO: 4013 - DNA, 970 bp, Secale cereale
gcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgtcatatcatggttgatggaaaggtccgcactgacaagacctaccctgctggtttcatggacatcatttccattcccaagactggtgagaactacaggcttctgtatgacaccaagggccgcttccgccttcactctgtcaaggatgaggatgctaagttcaagctctgcaaggtcaggtctgtccagttcggccagaagggcatcccctaccttaacacctatgatggccgcaccatccgctaccctgacccactcatcaaggccaacgacactatcaagcttgacttggagaccaacaagattgttgacttcatcaagtttgatgtcggcaacgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgggatgccgctgcccaggctgctgccaaggcctgattctgatgcgttgagtcgttctgctcgtttttaagttttgttggatgtctgttgatttgcgaactcgtggttgctgctagatgtactgtggatgtttaccttattaagtgctatttcgagacctcatctggttatcttaaatgtttgagatccaagtttaggcattatctgataaaatgttatctgttcaaa

SEQ ID NO: 4014 - DNA, 934 bp, Antirrhinum majus
  misc_feature (628)..(628): n is a, c, g, or t
ccgcggcggaagagctagggtttgtgcgactgagagaagaaagagagtcaatctccggcatcaacaaacaatatggcgagaggtttgaagaagcatttgaagaggctcaatgcgccgaagcattggatgttggacaagctcggtggtgctttcgcccccaaaccatcatcgggaccccacaaatccagggagtgcttgcccttgatgcttattatccgaaacaggctgaaatatgctctaacttaccgtgaagttattgccattctcatgcaacgccatgtccttgttgatggcaaggttaggactgataagacatatcctgctgggttcatggatgttatttctatcccaaagaccaatgagagtttccgtctgctgtatgacaccaagggacgattccgtctgcactctcttagggatgaggaagccaagtttaagctttgcaaagtccgttcagttcaatttgggaagaaaggtattccttacattaatacctatgatggaaggacaatccgctacccagatcccttgatcaaggcaaatgacaccattaaactggacctggaagaaaacaaaattgtggactttatcaagtttgatgttggtaatgttgtgatggtgactggtngtaggaacaggggacgtgttggagtgatcaagaaccgtgaaaagcataagggaagctttgaaactatccatgtccaggattccactggccatgagtttgctactcgattgggcaatgtttttacaattggcaagggtacaaagccttggatttctcttccaaagggcaaaggtatcaagttgtctatcattgaggaggctaggaagaggcttgccgcccagtctgcagccacagcttagagacatttttaacttgcattatctatttaaattagttaagcgctggtctgtggatgtatgcttctac

SEQ ID NO: 4015 - DNA, 923 bp, Musa acuminata
gcctgtcggcttctcgtggtgttcagcggcgcttccgagttctctcgagaggcggcgaagcgaggcggccgagatccggaaaaatggccaggggattgaagaagcatctgaagaggctcaatgccccaaggcactggatgctagacaagcttggtggagcttttgctcccaaaccatcatctggccctcataaagccagggaatgcttgcccttgattcttattttaagaaacaagctgaaatatgctctaacataccgtgaagtcattgctatactgatgcaacgtcatgtgatggtggatggaaaagtcaggaccgacaagacatacccagctggtttcatggatgttgtttcaatccccaagacaaatgagaacttccgccttctttatgacaccaagggacgcttccgtcttcattcgataagggatgaagaatccaagttcaagctttgcaaggttcgctctgtccagtttggacagaagggcattccctacctgaacacttttgatggtcgtaccattcgctaccctgaccctcttatcaaggccaatgacaccatcaagcttgatttggagaccaacaagattgtggacttcatcaagtttgatgttggaaatgttgtcatggtgactggtgggagaaataccggtcgtgtcggtgtgattaagaacagagagaagcacaaggggagcttcgagaccatccatgtccaagatgccaccggccatgaatttgcaactcgcatgggcaacgtctttaccattggtaagggcacgaagccatgggtgtcacttcccaaaggcaagggtatcaagctcagcatcattgaggaagcaagaaagcgcttggctgctgccagtgcaactgccactgcttagacctgctctgcgaccaccggaatttttgttttatggtttgtt

SEQ ID NO: 4016 - DNA, 1947 bp, Ricinus communis
agcgtatttgcgtctcttccattagctcctcaaagcgcatcccagactcaagagtaggagacagatagtgcctagaaaatggcaagaggattgaagaaacacttgaagaggctcaatgccccaaagcattggatgcttgacaaactcggtggtgcattcgctcccaagccatcatcaggacctcacaagtcaagggaatgcttgcctttgatccttattttacgaaacaggctgaagtatgctctcacatatcgtgaagttattgccattttgatgcaacggcatgttctggttgatgcgaaggttaggacagataaaacgtatcctgcaggtttcatggatgttgtgtcaattccaaagacaaatgagaacttccgcctcctctatgacacgaagggccgttttcgtctccactccattagagatgatgaggcaaagttcaagctttgcaaagttcgttctgttcagtttgggcagaaagggatcccctacctgaacacctatgatggtcgcactatccgctacccagatccgcttatcaaggctaatgatactatcaaactagatctagagagcaacaagatcactgagttcatcaagtttgatgtgggaaatgttgtcatggttactggaggtagaaacaggggtcgagttggagtaatcaagaacagagagaagcacaagggaagctttgagaccatccacattcaggattcaactggtcacgagtttgctactcgcatgggcaatgtcttcacgataggaaaggggaccaaaccatgggtgtctcttcccaagggcaagggtatcaagttgtcaatcattgaagaggcccgaaagaggcttgcagcatcccaaactgctgcttaagaaaagaagctgaaaatttatcctcactggtgaacttactggttttgggctagtgttaattttgtttttttttttagttacagcttttgagcttatgccagatcgagtgttttatttttatcacctagcacaacttgaactgaatttgtttttgaatatcgtatttaagctgtgggggaaaacatagtttgaagatttacatcctaggtatagtccgaagatttacatcctaggatactaggatcccatggtaaactcttggtgctgaaatagtttagtacaaggttttttgggccatttttttgagttgcttcgaagtacgcaaaaggccaagacaacatgcggcatactgatttttctagtcgtctcaaaatatattacaaatcttgaatggaaatttctattcccagtgcattttttgtaacagctcgtctttctacgcccgcctggaaagttaaacaaagtgttcgaatttagtcagcttgttcagttttttccgtctccttagtgtagacataagagcaaaatcaaattctttcgattagttatacctgattattgttctctttttaggctgcatggtttatttttctttcgacttcaggacaatttcaattattcttttcgtttttgaccatcttttgtacaaatcagaaaatcaaattgagctagctttagctatgaaatgtcagtttcactatttttaattgtaaacatagtcttattctcaacagcagccgagaataaaatggagaaaaaggttgctgtaagatttcagttataagtttttttaaatccatgaaatttttgtacccctttttctcacacgtgaagaaacaagtggagtagcctaatcttgtattggggactaaagtacaagtgatattgctgtacagttaagaaatcatggaggaagacaaaaattgccaaaagtaaaagattgatggaaattgttaaaaaactcttttatttctcttttcttctaaagaacttttttactattagattctaagagtagtaattagaattagaatgaattattttaacattcccagttttgccatattatattagtag

SEQ ID NO: 4017 - DNA, 1040 bp, Vigna unguiculata
gtgttgagtttcttcagtttagtgtcgtagcagtggagcactggtttcgtttgcaattccaaaatggctaggggattgaagaaacatttgaagaggctcaatgctcctaagcattggatgcttgacaaactgggcggtgcatttgcacccaaaccctcatctggaccccacaagtcgagggagtgccttcccctcatactcatcctgcgaaaccggttgaagtatgctctgacataccgtgaggtcattgctattctgatgcaacgacatgttcttgttgatggcaaagtcaggacagacaagacatacccctctggtttcatggatgttgtatccatccccaaaacaaatgagaacttccgcctgctttatgacaccaaaggtcgcttccgtcttcattctatcagggatgatgaggcaaagtttaagctctgcaaggttaggtcagtgcaatttgggcagaaaggtattccatacctgaacacctatgatggtcgtaccatccgttacccagatcctctgatcagagccaatgacaccattaagctggatctggaggaaaacaagatcgttgattttatcaagtttgatgttgggaatgttgttatggttactggaggaagaaacagggggcgtgttggagttattaagaacagggagaagcataagggtagctttgagacaattcacgttcaggatgccactggacatgaatttgccactcgtttgggaaatgtgttcaccattggtaagggcacaaagccatgggtatcacttcccaagggtaagggtattaagctatccatcattgaggaagctagaaaaaggattgctgctcagcaagcaactgctgcttaaatattccccttctgaattaaaagactttttgagtgtttcttagtttaattcaatgtttttgattttaatttcttttgtccaagagattttaatcgttgaattttgactcttgctctatacaattttattgtggatgttatattcatggtgcaatcgtttcattccttagtaaaaaaaaaaaa

SEQ ID NO: 4018 - DNA, 1034 bp, Vigna unguiculata
tgcgtgttgagtttcttcagtttagtgtcgtagcagtggagcactggtttcgtttgcaattccaaaatggctaggggattgaagaaacatttgaagaggctcaatgctcctaagcattggatgcttgacaaactgggcggtgcatttgcacccaaaccctcatctggaccccacaagtcgagggagtgccttcccctcatactcatcctgcgaaaccggttgaagtatgctctgacataccgtgaggtcattgctattctgatgcaacgacatgttcttgttgatggcaaagtcaggacagacaagacatacccctctggtttcatggatgttgtatccatccccaaaacaaatgagaacttccgcctgctttatgacaccaaaggtcgcttccgtcttcattctatcagggatgatgaggcaaagtttaagctctgcaaggttaggtcagtgcaatttgggcagaaaggtattccatacctgaacacctatgatggtcgtaccatccgttacccagatcctctgatcagagccaatgacaccattaagctggatctggaggaaaacaagatcgttgattttatcaagtttgatgttgggaatgttgttatggttactggaggaagaaacagggggcgtgttggagttattaagaacagggagaagcataagggtagctttgagacaattcacgttcaggatgccactggacatgaatttgccactcgtttgggaaatgtgttcaccattggtaagggcacaaagccatgggtatcacttcccaagggtaagggtattaagctatccatcattgaggaagctagaaaaaggattgctgctcagcaagcaactgctgcttaaatattccccttctgaattaaaagactttttgagtgtttcttagtttaattcaatgtttttgattttaatttcttttgtccaagagattttaatcgttgaattttgactcttgctctatacaattttattgtggatgttatattcatggtgcaatcgtttcattccttaaaaaa

SEQ ID NO: 4019 - DNA, 1180 bp, Cucurbita pepo
ccccaaggagtttcagaggcggcagcaaactcactcggccttctacaaaggcgaccttccttgtttcgaaaccatggcaaggggattgaagaagcatttgaagaggctcaatgctcctaagcattggatgcttgacaaacttggtggtgcatttgcccccaaaccttcctctggacctcataaatcaagggaatgcctcccattgattcttatcctacgaaaccgattgaagtatgctctcacttatcgtgaggtgatttcaatcttaatgcaaagacatgttcttgttgatgggaaagtgagaactgataagacatacccagctgggtttatggatgttgtatcaattcccaaaacaaatgagaacttccggctcctctatgacaccaaaggtcgattccgtcttcactctgtgagggatgaggaggcaaagtacaaactctgcaaagtccgttctgtgcagttcgggcagaagggcattccatatcttaacacatatgatggtcgtaccattcggtaccctgatcctctcatcaaggccaatgacaccatcaagctcgaccttgagaccaacaagatcgctgatttcatcaagtttgatgtgggtaatgttgtgatggttactggtggaagaaatcgtggaagagttggagtaattaagaacagggagaagcataagggaagttttgagaccatccacgtccaggatgccaccggccacgaatttgccactcgtctttgcaatgtctttaccgtcggtaagggtactaagccatggctatccctacctaagggcaagggtattaagttatccatcatcgaagaggctaggaagaggcttgcaagccaggcggcagttacagcttaggagtctttaatgaaaaggttggaagaagacattgtttatggttattgattttagattgttctgacgagtctgttctttgaatttgtgtttcaaattttgttttagtaagttttcccaaccgctgtttcgttattttcattttaattttagcgtggctgctacaattagtcattctaaaagtttcatgttaatgtttgcaatctaaatgagagtttaaaaattaagtcaattgtcaaaatgtcaatgtaggaacatttgtcatgttctattttgttacgtgtatttaaatgataggaagttttcttggttgtt

SEQ ID NO: 4020 - DNA, 969 bp, Cucurbita pepo
aacaatctcttgttcgcctctgcagaagctctacctctttccaacttcgttttgaggatatggcaagaggattgaagaagcatttgaagaggctcaatgctccaaagcattggatgctcgacaaactcggtggtgcatttgcccccaaaccttcatctggacctcacaaatcaagggaatgtctcccacttattttgatattgcgtaacagattgaaatatgctctcacataccgtgaggtaatttcaattttgatgcaacgacatgttttagttgatgggaaggtgaggacagacaagacgtaccctgctgggttcatggatgttgtgtcgattcccaaaacaaatgagaatttccggcttctctacgacacaaaaggccgattccgtcttcactcagtcagggatgaagaggctaagtttaagctgtgcaaagtccgatcagtgcagtttgggcagaagggaattccttatctgaacacttacgatggacgaacaatccgatatcccgaccccctgatcaaggcaaacgacaccatcaagctagacctcgactcgaacaagattgctgatttcatcaagtttgatgtgggaaacgttgtgatggtgactggtggaagaaatagaggacgagttggagtaattaaaaacagggagaagcacaagggaagctttgagacaattcacattcaggatgctaccgggcatgaatttgcaactcggctgggcaatgtgtttacgattgggaaggggacaaagccatgggtgtcccttcccaagggcaagggtataaaactatccatcattgaagaagccaggaagaggcttgccaaccaagcagccgttacggtttaagagttgagtattgtagtcatgattctaagaccatttttgtttaatattttgtgttctaatatgatgataaattagatgttgagactacttctgttgcttctataattttttgatt

SEQ ID NO: 4021 - DNA, 1085 bp, Cucurbita pepo
ccattgttccaactcctttcttcgcgtctgcagaagctctagctcactccccgcagccgccagcggcaatctcacttccgtcgaacttcgttttgaaaatatggcaagagggttgaagaagcatttgaagaggctcaatgctcctaagcattggatgctcgacaaacttggtggtgcatttgcccccaaaccttcgtctggaccacataaatcaagggaatgtctcccattgatccttatcttgcgaaaccgattgaaatatgctctcacataccgtgaggtcattgcaatattgatgcaacggcatgtattggtcgatgggaaggttaggacagataagacctatcctgctggtttcatggatgttgtgtcgatccccaaaacaaatgagaatttccggctcctctatgacacaaaaggccgattccgtttgcactcaatcagggacgaggagtctaagtttaagctctgcaaagttcgctcagtgcaatttgggcagaagggaatcccttatctgaacacttacgacggacgtacaatccgttatcccgaccccttgatcaaggcaaacgacaccatcaagctggacctcgactcaaacaagatcgctgatttcatcaagttcgatgtcggaaatgttgtgatggtgaccggtggaagaaatcgtggacgagtcggagtgattaaaaacagggagaagcacaagggaagctttgagactattcacgttcaggatgcaactgggcacgaatttgccactaggctgtgcaatgtcttcaccatcgggaaggggacgaagccatgggtatcccttccgaagggcaagggtatcaaactatccatcattgaagaggccaggaagaggcttgccagccaaaccgcagccacggcttaagagtttgagtattgtagtagtagtcatgatttgaagacagtttttgtcaaaattttgcactcttcttagttattattatgagtaaaagagatcttaagactgtttaattctactagaaatgtgatgaacacactgcttctatgattttgttgttggaaagcaccgttataatatagactgaacccaaaag

SEQ ID NO: 4022 - DNA, 1250 bp, Eucalyptus grandis
tctctctctctctctcgagctctctcgacagcttcaccccgccggcggcctccggagctcctccgtcgtcgagctcaagctaatccgaagatggctcgagggttgaagaaacacttgaagaggctaaatgccccaaagcattggatgcttgacaagctaggaggcgcctttgcaccaaagccttcatctggaccccacaaatcaagggaatgtttgccattgatccttatcctgcgtaacaggctgaaatatgcccttacttatcgtgaggttatagccatcttgatgcagcgccatgttcttgttgataacaaagtgaggacggataagacatatcctgctggtttcatggatgttgtgtcaatccccaagacgaatgagaacttccgccttctctatgacacaaagggtagattccggcttcacagcattagggatgatgaggcaaagtttaagctatgcaaagtgcgatccatccagtttgggcagaagggcatcccttatctgaacacttatgatggtcgcacgatccgctatccagaccctctgatcaaggccaacgacaccatcaagcttgaccttgagaccaacaagatcaccgacttcatcaaattcgacgttgggaatgttgtcatggtgacgggtggaaggaacagagggcgtgttggtatcatcaagaacagggagaagcataagggtacttttgagaccatccacgtccaagattctcttggacatgagtttgctactcggttgggcaatgtcttcattatcggtaaaggatcaaaaccttggttgtctcttcccaagggcaagggtatcaagctgtctatcattgaggaggccaggaagaggctcgcagcccaagcatctgccaccgcttaaagatgttcatgataatttgtccatcgacagtatttttttgggcctattcgaggggaagcagtggacatggtggtagagaagaatgatttgctttccttttagaaatctccggactaatttaatttatgcaccacttatatttcgaactatgaaatttatagcactcaagacaaattaatccatcctcccaaattttcctactttggaattggaccagtcctttttgttcccttatgatttggtgtagaagtttgtgtaagctttatgccctatcaggatctgttacctaggtaatgcatgcattgttgagaattgttttgtgggaatgggtgaggcacttctgatgatttggaccaaaacaaaaa

SEQ ID NO: 4023 - DNA, 1198 bp, Euonymus alatus
tttttgcacagttccgtgttatcgtctttgcaaggtgtaggagaggggcagagccgccggtagctcgagaagaccaaaatggcaagaggactgaagaaacatatgaagaggcttaatgcccccaagcattggatgcttgacaaacttggtggagcatttgctcccaagccctcatctggaccccacaaatccagggagtgtttgcctttgatcctcatcttaaggaacaggttgaagtatgccctcacctaccgtgaggtcattgctattttgatgcaaaggcatgtgttggttgatgcaaaggttagaactgataagacctatccagctgggttcatggatgttgtatcaattcctaaaacaaatgagaacttccgtttgctctacgatactaagggtcgatttcgcctccactcaatcagagatgaggaagctaagttcaagctctgcaaggttcgttcggtgcaatttgggcagaagggaattccatatctcaacacttatgatggccgcaccatacgctacccagatccacttatcaaggccaatgacactatcaagctagactttgagacgaacaagattgctgattttatcaaatttgatgttggaaatgttgtcatggtgactggtggaaggaacagaggacgtgttggagtcattaagaacagggagaaacataaggggagctttgagactatccacatccaggatgctcaaggccatgaatttgctacccgtcttggtaacgtgttcaccattggcaagggtacaaagccatgggtgtctcttcccaagggcaagggtattaaattgtctattattgaggaggcaagaaagagacttgcagcccaacaggcaacaactgcttgattctctcagggctagaagatgtatgtctgatgggaactagttcagctgttaagacattcttgctagctcatgcttttatgacttttaagttttggtttcttgttgcagagctgcttccttgtcatttttgaggttgctttgttttctcaattttgattttgtaatagccaagataatatatcatactatttctggcttaatctgtgcaatgactttccaactgctttgtatgattttcattttattgatttggcagttcagtgtatggttctgtgtgtatgttgctggacaagtagaggacccatggaaatgtgttatatttcta

SEQ ID NO: 4024 - DNA, 1109 bp, Actinidia deliciosa
ggcacagcagctgaggcacagcggagactgatctctcttctgatcttgcgaatccaaaatggctagaggtctgaagaaacatttgaagaggctcaatgctccaagccactggatgctcgacaagcttggtggtgcatttgctcccaaaccatcatctggaccacataaatcaagagaatgcctgcccctgatgcttatcctacgaaacaggctaaagtatgctctcacataccgtgaagtcattgcaatcctaatgcagcgtcatattctcgttgatgggaaggttaggacagataagacctaccccactggtttcatggatgttgtatccattcccaagacaaatgagaatttccgactcctttacgacacgaaaggtcgattccgtctccattcccttagagatgaagaagccaagtttaagctatgcaaagttcgctcggtgcagtttgggcagaaaggcatcccatacctgaacacttacgatgggcgtaccattcgttaccctgacccacttatcaaggccaatgacaccatcaagcttgacctagagacgaacaagatcactgacttcatcaagtttgatgttggtaatgtcgtcatggtgactggaggaaggaacaggggccgtgttggagtgatcaagaacagagagaagcacaagggaagctttgaaaccattcacgtccaggatgcaactggtcacgagtttgctactcgcatgggtaacgtttttaccattggaaaaggtacaaagccgtgggtgtcactgcccaagggcaagggtatcaagttgaccattattgaggaggctaggaagcggcttgctgcccaagcaagtgcaactgcataaattcgtgaatcatgagtagttgcgtgtttttagctgatttaggattttgtgagaatttatgttttctttcccatttctcattactattatgttgaactgaatttggttatgactgttggggtttctgaaattgaatgctgttgctcaactgccgcctttcatgagttggtttattggatgattatgtttagaactaaggattgtacgggaggctttttggcaatatgattactcctaatctcatctaaaaaaaaaa

SEQ ID NO: 4025 - DNA, 1083 bp, Actinidia deliciosa
gacagcagccgaggcccagaggtgactgatatctcttctgagcttgcgaatccaaaatggctagaggtctgaagaaacatttgaagaggctcaatgccccaagccactggatgcttgacaagcttggtggtgcatttgctcccaaaccatcatccggaccacataaatcaagagaatgcctgcccttgatgcttatcttacgaaacaggctaaagtatgctctcacataccgtgaagtcattgcaatccaaatgcagcgtcatattctggttgatgggaaggttaggacagataagacctaccccactggtttcatggatgttgtatccattcccaagacaaacgagaatttccgactcctttacgacacgaaaggtcgatttcgtctccattccctaagagatgaagaggccaagtttaagctatgcaaagttcgctcggtgcagttcgggcagaaaggcatcccatacctgaacacttatgatgggcgtaccattcgttaccctgacccgcttatcaaggccaatgacaccatcaaatttgacctagagacgaacaagatcactgacttcatcaagtttgatgttggtaatgtcgtcatggtgactggaggaaggaacagaggccgtgttggagtgatcaagaacagagagaagcacaagggaagctttgaaaccattcacgtccaggatgcgaccggtcacgagtttgctactcgcatgggtaacgtttttaccattggaaaaggtacgaagccgtgggtgtcccttcctaagggcaagggcatcaagttgtccatcattgaggaggctaggaagcggctcgctgcccaagcaagtgcaactgcatgaatttgtgaatcgtgactagttgcatgttttaccagctgaagtaggattttgtgagagaatttatgttttctttcccagttcttagtactgttatgttgaactaaattttggtactgaaagctggtgtttccgaaatagaacagtgatgcttaactgccttctttcatgagttggtttattttcatatttgaaactaaagattctatgggaggcgtttttgccatatgattac

SEQ ID NO: 4026 - DNA, 991 bp, Actinidia deliciosa
cacagtttgaaggaaaagagcacagaggcacggcggcgtcgtgaagggaacacaatggctagaggtttgaagaagcatttgaagaggctcaatgccccgagtcactggatgcttgacaagcttggcggtgcatttgcacccaagccatcatctggaccccataaatcaagggaatgccttcctttgattcttatcttgcgaaacaggctgaaatatgctctcacataccgtgaagtcattgcaatcttgatgcaacgccatatccttgttgatgggaaggttaggacagacaagacctatccttctggtttcatggatgtcgtatctattcccaagacaaatgagaatttccgtctcctttatgatactaagggccgattccgactccattccatcagagatgaagaggccaagtttaagctttgcaaagttcgctccgtacaatttgggcagaaaggtatcccatacatcaacacttacgatggacgcactattcgttaccctgacccccttatcaaggccaatgacaccgttaaacttgacctagagtcgaacaagatcactgatttcatcaagtttgatgttggcaatgttgtcatggtgactggaggaaggaataggggccgtgttggagtcatcaagaacagagagaagcacaagggaagctttgaaaccattcacatccaggattctacaggtcacgagtttgctactcgcatgggcaatgttttcaccattggaaaaggttcaaagccgtgggtgtctcttcccaagggcaagggaatcaaattgtccatcattgaggaggctaggaagaggcttgctgcccaagcaggtgcagctgcataaatttatgacccagtagttggtgcagcatcatttaactgctgaatggttcatgatagagattgttatgttttgttcttttattccgtaatacaatgttgatctaaattttgttgttgcaagtttggtttggctgctacttgat

SEQ ID NO: 4027 - DNA, 1108 bp, Cucumis melo
attattaagttcaaactcgcggcggccggcgatcttctctcatctgctccgtggaacatcccgtttcgacaacatggcgaggggattgaagaaacacttgaagaggctgaatgctccgaagcattggatgctcgacaaactcggtggtgcatttgcccccaaaccttcatcaggacctcacaaatcaagagaatgtctcccattaatcctcatattgcgaaaccgattgaaatatgctctcacataccgtgaggttattgcaattttgatgcaacgccatgttttagttgatgccaaggtcaggactgataagacctatccagctggtttcatggatgttgtgtccattcccaaaacaagcgagaatttccggcttctctacgacacaaaaggtcgtttccgtcttcactcaatcagggatgaagaggctaagttcaagctttgtaaggtacgctcagtgcagtttgggcagaagggaataccttatctgaacacttacgatgggcgtacaatccgttaccctgatcctctaatcaaggcaaacgacaccatcaagttggaccttgagtcaaacaaaattgctgatttcattaagttcgacgtaggaaatgttgtgatggtgactggtggaagaaacagagggcgagtgggagtaattaagaacagagagaagcacaagggaagctttgagaccattcacattcaggatgcaactgggcatgaatttgccactcggcttggcaatgtgtttacaatcgggaaggggacaaagccatgggtgtccctccctaagggcaagggtatcaaactaaccatcattgaagaagccaggaagaggcttgctagccaagcagcagttaccgcttaagagttccgagttattactaaattgtagtcttgagttttttaatcatttttggtagacacatacctttctcgaatttgctctcctattatggctaagtttgtattttgagacaatttatttctaccagaattatcggtgaggtcgttgcttctttgattttgttttaaaaaacacttttggcgtattcgtagttgtgtaatgtgttgtgactctgctctatagcttcaatgatctaatcta

SEQ ID NO: 4028 - DNA, 1151 bp, Cucumis melo
ctcttaagctctacgtctctgcggccggcggcaatctcctctgccctctggaaccttctgtttcgacaacatggctagaggtttgaagaaacacttaaagaggcttaatgctcccaagcattggatgctcgacaaacttggtggtgcatttgctcccaaaccttcatcaggacctcataaatcaagagaatgtctcccattaatccttatattgcgaaaccggttgaaatatgctcttacataccgtgaggttattgcaattttgatgcaacgccatgttttagttgatgccaaggtcaggactgataagacctatccggctggcttcatggatgttgtgtccattcccaaaacaagcgagaatttccggcttctatacgacacaaaaggtcgtttccgtcttcactcaatcagggatgaagaggctaagttcaagctctgtaaggttcgctcagtgcaatttgggcagaagggaatcccttatcttaacacttatgatgggcgtacaattcgttaccccgaccccctcatcaaagcaaacgacaccatcaagttagaccttgagtcaaacaaaattgctgatttcatcaagttcgatgtaggaaatgttgtgatggtgacaggagggagaaacagagggcgagtgggagtaattaagaacagagagaagcacaagggaagctttgagacaattcacatacaggatgcaactgggcatgaatttgccactcgacttggcaatgtgtttacaattgggaaggggacgaagccatgggtgtccctccccaaggggaagggtatcaaactaaccatcattgaagaagccaggaagaggcttgctagccaagcagcagttactgcttaagagttttgagttaatactaaattgtagtcatgagtaatcctttttgatagacaaatatctttctcgaattttgctctcttattatttatggctaagtttgtcttgtgagacaatttatttgtgccatagattttgaggaggccatttgcttctgtgattttgctgttaaagagaaacgctgttagcttatttgttagttatgttgtgactctgctctatagcctcaattattatctatagtaaaattccttcgaagaacattagtatttactgtgctaaaaaaaaa

SEQ ID NO: 4029 - DNA, 1023 bp, Olea europaea
gaggggcagcacaaccggcggcataagcggcggaggcggcggcaagagtcagttcacagacaccaaactgtaacatggcgaggggattgaagaaacatttgaagaggctcaatgccccaaagcattggatgcttgacaagcttggtggagcatttgctcccaagccatcttcagggcctcataagtccagggagtgcctgccattgatccttattatgagaaacaggttgaagtatgcgctgacataccgagaagttattgccattttgatgcaacggcatgttttggtcgatggcaaggtcagaacagataagacttatcctgctggcttcatggatgttgtctcaatccctaaaacaaatgaaaacttccgtctgctctatgacaccaagggcagatttcgtctccactcagtcagggatgaagaggcaaagtttaagctttgcaaggtccgatctgtccaatttgggaagaagggaataccatacctcaatacttatgatgggagaaccatccgttatccagatcctcttataaaggccaatgatagcatcaagttggatttggagacaaacaagattgttgatttcattaaattcgatgttgggaatgttgttatggtgactggtggaagaaacagggggcgagttggagtcattaagaacagggaaaaacataagggtagctttgaaaccattcacgtccaggatgcacttggccacgagtttgcaactcgcctgggaaatgttttcacgattggtaaaggtacaaagccttgggtgtctctacccaaggggaaaggcatcaaattgtccatcatcgaagaggcaagaaagaggcttgctgcgcaatcagctacaactgtttaatggtgttcacctccaaggacaggtcctatcgaatctagttttggatgtacgttcttatttcattggatttcaattttcttttggctttacacattttaattgtttgacgagctttaatatttgaggaaccacttgagcttattttcagttatcc

SEQ ID NO: 4030 - DNA, 903 bp, Plantago ovata
ctcagctaagcacagccgccgtgccctgtttccgcatctaccaatatggctaggggtttgaagaagcatttgaagaggctcaatgccccaaaacattggatgttggataagcttggtggtgcttttgcccccaaaccatcatctggaccacataaatctagggagtgcttgcctttggtgctgatcatccgtaacaggctcaagtatgctcttacataccgtgaggttattgcgattctgatgcaacgtcatgtgcttgttgatggcaaggtcaggactgacaagacttatcctgctggcttcatggatgtggtttccatccccaagaccaatgagaatttccgtcttctctatgacaccaagggtcgattccgcttgcactctgttagagacgaggaagctaagtttaagctttgcaaagtccggtcgattcagtttggcaagaaaggcattccatacctcaatacctatgatggaaggaccattcgctacccagaccctctgatcaaggcaaacgacaccatcaaactggaccttgaggccaacaagattgttgatttcatcaagttcgatgttggtaatgttgtgatggtgactggtggtaggaataggggtcgtgttggagtgatcaagaaccgtgagaagcataagggtagctttgagacaattcacgtccaagatgcaactggacacgagtttgctactcgtttggggaatgtgttcacgattggaaaggggactaagccatgggtatctcttcccaagggtaaaggtatcaagttgtccattattgaggaggccaggaagaggctagctgctcaagctgccacagcttagaaacatgttttcaagttattttactatgaacttcatcaagcctaatttcagttttttgtcagttga

SEQ ID NO: 4031 - DNA, 1083 bp, Prunus persica
agagagagagagagagagcggcttcggacttgggacttaggagcagcgagggagggtcggcagccggcgtagttcacctgacaagatggcgcgaggattgaagaagcatctgaagaggctcaatgccccgaagcattggatgcttgacaaacttggtggtgcatttgctcccaagccttcgtctggacctcacaaatccagggaatgcctgccattggtcatcatcttaagaaaccgattgaaatatgctctaacataccgtgaggtcatttccattttgatgcaacgacatgttctggttgatgggaaagttaggactgataagacctatccttctggttttatggatgttgtttcaatccccaaaacaaacgagaacttccgtctcctctatgacaccaagggtcggttccgtctccattcaatcagggatgaagaggcaaagttcaagctttgcaaggtccggtctgtgcagtttggacaaaaaggtatcccatatattaacacctatgatgggagaacaatccgttacccagaccctctcatcaaggctaatgacaccattaagctggacttggagaccaacaagatcactgacttcatcaagttcgatgttggtaatgtcgtcatggtgactggtggaaggaatagaggccgtgttggagtaatcaagaacagggagaagcataagggaagctttgagacaatccatgtccaggatgccagtggacatgaattcgccactcggttgggcaatgtgttcacaataggcaaggggaccaagccgtgggtaagccttcccaagggtaagggtattaagctcaccattattgaagaggccaagaagaggcaagcagcccaagccacagccacagcttaaatggtcgtgggtgaaaaacaatctttgaacttattttggcgatgttcacttttattcttgtagtctttaccaattggaatttatgatgcaaattttgtcttgtttattttgtctatcgtttcacatcttgatacaaataatttagttgtttcaacccggactttaaattcatgttacttttaaagtaaacttttacttggcca

SEQ ID NO: 4032 - DNA, 1202 bp, Glycine max
ggggctccgtgaatatatattcaaatagaaccctcctagggttttagttttgggtctctctcattcttcacccgctcagacgcagaggagcagaagcctaagcctcaaacatggcgagagggttaaagaaacacctgaagaggctcaatgctccaaaacattggatgcttgacaagcttggtggtgcctttgcacccaagccatcatctggaccccacaagtcccgggagtgtcttcctctgatcctcatcctacgaaacaggctaaagtatgctctaacatatagagaagttattgccatcttgatgcagcgccatgttcttgttgatggcaaggttaggacagacaagacataccctgctggtttcatggatgttgtttctattcccaaaacaaatgaaaatttccgtctactgtatgacacaaaaggtcgattccgtctccactctgtaagggatgaagagtcaaagtttaagctctgcaaggttcgatctgttcaatttgggcaaaagggtatcccctatttaaacacatacgatgggcgcaccatccgctatcctgacccactaatcaaggccaatgacaccatcaagctggaccttgaaagcaacaagatcactgatttcatcaaatttgatgtggggaatgttgttatggtcactggtggaaggaacagaggccgtgtcggtgtcatcaagaacagagagaaacacaagggaagttttgagaccatccatgtccaggatgcaactggtcacgaatttgcaactcgtatgggtaatgtcttcatcattggcaaagggacaaaaccttgggtgtctcttcccaaaggcaagggtatcaagttgtctatcattgaggaggctagaaagaggcttgctgcacaaaatgaaacagttgcctaaatgattttgctggtaaaatttagctattttatctcttcggctgtctgagcataggatttttggtgaaatgactgagcatagttttgtatcaaactttatattacaattttgagctgttgatttcagtttttattaccttgtgattattaatattttggtgagatattgatctttttaggggggtaaaattacgtccttaatcttttactttagttgcaattttacctcctcagatattaaattcagtatattttctcatttatattcctacctaatatggaattttctttattcatc

SEQ ID NO: 4033 - DNA, 1145 bp, Glycine max
ggttttggttttgtgtctctctcattcttcacccgctcagcacgcagaggagcagaagcctaagccttcaacatggcgagagggttgaagaaacacttgaagaggctcaatgctccaaaacactggatgcttgacaagcttggtggggcctttgcaccgaagccatcatctggaccccacaagtccagggagtgtcttcctttgatcctcatcctacggaacaggctaaagtatgctctaacatatagagaagttattgccatcttgatgcagcgccatgttcttgttgatggcaaggttaggacagacaagacataccctgctggtttcatggatgttgtttctattcccaaaacaaacgaaaatttccgtctactgtatgacacaaaaggtcgattccgtctccactctgtaagggacgaagagtcaaagtttaagctctgcaaggttcgatctgttcaatttgggcaaaagggcatcccctatttgaacacatatgacggccgtaccatccgctatcctgacccactaatcaaggccaatgacaccatcaagctggaccttgaaagcaacaagatcactgatttcattaaattcgatgtggggaatgttgttatggtcacaggcggaaggaacagaggccgggtcggtgtcatcaagaacagagaaaagcacaagggaagctttgagaccatccatgtccaggatgcaactggtcatgagtttgcaactcgtatgggtaatgtcttcattattggcaaaggaacaaagccttgggtgtctcttcccaaaggcaagggtatcaagttgtctatcattgaggaggctagaaagaggcttgctgcacaaaaggaaactgttgcctaaatttgattaaatgaattggtggtaaagtttagctattttatctcttcggctgtctgagcataggatttttggtaaaatgactgagcatagttgtgtcaaacataatattacaattttgagctgttgatttcagttttcattaccttatgattattaatattatggtgacattgatttttttagggggtaaaaattactttacttccctaatcttttactttagttgcaatttgacctcttcatatattaaattcagtatattttctcatttatatttc

SEQ ID NO: 4034 - DNA, 1184 bp, Glycine max
gcagcaactcattctgtttcttcagtttggtataactttagccgaggtcaggaggagcactagctaagttcacaatttcaaaatggctaggggactaaagaagcatttgaaaaggctcaatgctcctaagcattggatgcttgacaaactgggtggtgcatttgcgcctaaaccctcatctggaccacacaaatcgagggagtgcctccccctcattcttattctgcgaaaccggctgaagtatgctctgacataccgtgaagtcattgctattctgatgcagcgccatgttcttgttgatggcaaagtcaggactgacaagacttaccctgctggtttcatggatgttgtttcaatcccaaaaacaaatgagaacttccgcctgctctatgacactaaaggccgattccgtcttcattccatcagggatgatgaggcaaagttcaagctctgcaaggttaggtcagtacagtttggccagaaaggtatcccatacctgaacacctatgatggtcgcaccatccgttacccagaccctctcatcagggccaatgacactgttaagctggatctggaggaaaacaagattgtcgattttatcaaatttgatgttgggaatgtagttatggtaacaggtggaagaaacagggggcgtgttggagtgatcaagaacagggagaagcataagggtagcttcgagacaattcacgtgcaggatgccactgggcatgaatttgctactcgtatgggcaatgtgttcactattggcaaggggacaaagccatggatatccctgcccaagggtaagggtattaagctatcaatcattgaagaagctaggaaaaggattgccgcccagcaagcaactactgcttaaaaaaccccccttttgaatgaatagacttgagtgcttggtagttttgttcaatgtttttgttttctaatttcttttgtctaagtttttaatcgttgaattttgactcttgcactatacaactttattgtggctgtgttatattcatggagtaatctttctattctcttggtcgtcatacaaaatcactgaatgaatttcacgatagcaaaatgccgcagctgtagtaagatggtattgcttgcaattgaagagaatatggatgtttatttgcgtgttttggtaaatgattcaatgcgcctcattgttt

SEQ ID NO: 4035 - DNA, 1232 bp, Glycine max
aaagattagggttttaaagtgacgcaacctctctctcttcttttcttcagttcggtggagggagggagccgtagcagcggaagctctagcttgggtagcgaatcacaatggcgagaggattaaagaagcatctgaagaggcttaatgccccaaagcattggatgcttgacaaactgggtggtgcatttgctcctaagccctcatctggaccacacaaatcgagggaatgcctgccactcatactcattttgcgaaaccggctgaagtatgctctaacataccgtgaagtcattgctattctgatgcagcgacatgtccttgttgatggcaaagtcaggactgacaaaacataccctgctggttttatggatgttgtatcaatccctaaaacaaatgagaacttccgcctgctgtatgacaccaaaggtcgattccgtctccactcagtcagggatgacgaggctaagttcaagctttgcaaagttcgctcagtgcagtttgggcaaaagggtatcccatacttaaatacctacgacggtcgcactatccgctacccagaccctctcatcagggctaatgacaccattaagctggatttggaggagaacaagattgttgatttcatcaaatttgatgttgggaatgtagtcatggtgacgggtggaaggaataggggtcgtgttggagtgatcaagaacagagagaagcataagggaagctttgagactatccatgttcaggatgctactgggcatgaatttgcaactcgaatgggcaatgtgttcaccattggcaagggaacaaaaccgtggatatctcttcccaagggtaaaggtattaagctatcaatcattgaggaagctaggaaaaggattgccgcccaacaagcaactgctgcttaaatctttaggatatgaatagactttgagtgcttggtagtttttattcaatgtttttggtttgtaatttaatttgtcttttgagattttatccgttgaattttgtctcttaaatgcactatagaacttttatcgcgtctgctatattcatgaaggaatctttccatttcctagttttgatgtagtttagttggataaaattacttaagtccccactctaaaatgtcttaataataactcttgttaagggaccgtgttggtattgaatgttatatgcgtactatcttgaatgattcaatgcaacttaagagttggtttttgccgttaccaata

SEQ ID NO: 4036 - DNA, 1237 bp, Tabernaemontana elegans
gacataaaaggctagggtttaaggagacgcagtttcactcctactacaagggaagcagcaggactcaccaccgccggcggcagcgactgttcaccacttttggcggcgattcgcattttcagttcgatatggcaagagggttgaagaaacatttgaagaggcttaatgcgcccaagcattggatgcttgacaagcttggaggagcatttgctcccaagccatcttctgggccacataaatcaagagagtgcttgccgttgatccttatcttgcgaaacaggctaaagtatgctctcacttaccgtgaagtcattgccattttgatgcaacgccatgttttggtggatggtaaagttaggacagacaagacttacccttctggcttcatggatgttgtttcaattccaaagacaaatgagaacttccggcttctttatgacaccaagggacgtttccgtctgcactcaataagggatgaggaggcaaagttcaagctttgcaaggttcgatctgtccagtttgggcagaagggtattccatacctaaacacttatgatgggagaaccatacgttatccagatcctctgatcaaggctaatgatactatcaagttggatttggagactaacaagattgtggactttattaaatttgatgttggaaatgttgtcatggtgactggtggaagaaacaggggacgtgttggggtcattaagaacagggagaagcataagggtagctttgagacaatccacatccaagatgctactgggcatgagtttgcgacccgcttgggcaatgtctttacaattggcaaaggtaccaagccctgggtatctctacccaagggaaaaggtattaaattgtccattattgaagaggcacataagagaaatgctatccaatcagctacaactgcctaatagctttagtctctcctcttgttattgttctgctattgtgtgggcaagtctagatggaatttggttttgcagtttaaacagtttttcttttcttggtgctgttattttgcgttgctagaagtgttccatacttgtgcttctgttcatgatgggggcttagagaattttgaatttgttgtcttggttgtaagaactgatagtaggttagtttattgacttctctttactggatcgaagggttgggattacactggcccttttacaccatttattttagcatcatgatatttcatgttttgctaaattctgaattg

SEQ ID NO: 4037 - DNA, 1193 bp, Tripterygium wilfordii
tgtcttatcgtctttgcaggtgtaggagcgtagcagacccgccggttggcgccgatagctcgagaagaccaaaatggctagaggactgaagaaacatatgaagaggcttaatgcccccaagcattggatgcttgacaaacttggcggagcatttgctcccaagccctcgtctggaccccacaaatccagggagtgtttgcctttgatccttatcttaaggaacagattgaagtatgcgctcacctaccgtgaggtcattgctattttgatgcaaaggcatgtgctggttgatgccaaggttagaactgataagacatatccagctggcttcatggatgttgtatcaattccaaaaacaaatgagaacttccgtctgctctatgataccaagggtcgatttcgcctccactcaatcagagatgaggaagctaagttcaagctctgcaaggttcgttcagtgcaatttgggcagaagggaattccatatctcaacacttacgacggccgcaccatacgctacccagatccacttatcaaggccaatgacaccatcaagctggactttgagacaaacaagattgctgattttatcaaatttgatgttggaaatgttgtcatggtgactggtggaaggaacagaggacgtgttggagtcattaagaacagggagaaacataaggggagctttgagactatccacatccaggatgctcaaggccatgaatttgctactcgtcttggtaatgtttttaccattggcaagggtacaaagccgtgggtgtctcttcccaagggcaagggtattaaattgtctattattgaggaggcaaggaagagacttgcagcccaacaggcaacaactgcttgattcgtgaaggcaccaggtctagaagatgtatttctgatgggaactcgttcagctgttgacattcttgctagtgcttttatgacttttaagttttggtttcttgtttcagagctctttcctggtcatgtttcagattgttttatcaactcaattttggtttggttttgtgatagctaagatatttcgtactatttctggcttaatttggcagtgctgttctaatattcggtcattctgtgtgtatttgctggacgattagaggacccttggaaatttgttttatatccacgcatgaacacaactgttgtttgcccaacagattcgg

SEQ ID NO: 4038 - DNA, 1085 bp, Tripterygium wilfordii
cgagaggaggagacccgctgcttggcgccgatagctacagacgaccaaaatggctagaggactgaagaaacatatgaagaggcttaatgcccccaagcactggatgcttgacaaacttggcggggcatttgctcccaagccctcatccggaccccacaaatccagggaatgcttgcctttgatccttatcttaaggaataggttgaagtatgcactcacctaccgtgaggtcattgctattttgatgcaaaggcatgtgctggttgatgctaaagttagaactgataagacatatccagctggcttcatggatgttgtatcaattccaaaaacaaatgagaacttccgtctgctttatgataccaagggtcgatttcgcctccactcaatcagagatgaggaagccaagttcaagctctgcaaggttcgatcagtgcaatttgggcaaaagggaattccatatctcaacacttacgatggccgcaccatacgctacccagatccacttatcaaggccaatgacaccatcaagctggactttgagacaaataagattgctgatttcatcaaattcgatgttggaaatgttgtcatggtgactggtggaaggaacagaggacgtgttggagtcattaagaacagggagaaacataagggaagctttgagactatccacatccaggatgctcaaggccatgaatttgctactcgtcttggtaatgtcttcaccattggcaagggtacaaagccatgggtgtctcttcccaagggcaagggtattaaattgtctattattgaggaagcaaggaagagacttgcagcccaacaggcaacaactgcttgatttgctaggcaccataggtctggaagatgtactctcatcagaacttggttcagccgttaagactttgttgctggcttatgctcaagagtttggtttcttgttgcatacatgtttcttggtaatttttgaggtggttttgtagacttaattttgttttgtgatgaactttgaaatattatactatttcaggcttaaatctccgcaaggacttgtttatctttgtctactggttaatgatttt

SEQ ID NO: 4039 - DNA, 1041 bp, Vinca minor
tcttgtacctcaagagcagcggacgccataaccatacgggagcagcggcgccggcgattcaaggtttcaggtcataatggcgagaggtttgaagaagcatctgaagaggctcaatgccccgaagcattggatgcttgacaagcttggaggagcatttgctcctaagccatcgtctgggccacacaaatcaagggagtgcttgcccttgatccttatcatgcggaacaagttgaagtatgctcttaactacagagaagtcgtttctatcctgatgcaacgacatgttatggttgatgggaaggtcaggaccgacaagacctatcctgctggctttatggatgttgtttccattcccaagacaaatgagaacttccgtctcctttatgacaccaagggtcgtttccgtctacattcactcagggatgaggaggccaagttcaagctttgcaaagtgcgatcaatccagttcgggcagaagggaattccatacctaaacacttatgatggaaggaccatccgctatcctgatcctctcattaaggccaacgataccatcaagttggatttggagactaacaagattgttgactttattaagtttgatgtgggaaatgttgtcatggttactggaggaagaaacaggggacgtgttggagtcataaagaacagagataagaataagggtagctttgagactatccacgtccaggatgccactggacatgagtttgctactcgtctaggaaatgtgtttacaattggaaaaggtaacaaaccatgggtctctctacccaaggggaaaggtattaaattgtccattatcgaggagcaaaagaagaggcttgctgctacccagtcggctgctactgcctagtgttttactttttaagatgctgttcttgcctttttcctgctatagattagatagtagttttcattggagttttttttcattggatttaacaaatgatacattgttgaacttccgttactgtacttttgcatttgaagtagctatgctcgcttgttcttattttttgg

SEQ ID NO: 4040 - DNA, 1302 bp, Musa acuminata
atgaaattgcagaaggttggtgacattcttttcaagttccaatctgtttttggtttcctgtcgacttctcgtggtgttcagcggcgcttccgagttctttcgagaggcggcgaagcgaggcggccgagatccggaaaaatggccaggggattgaagaagcatctgaagaggctcaatgccccaaggcactggatgctagacaagcttggtggagcttttgctcccaaaccatcatctggccctcataaagccagggaatgcttgcccttgattcttattttaagaaacaagctgaaatatgctctaacataccgtgaagtcattgctatactgatgcaacgccatgtgatggtggatggaaaagtcaggaccgacaagacttacccagctggtttcatggatgttgtttcaatccccaagacaaatgagaacttccgccttctttatgacaccaagggacgcttccgtcttcattcgataagggatgaagaatccaagttcaagctttgcaaggttcgctctgtacagtttggacagaagggcattccctacctgaacacttttgatggtcgtaccattcgctaccctgaccctcttatcaaggccaatgacaccatcaagcttgatttggagaccaacaagattgtggacttcatcaagtttgatgttggaaatattgtcatggtgactggtgggagaaataccggtcgtgtcggtgtgattaagaacagagagaagcacaaggggagcttcgagaccatccacgtccaagatgccaccggccatgaatttgcaactcgcatgggcaacgtctttaccattggtaagggcacgaagccatgggtgtcacttcccaaaggcaagggtatcaagctcagcatcatcgaggaagcaagaaagcgcttggctgctgccagtgcaactgccactgcttagactgctctgcgaccaccggaatttttgttttatggtttgttatttgctgtggaaagggatggtcatgacaactcgaatttggaccctttttcttttcttattacttgcatgccaatttccctttggatgattagtagaaaatgagatgtttgtcatgattgtagtttcatgagcagggttgttttaagtttcaccattttgccggtcaaactgttgaattcggatatctatttggttgagaactattactctttcattctctggtgtagaagattgaaattggattttgtgttacacgtatgaaaaatggtaaaaattaggaaaatttgaaatggctaagttttgggcaaatcaaggaaagtggca

SEQ ID NO: 4041 - DNA, 1018 bp, Tropaeolum majus
gactgttgttcactctttaagctttgaagagaagtcgcaggcgcagctctagggagagatctcttgagcacatacagaaatctgcaaaatggctaggggattgaagaagcatttgaagaggctcaatgctcccaagcattggatgttggataagcttggtggagcatttgcacccaagccatcatctgggccacacaagtccagggagtgcttaccgcttatccttatcttgcgtaacagattgaagtatgctcttacgtaccgtgaggttatagcaatcttgatgcagcgacatattcttgttgatggaaaggttaagacagacaagacatacccagctggtttcatggatgttatctccattcccaagaccaatgaaaatttccgtctcctctatgacactaagggtcggttccgtcttcactctgtcagggatgaagagtccaagtttaagctgtgcaaagttcgatctgttcagttcggacagaaaggtattccatacatcaacacatatgatggacgaaccattcgctacccagaccccctcatcaaagctaatgacaccataaaactggatctggaggccaataagattgttgacttcattaagtttgatgttgggaatgttgtcatggtgactggaggaagaaacagagggcgtgtaggagtcatcaagaacagggagaaacataagggcagttttgagaccattcacgtgcaagattctcttggtcatgagtttgcgactcggttgggcaatgtgtttacaattggcaaaggtaccaagccgtgggtgtctcttccaaagggtaagggaatcaagttgaccattatcgaggaggctaggaagaggttagctgcccaacaagctgcataatttatgctttaagatacttcctgcttaaatgttatgttggtgcttttcagttagttgtagcagattgatttggttttcatttagcaccatgagcacaattttttattagttgttatcattacattttcattaatattattg

SEQ ID NO: 4042 - DNA, 1183 bp, Tropaeolum majus
cggccgggggatctcttgcctttctccacaccaacagcctgaaattaaaagctgtataatcgcagctcgagggggtgatctcttgagctaatacacatatctgcaaaatggctcgtggtttgaagaaacatttgaagaggctcaatgccccaaagcattggatgttggataaacttggtggcgcatttgcacccaaaccatcatctggaccacacaagtccagggaatgcttgcccttgatccttatcctgcgaaatagactcaagtatgctcttacatatcgtgaggttatagccatcttgatgcaacgacatattcttgttgatggaaaagttaggacagacaagacatacccagctggtttcatggatgtaatgtcaattcccaagactaatgagaacttccgtcttctgtatgacactaaggggcgtttccgtctccactctatcagggatgaagaggcaaagtttaagctatgcaaagttcgctctgtccagtttggtcagaaaggcattccctacatcaatacctttgatggtcgaaccatccgttacccagatccacttatcaaggctaatgacaccatcaaactagaccttgaagccaacaagattgtagacttcattaaatttgatgttggtaatgttgtcatggttactggagggcgaaacagagggcgtgtcggagtaatcaagaaccgagagaaacataagggtagctttgaaactatccacgttcaagatgctcaaggacatgagtttgcaactcgcttgggcaatgtcttcacaattggcaaaggtaccaagccttgggtatctcttccaaagggcaagggtattaagttgacaatcattgaggaagctaggaagaggattgctgcccaacaagctgcataatgtcattctggctctccggacatattgctttgcttttttacaatggattaacattagcagagttacggttttgaattatcgggtacaatttttcatagcttatgtggtctcattttctgtattttttttgagtaattttgtattcttggtctcttacatggacttagccataattcaagcataaattctaattttttacaatttaaaacttacgatgttaggtttgcatatttgtttttatttaagcgctgttatttactagctgctttatcgtaaagggttcttag

SEQ ID NO: 4043 - DNA, 1133 bp, Elaeis guineensis
tacgcgggggccgaagcacgcgagtccatttcgagcgtttgaggagtcggaggggaaggccgccgcgatcaggaggagaaaatggctaggggattgaagaagcatctgaagaggctcaatgccccaaagcattggatgctagacaagcttggtggtgcctttgccccaaaaccatcttctggcccacacaaggctcgtgagtgtttaccattaatccttatcctaagaaatcggttgaaatatgctcttacttaccgtgaagtcattgcaattctgatgcaacggcacgtactggttgatggaaaggtcaggacagacaagacttatccagctggtttcatggatgttgtatcgatcccaaagacaaatgagaattttcggctcttgtatgacaccaaggggcgcttccgtctccactcaatcagagatgaggaggctaagttcaagctgtgcaaggtccgatctgttcagtttggacacaagggcattccttatctcaatacttatgatggtcggacaattcggtatccggatcctctaatcaaagcaaatgacaccattaagcttgatctggagacttacaagatcgtagatttcatcaagtttgatgtcggcaatgtagtcatggttactggtggaaggaacaggggacgtgttggcgttatcaagaacagggagaagcataagggcagttttgagactatccacctccaagatgcaaccggtcatgagtttgcaactcgccttggcaatgtcttcaccattggcaagggaacgaagccatgggtttctcttcctaaaggaaagggtatcaagctcagcatcattgaggaggctaggaagcggcttgctgcctctggtgccgctgccactgtctgatcgtattgcttatttcatattttgtctggggtagtcggagttctttgtggacatgtatgggggaggttgcaaatcctcttatctgattttgatgatgtcaactctttttaagtctagtttgctttggattatggatattagttctcttaaattttcatggacagctggatatttgtgttgcttttacataattggcttttgattacatctgcttatccaacagttttaatgacatcttagattatttttgtgtt

SEQ ID NO: 4044 - DNA, 1107 bp, Catharanthus roseus
tagtggatccaaagaattcggcacgaggcgagcagagcgacaccggcatcccaccacttggagcggcgattcaagcttccaattcaccagcatggcgagagggttgaagaaacatttgaagaggctcaatgccccaaagcactggatgctcgacaagcttggaggagcttttgctcccaagccatcttctgggccacacaaatcaagggagtgcttgcccttgatccttatcctgcgaaacaggctgaaatatgctctgacctacagagaggttattgctatcttgatgcaacgacatattatggttgatgggaaggtcaggactgacaagacttacccttctggctttatggatgttgtttcaattcccaagacaaatgagaacttccgtctcctctacgacaccaagggacgttttcgcctgcattcaatcagggatgaggaggcaaagttcaagctttgcaaagtgagatcagtccagtttgggcagaagggtattccatacatcaacacttatgatgggaggaccatccgctaccctgatcctctgatcaaagccaatgataccatcaagttggacttggagagcaacaagattgttgacttcatcaagtttgacgtgggtaatgtggtgatggttactggaggaagaaacaggggacgtgttggagtcattaagaacagggaaaagcataagggtagctttgagaccatccacatccaagatgcaaccggccatgaatttgccacccgtctgggaaatgtgtttaccattggcaaaggcaccaaaccctgggtctctctacccaagggtaaaggtattaaattgtccattattgaggagcaaaggaagagagctacacaatctgctgctactgcttaatgcttttcttgtctgagatgctgttttttgtctttctccttctcgaagtttagattgtagttttgctaagaggagagttttgttgaagatattgatataagggttaatttcaaaatactcccaagttttagagcttttgttagtcttgagtaccttatcttttatcttttggttttgacaattgaatacttaattgacgatttcatctattttccgtaaatgtc

SEQ ID NO: 4045 - DNA, 890 bp, Papaver somniferum
agctccagaggcggaagactaaggcggagagattctcaggcgaacaactccaactccaacatggcgagaggattgaagaagcatttgaagcggctcaatgcccccaagcattggatgctcgacaaacttggtggtgcatttgctcccaagccatcatctggaccccacaaatccagagagtgccttccattgatccttatcctgcgaaataggctgaagtatgctcttacatatcgtgaggtcattgccattttgatgcaacgacatgttctggttgatgggaaggtgcggacagataagacctatccatcaggcttcatggatgttgtgtccattccaaaaacaaatgagaacttccgtctcctctacgacaccaagggccgtttctgtctccactcaattaaggatgaagaggctaagttcaagctctgcaaggtccgtaatgtgcagtttggtcaaaagggtatcccctacatcaacacctatgatggacgcactatccgctacccagacccacttatcaaggcaaacgacactatcaagcttgacctcgagagcaacaagatcaccgacttcatcaagtttgatgtcggaaacgtcgtcatggtgactggtggaaggaacaggggacgtgttggagttatcaagaacagggagaagcataagggaagttttgagaccatccatatccaagactccactggtcatgagtttgctactcgtttgggtaatgtgttcaccatcggtaagggcactaagccatgggtttcactccccaagggcaagggtatcaagttgtcaatcattgaagaggccaggaagcgccttgctgctcaaggagctgcgacagcttagtttcattgaaggcaatgaggtcatatcgttaatgc

SEQ ID NO: 4046 - DNA, 1067 bp, Rosa hybrid cultivar
tttcttccctctgcctcttcgctcggctcacctctcctaatctagggtttctccatcttcctctgcaaacatggcgagaggtttgaagaagcatctgaagaggctcaatgccccaaagcattggatgctcgacaagcttggtggtgcttttgctcccaaaccatcatctgggccacacaaatcgagggagtgccttcccctgatcatcattctgaggaacaggttgaagtatgctctcacataccgtgaggtgattgctattctcatgcaacgtcatgttttggttgatggaaaggtcaggactgataagacctaccctgctggcttcatggatgttgtttccatcccaaaaaccaatgagaacttccgtctgctctacgacaccaagggtcgtttccgtctccattcaatcagggatgaggaggcaaagttcaagctctgcaaggttcgctcagtgcagtttgggcagaagaacatcccctatattaacacttatgatgggagaactattcgctacccagacccacttattaaggccaatgatactatcaagctggacttagagaccaacaagattattgacttcattaagtttgatgttgggaatgttgtcatggtgactggtggaaggaataggggacgtgttggagtcatcaagaacagggaaaagcataagggaagctttgagaccatccacgttcaggatgccgcaggtcatgagtttgccacccgtcttggcaatgtgttcaccattggcaagggtacaaagccttgggtgtcacttcccaagggcaagggtatcaagctctccatcattgaggaggcaaggaagcgacaagcagcactccaaactgctactgcttaaacaatatggtggcaactatagattgttgttcctatattttagacagtacttagtttgaatcagttgagaagttggtctgttgtcagcctatgctcagaatttcattttgattttgctgtcctgctttatggattactttttaagttggaatactgacttggattttattatgttttgtgcttgaacgggacgtgtattgaat

SEQ ID NO: 4047 - DNA, 1108 bp, Malus domestica
tttgtaacttccacagatcacagagagcgagcggcttcggactttggactcgggagcagtgaaggagaggcggcggaggtcggcggagttcacctgaaatcaagcttacaacatggctcgtggtttgaagaaacatttgaagaggctcaatgctcctaagcattggatgctcgacaaactcggtggtgcatttgctcccaagccttcgtctggacctcacaaatccagggaatgcctgccattggttatcatattgcgtaatcggttgaagtatgctctgacataccgtgaggtcatttccattctaatgcaacgacatgttctcgttgatgggaaagtgaggaccgataagacatatccttctggtttcatggatgttgtttcaatccccaagacaaatgagaacttccgtcttctttatgacaccaagggtcggttccgtctccattcaatcagggatgaagaagcaaagttcaagctctgtaaagtccgatctgtgcagtttggacagaagggcattccatacataaacacctacgatggccgtacaatccgttacccagaccctctcatcaaggcaaatgacaccattaagctggacttggagaccaacaagatcactgacttcatcaagtttgatgttggcaatgtggtcatggtgactggaggaaggaacaggggccgtgttggagtaatcaagaacagggagaagcataagggcagcttcgagacaatccatgtccaggatgccagtggtcatgagtttgcaactcggttgggcaatgtgttcacaattggcaaggggactaagccatggataagccttcccaagggtaagggtattaagcttaccattattgaagaggccaagaagagagcggcagcacaagccacagccacggcttaaattgtcgcgttgaaaacaagctttaaaattatttgacgattttcacctatgtttttgtagtggatacctatttactttggatgttatgctgcaaattttgtcttgtttatttctttcaccctttcacatcttgatacaaataactttagttgttgcaccggctttatgcttatgttattttgaagtaattttgcttggtca

SEQ ID NO: 4048 - DNA, 1281 bp, Aristolochia fimbriata
acggttcgagtttatatagtactgaggctaggttttgatgtttttgatagagcggagggagtgcgtcgtcggcctgcgtgggaaggcggaaggttgagagctgatcacagaaaatggctagagggttgaagaagcatttgaagcggctcaatgcccccaagcattggatgcttgacaagcttggaggtgcatttgctcctaagccatcttctggaccacacaaatcaagagagtgtcttcccctgatacttattcttaggaataagttgaagtatgctctcacctaccgtgaagtcatttccattatgatgcaacgtcatgttttggtggatggaaaggttaggacagacaagacataccctgcaggttttatggatgtggtgtctattccaaaaacaaatgagaacttccgtctcctctatgatacaaagggtagattccgcctgcataccatcaaagatgaggaagctaagttcaagctctgcaaagttagaaatgtacaatttggccagaagggtattccttacctgaacacttatgatggacgcaccatccgttacccagatcctcttatccgagccaatgacactatcaagctagacctggaagcaaacaaaattgtcgacttcatcaagttcgatgttggtaatgtggttatggtgactggtggcagaaacagaggaagggttggtgttattaagagcagagaaaagcacaagggcagctttgagactattcacgttgaggatgctacaggccatgcttttgctactcgattgggtaatgtgttcaccattggaaaggggacaaagccatgggtttcccttcccaaaggtaagggtatcaagctttctattattgaagaggcaaggaaacgtcttgctgcccaagcagccactgcctaaggacgaggaagagtaattttggagatggagcagtagattttctggtcgttggttttctgtttgtcttttatttcagtatggataacttgatgaacatcgacttagtgctcttttttgcccctggagaatgtgctgagacctgatctgtccttcacaagcttattataaacattagatttgcacttagtatacatcgtttttagaaaaatatacttgttttgtgtggaaatctattcaatcttagttgtttgtgagcaaaggtcttgaaacacaggagagcagattacttgctgcatgtagtgataattaagcgtacatggatcaggaaagtaatgaaagacatgcaaagctatttttcagtaacgggtggatatgt

SEQ ID NO: 4049 - DNA, 1133 bp, Catharanthus roseus
gcgacaccggcatcccaccacttggagcggcgattcaagcttccaattcaccagcatggcgagagggttgaagaaacatttgaagaggctcaatgccccaaagcactggatgctcgacaagcttggaggagcttttgctcccaagccatcttctgggccacacaaatcaagggagtgcttgcccttgatccttatcctgcgaaacaggctgaaatatgctctgacctacagagaggttattgctatcttgatgcaacgacatattatggttgatgggaaggtcaggactgacaagacttacccttctggctttatggatgttgtttcaattcccaagacaaatgagaacttccgtctcctctacgacaccaagggacgttttcgcctgcattcaatcagggatgaggaggcaaagttcaagctttgcaaagtgagatcagtccagtttgggcagaagggtattccatacatcaacacttatgatgggaggaccatccgctaccctgatcctctgatcaaagccaatgataccatcaagttggacttggagagcaacaagattgttgacttcatcaagtttgacgtgggtaatgtggtgatggttactggaggaagaaacaggggacgtgttggagtcattaagaacagggaaaagcataagggtagctttgagaccatccacatccaagatgcaaccggccatgaatttgccacccgtctgggaaatgtgtttaccattggcaaaggcaccaaaccctgggtctctctacccaagggtaaaggtattaaattgtccattattgaggagcaaaggaagagagctacacaatctgctgctactgcttaatgcttttcttgtctgagatgctgttttttgtctttctccttctcgaagtttagattgtagttttgctaagaggagagttttgttgaagatattgatataagggttaatttcaaaatactcccaagttttagagcttttgttagtcttgagtaccttatcttttatcttttggttttgacaattgaatacttaattgacgatttcatctattttccgtaaatgtcattaaatgtcttaaatacattgtctttactatttttatggaatgatatatattattttttca

SEQ ID NO: 4050 - DNA, 1106 bp, Catharanthus roseus
gagcacatataagcgccgaaggtttgagggtttcgttggtagtgcagggagcagcagaggagcgcaggcaaccggcatcccaccagcaagagcggcgattctagctgtcagttcaccaccatggctagagggttgaagaaacatttaaagaggcttaatgccccaaagcactggatgcttgacaagcttggaggagcatttgctcccaagccatcttctgggccccataaatcaagggagtgcttgcccttgatccttattctgcgaaacaggctaaaatatgctcttacctacagagaggttattgccatcttgatgcaacgtcatgttatggttgatggaaaagtcaggactgacaagacttacccttctggctttatggatgttgtttcaattcccaagacaaacgagaacttccgtctcctctacgacaccaagggtcgtttccgcctccattcaattagggacgaggaggcaaagttcaagctttgcaaagtgagatcagtccaatttgggcagaagggaattccatacataaacacttatgatgggaggaccatccgctaccctgatcctcttatcaaggccaatgacaccatcaagttggacttggagagtaacaagattgtggatttcattaaatttgacgtggggaatgtagtcatggtgactggcggaagaaacaggggccgtgttggagtcattaagaacagggagaagcataaaggtagctttgaaacaatccacatccaggatgccactgggcatgaatttgctactcgcttaggtaatgtgtttactattggaaaaggtaccaaaccctgggtctctctgcctaagggcaaaggtattaaattgtccattattgaggagcaacggaagagagctacacaatcagctcctactgcttaaagcttctctttgcagagatgctgtccttgtctctctccgtctaagttaagatggtaattgtgctggaggaatcttttgttttaattattgatataatgttgaacttcccatggtactgtaattttgctatgcttatttttggataagtggattagacaaattttggggattactttatgatttgattactgccc

SEQ ID NO: 4051 - DNA, 1037 bp, Chelidonium majus
gaagacgcagcagcgctggccttagctccgtccaggcgaaacaactcacaaaatggcgagaggtttgaaaaagcatttgaagaggctcaatgccccaaagcattggatgctcgacaaactgggtggtgcctttgctcccaagccctcatctggaccacacaaatctagggagtgcttgcccctgattcttattctgcgtaatagattgaagtatgctctcacataccgtgaggtcattgctattttgatgcaacggcatgttcttgttgatgggaaggtcaggacagacaagacctatccttcaggattcatggatgttgtttcaattcccaagacaaatgagaacttccgtctcctgtatgacaccaaaggtcgcttcagactccactcaatcaaggacgaggaggctaagttcaagctttgcaaagtccgcaacgtgcagtttggtcagaaaggtattccatacattaacacatacgatggtcgcacaatccgctaccctgatcctcttatcaaggctaacgacaccatcaagcttgaccttgagagcaataagatcactgacttcatcaagttcgatgtcggtaatgttgtcatggtaactggaggaaggaacagaggtcgtgttggagtcatcaagaacagagagaagcataagggcagtttcgagacaatccacatccaagattcaactggccatgagtttgctactcgtttgggtaatgtgtttaccattggcaagggtaccaagccatgggtgtccctacccaagggcaagggtatcaagctctccatcattgaagaggcaagaaagcgacttgcagcacaaggtgctaccaccgcttaacttttattatgaaaagactttaataggtttcagaaatagtttattaaaggagttctcgaattatttttgtttattttggcagttctctaatgttagcttgagatatgttttgtttttatttcctggtactatcagaacaaagttttgtacctgcaaaattgggtttagagtttgtttttatgatcttgta

SEQ ID NO: 4052 - DNA, 1054 bp, Cucurbita pepo
cccccacagacgccggcggcgaccccagtttagcttcttcgagcttcacttcgacaatatggcaaggggattgaagaagcatttgaagaggcttaacgccccaaagcattggatgcttgacaaacttggtggtgcatttgctcccaaaccttcatctggacctcataagtcgagggaatgccttccgttgatccttattttgaggaaccgattgaaatatgctctcacataccgtgaggtaatttcaattttaatgcaacgacatgtcttggtcgatgggaaggtcaggacagacaagactttccctgctggtttcatggatgttgtgtcaattcctaagacaaacgagaatttccggcttctttatgacacaaagggacgattccgccttcactcagtcagagatgaggaggctaagtttaagctgtgcaaagttcgctcagtgcagttcggacaaaagggcatcccatacctgaacacttacgatggacgtacaatccgttatcccgaccctctaatcaaggcgaacgacaccatcaagctggacctcgactccaacaagatagccgatttcatcaagttcgacgtaggaaatgttgtgatggtgactggtggaagaaacaggggcagagttggagtgataaagaacagggagaagcacaagggaagctttgaaacgatccacgttcaggatgcgaccgggcacgagtttgcaacccggctgtgcaatgtgttcacagttggtaaggggacaaagccatgggtgtctctacccaaggggaagggtatcaaactatccatcatcgaagaagccaggaagagggtggcaagccaagctgcagttaccgcttaggaggtaggtagtgtagtgtagtgtagtgtagtgtagtgtagtgtagtgtagtgtagtgtgtagccatatgatgctgaaacgtgggtttgcctcttgttattgggctttagttgatagatgtcctcccaaagggctcatactttgttgtttctactggaattgtgtgaggctactagtagccattccaaactctttgctaca

SEQ ID NO: 4053 - DNA, 1111 bp, Euonymus alatus
gctgccttttcgcaagcttgtgcgttttatctttgcaggtgtgggagaagcagacccgccgcttggcgctgaaagctcgagaagacaaaaatggcaagaggactgaagaaacatatgaagaggcttaatgcccccaagcattggatgcttgataaacttggcggggcatttgctcccaagccctcatctggacctcacaaatccagggagtgcttgcctttgatccttatcctaaggaataggttgaagtatgcgcttacataccgcgaggtcattgctattctgatgcaaaggcatgtgctggttgatgcaaaggttagaactgataagacatatccagctggcttcatggatgttgtatcaattccaaaaacaaatgagaacttccgtctgctctatgataccaagggtcgatttcgtctccactcaatcagggatgaggaagctatgttcaagctctgcaaggttcgttcagtgcaatttgggcagaagggaattccatatctcaacacttacgatggccgcaccatacgctacccagacccacttatcaaggccaatgacaccatcaagctggactttgagacaaacaagattgttgattttatcaaatttgatgttggaaacgttgtcatggtgactggtggaaggaacagaggacgtgttggagtgattaagaatagggagaaacataaggggagctttgagactatccacatccaggatgctcaaggccatgaatttgccactcgtcttggtaatgttttcaccattggcaagggtacaaagccatgggtgtctcttcccaagggcaagggtattaaattgtctattatcgaggaggcaaggaagagacttgcagcccaacaggcaacaactgcttgatttgcgaaggcagcaggtctagaagatgtatttctgatgggaagacattcttgcgagagctcatgcttttatggtttcttgttacatagttgttgtttcctggtcatttttttaggttgccttgtcaactcgattttggttttgtgatagctaagatatatcatactatttcaggcttaatttctgcaatggctgctatattactgtcgccaacagtttctatgat

SEQ ID NO: 4054 - DNA, 962 bp, Euphorbia peplus
cggtggaggtagctaggtttttggaggagctcgcacttctacagtctgctgaaacgcctcattcataatggctagaggcttgaagaaacacttgaagaggctcaatgcgccgaagcattggatgcttgacaaacttggtggcgcttttgctccaaaaccatcatctggacctcacaagtctcgtgagtgcttgccattgatcctaattcttcgcaacaggttgaagtatgctctcacatatagggaagtgattgctattctgatgcagcgacatattcttgttgatgggaaggttaggactgataaaacatatccagctggtttcatggatgttgtgtcaattcccaagacaaatgagaacttccgtctcctttatgacaccaaaggccggtttcgtctacactccatcagagatgatgaggcaaagtttaagctatgcaaagtccgttctgttcaatttggccagaagggcatcccttacttgaatacatatgatggtcggacaatccgctacccagatcccctcatcaaagcaaatgacaccatcaagctcgacttggagagcaacaagattactgaattcatcaaatttgatgtggggaatgttgttatggtcaccggaggcaggaacagaggaagagttggagtgattaagaatagagaaaagcataagggaagcttcgagactattcacatccaagatgcgactggccacgagtttgccactcgtttgggcaatgtcttcaccatcgggaaagggacgaagccgtgggtatctcttcccaagggcaagggtattaagttatccatcatcgaagaggctagaaagaggcaagctgcagctcaaacagctgcctaaaagttgtttgaattttttagttgttgaagttttattgaacatctgatgagagatagtgtggtttattttccttcatggccacagttttgaactatatcctaat

SEQ ID NO: 4055 - DNA, 1211 bp, Setaria italica
gggcaataaagctctcctcccgatcccgcgccgtcgcattccctagggtttatcaccgtctcacaccccccccccgcagccagctcgccgccgccgcccgctcgagcgcggaagaaccctaggcgccgagcaagatggcaaggggtttgaagaaacatctgaagaggctcaatgctcctaagcattggatgcttgacaagcttggtggagcatttgcacccaagccttcatctggtccccacaaagccagggagtgcttgcctttgatccttatcctcaggaacaggttgaagtatgccttaacctaccgtgaagttatttcaatcttgatgcagcgtcaggttatggttgatggcaaggtcaggaccgacaagacatatccatctggattcatggatgttgtatcgattcctaagactggagagaatttccgccttctctatgacactaagggacgcttccgtctccacagtatcagggatgatgaggctaagttcaagctttgcaaggtgcggtctgtgcagtttgggcagaagggcatccctttcctgaacacctatgatggacgcacaatccgctacccagaccctctcatcaaggccaatgacaccattaagatcgacctggacaccaacaagattgttgacttcatcaagtttgatgttgggaatgtcgtgatggtgactggtggaaggaacactgggcgtgttggggtgatcaagagcagggagaagcacaagggcagctttgagaccatccacgtcgaggattcactcggccaccagtttgccacccgcatgggcaacgtgttcaccatcggcaaggacaagaagccgtgggtgtctcttcccaagggcaagggtatcaagctcagtattatcgaggaggcgcggaagcgcaatgctgaggctgctgaggcttgatttcttacattttaggctacagattgctgctgctgaggcttgatttcttacattttaggctacagaaaaccattgctgtaagcattctatcaaaagatgtagacgtgcctgctggacgcatgcattgccatggggctgttctgaacagtgaagtcatgtgctattttgaaccttcaagtagttgatacgcaattattttttggtgcttgtttttatcatttgatttcgttttaagcgttctatgaaaagataaagatggttctgctggacacaagcattctataaaat

SEQ ID NO: 4056 - DNA, 1163 bp, Panax ginseng
aaaattgggtgtgtttttatacgcgcaagtctcgcgccattgtgttggtaccccgggaaattcggccattacggccggggggaagcaaggagtttgcggcacagagagagagggagggagacgcagcttatcgaacaaagaaaccatggctagaggtttgaagaagcatttgaagaggctcaatgcccctaagcattggatgctcgataaacttggtggtgcatttgctcccaagccttcatctggaccccataaatccagggaatgcctgcctttgattcttattttgcgaaacaggctgaagtatgctctaacttaccgtgaagtccaatccatcttgatgcaacgacatgttcttgttgatgggaaggttaggacggataagacctatccagctggtttcatggatgttgtatcaattcccaagactaatgagaatttccgtctcctctatgacacaaagggtagattccgcctacactcggtcagggatgaggaggcaaagtttaagttgtgcaaagttaggtcagttcagttcggtcagaaaggcattccgtacatcaatacctatgatgggcgtactatccgttatccagacccgctcattaaggccaatgacaccatcaaacttgacttggaggcaaacaagatagctgatttcattaagttcgatgttggaaatgttgtcatggtgactggggggaggaatactgggcgagttggagttatcaagaacagggagaaacataaggggagcttcgagactgttcacattcaggattcccttggtcacgagtttgctactcgtctaggcaatgtttttaccatcggaaaaggtacaaagccatgggtgtctcttcccaagggcaagggtatcaaattaaccatcattgaggaggccaggaagaggaatgttgcccagtctgctacaactgcataaacaaaaaatttatgcatgtgttgctgttaaaagttttatcttctggtcttgcttgcaggttggtgctgtggtctagctaacttaggatttatgcttaaaattatgtgttgttttcatttcagacaattttgaaagatattttgttgttgcaaatttgattaaaactcttctgctggctgattttggcaacaaatagacaacttaatcaagtctacaatctttt

SEQ ID NO: 4057 - DNA, 1344 bp, Vitis vinifera
atgggctcaacccgcccacaatgtagtccgggttcaggatatatatttataggtgaactagggtttatagtggctgacgctgtttcaacccaagttcattctcgtggagtagcggccgtcgacaccgccggcggtagtctagggattcaagactgtcaacatggcacgagggttaaagaaacatttgaagaggcttaatgccccaaagcattggatgcttgacaaacttgggggtgcatttgctcccaagccatcttctggacctcataagtcaagggagtgcttgcccttgatccttatcctgaggaacaggttgaagtatgctctcacatatcgtgaggtcattgccattttgatgcaacgtcatgttttggttgatgggaaggtcaggaccgataagacatatccctcaggcttcatggatgttgtgtcaattcctaaaacaaatgagaacttccgtctgctttacgacaccaagggccggtttcgtctccactcaattagggatgaagaggctaagtttaagctctgcaaggtgaggtctgtgcagtttggacagaagggaatcccatatctcaacacttatgatgggcgaaccatccgctaccctgatcctctgattaaggccaacgacactatcaagctcgatttggagagcaacaagatcacagatttcataaagtttgatgttgggaatgttgtcatggtgacgggtggaaggaacagaggacgtgtcggagtcattaagaacagggagaagcgtaagggcagctttgagaccatccatgtccaggatgccactgggcatgagtttgcaacacgtttgggaaatgtgttcatcattggcaaaggtacaaagccctgggtgactcttcccaagggcaagggtatcaagctgtccattattgaggaggcccagaagagactcgcagcccaagcagcttccagtgcctaatagcatggggtcaattttcttggtatgtcctccaggcatagtttttatacaagttcagtagatgtgactttgattttgcagtttaatctctcttattagcctttatgcttaaagattcatgttttgatttctggtgtttctttaccattactgagttgcaaactgtatgctgtgggctggaatttggatagactagatcgttttgattagctaaaatctgtcctgtattttgttttgtgatgttggaccttttttttgttctcataaggaatatctaccttgcatttgcagcttttatcattttaatgactaatgttgcttgtttttcaaagctagggtattgaacctttttgtcatggttccatccatttagctttgacatcatttcc

SEQ ID NO: 4058 - DNA, 1111 bp, Liriodendron tulipifera
gcgttgagcaaacgagagagtggagaggctctttcccgaaggcggagatttccagtccagagaagtaacaaaatggctagaggactgaagaaacacttgaagaggctcaatgccccaaagcattggatgcttgacaaacttggtggtgcatttgcccccaagccatcatctggccctcacaaagccagggaatgtttgcctctaattctcatcttacgaaacaaattgaaatatgcacttacgtaccgtgaggtcatatcaattttgatgcaaaggcatgttttggttgatggaaaggttagaactgacaagacgtatccagctggtttcatggatgttgtctctattcccaaaacaaatgagaacttccgactgctctatgacaccaagggccgcttccgtctgcacacaatcaaggacgaagaggcaaagttcaagctttgcaaggtccggtctgtgcaatttggacagaagggcattccctatctgaacacctacgacgggcggaccatccgctacccagacccactcatcagggccaatgacaccatcaagcttgaccttgagacatacaagatcgtcgactttatcaagtttgatgtcgggaacgttgtcatggtgacaggtggcaggaataggggacgtgttggcgtgatcaagaacagggagaagcataagggcacctttgagaccatccacgttcaggatgccaccggtcacgagtttgcgacccgtctgggtaacgtgttcaccatcggcaaggggacaaagccgtgggtgtctctgcccaagggcaagggtatcaagctctccatcattgaagaggctaggaaacgccttgcagccacatcagccaccaccgcataagaatagctctccaggtaatccatgtttttttagagggctagactttgttcttcggctatggctgttttgctcttttttagttgaattatgaactccttaggacttagattctgcatgtttggattgagattctgcactatctgatatggaatttttgtagtttggttgtattttttttcagctatataagacgtggtgagtttaagcaagttttaaatatactatcttcatccaatgtttggac

SEQ ID NO: 4059 - DNA, 1102 bp, Momordica charantia
gacgaactctctctctctcacttcggcgaagccctagctctctcacacagacgccggcggcaacctcaggtttagctctctcgagcttcgattcgaagatatggcaagaggattgaagaagcatttgaagaggctcaatgctccgaagcattggatgctcgacaaactcggtggtgcatttgcccccaaaccttcatctggacctcataaatctagggaatgccttccattgatccttatcttgcgaaaccgactgaaatatgctctcacataccgtgaggtaattgcaattttaatgcaacgacatgttttggttgatgggaaggtgaggacagacaagacatatcccgcgggtttcatggacgttgtgtctattcccaaaacaaacgagaattttcggcttctttatgacacaaagggccgattccgtcttcactcagtcagggatgaagaggctaagtataagctctgcaaagttcgctcagtgcagtttgggcaaaagggcatcccttacctgaacacttatgatggacgtacaatccgttatcccgatcctctgatcaaggctaatgacaccatcaagctggacctcgactccaacaagattgctgatttcatcaagtttgacgtgggaaatgtcgtgatggtgacaggcggaagaaatcgtggtcgtgttggagtgataaagaacagagagaagcacaagggaagcttcgagacaatccacatccaggatgcgaccgggcacgagtttgcaactcggctaggcaatgtgtttacaataggcaagggtaccaagccatgggtgtcccttcccaagggcaagggtattaagttatccataattgaagaggccaggaagaggcttgcaagccaagcagcagttacagcttaaggaatagtttagtgtagtcatgatgaaaggccatgaacaacattaattttgaaatatctgtttaatgggattttgctctgatgctttgttttttctactggaaatgtttctgctatgattttatttgttacgatggacttatcttttggaaattgtcatgagttgtttacttgtttttctggtaaatggaaagtaaaattgtcttct

SEQ ID NO: 4060 - DNA, 1053 bp, Tropaeolum majus
tctccgactcagcggccgggggttcagactgttgttcactctttaagctttgaagagaagtcgcaggcgcagctctagggagagatctcttgagcacatacagaaatctgcaaaatggctaggggattgaagaagcatttgaagaggctcaatgctcccaagcattggatgttggataagcttggtggagcatttgcacccaagccatcatctgggccacacaagtccagggagtgcttaccgcttatccttatcttgcgtaacagattgaagtatgctcttacgtaccgtgaggttatagcaatcttgatgcagcgacatattcttgttgatggaaaggttaagacagacaagacatacccagctggtttcatggatgttatctccattcccaagaccaatgaaaatttccgtctcctctatgacactaagggtcggttccgtcttcactctgtcagggatgaagagtccaagtttaagctgtgcaaagttcgatctgttcagttcggacagaaaggtattccatacatcaacacatatgatggacgaaccattcgctacccagaccccctcatcaaagctaatgacaccataaaactggatctggaggccaataagattgttgacttcattaagtttgatgttgggaatgttgtcatggtgactggaggaagaaacagagggcgtgtaggagtcatcaagaacagggagaaacataagggcagttttgagaccattcacgtgcaagattctcttggtcatgagtttgcgactcggttgggcaatgtgtttacaattggcaaaggtaccaagccgtgggtgtctcttccaaagggtaagggaatcaagttgaccattatcgaggaggctaggaagaggttagctgcccaacaagctgcataatttatgctttaagatacttcctgcttaaatgttatgttggtgcttttcagttagttgtagcagattgatttggttttcatttagcaccatgagcacaatttttaattagttgttatcattacattttcattaatattattgtatgttggt

SEQ ID NO: 4061 - DNA, 1076 bp, Tropaeolum majus
tccacaccaacagcctgaaattaaaagctgtataatcgcagctcgagggggtgatctcttgagctaatacacatatctgcaaaatggctcgtggtttgaagaaacatttgaagaggctcaatgccccaaagcattggatgttggataaacttggtggcgcatttgcacccaaaccatcatctggaccacacaagtccagggaatgcttgcccttgatccttatcctgcgaaatagactcaagtatgctcttacatatcgtgaggttatagccatcttgatgcaacgacatattcttgttgatggaaaagttaggacagacaagacatacccagctggtttcatggatgtaatgtcaattcccaagactaatgagaacttccgtcttctgtatgacactaaggggcgtttccgtctccactctatcagggatgaagaggcaaagtttaagctatgcaaagttcgctctgtccagtttggtcagaaaggcattccctacatcaatacctttgatggtcgaaccatccgttacccagatccacttatcaaggctaatgacaccatcaaactagaccttgaagccaacaagattgtagacttcattaaatttgatgttggtaatgttgtcatggttactggagggcgaaacagagggcgtgtcggagtaatcaagaaccgagagaaacataagggtagctttgaaactatccacgttcaagatgctcaaggacatgagtttgcaactcgcttgggcaatgtcttcacaattggcaaaggtaccaagccttgggtatctcttccaaagggcaagggtattaagttgacaatcattgaggaagctaggaagaggattgctgcccaacaagctgcataatgtcattctggctctccggacatattgctttgctttttacaatggattaacattagcagagttacggttttgaattatcgggtacaatttttcatagcttatgtggtctcattttctgtattttttttgagtaattttgtattcttggtctcttacatggacttagccataattcaagcataaattcaattttttacatttaaa

SEQ ID NO: 4062 - DNA, 1117 bp, Elaeis guineensis
agcacgcgagtccatttcgagcgtttgaggagtcggaggggaaggccgccgcgatcaggaggagaaaatggctaggggattgaagaagcatctgaagaggctcaatgccccaaagcattggatgctagacaagcttggtggtgcctttgccccaaaaccatcttctggcccacacaaggctcgtgagtgtttaccattaatccttatcctaagaaatcggttgaaatatgctcttacttaccgtgaagtcattgcaattctgatgcaacggcacgtactggttgatggaaaggtcaggacagacaagacttatccagctggtttcatggatgttgtatcgatcccaaagacaaatgagaattttcggctcttgtatgacaccaaggggcgcttccgtctccactcaatcagagatgaggaggctaagttcaagctgtgcaaggtccgatctgttcagtttggacacaagggcattccttatctcaatacttatgatggtcggacaattcggtatccggatcctctaatcaaagcaaatgacaccattaagcttgatctggagacttacaagatcgtagatttcatcaagtttgatgtcggcaatgtagtcatggttactggtggaaggaacaggggacgtgttggtgttatcaagaacagggagaagcataagggcagttttgagactatccacctccaagatgcaactggtcatgagtttgcaactcgccttggcaatgtcttcaccattggcaagggaacgaagccatgggtttctcttcctaaaggaaagggtatcaagctcagcatcattgaggaggctaggaagcggcttgctgcctctggtgccgctgccactgtctgatcgtattgcttgtttcatattttgtctggggtagtcggagttctttgtggacatgtatgggggaggttgcaaatcctcttatctgattttgatgatgtcaactctttttaagtctagtttgctttggattatggatattagttctcttaaattttcatggacagctggatatttgtgttgcttttacataattggcatttgattacatctgcttatccaacagttttaatgacatcttagattatttttgtg

SEQ ID NO: 4063 - DNA, 1043 bp, Cajanus cajan
agggtttaaagagacgcactcttgctatttgttttcagtttcggtggtgtcgtagcagcgaagctcggagcttagtttctgactcgaagatggcaagaggattgaagaagcatttgaagaggctcaatgccccaaagcattggatgcttgacaaactgggtggtgcatttgctcctaagccctcatctggaccccacaaatctagggaatgtttgccacttatactcatattgcgaaaccgtctgaagtatgctctgacataccgtgaagtcattgctattctgatgcagcgacatgtccttgttgatggcaaagtcaggacagacaagacatatccttctggtttcatggatgttgtatctatccctaaaacaaatgagaactttcgcctgctgtatgacacaaaaggtcgattccgtctccactcagtcagggatgaggaggctaagttcaagctctgtaaggttcgctcagtgcagttcgggcagaaaggtatcccatacctgaacacctatgatggtcgaactatccgctacccagatcctctcatcagggccaatgataccattaagctagatttggaggaaaacaagattgttgatttcatcaaatttgatgtgggtaatgtagtcatggtgaccggtggaaggaacagagggcgtgttggagtgataaaaaacagggagaagcataagggtagctttgagactatccatgttcaggatgccactgggcatgaatttacaactcgtatgggcaatgtgttcactattggcaagggcacgaaaccatggatatctcttcccaagggtaaaggtattaagctatcaatcattgaggaagctaggaaaaggattgctgcccaacaagcaactgctgcttaaacctttttaggatatgaatagacttgagtgcttggtatttttgttcaatggtttttgtttctaatttatttttctcgtagattttatctgttgaatttttgtctcttaaatgcactatagaacttttattgtggcggctatattcatgaaggaatcttt

SEQ ID NO: 4064 - DNA, 1142 bp, Prunus persica
atataaatcttaacctctccgccgcttcgtccctgtcttcttcagcatcgcacctcctcctcactcccacctagggtttctgcatctgcctctgctaaaatggctagaggattgaagaagcatctgaagaggctcaatgccccaaagcattggatgctcgacaaacttgggggtgcttttgctcccaagccatcatctgggcctcacaaatctagggagtgccttccactgatcctcatcctgaggaacaggttgaagtatgctctcacataccgtgaggtcgtttccattctcatgcagcgtcatattttggttgatggcaaggttaggaccgataagacctacccttctggattcatggatgttgtttccatcccaaaaacaaatgagaatttccgtctgctttatgacaccaagggtcggttccggctccactcaattagagatgaggagtctaagttcaagctatgcaaggtccggtcagtgcagtttgggcagaagggcattccctatattaacacttatgacgggagaactattcgctaccctgaccccctcatcaaggccaatgacactatcaagctggacttggagaccaacaagatcactgacttcattaagtttgatgttggaaatgttgtcatggtgactggtggaagaaacagaggtcgtgttggagtcattaagaacagggagaagcataagggaagctttgagaccatccacgttcaggatgccactggtcacgagtttgctactcggcttggtaatgtgttcaccattggcaagggtacaaagccttgggtgtctcttcccaagggcaaaggtatcaagctgaccatccttgaagaggcaaagaagcgacaagcagccgcccaagcagctgctactgcttaaacaatagggtggcaactatagattgttgttcctatagttttagatggtacttagttgaatcagttaagcagtttgactcttttcagcttatgctcagaggattctattttctttcattttgcggccctgctttgtggattatttaagatgcaatactggcttgaatgtttttatgttttgtgctggaatgagatatgtatcggaccaattttaattgacttgctgcttatgttattcggatgttt

SEQ ID NO: 4065 - DNA, 1356 bp, Glycine max
ggattagggttttaaagagacccaacccctctcttttcttttcttcagttcggtggaaggagccgtagcagcagcggaagctctagcttgggcagcgaatcacaatggcgagaggattgaagaagcatttgaagaggcttaatgccccaaagcattggatgcttgacaaactgggtggtgcatttgctcctaagccctcatctggaccacacaaatccagggaatgcctgccactcatactcattttgcgaaaccggctgaagtatgctctgacataccgtgaagtcattgctattctgatgcagcgacatgtccttgttgatggcaaagtcaggacagacaagacatatcctgctggtttcatggatgttgtatcaatccctaaaacaaatgagaacttccgcctgctgtatgacaccaaaggccgattccgtcttcactcagtcatagatgacgaggctaagttcaagctttgcaaagttcgctcagtgcagtttgggcaaaaaggtatcccatacttgaacacctacgatggtcgcactatccgctacccagaccctctcatcagagctaatgacaccattaagttggatttggaggagaacaagattgtcgatttcatcaagtttgatgttgggaatgtagtcatggtgacaggtggaaggaataggggtcgtgttggagtgatcaagaacagagagaagcataagggaagctttgagactatccatgttcaggatgccactggccacgagtttgcaactcgtatgggcaatgtgttcaccattggcaagggaacaaaaccatggatatctcttcccaagggtaaaggtattaaactatcaatcattgaggaagctaggaaaaggattgccgcccaacaagcaactgctgcttaaatctttaggaaatgaatagactttgagtgtttggtagtttttatttaatggttttggtttctaatttattttgtcttgaaattttatccactgaatttcgtctcttaaatgctctatagaactttttattgcggcttctatgttcatgaaggaatctttccatttcctagtattgatgtagtttagtcggataaaattacttaaagtccactcaaacgaaatgccttaataattacttagtaagggatcatgttgctattgaatactgtattgttatttgcgtactatcttgaatgattcaacgcaacttaatagttggattttgcggttaccaatatttttaaggacgtttgattccgttgaggtccatttaacgtcaatgttgtgcgagtgggttgatttacattgaatgttcgtttgagacttgggaatggaaaaaggaacacagattaagtct

SEQ ID NO: 4066 - DNA, 1087 bp, Tabernaemontana elegans
agctcagtttactgcgagagctagggtttaacattctctccttgttttggcggcagcgaggaagcgaaagtagggcgcagctgagctccaccaccctgatcctacagcaatggctagaggtttgaagaaacacttgaagaggctcaatgccccaaaacattggatgctggataagctcggtggtgcttttgcacccaagccatcatctggacctcacaaatctagggaatgcttgcccttgattcttattctacgaaacaggttgaagtatgctctcacatatcgtgaagtaatcgccatattgatgcaacgtcatattcttgttgatgggaaagttaggacagacaaaacgtacccttctggattcatggatgttgtatcaatccccaagacaaatgagaatttccgtctgctttacgacacaaagggtcgattccgtcttcattctatcagggatgaggaggctaagtttaagctgtgcaaagttcgatcagtccagtttggtcagaagggcatcccatatctgaatacctatgatggacgaactatccgttacccggatcctctcatcaaggcaaatgacaccataaaacttgatctggagactaacaagatcactgatttcatcaagtttgatgttgggaatgttgtcatggtgactggtggaaggaacagagggcgtgttggagtgatcaagaatagagagaagcataagggaagctttgagaccatccatatccaggatgctcaaggtcacgagtttgctacccgcctgggcaatgtgtttaccattggaaagggtacaaaaccttcggtttctcttcccaagggcaaaggaatcaagttgtcaattattgaggaggcaaggaagagggaggcagctaaatcacctgctactgcctaatttatagaatgtcacaaagatcttggcaaattttcccagacaggcttttgcctgtgaaacttgttatcacataggcaatgtgctctagtttttagcaggtattgtgccggaattgatctcttattttatgttatcggcaaattttgaaccatgtgttgtctatttaactccctttttcagtta

SEQ ID NO: 4067 - DNA, 1248 bp, Tripterygium wilfordii
cagttgagggctgtttttatctttgcaggtgtgggagaggagcagacctgccgcttggcgcagatagctcgagaagaacaaaatggctagaggactgaagaaacatatgaagaggcttaatgcccccaagcattggatgcttgacaaacttggcggggcatttgcacccaagccctcatctggaccccacaaatccagggagtgcttgcctttgatccttatcttaaggaacaggttgaagtatgcactcacctaccgtgaggtcattgctattttgatgcaaaggcatgtgctggttgatgcaaaggttagaactgataagacatatccagcaggtttcatggatgttgtatcaattccaaaaacaaatgagaacttccgtctgctgtatgataccaagggtcgttttcgcctccattcaatcagagatgaggaagctaagttcaagctatgcaaggttcgttcagtgcaatttgggcagaagggaattccatatctcaacacttacgatggccgcaccatacgctacccagatccacttatcaaggccaatgacaccatcaagctggactttgagacaaacaagattgctgagttcatcaaattcgatgttggaaacgttgtcatggtgactggtggaaggaacagaggacgtgttggagtcattaagaacagggagaaacataagggaagctttgagactatccacatccaggatgctcaaggccatgaatttgctactcgtcttggtaatgttttcaccattggcaagggtacaaagccatgggtgtctcttcccaagggcaagggtattaaattgtctattattgaggaggcaaggaagagacttgcagcccaacaggcaacaactgcttgattcacaaaggcaccaggtctctgataggaactagttcagctgttaagacattcttgctagctaatgcttttatgactaagttttggttagttgttacatagttgtttcctggtcatttttgaggttgctttgtcgactcaattatggttttgtgatagctaagatatatcatactatttcaggcttgatctgtgcaatgactacttgttctatgattttcattttaatgatttggcagtgcaggggaattggctgcgactgttgcttgtttacccattgctcgttccttattcccgtgaggtgattgaatatgtgataacttgaggatattgagacatcagtaaattttcgtctcatatgatttatgataa

SEQ ID NO: 4068 - DNA, 1345 bp, Juglans hindsii x Juglans regia
ttggctttgcagtgacggagagcatagagagagagagagcagtggaggcggcggatttgctactacttcccccacaaaatggctagaggtttgaagaagcatttgaagaggctcaatgcccctaagcattggatgctggacaaacttggtggtgcatttgctccaaagccttcatctggacctcacaaatccagggaatgcctgcctttgatccttatcttgcgtaaccgtttgaaatatgctctcacataccgtgaggtcatttccatattgatgcaacgacatgttctggttgatggcaaggttaggacagataaaacatatcctgcaggtttcatggatgttgtttcaatccctaaaaccaatgagaatttccgcctcctctatgacactaagggtcgtttccgtctgcactcaatcagagatgatgaggcaaagtttaagctctgcaaagtcaggtctgtgcagtttgggcaaaaaggcatcccatatctgaacacctacgatgggcgaaccatccgctacccagaccctctcatcaaggccaatgacaccatcaagcttgacttggagagcaacaagattgctgacttcattaagtttgatgtggggaatgtggtcatggtgactggtggaaggaacaggggccgtgttggtgtaataaagagcagagaaaagcagaagggaagcttcgagacaattcacgtccaggatgccacaggtcatgaatttgcaactcgtttgagcaatgtgtatacctattggcaaggggacgaagccgtgggtatcccttcccaagggtaagggaatcaagctgtccatcattgaagaagccaggaagaggcttgctgcccaaggtgcaaccacagcttaaattcgatatggttgaaaataacattgagattgttattttcatggtagtccggaccacttagcttcatatttcatgctctaattatgttcccccgtttatcatgtttgatacctataatttagtttctaagatttctatcttgaacattatttgacacacttctttatgcttgtctgcggtggttttggttttctataaaagctctaaattgggtgttcatttgattttggtaatgtaaaaagttaaatttgatatttggatgatccaagtcatgaagccttgcaggttttccatctcctgcagaagtatggtctggccttgcagttagaaaaagtaggaattgctctgacaatctacattctacacccaaattcactttgtgcctggcgtattttagcctcagctctacttgtagcatgttgatgcagatcacaattaactcataattatatttttactggagtgttaacc

SEQ ID NO: 4069 - DNA, 1067 bp, Liriodendron tulipifera
gggaggctctttcccgaaggcgtagaaatggctagaggactgaagaaacatttgaagaggctcaatgccccaaagcattggatgcttgacaaacttggtggtgcatttgcccccaagccatcatctggtcctcataaagctagagaatgcttgcctcttattctcatcctacgtaacaagctgaaatatgctcttacgtaccgtgaagtaatctcaattttgatgcaaaggcatgttttggttgacggaaaggttaggactgataagacgtatcctgcaggtttcatggatgtcgtatctattcctaaaacaaatgagaatttcagactcctttacgacactaagggtcgcttccgtctacacacaattaaggatgaagaggcaaagttcaagctctgcaaggtccggtcagtgcaatttggacagaagggcattccttacctcaacacctatgacgggcgtactatccgctatccagacccactcatcagggccaatgacaccatcaagcttgaccttgagacctacaaaattgttgacttcatcaagtttgacgttgggaacgtggtcatggtgacgggcggcaggaacaggggacgtgtcggtgttatcaagaacagggagaagcataagggcaccttcgagaccatccacgttcaggatgccaccggccatgagtttgcaacccgcctaggggaatgtgttcaccatcggcaaggggacgaagccgtgggtctccctgcccaagggcaagggtatcaagctctccatcattgaagaggccaggaaacgccttgccgctgcatccaccaccactggataggaacagctctgcaggtaataccatatttcagagccatggactttcatagatggtcttcaggaatgctaattgaattatgatctcctcagaatctaggtgttgcatgtaatgccgataaggaatttttgtagtttggttgagtttaagctgtttcaaatatattttcttccatgtgtttgtttttttactttactagtaccctctaggcttgtctgcagtccatgcttcctggtgattctatcta

SEQ ID NO: 4070 - DNA, 1091 bp, Cicer arietinum
gtgtgcgttgccctagctctggtttcgcaactccaacatggcgagaggattgaagaagcatttgaagaggctcaatgcccccaagcattggatgcttgacaaattgggtggtgcctttgctcctaaaccctcatctggaccacacaagtcaagggaatgtctgccactcattctcattttgcgaaacaggttgaagtatgctttgacataccgtgaggtcattgccattctgatgcaacgccatgtccttgttgacaacaaagtcaggaccgacaagacctatccagctggattcatggatgttgtgtcaattcccaaaacaaatgagaacttccgcctgctttatgacaccaaaggccgttttcgtctccactcagtcagggatgatgaggctaagttcaagctctgcaaggttcgctcagttcaatttggacagaaaggtatcccatacctaaacacttatgatggtcgcactatccgctacccagaccctctcattaaggctaatgatacaattaagcttgatcttgaggagaacaagattgttgatttcatcaagtttgatgttgggaatgtagttatggttactggtggaaggaataggggtcgtgttggagtgatcaagaacagggagaagcataagggaacttttgagacaatccatgttcaggatgctactggccatgaatttgcaactcgattgggcaatgtgttcactattggcaagggaaccaagccatgggtatctcttcccaagggtaagggtattaagttaaccgtcattgaggaagctagaaaaagggctgctgcagcccaacaagcaattgctgcttaaatcgttattgaatgagtttacaatagacttgagtgttttctagttttattccaacttatttggtttctgatgtctgagtttttatcagttgaattttgacttttgaactatacatctgttattgtgcttgctatatttattcatgaaggaatattttcattccgtagttttgaattattttggtcgtatagaatctcctaagtgggtttgccattacaaatcctagttctattggttttttgtatgataccctagg

SEQ ID NO: 4071 - DNA, 1030 bp, Carpinus betulus
acctactagaggctctcacttctcagagcgctagaggaagcagaggaggcgcagccccatcccaagagatcttcaagcgcacaaagccaaaatggctagaggattgaagaagcatttgaagaggctcaatgccccaaagcattggatgctcgacaaacttggtggtgcatttgctcccaagccttcatctggacctcacaaatccagagaatgccttccattgatccttattctacgaaacaggttgaagtatgctctcacttaccgtgaggtcattgctattttgatgcaacgccatgttctggttgatgggaaggtcaggacggataaaacttatcctgcaggtttcatggatgttgtatcaatccctaaaacaaatgagaatttccgtctcctttatgacaccaagggtcggttccgtctccactcaatcagggatgaagaggcaaagtttaagctctgcaaagtccgctctgttcagtttggccaaaaaggtatcccatacctgaacacctatgatggacgaaccatccgctacccggaccctgtaattaaggcaaatgacacaatcaagctagacctggagagcaacaagatcacagatttcatcaagttcgatgttgggaatgtagtcatggtgacgggtggaaggaataggggacgtgttggagtcatcaagagcagggagaagcataagggtacctttgagaccatccatgtgcaggatgccagtgggcatgaatttgcaactcggttggggaatgtgttcatcattggaaaggggacaaaaccatgggtatcccttcctaagggtaagggtattaagctgacaatcattgaagaggccaggaagaggcatggagcagaagcagctgcatctacagcataaagaatcttggtaaaaacattcttcaaagtgactaagttgacggttattttgtagtttgatccccggatttatgctccatttttttgtcatttttattatgcttcaaagtttgaaaagattatcttaaactattgttatttt

SEQ ID NO: 4072 - DNA, 1090 bp, Amsonia hubrichtii
gtgcgcagtagggagggtacttttgagagctagggtttaaaccttctctgcttgtgcttgcggctgcgagggagcgaaaggaggcgcaacaactctgaacccacagcaatggctagaggtttgaagaaacacttgaagaggctcaatgccccaaaacattggatgctggataagctcggtggtgcttttgcacccaagccatcatctggacctcacaaatcaagggagtgcttgcccttaattctcattctacgaaacaggttgaagtatgctctcacatatcgcgaagtaattgccatattgatgcagcgccatgttttcgttgatgggaaagttaggacagacaaaacatacccgtctggattcatggatgttgtctcaatccccaagacaaatgagaatttccgtctgctttatgatacaaagggtcgattccgtcttcactctatcagggatgaggaggctaagtttaagctgtgcaaagttcgatcaatccagttcggtcagaaaggcattccgtacctgaatacctatgatggacgaactatccgttacccggaccctctcatcaaggcaaatgacaccattaaacttgacctggagactaacaagattactgatttcatcaagtttgatgttgggaatgttgtgatggtgaccggtggaaggaacagaggacgtgttggagtgatcaagaatagagagaagcataaggggagctttgagaccatccatatccaggatgctcaaggtcatgagtttgcaactcgtctgggaaatgtgtttaccattggaaagggtacaaaaccttgggtgtctcttcccaagggcaaaggtatcaagttgtcaattattgaggaggcgaggaagagggaggctaccaaatctcctgctactgcctagtttgtagaatatctcaaagatcttgaacaattttcatagacagggttttacctgtgaacttattatcagatattatcagtgttttcagtaggtatcttgctgcaattatctcttatttgatcttatcacaattttgaaccatggtgttgtctattttaactcgtgctttttgttgttctgtttacag

SEQ ID NO: 4073 - DNA, 1128 bp, Amsonia hubrichtii
gtacttttgagagctagggtttaaaccttctctgcttgtgcttgcggctgcgagggagcgaaaggaggcgcaacaactctgaacccacagcaatggctagaggtttgaagaaacacttgaagaggctcaatgccccaaaacattggatgctggataagctcggtggtgcttttgcacccaagccatcatctggacctcacaaatcaagggagtgcttgcccttgattcttattctacgaaacaggttgaagtatgctctcacatatcgtgaagtaattgccatattgatgcagcgtcatgtttttgttgatgggaaagttaggacagacaaaacgtacccgtctggattcatggatgttgtctcaatccccaagacaaatgagaatttccgtctactttatgatacaaagggtcgattccgtcttcactctatcagggatgaggaagctaagtttaagctgtgcaaagttcgatcaatccagttcggtcagaaaggcattccgtacctgaatacctatgatggacgaactatccgttacccggaccctctcatcaaggcaaatgacaccattaaacttgacctggagactaacaagattactgatttcatcaagtttgatgttgggaatgttgtgatggtgactggtggaaggaacagaggccgtgttggagtgatcaagaatagagagaagcataaggggagctttgagaccatccatatccaggatgctcaaggtcatgagtttgcaactcgtctgggaaatgtgtttaccattggaaagggtacaaaaccttgggtgtctcttcccaagggcaaaggtatcaagttgtcaattattgaggaggcgaggaagagggaggctaccaaatctcctgctactgcctaatttatagaatatctaaagatttttgacaattttcatagacaggtttttacctgtgaacttgttatcagataattagcagtatgctagttttcagtaggtatcgtgctgtactcatatttgatcctatcacaattttgaaccatggtttttctattttaactcgtgcttttagttgttctgattatagactaaagcttggtttgacactgctcaatatctctttccattagtgcactttagt

SEQ ID NO: 4074 - DNA, 1043 bp, Aristolochia fimbriata
agacaggctcttcgccttccgcggttgaaaagccacagaccggtgaaaaaatggcaagagggttgaagaaacatttaaagcggctcaatgccccaaagcactggatgcttgacaaacttggtggtgcatttgccccgaagccatcatctggccctcacaaatccagagaatgcttgccattaatccttattctaaggaataagctgaagtatgcacttacttaccgtgaggtgatatcaatcatgatgcaaagacatattttggtcgacggaaaggtcaggacggacaagacctatcctgctggtttcatggatgtggtgtctattcctaaaacaaatgaaaatttccggctcctatatgacaccaagggtcggttccgtctacacactataaaggatgaggaggctaagtttaaactatgcaaggtgcggtctgttcaatttgggcaaaagggcattccttacctcaatacctatgatgggcgcacaatccgttatcctgacccacttattcgtgccaatgacaccatcaaacttgatctcgaaaccaacaaaattgttgacttcatcaagtttgatgtcggtaatgttgtgatggtgactggtggtagaaacagggggcgtgttggcatcatcaagagcagggagaagcataaggggagtttcgaaaccatccatgttgaggacgccacaggtcatgcttttgctacgcgtctaggcaatgtgttcaccctaggtaaggggtcaaagccttgggtgtccctgccgaagggcaagggtataaagctctccatcattgaagaggctcggaagcgcctcgccgcccaggctgccacagcctaaattaaaagggttaagttttttttttcacaccaagagcttattctagttagatctttttaagacttaatttattcatgcttgtgtaacagattagtagccagattatttactcgtgttttcatggattgatctgttgctttattgaattttgtagtgtccaacaatttataagtcaagttaaggtctgaagaggagtggatg

SEQ ID NO: 4075 - DNA, 1132 bp, Persea americana
ggggacggagcagctagggttttgggaagaagaagaagacgacggcggggagtcccctaatctatcatatccgtactctgaaaccctgaaaaatggcaagaggtttgaagaaacatttgaagaggctcaatgccccaaagcattggatgcttgacaaacttggcggtgcatttgctcccaaaccgtcttctggtcctcacaaagccagggaatgtttgcctttgattctaattctgcgcaacaagttgaagtatgcactcacctatcgtgaagtcatctcaattttgatgcaaaggcatgtgttggttgatggaaaggttaggactgacaagacatatcctactgggttcatggatgttgtctctattcccaaaacaaatgagaacttccgtctgctgtatgacaccaagggccgcttccggctccattctatcagggatgacgaggcaaagtacaagctttgcaaggtccgctctatccagtttggacaaaaaggcattccttacctcaacacctatgatggtcgcactatccgttatcctgacccccttatcaaggccaacgacaccatcaagcttgatttggagacctgtaagattgtcgacttcatcaagttcgatgtcggtaatgttgtcatggtgactggtggaaggaataggggacgggttggtgtgatcaagaacagggaaaagcataagggcagctttgagactatccacgttcaggattccactggccatgagtttgcaacccgtctagggaatgtctacaccatcggcaaggggacgaaaccatgggtgtcactgcctaaaggaaagggtatcaagctctcaatcatcgaggaggctcgaaagcgccttgcagcagcatctgctgccaccgcctaaagaacagctctgcagatttatgtctgaacttaagtagtaggtactcttcattatgctgcaattggcccctgctgttctgtatctggtttaggatcaattttccttatataactttaatacctagttatttgggtttacatgacaatatgcattttctccattgcggattgtttcattaatgcaattttggctgtttcaatgtttgtgatcaatcaaccattttctccattgtcggcccttctctc

SEQ ID NO: 4076 - DNA, 1119 bp, Citrus sinensis
catggaatggaattaggtagaaaactcttatcgcggagccaaagagaacagacaagcagccgcagcgaggcagcagcttcaaactcacaaaaatggctagaggattgaagaagcacttgaagaggctcaatgcccctaagcactggatgcttgacaagcttggtggtgcatttgcacctaagccatcatctggtccccacaagtcaagggaatgcttgccattgatccttgtattgcgaaaccgtttgaaatatgctctcacatatcgtgaagttattgctattctgatgcaacgacatgttcttgttgatgggaaggttaggacagataagacctaccctgctggtttcatggatgttgtgtcaattcccaagaccaacgagaacttccgtctcctttatgacaccaagggtcgcttccgtctccattccctcagagatgaggaggcaaaattcaagctttgcaaagttagatcagtccagtttggccagaaaggtatcccatacatcaacacctatgatgggcgtaccatccgctaccctgacccactcatcaaagccaatgataccatcaaacttgacttagaagagaacaagatcactgacttcatcaagtttgatgttgggaatattgtcatggtcactgggggtagaaacagaggtcgagttggaatcatcaagaacagggaaaagcataagggaagttttgagaccatccatattcaagatgcccttggtcatgagtttgcaactcgtctaggcaatgtgttcaccatcgggaagggttcaaaaccatgggtgtcacttcctaagggcaagggtattaagttgtccatcattgaggaagctaggaagagacaggctgcccaggctgctgcttaagcttttacaatgaatttggatgcattttgctgctttgttttttcttgttgaattagagctgattggcactctctaaagctgaagtaggaccgatgcaaaaatgaatctttatttttatttttatttttatcagcacaattttgaacctgctttgtccttttttattttagctactatttggtggatgttattttcaactatttaatctaagttcatgtatctctttatcgtttctgtt

SEQ ID NO: 4077 - DNA, 1304 bp, Citrus clementina
aatacagaaactagggtttagtcaccttctcactcttctcgcggagccaaagagaacagacaagcagccgcagcgaggcagcagcttcaaactcacaaaaatggctagaggattgaagaagcacttgaagaggctcaatgcccctaagcactggatgcttgacaagcttggtggtgcatttgcacctaagccatcatctggtccccacaagtcaagggaatgcttgccattgatccttgtattgcgaaaccgtttgaaatatgctctcacatatcgtgaagttattgctattctgatgcaacgacatgttcttgttgatgggaaggttaggacagataagacctaccctgctggtttcatggatgttgtgtcaattcccaagaccaacgagaacttccgtctcctttatgacaccaagggtcgcttccgtctccattccctcagagatgaggaggcaaaattcaagctttgcaaagttagatcagtccagtttggccagaaaggtatcccatacatcaacacctatgatgggcgtaccatccgctaccctgacccactcatcaaagccaatgataccatcaaacttgacttagaagagaacaagatcactgacttcatcaagtttgatgttgggaatattgtcatggtcactgggggtagaaacagaggtcgagttggaatcatcaagaacagggaaaagcataagggaagttttgagaccatccatattcaagatgcccttggtcatgagtttgcaactcgcctaggcaatgtgttcaccatcgggaagggttcaaaaccatgggtgtcacttcctaagggcaagggtattaagttgtccatcattgaggaagctaggaagagacaggctgcccaggctgctgcttaagcttttacaatgaatttggatacattttgctgctttgttttttcttgttgaattagagctgattggcactctctaaagctgaagtaggaccgatgcaaaaatgaatctttatttttatttttatttttatcagcacaattttgaacctgctttgtccttttttattttagctactatttggtggatgttattttcaactatttaatctaagttcatgtatctctttatcgtttctgtttgtaattttgggcttatggttttccacttttgtatttgaaatatattaagcattggggtctggttaaacctgaatggggatcagggtacttttcctctctctttcagtgggttttgcacaaatcacaatcaccactgttgtgaggataaagattcagtgttgaactgagtttttttg

SEQ ID NO: 4078 - DNA, 1133 bp, Vigna unguiculata
ggagggttttaaagagacgcaactcttctgtttcttcagttctgtggtgccgtagcagggagctccagcgtatctctcaaatccagaatggctagaggattgaagaagcatttgaagaggctcaatgccccaaagcattggatgcttgacaaactgggtggtgcatttgctcccaagccctcatctggaccacacaaatctagggaatgcctgccactcattctcattctgcgaaaccggctgaagtatgccctgacataccgtgaagtcattgctattcttatgcaacgacatgtcctcgttgatggcaaagtcaggacagacaagacatatccatctggttttatggatgttgtatccatccctaaaacaaatgagaacttccgcttgctgtatgacactaaaggcagattccgtcttcactcagtcagggacgaggaagctaagttcaagctctgcaaggttcggtcagtgcagtttgggcaaaagggcatcccatacctgaacacctatgatgggcgcaccatccgctacccagaccctgtcatcagggccaatgacaccattaagttggacttggaggaaaacaagatcgttgatttcatcaaatttgatgttgggaatgtagttatggtgacaggtggaaggaatagagggcgtgttggagtgatcaagagcagagagaagcacaagggaagctttgagactatccatgttcaagatgctactgggcacgaatttgcaactcgtttgggcaatgtgtttaccatcggtaaaggaacaaaaccttgggtatctcttcctaagggtaaaggtattaagctttcgatcatcgaggaagccaggaagaggattgccgcccaacaagctactgctgcttaaatcattaggctatgaatagactacttttgagtgcttgtagtttttatgcgatggtttttgctttctaatttatattgtctggagattttatccgttgaattttgtctcttaatgaaccatagaactcttattgctgctgctatatatgcatgaaggaatctttccattccatagatttgatgtactttagttgcaacaagtttcttaactaagtccaatcaatgcatcttttaagaaaatatatttttgca

SEQ ID NO: 4079 - DNA, 1138 bp, Vigna unguiculata
ggagggttttaaagagacgcaactcttctgtttcttcagttctgtggtgccgtagcagggagctccagcgtatctctcaaatccagaatggctagaggattgaagaagcatttgaagaggctcaatgccccaaagcattggatgcttgacaaactgggtggtgcatttgctcccaagccctcatctggaccacacaaatctagggaatgcctgccactcattctcattctgcgaaaccggctgaagtatgccctgacataccgtgaagtcattgctattcttatgcaacgacatgtcctcgttgatggcaaagtcaggacagacaagacatatccatctggttttatggatgttgtatccatccctaaaacaaatgagaacttccgcttgctgtatgacactaaaggcagattccgtcttcactcagtcagggacgaggaagctaagttcaagctctgcaaggttcggtcagtgcagtttgggcaaaagggcatcccatacctgaacacctatgatgggcgcaccatccgctacccagaccctgtcatcagggccaatgacaccattaagttggacttggaggaaaacaagatcgttgatttcatcaaatttgatgttgggaatgtagttatggtgacaggtggaaggaatagagggcgtgttggagtgatcaagagcagagagaagcacaagggaagctttgagactatccatgttcaagatgctactgggcacgaatttgcaactcgtttgggcaatgtgtttaccatcggtaaaggaacaaaaccttgggtatctcttcctaagggtaaaggtattaagctttcgatcatcgaggaagccaggaagaggattgccgcccaacaagctactgctgcttaaatcattaggctatgaatagactacttttgagtgcttgtagtttttatgcgatggtttttgctttctaatttatattgtctggagattttatccgttgaattttgtctcttaatgaaccatagaactcttattgctgctgctatatatgcatgaaggaatctttccattccatagatttgatgtactttagttgcaacaagtttcttaactaagtccaatcaatgcatcttttaagaaaatatatttttgcatatca

SEQ ID NO: 4080 - DNA, 1099 bp, Cucumis sativus
gtaacaaacactctctcttcagtaagaaaccctatctctcccccactagcgccggcgccgactccgacttttagctcttgcaacagatatggcaagaggactgaagaagcatttgaagaggctcaatgctccaaagcattggatgctcgacaaacttggtggtgcatttgcccccaaaccttcatctggtcctcataagtcgagggaatgcctccccttgatccttatattgaggaaccggctgaagtatgctctcacgtaccgtgaggtaattgcaattttaatgcaacgacatgttttggtcgatgggaaggtcaggactgataagacttttcctgctggttttatggacgttgtgtcaattcccaagacaaacgaaaatttccggcttctttatgacacaaaaggtcgattccgtctacactcagttagggatgaagaggctaagtataagctgtgcaaagttcgctccgtacagtttgggcaaaagggcatcccttatctgaacacttacgatggacgcacaattcgttatcctgaccctctgattaaggcgaatgacaccatcaagctagaccttgagtctaacaagattgctgatttcatcaagtttgatgtaggaaatgttgtgatggtgactggtggaagaaacagaggcagggttggagttataaagaacagggagaagcataagggaagctttgaaacaatccacattcaggatgcaaccgggcacgaatttgcaactcggctgggcaatgtgttcacaattggtaaggggactaagccatgggtgtccctacccaagggcaagggtattaaattatccattatcgaagaagccaggaagaggctggcaagccaagccacagttactgcttaagacttagtttagtgtaacgtagtcatggatgaaagattggatttttcttttgtttttgtataagtagatctagaaaaggctgatacacttggatatttctacttcaactgtgtgaagctactgctatgattttgtcattccaagactcttttcttcatgagggctacttgtttttctggtaaatggaaaaatcttgacttgtgttcgatttgttaa

SEQ ID NO: 4081 - DNA, 1106 bp, Euonymus alatus
ttttttttcagtcatctttgcaggtttaggaaaggagcagagcagacgggctggttgccgacagtagctcgaaaccacaaaaatggctagaggactgaagaaacatatgaagaggcttaatgcccccaagcattggatgcttgacaaacttggcggggcatttgctcccaagccctcatctggaccccacaaatccagggagtgcttgcctttgatccttatcttaaggaacaggttgaagtatgcgctcacctaccgtgaggtcattgctattttgatgcaaaggcatgtgatggttgattttaaggttagaactgataagacgtatccggctggcttcatggatgttgtatcaattccaaaaacaaatgagaacttccgtctgctttatgataccaaaggtcgatttcgccttcactcaatcagagatgaggaagctatgttcaagctctgcaaggttcgttcagtgcagtttgggcaaaagggaattccatatctcaacacttacgatggtcgcaccatacgctacccagatcccctcatcaaggccaatgacaccatcaagctggattttgagacaaacaagattgctgatttcatcaaattcgacgttggaaatgttgtcatggtgactggtggaagaaacagaggacgtgttggagtcatcaagaacagggagaaacacaaggggagctttgagactatccacatccaggatgctcaagggcatgaatttgctacccgccttggtaatgttttcaccattggcaagggtacaaagccatgggtttctcttcccaagggcaagggtattaaattgtctattattgaggaggcaaggaagagacttgcagcccaacaggcaacaactgcctgatttgctaggcaccataggtctagaagttgaactctgatgtgaactagttcagccgttaaagactttcttgctggctcatgcttaagagtttgtttcttgttgcagacctgtttccgggtcatatgtgaggttattttatagattttaatttgttttgtgatcaactatgaaatattatactttcaggcttaatctttggatgaacttgtttatttttgtttgttatact

SEQ ID NO: 4082 - DNA, 1049 bp, Euonymus alatus
tttttttttttcagtcatctttgcaggtttaggagaggagcagagcagacgggctggttgccgacggtagctcgaaaccacaaaaatggctagaggactgaagaaacatatgaagaggcttaatgcccccaagcattggatgcttgacaaacttggcggggcatttgctcccaagccctcatctggaccccacaaatccagggagtgcttgcctttgatccttatcttaaggaacaggttgaagtatgcgctcacctaccgtgaggtcattgctattttgatgcaaaggcatgtgatggttgattttaaggttagaactgataagacgtatccggctggcttcatggatgttgtatcaattccaaaaacaaatgagaacttccgtctgctttatgataccaaaggtcgatttcgccttcattcaatcagagatgaggaagctacgttcaagctctgcaaggttcgttcggtgcagtttgggcaaaagggaattccatatctcaacacttacgatggtcgcaccatacgctacccagatccgctcatcaaggccaatgacaccatcaagctggattttgagacgaacaagattgctgatttcatcaaattcgacgttggaaatgttgtcatggtgactggtggaagaaacagaggacgtgttggagtcatcaagaacagggagaaacacaaggggagctttgagaccattcacatccaggatgctcaagggcatgaatttgcaacccgtcttggtaatgttttcaccattggcaagggtacaaagccatgggtttctcttcccaagggcaagggtattaaattgtctattattgaggaggcaaggaagagacttgcagcccaacaggcaacgactgcctgatttgctaggcaccataggtcttgacgttgtactctgatttgaactagttcagccgttaaggactttcttgcttggctcatgcttaagagtttgtttcttgttgcagacctgtttccgggtcatatgtgaggttattttatagacattaatttgttttgtgatcaactat

SEQ ID NO: 4083 - DNA, 1022 bp, Actinidia deliciosa
aaaagagcacagaggcacggcggcgtcgtgaaggcaacacaatggctagaggtttgaagaagcatttgaagaggctcaatgccccgagtcactggatgcttgacaagcttggtggtgcatttgcacccaagccatcatctggaccccataaatcaagggaatgcctgcctttgattcttatcttgcgaaacaggctgaaatatgctctcacataccgtgaagtcattgcaatcctgatgcaacgccatatccttgttgatgggaaggttaggacggacaagacctatccttccggtttcatggatgtcgtatctattcccaaaacaaatgaaaatttccgcctcctttacgatactaagggccgattccgactccattccgtcagagatgaagaggccaagtttaagctttgcaaagttcgctctgtacaatttgggcagaaaggtatcccatacctcaacacttacgatgggcgcactattcgttaccctgacccccttatcaaagccaatgacaccgttaaacttgacttagagtcgaacaagatcactgatttcatcaagtttgatgttggcaatgttgtcatggtgactggaggaaggaataggggccgtgttggagtcatcaagaacagggagaagcacaagggaagctttgaaaccattcacatccaagatgctaccggtcatgagtttgctactcgcatgggcaatgttttcaccattggaaaaggtacaaagccgtgggtgtctcttcccaaaggcaagggaatcaaattgtccatcattgaggaggctaggaagaggcttgctacccaagcaggtgcagctgcataaatttatgaatcataagttgttgcgacatcagttaacaactagaatggtttatgatagaggtggttatgttttgttctttttattccttagtacaatgttgctcaaaattttgttgttgcaagtttggttcgactgctgctggatgatttaaaatctgaacaatgttggtcaactttcttctttcat

SEQ ID NO: 4084 - DNA, 1085 bp, Medicago truncatula
gggttttgtcttcagctctgaacccacccacctacggcggaacttatctctgaggagtgaagagcagattctgcagaagacttcaacatggcaagagggttgaagaaacacttgaagagactcaatgctccaaaacattggatgcttgacaaacttggtggagcctttgcaccaaagccatcatctggaccccacaagtcaagggagtgccttcctttgatcctcatcctgcgaaacagactgaaatatgctctaacatacagagaagttattgccatcttgatgcagcgtcatgttcttgttgatggcaaggttaggacagacaagacatatcccgctggtttcatggatgttgtttctattcccaaaacaaatgaaaactttcgtcttctgtatgacaccaagggtcggttccgtctccactctgttagggacgatgaggcaaagtttaagctctgcaaggttcgatctgttcaattcggacagaagggcattccctatctgaacacctatgatggtcgcaccatccgttatccagatccactaattaaggctaatgacaccatcaaacttgaccttgaaaacaacaagatcactgattttatcaagtttgatgtggggaatgttgtcatggttaccggaggaaggaatagaggtcgtgttggtgtcatcaagaacagagagaaacataaaggaacttttgagactattcacgttcaggatgcaagtggtcatgagtttgccactcggctgggcaatgtgtttactattggcaaaggaacaaaaccttgggtgtctcttcctaaaggtaaaggtatcaagttgactgttattgaagaggctagaaagaggcaggctgctcaaaatgtaactgctgcttaaattttttgatcaaactatattgctagcagatttatttattttaagatgagtgggcatttttgttgattgggaggtttgtttggtgaagtgactgagcatattttttattttattttcattatactagtgcgcaattctgaactgcttcatgctgtttcagtttaattacctttaacaatattatggtgatatgttcttcatcc

SEQ ID NO: 4085 - DNA, 1099 bp, Medicago truncatula
gggttttgtcttcagctctgaacccacccacctacggcggaacttatctctgaggagtgaagagcagattctgcagaagacttcaacatggcaagagggttgaagaaacacttgaagagactcaatgctccaaaacattggatgcttgacaaacttggtggagcctttgcaccaaagccatcatctggaccccacaagtcaagggagtgccttcctttgatcctcatcctgcgaaacagactgaaatatgctctaacatacagagaagttattgccatcttgatgcagcgtcatgttcttgttgatggcaaggttaggacagacaagacatatcccgctggtttcatggatgttgtttctattcccaaaacaaatgaaaactttcgtcttctgtatgacaccaagggtcggttccgtctccactctgttagggacgatgaggcaaagtttaagctctgcaaggttcgatctgttcaattcggacagaagggcattccctatctgaacacctatgatggtcgcaccatccgttatccagatccactaattaaggctaatgacaccatcaaacttgaccttgaaaacaacaagatcactgattttatcaagtttgatgtggggaatgttgtcatggttaccggaggaaggaatagaggtcgtgttggtgtcatcaagaacagagagaaacataaaggaacttttgagactattcacgttcaggatgcaagtggtcatgagtttgccactcggctgggcaatgtgtttactattggcaaaggaacaaaaccttgggtgtctcttcctaaaggtaaaggtatcaagttgactgttattgaagaggctagaaagaggcaggctgctcaaaatgtaactgctgcttaaattttttgatcaaactatattgctagcagatttatttattttaagatgagtgggcatttttgttgattgggaggtttgtttggtgaagtgactgagcatattttttattttattttcattatactagtgcgcaattctgaactgcttcatgctgtttcagtttaattacctttaacaatattatggtgatatgttcttcatcctattattttcttct

SEQ ID NO: 4086 - DNA, 1060 bp, Cucumis melo
cttccacaaacaccacaccgctgctccatccccacagccgcccactccagtttagctccaaaatatggcaaggggactgaagaaacatttaaagaggctcaatgctccaaagcattggatgcttgacaagcttggtggtgcatttgcccccaaaccttcatctggacctcacaagtcgagggaatgcctccctttgatccttatattgagaaaccgactcaaatatgccctcacgtaccgtgaggtaattgcaattttaatgcaacgacatgttttggttgatgggaaggttaggacagacaagacttttcctgctggtttcatggatgttgtgtcaattcccaaaacaagtgagaatttccggcttctttatgacacaaaaggtcgattccgtttacactcagttagggatgaagaggcgaagtataagctgtgcaaagttcgctcagtacagtttgggcaaaagggcatcccttatttgaacacctacgacggacgcacaatccgttatcctgaccctttaatcaaggcgaatgacaccatcaagctggaccttgagtccaacaagattgcagatttcatcaagtttgatgtaggaaatgttgtgatggtgaccggtggaagaaacagaggcagggttggagtgataaagaatagggagaagcataagggaagctttgaaacaatccacattcaggatgcaaccgggcacgaatttgcaactcggctgggcaatgtgttcactattggtaaggggactaagccatgggtgtccgtacctaagggcaagggtattaaattatccatcatcgaagaagccaggaagaggctggcaagccaagccgcagttaccgcttaagatttagtgtagtgtagtcattggtgaaaggtgggagtttgctcttgtcagttttgtttttgttttgtttttttttctttttctggttaagtagatctaaaaaaggttgatactttgttatttctactacaattgtgtaaggctactgctatgatttttgtcattccagaactctttgctacaatgaactatcttacggaa

SEQ ID NO: 4087 - DNA, 1135 bp, Momordica charantia
gagggcactttggtaaatgtaagtaaaaaccctaagccctcctatttaaactgaagcactaaacctaattccttccccaaagagtttcagaggcggcagcaaactcaagccttcggcgagcttccttgtttcgaagccatggcaagaggattgaagaagcatttgaaaaggctcaatgccccaaagcattggatgcttgacaaacttggtggtgcatttgcccccaaaccttcatctggaccacataaatcaagggaatgcctcccattgattcttatcctacgaaaccggttgaagtacgctctcacataccgtgaggttattgccattttaatgcagcgacatgttttggttgatgctaaagtgaggacagacaagacatatcctgctggtttcatggatgttgtatcaatccccaaaacaaatgagaatttccgtcttctttatgacaccaaaggtcaattccgtcttcactcagtgagagatgaggaggcaaagtacaagctttgcaaagtccgctctgtgcagttcgggcaaaagggcattccctatctgaacacttatgatggtcgtacaattcggtacccagaccctctaatcaaggccaatgacaccattaagctggaccttgagaccaacaaagttgctgatttcatcaagtttgatgtaggaaatgtggtcatggtgacaggtggaaggaatcgtggacgggttggagtaattaagaacagggaaaagcacaagggaagctttgaaacaatacacattcaggatgccactggccatgaatttgccacccggcttggcaacgtctttaccatcggtaaaggtactaagccatgggtatcccttcctaagggcaaaggtattaaattatccattattgaagaagctaggaagaggcttgcaagccaagcagcagttacagcttaggagtggtgatgaaaaggttggaagaagacattgtttatggttgattgatttgaaattgttctgacatgtcctgtttcttggatttgtgtttcaaattttgttttagcaagttcttttcgacaggctggtgttttgttatttcccttagaattttggtgcagctgctaccattagtcattctaaaaacttcatgttaatgtta

SEQ ID NO: 4088 - DNA, 1081 bp, Tropaeolum majus
atccttcttccactcaatcttataagccgcacaagcataattcagttcctgacgagtttcccccggtgcacattccgaaactttcaagatggctaggggtttgaaaaaacatttgaagaggctcaatgccccaaagcattggatgcttgacaaacttggtggagcatttgcacccaaaccatcttctggtccacacaagtctagggaatgcttgcctctgatccttattctccgaaacagactcaagtatgctcttacctaccgtgaggttattgcaatcttgatgcagcgtcacattcttgtagacgggaaggtgaagactgataagacatacccagctggtttcatggatgttgtgtcaattcccaagacaaatgagaacttccgtctcctttatgacaccaagggtcgtttccgtatgcactcaatcagggatgaagaagcaaagttcaagctgtgcaaggttagatctgttcagtttggttcaaagggtatcccctacatcaacacctatgatggccgaaccatccgctacccagaccctcttatcaaggctaatgacaccatcaaactagacctagaggcaaacaagattgttgactttatcaagtttgatgttgggaatgttgtcatggttactggtggaaggaatagaggtcgtgttggagtcataaagaacagggagaagcataagggtagttttgagaccatccatgtgcaagattctcttggtcatgagtttgcaactaggttgggtaatgtgttcaccattggcaaaggaacaaagccatgggtgtcacttccaaagggcaagggtatcaaattaaccatcattgaggaggccaggaagaggcttgctgctcaacaagctgcttaattaaaagagagtgaatttatgcttaaattaacctttttgtgccatcattgctgttttgtttgttttctcaagagatagttgaatttattctataggacctctcgtttaatttatattatcggcacatttttgaagtaaacctgtttttgttcctctgtttttatattattattttcctagaaaaaaaaaaaaaaaaaaaggccg

SEQ ID NO: 4089 - DNA, 1266 bp, Citrus sinensis
aatacagaaactagggtttagtcaccttctcactcttctcgcggagccaaagagaacagacaagcagccgcagcgaggcagcagcttcaaactcacaaaaatggctagaggattgaagaagcacttgaagaggctcaatgcccctaagcactggatgcttgacaagcttggtggtgcatttgcacctaagccatcatctggtccccacaagtcaagggaatgcttgccattgatccttgtattgcgaaaccgtttgaaatatgctctcacatatcgtgaagttattgctattctgatgcaacgacatgttcttgttgatgggaaggttaggacagataagacctaccctgctggtttcatggatgttgtgtcaattcccaagaccaacgagaacttccgtctcctttatgacaccaagggtcgcttccgtctccattccctcagagatgaggaggcaaaattcaagctttgcaaagttagatcagtccagtttggccagaaaggtatcccatacatcaacacctatgatgggcgtaccatccgctaccctgacccactcatcaaagccaatgataccatcaaacttgacttagaagagaacaagatcactgacttcatcaagtttgatgttgggaatattgtcatggtcactgggggtagaaacagaggtcgagttggaatcatcaagaacagggaaaagcataagggaagttttgagaccatccatattcaagatgcccttggtcatgagtttgcaactcgtctaggcaatgtgttcaccatcgggaagggttcaaaaccatgggtgtcacttcctaagggcaagggtattaagttgtccatcattgaggaagctaggaagagacaggctgcccaggctgctgcttaagcttttacaatgaatttggatgcattttgctgctttgttttttcttgttgaattagagctgattggcactctctaaagctgaagtaggaccgatgcaaaaatgaatctttatttttatttttattttatcagcacaattttgaacctgctttgtccttttttattttagctactatttggtggatgttattttcaactatttaatctaagttcatgtatctctttatcgtttctgtttgtaattttgggcttatggttttccacttttgtatttgaaatgtattaagcattggggtctggttaaacctgaatggggatcagggtacttttcctctctctttcagtgggttttgcacaaatcacaatcaccactgttg

SEQ ID NO: 4090 - DNA, 1177 bp, Arachis hypogaea
ctgccggaggaggaaggagacgattgaagccctagctaggttgcgccctcagatctcgtctcaaacctcgcattctcatcatggcgagaggattgaagaagcatttgaagaggctcaatgcacccaagcattggatgcttgacaaactcggtggtgcttttgcacctaaaccgtcttctggaccacacaaatccagggagtgtctcccactcatactaatcttgagaaacaggttgaagtatgctcttacttatcgtgaagtcatcgctattctgatgcagcgtcatgtccttgttgataacaaggtcaggactgacaagacgtatccagctggcttcatggatgttgtatcaatccccaagacaaatgagaacttccgtcttctttatgacacaaagggcagattccgtctccactcaatcagggacgaggaggctaagtttaagctatgcaaggttcgttcagtgcagtttggtcagaagggtatcccatacctcaacacctttgatggtcgtactatccgctaccctgacccgctcatcagggctaatgacaccattaagctggacttggaggaaaacaagatcgttgatttcatcaagtttgatgttgggaatgttgttatggtcactgggggaaggaacagagggcgtgttggagtgatcaagaacagggagaagcataagggaagttttgagacaatccacgttcaggatgctactggtaacgaatttgcaacccgtatgggaaatgtgttcaccattggcaagggatcaaaaccatgggtttcacttcccaagggcaagggtattaagctgacaatcattgaggaagctaggaaaaggattgcttcacaacaagcagttactgcataaatctccttatggatgaatagacttgagtgtttgctagtttattatttaatgttattgttttcacttagctcgagatttttggctgttgaattttgggtattaaattttgctctatactatgccttgattctgccgtttaatatttatgaacaactttatatcacccatcttcgatttcttttttttatccctttgttagtttcttctcgtaaataatcgatggggcagagtggcacactattgttggttttcttacttaaaacatgtaagaatccagtttatgtggagtgtgtactttgtag

SEQ ID NO: 4091 - DNA, 1045 bp, Prunus persica
atgggccaactcaaaatcggatccgggcttaggtggagcagtaagttgaggcccaagctcagatactctcccggaggtcaagctcacaatcccaaaatggcaagagggttgaagaagcatttaaagaggctcaatgccccgaagcattggatgcttgacaaacttggcggtgcctttgcgcccaagccttcatctgggcctcacaagtccagggaatgccttcccttggtcattatcttacgaaacagattgaaatatgctctcacttaccgtgaggtcatttccattttgatgcaacgacatgttctggttgatgggaaggttaggactgacaagacatatccttcgggtttcatggatgttatttcaatccccaaaacaaatgagaatttccgtctcctttatgacacaaagggtcggttccgtctccactcgatcagggatgaagaggcgaagtttaaactttgcaaagtccggtcagtgcagtttgggcaaaagggtatcccgtacatcaacacctacgatgggcgaaccattcgctaccctgaccctctcatcaaggccaacgacaccattaagcttgacctagagagcaacaagatcactgacttcattaagtttgatgttgggaatgtggtcatggttacaggtggaaggaacagggggcgtgttggagtaatcaagaacagggagaaacacaagggaagttttgagacaatccatgttcaggatgccaccggccatgaattcgctactcggttggctaatgtgttcaccattggcaaggggacgaagccatgggtaagtcttcctaagggaaaaggtatcaagctcactatcatcgaagaggccaaaaagaggcaagcagcccaacaagcatccactgcctaattaattgcgacaccctttttaattttgttgtacttgtgtggtcactgtttttgcggttagacttaaaacaattagttctgaatttgtgcttcaaattttttttccggcttgtttttctcagtactgataaattgttgacctcaattttttataa

SEQ ID NO: 4092 - DNA, 1236 bp, Rhizophora mangle
ggtggtttctccgtggaatagccgcagcggctctcatctcagtcgaagtaccccgtggagagataagtgatctagcaaatccaaaatggcaaggggtttgaagaagcatttgaagaggcttaatgccccaaagcattggatgcttgacaaacttggcggtgcatttgcaccaaagccatcatctggacctcataggtccagggagtgcttgcctttgattcttattttgagaaacaggctgaagtatgctctgacatatagagaagttattgctattctgatgcagcgacatgtccttgttgatgggaaggtcaggacagataaaacttacccttctggtttcatggatgttgtatcaattcccaagacaactgataacttccgactcctttatgacaccaagggtcgcttccgtcttcatcgcatcagagatgatgaggcaaagttcaaactttgcaaagttcgatctgttcaatttggtgacaaaggcatcccatacataaacacctatgatggccgtacaatccgttatccagatcccttgattaaagctaatgacaccatcaagctggaccttgaagccaacaagattactgacttcatcaagtttgatgtgggtaatgttgtcatggttactggaggaaggaacagggggcgtgttggagtgatcaagaacagagagaagcataagggaagctttgagaccattcatgttcaagattctctgggtcatgagtttgccactcgcatgggcaatgtcttcattattggaaaagggaccaagccattggtttctcttcccaagggcaagggaatcaagttgtcaatcattgaagaggctaggaagaggctggcagcccaagctgctgcatgaaaatactgtggttttggtggtttaccttgccattggctgctgcggaaattacttatgttggtctgagtgctagttttctctttaagctgcaatgggtttgtgccttgatgaacgagttgcttttagcatttttcagcaattttgaactatatagttaatgttccagttcaaattttggcaatgttggtgaaaatttggctttatattttcaagttgataaggcatttctccagagttgtttgtctccgttgagtctggtctattcattgtaatttcacggacgaccggtaaatttttagccctcgtatgctgaatttagttattccgtaatgaatacatgtttggatgtttcacaaaaaaaa

SEQ ID NO: 4093 - DNA, 1093 bp, Fragaria vesca
gggtttttagcgtcgtcacttttttctgcagtcaaagagtgacagagctctagccgcggaagctctgatactgaaccggaggtcaagctcaggatcacaaaatggcgaggggattgaagaagcatttgaagaggctcaatgcccccaagcattggatgcttgacaaacttggtggcgcatttgcacctaagccgtcatctggacctcacaagtccagggaatgcctgccattgatcattatcctgcgaaaccggttgaaatatgctctcacttaccgtgaggtcattgccattctgatgcaacgacatgttctggttgatgggaaggttaggactgacaaaacctatccatcaggtttcatggatgttatatcaatcccaaaaacaaatgagaatttccgtctcctgtatgacacaaagggtcggttccgtctccactctatcagggatgaagagtcaaagtttaaactgtgcaaagtccggtcagtgcagtttggtcaaaagaatatcccctacattaatacctatgatgggcgtacaatccgctaccctgaccctctcatcaaggccaatgacaccatcaagcttgacctagagaccaacaagatcaccgacttcatcaagtttgatgttggtaatgtggtcatggtcactggtggaaggaacagggggcgtgttggtgtcatcaagagcagggagaagcacaagggaagttttgagaccatccacgtccaggattcaactggtcatgagtttgcaacccgtttggggaatgtgttcaccattggcaagggaacaaagccatgggtgagtctgcccaagggaagaggtattaagctatcgatcatcgaggaggccagaaagaggcaagcagctctacaagcatcagccgcataagcaattatgagttgtttcagattttgattcgcttgtgcagtgctgttttacagtcgcgcctgaaccattagttatgaatttgtgcctcgaatttttccagcttgtttcttgtgacagtcggattatggattctaatatctgttatgttaatgttgcattggccattagttaactctaaatgtttttctcctcttaaa

SEQ ID NO: 4094 - DNA, 1064 bp, Tabernaemontana elegans
cagcagcagagaagctcagcgccaccggcggcaggcgggtcaccaacatggcaagagggttgaagaaacatttgaagaggctcaatgccccgaagcactggatgcttgacaagctcggaggggcatttgctcccaagccatcttctgggccacataaatcaagggagtgcttgcccttgatccttatcctgcgaaacaggctaaagtatgctcttacctaccgtgaggtcattgccatcttgatgcaacgacatgttatggttgatgggaaggtcaggacagacaagacttatccttctggcttcatggatgttgtttcgattcccaagacaaatgagaactttcgtctcctctatgacaccaagggtcgtttccgtctgcattcagtcagggatgaggaggcaaagttcaagctttgcaaggtgcgatcagtccaatttgggcagaagggaattccattcctaaacacttatgatgggaggaccatccgctatcctgatcctctcattaaggccaatgacaccatcaagttggatttggagagtaacaagattgtggacttcattaaatttgatgtgggaaatgttgtcatggtgactggtggaagaaacaggggacgtgttggagtcattaagaacagggagaagcataagggtagctttgagacaatccacatccaggatgccactgggcatgaatttgctactcgcctaggaaatgtctttacaattggaaaaggtaccaagccctgggtgtctctacccaagggcaaaggtattaaattgtccattattgaggagcaacagaagagacttgcttcccaatcagctgctactgcctaatgctttgatgggctgcttcttgtctttgttctgctattacatgggcaagtttaggcggtatctagttttgcaggttttctgttttaagcagttattcaatgttcaactttcaatggtactgtaattttgcatttcgagtagctatgcttgcttgttcttgtctcgggataaaggtgaattagacaattttgagtataatatcacaatttgatcatattctcg

SEQ ID NO: 4095 - DNA, 983 bp, Utricularia gibba
aggttctagatcccatggcgaggggattgaagaagcacttgaagaggctcaatgccccgaagcattggatgctcgacaagctcggtggagcatttgcacccaaaccatcatccgggccacataaatccagggagtgcttgccgttgattctcattctgcgaaataggctgaagtatgctttgacctaccgtgaagtcattgcaattttgatgcagcgcctggtccttgttgataacaaggtcaggactgacaagacatatcctgcaggattcatggatgttgtctctattccgaagaccaatgaaaatttccgccttctgtatgacaccaagggccgcttccgtctccattctatcagagatgaggaggcaaagtttaagctttgcaaagtgaggtcggtccagtttggaaagaagggtattccatacctgaacacctacgatggcaggactatccgctaccctgatccattgatcaaggccaacgacaccataaagctggacttggaggagaacaagatcgttgatttcatcaaattcgatgtggggaatgtcgttatggtcactggtggaagaaacagaggccgtgttggtgtgatcagaaacagggagaaacacaagggaaccttcgagacaatccacgtcgaggacgccaccggacatgctttcgccactcgtctgagcaatgtcttcactattggcaagggcacaaagccctgggtgtcactccccaaaggtaaaggcatcaagttgtccgtcatcgaagagtccaggaaaaggctcgcagctcaagccgccacctcttaggctgaaattggtggtgtatctctctcttttcctgcgctctgctaaactcctcctttcaaggctttttattccatgacttgttcttttcattcaccagacttgtgcattgcacctccactgttgtcatgacctcgatcttcttctggttttgatgggcgctcgcatagaggcttgtga

SEQ ID NO: 4096 - DNA, 1061 bp, Vinca minor
acaataagccctaggagcggagcggcggcggcgattcaagctttccggtcaccaacatggcgagaggtttgaagaagcatttgaagaggctcaatgccccgaagcactggatgcttgacaagcttggaggagcatttgcacctaagccatcttctgggccacacaaatcaagggagtgcttgcccttgatccttatcttgcgaaacaagttgaagtatgcccttaactacagagaagtggtttccatcctgatgcaacgacatgttatggttgatgggaaggtcaggaccgacaagacttacccttctggctttatggatgttatttccattcccaagacaaacgagaacttccgtctcctttacgacaccaagggtcgtttccgtctccattccctcagggatgaggaggcaaagttcaagctttgcaaagtgcgatcagtccagtttgggcagaagggaattccattcctgaacacttatgatggaaggaccatccgctatcctgatcctctcattaagcccaacgataccatcaagttggatttggagagtaacaagatcgttgacttcattaagtttgacgtgggaaatgttgtcatggttactggaggaagaaacaggggtcgtgttggagtcattaaaaatagggagaagcagaagggtagttttgagactatccatgtccaagatgccactggacatgaatttgctactcgtcttggaaatgtgtttacaattggaaaaggtaccaaaccctgggtctctctacccaagggcaaaggtattaaattgtccattattgaggagcaaaagaagagacttgctgcttctcagtctgctgctactgcttaaagcttttcttgagatgccgttgtctgtctttctccatcttaatttagatgctagttttctctggtgaagttttttggttttaacaaatgatacaattttggacttcctatagtactgttattttacatttgaagtagctatgctcgtttctgtctttatttttggattaatttttttttaagttgtatgattctgattactattttt

SEQ ID NO: 4097 - DNA, 1241 bp, Cajanus cajan
taaggattagggtttaaagagacgcactcttgctatttgttttcagtttcggtggtgtcgtagcagcgaagctcggagcttagtttctgactcgaagatggcaagaggattgaagaagcatttgaagaggctcaatgccccaaagcattggatgcttgacaaactgggtggtgcatttgctcctaagccctcatctggaccccacaaatctagggaatgtttgccacttatactcatattgcgaaaccgtctgaagtatgctctgacataccgtgaagtcattgctattctgatgcagcgacatgtccttgttgatggcaaagtcaggacagacaagacatatccttctggtttcatggatgttgtatctatccctaaaacaaatgagaactttcgcctgctgtatgacacaaaaggtcgattccgtctccactcagtcagggatgaggaggctaagttcaagctctgtaaggttcgctcagtgcagttcgggcagaaaggtatcccatacctgaacacctatgatggtcgaactatccgctacccagatcctctcatcagggccaatgataccattaagctagatttggaggaaaacaagattgttgatttcatcaaatttgatgtgggtaatgtagtcatggtgaccggtggaaggaacagagggcgtgttggagtgataaaaaacagggagaggcataagggtagctttgagactatccatgttcaggatgccactgggcatgaatttacaactcgtatgggcaatgtgttcactattggcaagggcacgaaaccatggatatctcttcccaagggtaaaggtattaagctatcaatcattgaggaagctaggaaaaggattgctgcccaacaagcaactgctgcttaaacctttttaggatatgaatagacttgagtgcttggtattttttgttcaatggtttttgtttctaatttatttttctcgagattttatctgttgaattttgtctcttaaatgcactatagaacttttattgtggcggctatattcatgaaggaatctttccattcctggttttgatgtagtttaaatcggataaattacttaagcaagtccactctaaagaaatatcggaataacttctcttgggaagggatcatgttgctatggaatatggttggttatttatttgagtactatattgagtgattaaattaacttgggagttgggttttgccgtggctagtattatgaa

SEQ ID NO: 4098 - DNA, 1224 bp, Citrus sinensis
ccacgcgtccgagctagcagcgcttgtgagtgcatttttcacttcgtttttgttttgcaggactgtgacacgccgttggcgaatccaagctcaggctcacgaacacaaaaatggcgagaggtttgaagaaacatttgaagaggcttaatgccccaaagcactggatgcttgacaaacttggtggagcatttgctcccaagccttcatctgggccacacaaatcaagggagtgtttgcccttaattcttatcttacgtaaccgcttgaagtatgctcttacataccgagaagtcattgcaattttgatgcaacgacatgtgttggttgatgctaaggttcgcacagataagacttaccctgctgggttcatggatgttgtgtcaattccaaagacgaatgagaacttccgtctcctttacgacaccaagggccggttccgccttcattcaatcagggatgaggaggctaagttcaagctctgcaaggttcgatcagtgcaatttgggcagaagggaatcccttacatcaacacttatgatgggaggactattcgctacccagacccactcatcaaggccaatgataccatcaagctggacctggagactaacaagatcaccgagttcatcaagtttgatgttggaaatgttgtgatggtgactggagggagaaacagaggacgtgttggaatcattaagaacagagaaaagcataagggtagctttgaaactatccacatccaggatgctcttggtcatgagtttgcaactcgtcttggaaatgtgttcaccattggcaagggtacaaagccatgggtttctcttcccaagggcaagggtattaaactatccatcattgaggaggcaaggaagagacaagccctggcgacttcagcagccgcccaatgatgataaacttcatggtctttgcgatatggttttagaaagtttactagatgaaagttttgcagtttgacacttttgtgattgcttgttcgattttcttgttggtgatactagttatcataaagtttttgagtcgtaatactggtttcaattttagttttgtgatgaaacaggtgactcttttattttatcagcggcaatattattggcaatgaatttttggcccaaaaaaaaaaaaaaaaagggggggcccccccctcaaaaaggaatccaagccttaaagttaacccgggtggtagggcaacagttcaaaacctct

SEQ ID NO: 4099 - DNA, 1041 bp, Jatropha curcas
aacactctgggcgaagtttgctggcggcgattttctttctgaggacggagagaagaaaccagcgtaaaaatggcaagagggttgaagaaacacttgaagaggcttaatgccccgaagcattggatgctagacaaacttggtggtgcatttgcacccaaaccatcatctggacctcataagtccagggaatgcttgcctttgatccttattctgcgaaacaggctgccgtatgctctcacataccgtgaagttattgctattctgatgcaacgacatgttcttgttgttgggaaagttaggacagataaaacttaccctgctggtttcatggatgttgtatcaattccgaagacaaatgagaacttccgtctcctctatgacactaaaggcagattccgtctccactctgttagagatgaagaggctaagtttaagctttgcaaggttcggtctgttcaatttggccaaaagggcatcccttacttgaacacctatgatggccgcaccattcgctatccagatcctctaataaaggctaatgacaccatcaagctagaccttgagagtaataaaattactgacttcattaagtttgatgtgggaaatgttgtcatggtgactggagggagaaacagggggcgagttggtgtcattaaaaatagggaaaagcacaagggtagttttgagactatccatatccaagacgcaactggccacgagtttgccactcgcttgggcaatgttttcactattggaaaggggaccaaaccgtgggtctctcttcccaagggtaagggtatcaagctctcgatcatcgaggaggcaagaaagaggcaggcagcagcagctcaaacagttgcatgatattgtgttgaaatgtttagaacagtattttgatagcattttgaaaattttatttgagtttttgatgctagagtttgttggcttttgactattgttgctttacattttaaacttttttaaggtttttgaagggattaattaaaatatcaaatgaagacttttttttgcatggtcatg

SEQ ID NO: 4100 - DNA, 1194 bp, Citrus sinensis
aagtagggcatcaagctcaaacttccgtgtcctatatctatctaaatgccaatgttagggttttgcgggagtggagctagcagcgcttgtgagtgcatttttcacttcgtttttgttttgcaggactgtgacacgccgttggcgaatccaagctcaggctcacgaacacaaaaatggcgagaggtttgaagaaacatttgaagaggcttaatgccccaaagcactggatgcttgacaaacttggtggagcatttgctcccaagccttcatctgggccacacaaatcaagggagtgtttgcccttaattcttatcttacgcaaccgcttgaagtatgctcttacataccgagaagtcattgcaattttgatgcaacgacatgtgttggttgatgctaaggttcgcacagataagacttaccctgctgggttcatggatgttgtgtcaattccaaagacgaatgagaacttccgtctcctttacgacaccaagggccggttccgccttcattcaatcagggatgaggaggctaagttcaagctctgcaaggttcgatcagtgcaatttgggcagaagggaatcccttacatcaacacttatgatgggaggactattcgctacccagacccactcatcaaggccaatgataccatcaagctggacctggagactaacaagatcaccgagttcatcaagtttgatgttggaaatgttgtgatggtgactggagggagaaacagaggacgtgttggaatcattaagaacagagaaaagcataagggtagctttgaaactatccacatccaggatgctcttggtcatgagtttgcaactcgtcttggaaatgtgttcaccattggcaagggtacaaagccatgggtttctcttcccaagggcaagggtattaaactatccatcattgaggaggcaaggaagagacaagccctggcgacttcagcagccgcccaatgatgataaacttcatggtctttgcgatatggttttagaaagtttactagatgaaagttttgcagtttgacacttttgtgattgcttgttcgattttcttgttggtgatactagttatcataaagtttttgagtcgtaatactggtttcaattttagttttgtgacgaaacaggtgactcttttattttatcagcggctatattattggcaatgaatttttggccc

SEQ ID NO: 4101 - DNA, 1099 bp, Ananas comosus
agacgaagcaaagagaaagccgcgagagggagatagagcgagagggaggcgcagggggagatccacaaaaatggcaagaggactgaagaaacatctgaagaggctcaatgccccaaagcattggatgttagacaagcttggtggtgcctttgcccccaagccatcatctggtcctcacaaggccagagaatgcctcccacttattcttattttgaggaacaaactaaaatatgctctcacataccgtgaggttattgcgattttgatgcaacgccatgtaatggttgatggaaaagtcagaactgacaagacttatccagcgggtttcatggatgttgtttcaattcctaagacaaatgagaacttccgactactttatgacacaaaaggccgcttccgcctgcactccataaaggatgaagaggcaaagttcaagctttgcaaggtccgctctgtccagtttggccagaagggcatcccctacctgaacacgtatgacggtcgtacgatccgctaccctgatccgctgatcaaggcgaacgacaccatcaagcttgatcttgaggccaacaagattgtggacttcatcaagtttgacgtggggaatgtggtaatggtgacaggtggcagaaacacaggccgggttggtgtgattaagaaccgcgagaagcacaagggcagcttcgagaccatccacattcaagatgctaccgggcatgagttcgccacccgtcttggcaacgtgttcactattggtaaagggacgaagccgtgggtgactcttcctaagggtaagggtatcaagctcagcattattgaggaggctaggaagcgcttggctgctgctggtgcgactgccgctgcttcataatcgtggtccgtcaactgattaatcttttgtttgagcatgatccatcaactgattaatcttttgtttgagcatgatcttatttgagatcttgttgaatatgaattggtgattgaacttctttctgtgggatttgaccgtgttagatctatctcgagttgtgagatctatctcgagttgtgactcgccttaagtagggaatggaattcatatcatataattcttgtttgc

SEQ ID NO: 4102 - DNA, 1603 bp, Cannabis sativa
ctctttaaccctaaaacccttctcatagtataaatcaagtcgtcaccgccgctcactcttctccttttaagctaccacactttcctctgcgctagggtttctacatctgcctccgttctcccaaaatggctagaggattgaagaaacatttgaagaggctcaatgcccccaagcattggatgctcgacaagcttggtggtgctttcgctcccaaaccatcatctggaccacacaaatcgagggagtgcttgcccttgatcctcattctgaggaacagattgaagtatgccctcacataccgtgaagttcaatctattctgatgcagcgacatgtcatggttgatggcaaggtcaggactgataagacctacccatctggtttcatggatgttgtttccatcccaaaaaccaatgagaacttccgtcttctttacgacaccaagggtcggtttcgccttcactcagtcagggacgacgaggctaagttcaagctctgcaaggtgaggtcagttcagtttggacagaagggaatcccctaccttaacacctatgatggacgaaccatccgctaccctgaccctctaatcaaggctaatgacaccatcaagttggatttggaggccaacaagatcactgatttcattaagtttgatgtgggtaatgttgtcatggtgactggtggccgtaacagagggcgtgttggtgttattaagaaccgagaaaaacataagggtacctttgagaccatccacgttcaggatgctcttggccatgagtttgctacccgtcttggtaatgtgtttaccattggtaagggaacaaagccctggatctctcttcccaagggcaagggtatcaagttgactatccttgaagaagctaagaagagattggcagcccaagctgctgctactgcttgattttcacggtagcaattacagattattgtctttaaattatagttcaattaggataattctgtttagttttcatctcaattaaggattttatgctttacatttttcattatggttttggaaagtaattttgctgcttgaattttgttgaagtttgtatcagagaatttttatcagactcaccctcagttttgcagtttgaacatcttagtatgatttaagcttctgattctgtctctcaatcagttgctagatttcattcattttagtttaccattagtgtttagttctagatctgcaatatcttacacttataaacgagaataagattaagataaagctttggaaggttaaaagaccaaatttgtttttgctgacgaaatacttcatttttatcttttagttaatgaaccttgctgaaaatgataatacacgacgtcacacagttgtaggcaaataaccattgttgcataaaattatgtttttaaaaccattgcagtgtgtttgttcatagttattttctcttgtaaaatcttttatttcattacaactcaattcaattgtatattcttttacgtgttttcttattttgggatatgcccatgacaatgttggatgcgcatcaaattgcctatactaaactaacattacaagagggcataagcttatttctaattccatgaacc

SEQ ID NO: 4103 - DNA, 1048 bp, Gossypium hirsutum
attttcttaagaagaacaactttcagcggaaacagccgcttcctccaacatggctagagggttgaagaaacacttgaagaggctcaatgcccccaggcattggatgctcgacaagcttggtggtgcattcgcgcccaagccatcgtctggaccccacaagtcgagggaatgtttgccacttattctcattctgcgaaacagactgaagtatgctttgacatacagagaagtgattgctattcttatgcaaaggcatgttatggtagatgggaaggttaggactgataagacctaccctgcaggttttatggatgttgtgtcaattcccaagacaaatgaggacttccgtctcctttatgacactaaaggtcgtttccgccttcatgccatcactggtgatgagactaagtttaagctctgcaaagttaggtctgtccaatttggccagaagggtattccatacctgaatacctacgatggacgcacaatacgctacccagaccctttgatcaaagccaacgacaccatcaagcttgacttagagagcaacaaaattgttgatttcattaagtttgatgttgggaatgttgtcatggtcactggtggaaggaacaggggacgtgttggagtgattaagaacagggagaagcataagggtagcttcgagacaatccatgtacaagatgctgctggacacgagtttgcaactcgtctaggcaatgtcttcacaatcggtaaaggaacaaagccatgggtttcgcttcccaagggcaagggtatcaagttgtcgatcattgaggaagcgaggaagaggcttgctgctcaggctgctgcttaaacctatcatatctggagttttttttttgtcgaaagacttgttggatgaatgctggctggtcctgtcctagcttttgtagggtttatggatttgctttttattaatgtttttttttctatgaatttagtttagttactcatttggtttatgttatattttaactatcatttatcacattacagttctttctgaaatctattgttttacttg

SEQ ID NO: 4104 - DNA, 1149 bp, Gossypium raimondii
ataagttaaaacaaagctagggttttgtctccctcttgctcgcattttcttaagaaagaacaactttcagcggaaacagccgcttcctccaacatggctagagggttgaagaaacacttgaagaggctcaatgcccccaggcattggatgcttgacaagcttggtggtgcattcgcgccaaagccatcgtctggaccccacaagtcgagggaatgtttgccacttattctcattctgcgaaacagactgaagtatgctttgacatacagagaagtgattgctattcttatgcaaaggcatgttatggtagatgggaaggttaggactgataagacctaccctgctggttttatggatgttgtgtcaattcccaagacaaatgaggacttccgtctcctttatgacactaaaggtcgtttccgccttcatgccatcactggtgatgagactaagtttaagctctgcaaagttaggtctgtccaatttggccagaagggtattccatacctgaatacctacgatggacgcacaatacgctacccagaccctttgatcaaagccaacgacaccatcaagcttgacttagagagcaacaaaattgttgatttcattaagtttgatgttgggaatgttgtcatggtcactggtggaaggaacaggggacgtgttggagtgattaagaacagggagaagcataagggtagcttcgagacaatccatgtacaagatgctgctggacacgagtttgcaactcgtctaggcaatgtcttcacaatcggtaaaggaacaaagccatgggtttcgcttcccaagggcaagggtatcaagttgtcgatcattgaggaagcgaggaagaggcttgctgctcaggctgctgcttaaacctatcatatctggagttttttttttgtcgaaagacttgttggatgaatgctggctggtcctgtcctagcttttgtagggtttatggatttgctttttattaatgtttttttttctatgaatttagtttagttactcatttggtttatgttatattttaactatcatttatcacattacagttctttctgaaatctattgttttacttggattcgtccttttcttttgtgataagttcctttatgctaaggctaaggcatggtttt

SEQ ID NO: 4105 - DNA, 1075 bp, Elaeis guineensis
ctctgacctttctttccaagagccgaacgggatctccgcgcgacttccagctcttgcagcaggaggagaaggtggagatctaaaacaacaatggcaaggggattgaagaagcatctgaagaggcttaatgccccaaagcattggatgctggacaagcttggtggtgcctttgcccccaagccatcttctggcccacacaaagcaagggagtgtttgcccctcattctgatcctaaggaataggttgaagtatgctcttacttatcgtgaagtcattgcaattctgatgcaaagacatgtaatggttgatggaaaggtcaggactgataagacctatccatctggtttcatggatgttgtatcaatacctaagactaatgagaactttcgtctcctctatgacaccaaagggcgattccgtctccactcgatcagggatgaggaggctaagttcaagctatgcaaggtccggtctgttcaatttggtcagaaaggcattccttatctgaatacttttgatggtcgcacaattcgttatccagaccccctgattaaagctaacgacactattaagcttgatctggaggctaacaagatcgttgacttcatcaagtttgatgttggaaatgttgtcatggtgactggtggaaggaacaggggacgtgtgggtgttatcaagaacagggagaagcacaagggtagttttgagactatccacctccaagatgcacttggtcatgagtttgcaactcgtattggcaacgtcttcaccattggcaaggggacaaagccatgggtttctcttcccaaaggcaagggtatcaagctcagcatcatcgaggaggctaggaagcggctcgccgcctctggtgctgctgctaccgtctgagtattgagcatgcttccatattttgtaagggatattcagatgtattttgtggacatgcaaggggggatgttttgagcccttttagttgttggtgtcaaattttccaagttttgtttgctttgaaatagggatatcagaccttttagttctcttaaattcaattaacagccagatagtgcttggtttt

SEQ ID NO: 4106 - DNA, 1112 bp, Capsicum annuum
tcagcatagtagtggagaaatccaaaatggctagaggtttgaagaagcatctgaagaggctcaatgccccgaagcattggatgcttgataagcttggtggagcatttgctcccaagccgtcttctggtccgcacaaatcaagggaatgcctgccattgatcattatcttgcgaaacaggttgaagtatgctctcacataccgagaggtgatctctattctgatgcaacgacaagttctggttgatgggaaagttaggacagacaagacatatccagcgggtttcatggatgttgtttcaattccaaagactaatgagagcttccgtctcctttatgacaccaagggccgatttcgtcttcactcactcagggatgaggaagccaagtttaagctttgcaaggtccgctcggtgcagtttggtcagaaggggattccatacttgaacacttacgatggaagaacaatccgctatcctgatcctctcattaaggccaacgatacaataaagctggacttggaatctaacaagattgttgatttcatcaagtttgacgttggcaatgttgtgatggtgactggaggtagaaacagaggacgtgttggtgttattaagaaccgggagaagcataaaggtagctttgagaccgtccacattcaggatgcacaaggtcatgaatttgctacacgtttgggtaatgtgttcactcttggcaagggtactaagccgtgggtttcactacctaaaggtaaaggaattaagttgtccatcattgaggaggcacggaagaggctggctgcacaatccgccaccactgcttaaaactgtcgcagattcttcatcctctgtcagcgtggataaagttaagttttgtagtttttgtagtcgatatgtttcactttgtttactaatacatattctattctgcgagcaaccttttgaagatttgtgttggttctagcatgcctagcattttgacgacaagatgattagactactttatggaccaaatcacgttctttttgttctggatttgaaagagtcccctttcctctccttccccagtttctttaagccatcaaatagtagttaagatgctaggttaaaaaaaaa

SEQ ID NO: 4107 - DNA, 934 bp, Rosa hybrid cultivar
gagcagcagcagaaggagtttcggccgccggcgggagatcaagctcacaaaatggcgcgaggactgaagaagcatttgaagaggctcaatgccccgaagcattggatgcttgacaaattgggtggtgcatttgcccccaagccctcatctggacctcacaaatccagggaatgtcttccgttgatcattatcttgcgaaaccggttgaagtatgctttgacataccgtgaggttattgccattttgatgcaacgtcatgttatggttgatgggaaagttaggactgataagacttatccttctggtttcatggatgttgtctcaatccccaagacaaatgagaatttccgtctcctttatgacaccaaaggacggttccgtctgcattcaatcagggatgaagaggcaaagttcaaactctgcaaggtccgttctgtgcagttcggccaaaagaacatcccttacattaatacctatgatggaagaacaattcgttaccctgaccctctcatcaaggcaaatgacaccatcaagctggatttggagaccaacaagatcgtcgactttatcaagtttgatgttggtaatgttgtcatggtgacaggtggtaggaacagagggcgagttggagtaatcaagaacagggagaagcataagggaagctttgagactatccatgtccaggacgccactggacatgaatttgcaacccgtttggcaaatgtgttcacgattggcaaggggaccaagccatgggtaagccttcccaagggtaagggtattaagcttaccatcattgaggaggctaagaagaggcaagcagcccaagccacagctgctgcttagatgattttggtgaaaacaatttaagcttatttgaagaatttcactagaactattgtaatttttactaaattagcgttggagtttcggc

SEQ ID NO: 4108 - DNA, 1062 bp, Eutrema halophilum
gccgcagaagaatcagaagtcgtcagctccggaacacctgcaaacatggcaagaggattgaagaagcatctaaagaggctcaatgcccccaaacattggatgcttgacaaacttggcggtgccttcgcccccaagccatcttctggacctcacaagtcgagggagtgtcttcctcttgtcctaatcatcaggaacaggttgaagtatgctttgacataccgtgaagtgatctccatcctgatgcagaggcacatccaagttgatggaaaagtgaggactgacaagacgtaccctgctgggttcatggatgttgtatcgatccccaagacaaatgagaacttccgtcttctgtatgacaccaagggacgtttccgtcttcactccatcagggacgaggaagctaagttcaagctttgcaaggttaggactatccagtttgggcagaagggaattccttacctgaacacttatgatggtcgcactatccgttaccctgacccgctcatcaagccaaacgacaccatcaagctggatcttgaggagaacaagattgtggagttcatcaagtttgacgtgggaaacgttgtgatggtgactggaggcagaaacagagggcgtgtgggtgtgattaagaaccgtgagaagcataagggaagcttcgagacgatacacatccaagactcaacaggtcatgagtttgccacaaggttgggcaatgtgttcacaatcggcaaaggaacgaagccgtgggtgtctcttccaaagggcaaaggtattaagctgtccatcattgaggaagccaggaagaggctttctgcacaacaagctgcttaaaaaacgtgaatcatcaaaggccgtttcgtgttactcttgtgttatagactcgcttcttgcctcagttttgaagctttttcctatttcatgttgttggtttgcaagacccggttataaaaaaacagctgaaaattccattagagcgttttgtaatgtttgtatggattttagtaatttactcattaaattcagttgacttaaataaattaaaagctaaacaatgttgct

SEQ ID NO: 4109 - DNA, 1057 bp, Eutrema halophilum
ttaaaattagggttttatgcttggttcttcaacccctagtgaaatagattactgcagagagagctggcttgtttagccgcggaggactcggaacgcattctctgcaaacatggcgagaggtttgaagaagcatctgaagaggcttaatgcccctaagcattggatgcttgacaaacttggtggtgcctttgcccccaaaccgtcttctggtccacacaagtctagggagtgcttaccccttgtccttatcatcagaaacaggttgaagtatgctctgacatatagagaagtgatttcgatcttgatgcaaaggcatattcaagttgatgggaaagtgaggactgacaagacctaccctgctggtttcatggatgttgtgtctatcccaaaaacgaatgaaaacttccgtcttttgtatgataccaagggacgcttccgtcttcactccatcagggacgaggaagcaaagttcaagctatgcaaggtgagatctatccagtttggtcagaagggcattccctacctgaacacatatgatggtcgcaccatccgttaccccgacccgctcatcaagccgaacgacacaatcaagctggacctcgaggagaacaagattgtggagtttatcaagtttgatgtgggcaacgtagtgatggtgactggaggaagaaacagagggcgtgttggtgtgataaagaaccgtgagaagcacaagggaagctttgaaaccatccacattcaagactcaacagggcatgagtttgctacaaggctggggaacgttttcacaattggtaaaggaacaaagccatgggtttctcttcccaaaggaaaaggtatcaagctgaccatcattgaggaagccaggaagagactttctgctcaacaagctgcttaaaactatacactcattccccagttgtcagaacaaattaaagccttttctttttatgcctgttagagtttacctgtcttttgggatcactatgaactattttttggatcttttgtgctatcaattatgacttggaacttcgacttggtttcttctgatagt

SEQ ID NO: 4110 - DNA, 1175 bp, Eutrema halophilum
ggcttcagcataatcgtagataagaagaaggtgagtggagaaagaacggctgcttcagccgtcggaggaatcagaacgcattcggagattcacctgcaaacatggcaaggggattgaagaagcatctcaagaggcttaatgcccctaagcattggatgctcgacaaacttggtggtgcctttgcccccaaaccatcttctggaccacacaagtcgagggagtgccttccccttgtgcttatcatccgtaatagattgaagtatgctctcacataccgtgaggtgatttcaatcttgatgcaaagacatattcaagttgatgggaaagtcaggactgacaaaacataccctgctggtttcatggatgttgtgtctatccccaaaacaaacgaaaacttccgtcttctgtatgacaccaagggacgcttccgtctccactccatcagggatgaggaagcaaagttcaagctgtgcaaagtgagatctatccagtttggtcaaaagggcattccatacctgaacacctacgatggtcgcaccatccgttaccccgacccgcttatcaagcctaacgacaccatcaagctcgacctggaggagaacaagatcgtggagttcatcaagtttgatgtgggaaatgttgtgatggtgactggaggaagaaacagagggcgtgttggtgtgatcaagaaccgtgagaaacacaagggaagctttgagaccattcatattcaggactcgacgggacatgaattcgccacgaggttagggaatgtgttcactattgggaaagggacaaagccatgggtgtctcttccaaagggaaaaggtattaagcttaccatcattgaggaagctaggaagaggctttctgctcaacaagccgcttaaactgttttttcctcggtttcagaagactgttgttttttgcatcgttttatttctcatacttatgcctttagaattcctttttttttgtcgactatttaagcttgtgatatttttttcaaaatagaaaatgatgctcttgatatttcctggtccacttacgtcttacgaatcttttttcaagctatgagctagtaatatccattgtaaaacaaagtaccttcgaccaagaaaaaacaaataggcctaaagtttttatgtatgtgaatgagtgatgttgatttgctc

SEQ ID NO: 4111 - DNA, 1030 bp, Eutrema parvulum
ctctcacttcttcaccagtcgttcagagctaaacgagagaagtcgtctggatcggagctaagcttgcaaactccaaacatggcgagaggtttaaagaagcatttgaagaggctcaatgcccccaagcattggatgcttgacaaacttggtggcgcgtttgcccccaagccatcttctggaccccataagtcgagggagtgccttcccctcgtccttatcatcaggaacaggttgaagtatgctctaacctaccgtgaagtgatctccatcttgatgcaaaggcatatccaggttgatggtaaagtgaggactgacaagacctaccctgctggtttcatggatgttgtgtctatcccaaagacaaacgagaacttccgtcttctctatgataccaagggacgtttccgtcttcactccatcagggatgaggaagcaaagtttaagctttgcaaagtcagatctatccagtttggacagaagggcattccttacctgaacacatacgatggtcgcaccatccgttacccagacccactcatcaagcctaatgacaccattaagctcgacctggaggagaacaagattgtagagttcatcaagtttgatgtaggcaatgttgtgatggtgactggaggaagaaacagggggcgtgttggtgtgattaaaaaccgtgagaaacataagggaagctttgagacaatccacatccaagactcaacaggacatgagtttgcaactaggttgggaaatgtgttcaccataggcaaaggaacaaagccgtgggtctctcttcctaagggtaaaggtattaagctgaccatcattgaggaagccaggaagaggcttgctggccaacaggctgcttaattttgtgatttccagctctttcttatgtggttttagacgtcttatatttcctagactcgctttgcatcttttggttcgctgctcagttttgaaacttgacgttattttttctatttcaagagttagaaaacttcaagccctatacttatgccctgttttcatt

SEQ ID NO: 4112 - DNA, 1012 bp, Citrullus lanatus
ggctagaggactgaagaaacatttgaagaggctcaatgctccaaagcattggatgcttgacaaacttggtggtgcatttgcccccaaaccttcatctggacctcataagtcaagggaatgcctcccattgatccttatattgaggaaccgactgaaatatgctctcacatatcgtgaggtaattgccattttaatgcaaaggcatgttttggtggatgggaaggtcaggacagacaagactttccctgctggtttcatggacgttgtgtcaattcccaagacaaacgagaattttcggcttctttatgacacaaaaggtcgtttccgtctacactcagttagggatgaagaggctaagtataagctgtgcaaagttcgctcagtgcagtttgggcaaaagggcatcccttatctgaacacatacgatgggcgcacaatccgttaccccgaccctctgatcaaagcgaatgacaccatcaagctggaccttgactccaacaagattgcagatttcatcaagtttgatgtaggaaatgttgtgatggtgactggtggaagaaacaggggcagagttggagtgataaagaacagggagaagcataagggaagctttgaaacaatccacattcaggatgaaaccggacacgaattcgctactcggctgggcaacgtgttcacaattggcaaggggactaagccatgggtgtccctacccaagggcaagggtattaaattatccatcatcgaagaagctaggaagaggctggcaagccaagccgcagttactgcttaagacttagtgtagtgtagtcaaggatgaaaggtgagattttgcccttatttattgttttttttttggttaagtagatctctccccaaaaatgctaatgctttgttatttctactaaattgtgcggggttctctatgattttgtcattccaagactctttgcttcatgaggttacttgtttttctggtaaatggaaaattccttctaacttgtattcgttt

SEQ ID NO: 4113 - DNA, 1108 bp, Malus domestica
tctccgccgtttcgtccctctgtatcctcctcctcgcctagggtttctgcatcccactctgcaaacatggctagaggactgaagaagcatttgaagaggctcaatgccccaaagcattggatgctcgacaagcttggtggtgcttttgcccccaagccatcatctggtccccacaaagccagggagtgccttcccctggttcttattctgaggaacaggttgaagtatgcactcacataccgtgaggttgtttcaattctcatgcagcgccatattttggttgacggaaaggttaggactgacaagacttacccttctggcttcatggatgttgtttcgatcccaaaaacaaatgagaatttccgtctgctctttgacaccaagggtcggtttaggctccactcaattagagatgaggaggccaagttcaagctctgcaaggttcgatcagtgcagtttgggcagaagggcatcccctatcttaacacttttgatggacgcactattcgctaccctgacccgctcatcaaggccaatgacactatcaagctggacttagaggccaacaagatcactgacttcattaagtttgatgttggtaatgttgtcatggttactggcggaaggaatagggggcgtgttggagtcattaagaacagggagaagcataagggaagctttgaaactatccacgtacaggatgccctcggacatgagtttgcaacccgtcttggtaatgtgttcaccatcggcaagggtacaaagccatgggtgtctcttcccaagggcaagggtatcaagctaagcatcattgaagaggcaaagaagcgacaagcggccgcccaaacagctgctactgcttaaacaatatggcgtcgactatagattgttgttcctgtagttttagaatggtacttagttgaagcagttcgactcttttcagcttatgctcgagggattttattttcttttgttttgtggcctgcgttacgttatggattatgagatgctgtactggcttgaatcttgttatgttttgtgctggaatgagatgtgtattgaaccatttttaatcagcttgctgcctatattatgcggatatttgcgt

SEQ ID NO: 4114 - DNA, 1310 bp, Theobroma cacao
ttgaaaaacacaagtttttaatttaaatacggaaaaacgaaaaagagttgggcctaacaagtttaataagttgtaaaggcaatccggcccgtccaacccaagtcggttgaacccctataatgccactatatatacataaaacgaagctagggctttgtctccctcttgctcgcatcctcatacaagaaaggctttcagcggatacagccgcatccccccaaaatggctagagggttgaagaaacacttgaagaggctcaatgcccctaagcattggatgcttgacaagcttggcggtgcatttgcacccaaaccatcatctggaccccacaagtccagggaatgccttccactgattctcattctgcgaaacagattaaagtatgctctgacatatagagaagtgattgccattcttatgcaaaggcatgttatggtagatgggaaggttaggacagataagacctatcctgctggtttcatggatgttgtgtcaattcccaagacaaatgaggacttccgtctcctttatgacacaaaaggtcgttttcgccttcatgcaatcacaggtgatgagaccaagttcaagctctgcaaggttagatctgtccaatttggccagaagggtattccatacctcaatacctatgacggacgcaccatccgctaccctgatcctctgatcaaggctaatgacaccatcaagcttgacctggagagcaacaaaattgttgatttcattaagtttgatgttgggaatgttgtcatggtcactggaggaaggaacaggggacgtgttggagtgattaagaacagggagaagcataagggtagctttgagacaatccacattcaagatgctgctgggcatgagtttgcaactcgtctagggaatgtcttcacaattggtaaagggacaaagccatgggtgtcacttcctaagggcaagggtatcaagttgtccatcattgaagaagccagaaagaggcttgcagcccaagctgctgcataaattttatgatagatatctggagttgtttttgtctaaagaagcacatcagttggatgaatgctggcaggtcctgtgtcttattagcttgtagtgtttatgcttagaatggatgctttgcttttactgatgagcgcagttttggaccatttgttatattgtttttgaaattaagttttattactgttggttatgttgttacatttcaactatcatttatcacatttttttgctaaaatctgttcttctgcttcttgggtatggcttccccttcaattcctctataaataatgatgatttat

SEQ ID NO: 4115 - DNA, 1034 bp, Castanea mollissima
acttctaagagcgcttgagcgaggctgagccacttccccagagatctctagctcacaataccaaaatggctagaggattgaagaagcatttgaagaggctcaatgccccaaagcattggatgctcgacaaacttggtggtgcatttgctcccaagccatcttctggacctcacaaatcgagggagtgcctgccattgatccttatcttgcgaaacaggttgaagtatgctctcacataccgtgaggtcatttccattttgatgcaacgccatgtcctggttgatgggaaggtcaggacagataaaacctatcctgcaggtttcatggacgttgtatcaatccccaaaacgaatgaaaacttccgcctcctttatgacaccaagggtcgattccgtctccactcaatcagggatgaagaggcaaagtttaagctatgcaaagttcgctctgtgcagtttgggcaaaaaggtatcccatacctgaacacctttgatggacgaaccatccgctacccagaccctttaatcaaggccaacgacacaatcaagctggacctggagagccaaaagatcactgagttcatcaagttcgatgttgggaatgtagtcatggtgacaggtggaaggaacagaggacgagttggagtcatcaagaacagggagaagcataaggggacttttgaaactgtccatattcaggatgccactgggcatgaattcgcaactcgtttgggtaatgtgttcactattggcaagggtacaaaaccatgggtatcccttcccaagggtaagggtattaagctaaccatcattgaagaggccaggaagaggcttggagcccaaacagcgtccacagcataagacattgtggtaaaaattgtcatgaagtttaaatgactaagtgttattttgtagtttgattctgaatttttgttccaatttttgtcatgttttccatactttaaagttgaacagccgatcttaaacttttgttattttgaattaaattttgctggacctactagtgttgattgt

SEQ ID NO: 4116 - DNA, 1045 bp, Cucurbita pepo
cagaagctccagctctctatccgcaggcgccggcggcaatctcactgaagggtttttctccgtcgaacatcgtttcgacaatatggcaagaggattgaagaaacatttgaagaggctcaatgctccaaagcattggatgctcgacaaacttggtggtgcatttgcccccaaaccttcatcaggacctcataaatcaagggaatgtctcccacttgtcctcatattgcgaaaccgattgaaatatgctctcacataccgtgaggtaatttcaattttgatgcaacgacatattttagttgatgggaaggtgaggactgacaagacgtatccggctggctttatggatgttgtgtccatccccaagacaaatgagaatttccggcttctgtatgacactaaagggcgtttccgccttcactctgtcagggatgaagaggctaagttcaagctctgtaaggttcgctctgtgcagtttgggcagaagggaattccttatctgaacacttacgatgggcgtaccatccgttatcccgaccccctgatcaaggcaaatgacaccatcaagttggatcttgagtcgaacaagattgctgatttcataaagtttgatgtaggaaatgttgtcatggtgactggtggacgaaacagaggtcgagtgggagtacttaaaaacagagagaagcacaagggaagcttcgagacagtccatattcaggatgcaactgggcacgaatttgcgactcgtctaggcaacgtgttcacacttgggaagggaaccaagccatgggtttccctccccaagggcaagggtataaaactgtccatcattgaagaagctaggaagaggcttgcaagccaggcagcagttactgcttaagagtttttgttgttgtagccatggattttcaatggttttgatttggcacatctgtttcttgaattttgctttcttaactatttatgggtaagttgagatcttttgagacaatttggcacatctatcatgattttgtggttcaaaaatacttacagtggactgaggtcg

SEQ ID NO: 4117 - DNA, 1256 bp, Eucalyptus grandis
ctcatacctccatccaccgtctctctcgcttgctcaaagcggcggaaatcgagtgctactacttcaggaggaccggtggggaagagctccttccgccgtctcgtctgagctgaagcaaccaaaatggcacgtggattgaagaagcatttaaagaggctcaatgctcccaagcattggatgctcgacaagctaggcggtgcatttgcgcctaagccatcctctggacctcacaaatccagggaatgtttgcccttgatcctcattctgcgtaacaggctgaaatatgctcttacgtatcgtgaggtcattgccatcctgatgcagcgccatgttcttgttgacaacaaagtcaggacagataagacttaccctgctggtttcatggatgtggtatcaattcccaagacaaatgagaacttccgtctcctctatgacactaagggccgattccgactccacagcattagggatgacgaggcaaagttcaagctttgcaaagttcgttcaatccagtttgggcagaaaggcatcccataccttaacacctatgatggccggactatccgctacccagaccctgtgatcaaggctaatgacaccgtcaaacttgaccttgaggccaacaagatcactgacttcatcaaatttgatgtcgggaatgttgtaatggttactggaggaaggaacaggggacgtgttggagttatcaagaaccgcgaaaaacataagggaacttttgagaccattcacatccaagatgcacagggccacgagtttgctactcgtttgggcaatgtgttcatcatcggaaagggaacaaagccttgggtctcccttcctaagggcaagggtattaagctgtccatcattgaggaggcaaggaaaaggcttgcagctcaggcatccgcaactgcgtgagtttacttttgatgcatgtgttggattagcagcagactggcagttgttatttagctacaagaggattttgggaagtgggcattttgttttctgttccattgcaattctgactaattttgctctttcgaattagattttcctgtcaatttttatgggcaatttgaggtcatggtatctgttacagtgtgtttctttgcatgcttgatttctgttcctgtttgaggtaacgaaaagattgaggagttattctcgtatagaagaggaaaaggcttatggagagtgtaattacgttgcgccgatgatctattgaatctatgcacaattttatcttttctaag

SEQ ID NO: 4118 - DNA, 1206 bp, Vitis vinifera
gggtgcattattcatcagagcctatataacataaagagtgcggctagggtttatgcctcctctctccgcaagtgtttttgcctgagccgaagttgcagtgggagtggtttctgagcgaacaccgccaacatggctagagggttgaagaaacatttgaagaggctcaatgcccctaagcattggatgcttgacaagcttggaggtgcatttgcacccaagccatcgtctggaccacataaatccagggaatgcttgcccttgatcctcattttgcgaaacaggctgaagtatgcactcacataccgtgaagtcattgctatcctgatgcaacgacatgttcttgttgatgggaaggttaggacagacaagacatacccttctggtttcatggatgttgtatccattcccaagacaaatgagaacttccgtctcctatatgacacaaagggccgattcagactccactcaattagggatgaggaggcaaagtttaagctttgcaaggtcaagggtgtccagtttgggcagaaaggcataccatatctgaacacctatgatgggaggactatccgctacccagatcctctcatcaaggccaatgacaccgttaaacttgacttagaaagcaacaagattgttgatttcatcaagtttgatgttgggaatgttgtcatggtgactgggggaaggaacagaggccgagttggagtcatcaagagcagggagaagcataaggggacctttgaaaccatccacgtacaggatgctaccggtcatgaatttgcaactcgtttgggcaatgtctttaccattggaaaggggacaaagccctgggtgaccctacctaaaggaaagggtatcaaattgtccatcattgaggaggccaagaagaggcttgcagcccaagcatcagcaactgcatgatttatgtgacaaattttctgagaatattataagtcttttaatttgcatttgggtactattaatttgctctcataggatttgttctagagacgtgtcgtttcattttgaactaatttttgttgcaattttggtttaaactgtgttattttcggggatatgggaggcaaatcagaccgttgctcatttttttgtcagatgcttatttgattatgttacgtttttctctttaaggctattccgatgctagtaagatagcaataatatgcttcacagttcacatta

SEQ ID NO: 4119 - DNA, 1220 bp, Vitis vinifera
tgagaattctgggagccatctcaagaggcagagagcagaggagagcagtgcagagatcttcctccagagtaaccaaaccctagaaaatggctagagggttgaagaagcatttgaagaggctcaatgcaccgaagcattggatgctagacaagcttggaggtgcatttgctccaaagccttcatctggacctcacaaatccagggaatgcctgccattgatcctcattttacggaacagattgaagtatgctctcacataccgtgaggtcattgccatcttgatgcaacgacatatttttgttgatggaaaagttaggacagataaaacatatccctctggtttcatggatgttgtctcaattccaaagacaaatgagaacttccgtcttctttatgacaccaagggccggttccgactccactcagttagggatgaagaggcaaagtttaagctctgcaaggtccgttctgtccagtttgggcagaagggcatcccatacttaaacacctatgatgggcggaccattcgctacccagacccactgatcaaggccaatgacactatcaagcttgacctagagagcaacaagatcaccgacttcatcaaatttgatgttgggaatgttgtcatggtgactggtggaaggaacaggggccgtgttggagtcatcaagaacagggagaagcacaaggggacctttgagaccatccacattcaggatgccactgggcatgaatttgcaactcgtttgggcaatgtgttcatcattggcaaggggacaaagccttgggtatctcttcctaagggtaagggtatcaagctgtctatcatcgaagaggccaagaagaggcttgcagcccaagcagcatccagcgcttgaaccatgctggcaaaaatatcatccaatatatagtattgaagacttcgactagattgatagtattggaggtccatccacttttggaattatgccaaaaattttgctgtgggttcttccctttctcagaactgatagttatgtttaagtgcattgttgcttggctaaattctctcaattctcctttgtctttgaaatttctggttgttgcctttggaggagtccattctacatctgcagtaatagagagtgcataactcctctgcccatgtcataggtcagtagcacgatcaagccaccaaccctccccagtgtcggttttgctacactgggcgaatcaaa

SEQ ID NO: 4120 - DNA, 1147 bp, Humulus lupulus
attaactcgtataaatctagtcgtccccgccgctcactcttctccttttaggctaccacactttcctctgctagggtttctgcatctgcctccgttcttgcaaaatggctagaggattgaagaaacatttgaagaggctcaatgcccccaagcattggatgctcgacaagcttggtggtgctttcgcccccaaaccatcatctggaccacacaagtcgagggagtgcttgcccttgatcctcatcctgaggaacaggttgaagtatgccctcacataccgtgaagtgcaatctattctgatgcagcgacatattatggttgatggaaaagtcaggactgataagacctacccgtctggtttcatggatgtggtttccatcccaaagaccaatgagaacttccgtcttctttacgataccaagggtcggttccgccttcactcaatcagggatgacgaggctaagttcaagctctgcaaggtgaggtcagtgcagtttggacagaagggaatcccctacctcaacacctatgatggacgaaccatccgctaccctgaccctctaattaaggctaatgacaccatcaagctggatttggaggccaacaagattaccgatttcatcaagtttgatgttggtaatgttgtcatggtgactggaggacgaaacaggggacgagttggagttattaagaacagggaaaagcataagggtacatttgagaccatccacgttcaggatgctcttggccatgagttcgctacccgtcttggaaatgtgtttaccattggtaagggaaccaagccctggatttctcttcccaagggcaagggtatcaagttgacaatccttgaagaggctaagaagagactggcagcccaagctgctgctactgcttgattttcatggtagcaattacagattgtctttaaattttagttccattagattaattctgtttagcagtgatcttttttcagctcaagtaaggattttatgtgttacatttttcatttatggttttggaaaggaattttgttgcttgaattttgttgaagtttgtatcagagcatttttatcgactcaccctcatttttgcgtaacccaattatgatttgagcttctgattctctcaatcagttgcaatg

SEQ ID NO: 4121 - DNA, 1142 bp, Cucumis melo
tttcgttgtcacaaacactctctccttcagtaagaaaccctatttctctcccactaacgccggcgccgactctgacttttagctctttcatcagatatggcaagagggctgaagaagcatttgaagaggctcaatgctccaaagcattggatgcttgacaaacttggtggtgcatttgcccccaaaccttcgtctggtcctcataagtcaagggagtgcctccccttgatccttatattgaggaaccggctgaaatatgctctcacataccgtgaggtaattgcaattttaatgcaacgacatgttttggtcgatgggaaggtccggactgataagacttttcctgctggtttcatggacattctgtcaattcccaagacaaatgagaatttccggcttctttatgacacaaaaggtcgattccgtctacactcagttagggatgaagaggctaagtataagctgtgcaaagttcgctcagtgcagtttgggcaaaagggcatcccttatctgaacacttttgatggacgcacaattcgttatcctgaccctctgattaaggcgaacgacactatcaagctagaccttgagtctaacaagattgctgatttcattaagtttgatgtaggaaatgttgtgatggtgactggtggaagaaacagaggcagggttggagttataaagaacagggagaagcataagggaagctttgaaacaatccacattcaggatgcaactggacatgaatttgcaactcggctgggcaatgtgttcactattggtaaggggactaagccatgggtgtccctacctaagggcaagggtattaaattatccatcatcgaagaagccagaaagaggctggcaagccaagccgcagttactgcttaagacttggtgtattgtaactgtagtcatcgatgaaaggtcggattttgcttgaattgttttgttttttgcttaagtagatctaaaaaaggctggtacttggttatttctactgcaattgtgtgaagctactgctatggttttgtcattccaagtctcttttcttcatgagggttacttgtttttctggtaaatggaaaaatcctgacttgtattcgttttgttaacaatagattaaaataatgccttatgca

SEQ ID NO: 4122 - DNA, 1134 bp, Tropaeolum majus
tttttttcttgagcagatactggaacttgcaaaatggctaggggtttgaagaaacatttgaagaggctcaatgccccaaagcactggatgcttgacaaacttggtggagcatttgcccccaagccatcatctggcccacacaagtcaagggaatgcctgcctctgatccttatcttgcgtaacaggctcaaatatgctcttacatatcgtgaggttattgcaatcttgatgcagcgccatattcttgttgatgggaaagttaagactgataagacataccctgctggtttcatggatgtcgtttctattcccaagacaaatgagaatttccgtctcctttatgacaccaagggccgtttccgcctccactcaatcagggatgaagaatccaagtttaagctttgcaaggtcagatctgtccagtttgggcagaaaggtatcccttacatcaacacctatgatggccgaaccatccgctatccagacccacttatcaaggccaacgacaccatcaaacttgacctggattcccaaaaaattgttgatttcattaagtttgatgttggaaatgtggtcatggtcactggtggaagaaacagagggcgtgttggagtgatcaagaacagagagaaacataagggtagctttgagaccatccatgttcaagattctcttggtcatgaatttgcaactaggttgggcaatgttttcacaattggcaaaggaacaaagccatgggtatctcttcctaagggcaagggtattaaattgaccatcattgaggaagcaaggaagaggcttgctgcccaacaggccgcataagtcttatctttttgagaaaaatgctgaattttgctttcattaagtgataccttctagaaatgactcatttgtttaatttacattatgaccaaattcggactcggttgtttatggtgtttttctgggctaagatgtctctttcttttttgtgcgctatttgatatctgttacacagataatatgctacttaggccatcattttgttactttatatttaccatctttagttttcccacccttgttggctaaatctggttgttgatttacattggaagtcatggatgaaagtaagagtctagagtggttcgcttg

SEQ ID NO: 4123 - DNA, 996 bp, Capsicum annuum
ctgccggcagctaatccaccaaatccgaaaaccgccaaaatggcaagagggttgaagaaacatttgaagaggctcaatgccccgaagcattggatgcttgacaagcttggaggtgcttttgctcccaagccatcttctggtccacacaaatcaagggaatgtttgccattgattattatcctcaggaacaggttgaaatatgctttgacataccgtgaggtcatctctatcttgatgcaaaggcaagttatggttgatgggaaagttaggacagataaaacttaccctgctggtttcatggatgttgtctccattccaaagacaaatgagaacttccgacttctttatgacactaagggtcgcttccgtctccattcactgagggatgaagaagccaagttcaaactttgcaaggttcgttcagtgcagtttggacagaagggaatcccatatctcaacacctatgatggaagaacaatccgctaccctgatcccctcatcaaggccaatgacaccatcaagctggacttagaatccaacaagattgttgacttcatcaaatttgatgttggaaatgtggtcatggtgactggtggtagaaacagaggacgtgttggagttatcaagaacagggagaagcataagggtagctttgagacagttcacattcaggatgccctgggacacgagtttgctacccgtttgggtaatgtgttcactcttggtaaaggtactaagccatgggtgtctctacctaagggcaaaggtatcaagttatctatcattgaagaggctcgcaagaggctggctgctcaatcagctgtagctgcttaaaaagtctaggttgaattttaagataaatttaacaggttggaccatgtttttctctgtttagagataccaatctcattttgtgtgttgcattttaatgtgtacttggtactgttttactacctttttttgttgggaaaagaggttgacagagttaagatcaat

SEQ ID NO: 4124 - DNA, 1051 bp, Capsicum annuum
acacacctctctccggcggccaatctctgccggcagctaatccaccaaatccgaaaaccgccaaaatggcaagagggttgaagaaacatttgaagaggctcaatgccccgaagcattggatgcttgacaagcttggaggtgcttttgctcccaagccatcttctggtccacacaaatcaagggaatgtttgccattgattattatcctcaggaacaggttgaaatatgctttgacataccgtgaggtcatctctatcttgatgcaaaggcaagttatggttgatgggaaagttaggacagataaaacttaccctgctggtttcatggatgttgtctccattccaaagacaaatgagaacttccgacttctttatgacactaagggtcgcttccgtctccattcactgagggatgaagaagccaagttcaaactttgcaaggttcgttcagtgcagtttggacagaagggaatcccatatctcaacacctatgatggaagaacaatccgctaccctgatcccctcatcaaggccaatgacaccatcaagctggacttagaatccaacaagattgttgacttcatcaaatttgatgttggaaatgtggtcatggtgactggtggtagaaacagaggacgtgttggagttatcaagaacagggagaagcataagggtagctttgagacagttcacattcaggatgccctgggacacgagtttgctacccgtttgggtaatgtgttcactcttggtaaaggtactaagccatgggtgtctctacctaagggcaaaggtatcaagttatctatcattgaagaggctcgcaagaggctggctgctcaatcagctgtagctgcttaaaaagtctaggttgaattttaagataaatttaacaggttggaccatgtttttctctgtttagagataccaatctcattttgtgtgttgcattttaatgtgtacttggtactgttttactacctttttttgttgggaaaagaggttgacagagttaagatcaatcatttgcttttttatgctatagtatttta

SEQ ID NO: 4125 - DNA, 1489 bp, Phalaenopsis aphrodite
ggagaaaaaccctaatcgctacgcctcctggtgaagggaaagaagcggatcaaaaatggccagaggattgaagaagcatcttaagcggctcaatgcccccaagcattggatgcttgacaagcttggtggtgctttcgcaccaaagccatcttctggtccccataaagctcgggaatgtttgccgctaatcctcattttaaggaacaaattgaaatatgcgttgacttatcgtgacgtgattgctattttgatgcaacgccatgtgatggtagacggaaaggttaggacggataagacctatcccgcaggttttatggatgttatccaaatccctaaaacgaatgagaattttcggcttttgtatgacacgaagggacgctttcgtctgcactcaattagggatgaagaggcaaagttcaagctttgcaaggttcgttccgtccagtttgggcagaaaggcattcctttcctgaacacctacgatggccgcacaattcgctaccccgatcctctgataaaggcgaacgatacgataaaacttgatcttgagtcgaacaaaatcgtcgacttcatcaaattcgacgtcggaaatgttgtgattgtcactggaggaaggaacagaggccgtgttggcgtgatcaagaacagggagaaacacaagggcacgttcgagacgattcacgtccaggatgcggcggggcacgagttcgcgactcggctcggtaatgtgttcaccattggaaagggaacaaagccatgggtctctcttcctaaaggtaagggtattaagctctctattattgaggaggccaggaagcgcttagctgctgcttctgctgccactgcttgatgtttctgagggtatttagagaattttcgtcgttttgttttggtgtgttttgaatgaagaatgaagaattcagtggacaaattttgtttgtggttttttgtttattgtaacttgatgttttaactggaagttaatttgctttcgatctggaagagtttattagttggtatatatttatggaaatttacatacataccgctcaaatcctatgtatttacatatctaccacttccatttgaatttgtacctacatgccacctcataacatgttggaaaggtgtatttcatttttgtaagactaaatagctagtataattgtagtattggtgttagatatagttaaaaaaaaacaaaaaaacaaagatagccctaactatatgtgagactctacacatacacgatctgtagagcattagtcttattatccactggcagtagtaggtggtctgccatcgagacactcaaaccaacaaatactttggttcaatcctcatacacaccaactaaataatgcgacttgtagcgtctaagtagtggtgaaggaagagacaatatatcatacatatgttcgtagatactaccgacgctcctcgtagactgtagttttgttggcaaccgagtactacctccagacattag

SEQ ID NO: 4126 - DNA, 987 bp, Phalaenopsis aphrodite
gggaaaaaccctaatcgctacgcctcctcgtgaagggaaagaagcggatcaaaaatggccagaggattgaagaagcatcttaagcggctcaatgcccccaagcattggatgcttgacaagcttggtggtgctttcgcgccaaagccatcttctggtccccataaagctcgggaatgtttgccgctaatcctcattttaaggaacaaattgaaatatgcgttgacttatcgtgatgtgattgctattttgatgcaacgccatgtgatggtagacggaaaggttaggacggataagacctatcccgcaggttttatggatgttatccaaatccctaaaacgaatgagaattttcggcttttgtatgacacgaagggacgctttcgtctgcactcaattagggatgaagaggcaaagttcaagctttgcaaggttcgttccgtccagtttgggcagaaaggcattcctttcctgaacacctacgatggccgcacaattcgctaccccgatcctctgataaaggcgaacgatacgataaaactcgatcttgagtcgaacaaaattgtcgactttatcaaattcgatgtcggaaatgttgtgattgtcaccggaggaaggaacagaggccgtgttggcgtgatcaagaacagggagaaacacaagggcacgttcgagacaattcacgtccaggatgcggcggggcatgagttcgcgactcgactcggtaatgtgttcaccattggaaagggaacaaagccatgggtctctcttcctaaaggtaagggtattaagctctctattattgaggaggccaggaagcgcttagctgctgcttctgctgccactgcttgatgtttctgagggtatttagagaattttcgttttgttttgttgtgttttgaatgaagaatgaagaattcagtggacaaattttgtttgtggttttttgtttattgtaacttgatgttttaactggaagttaatttgctt

SEQ ID NO: 4127 - DNA, 1300 bp, Sarracenia psittacina
tagtaccatagcatcaagaaacgcagcagtgaggaacagcgtcattgcgaagtctcggggggactgatctccgaacttacaaaaccacaatggctaggggattgaagaagcatttgaagaggctcaatgccccaaaacactggatgcttgacaagcttggtggggcatttgctcccaaaccatcttctggaccccataaatcaagggaatgcttgcccttgattcttattctgcgaaacaggctgaaatatgctctcgtaaaccgtgaagtcaacgcaattttgatgcaacgtcttgttctcgttgatgggaaggttagaacagataagacctaccctgccggattcatggatgttatttccatccccaaaacaaacgaaaacttccgtcttctttatgatacaaagggtcgatttcgacttcactccctcagagacgaagaggccaagatcaagctttgcaaagttcgttcggtacagtttgggcagaaaggtatcccatacctcaacacttatgatgggaggactattcgttaccctgacccgcttatcaaggccaatgacaccatcaaacttgacctagagacaaacaagatcactgatttcatcaagtttgatgttgggaatgttgtcatggtgactggaggaaggaacaggggtcgtgttggggtcatcaagaacagggagaagcataagggaagctttgaaactgttcacattcaggatgccactgggcaggagtttgctactcgcatgggcaatgtcttcaccattggaaaaggtacaaagccgtgggtgtctcttccgaagggtaagggaattaaattgtccatcattgaggaggctaggaagcggcttgcggtccagactggtgctgctgcttaaatttatgatacaagagtttttgcaagtaccatctttttttatagagaatgttgtgttttgtcctttttatttcttagtacaatattgaactaaatcttcttacgaatttggtttgactattgagtgatatagaaattgaacaattttggcaataaaatataatttgtaatttattggtttgaagatttttctctcttttgtaataatatgaacaattgataaaataaaatataaaataaaataacttatggaaagagaaaagagatgaagtttacatcccaattacccacataaaaacaatatacacacagaaaagcgaaattcaaatcccacctttttcttttccacttatttcatgtttcatcccattaatataattcttttttgcatttaaaaatctaaaaccaacttggatt

SEQ ID NO: 4128 - DNA, 1105 bp, Fragaria vesca
atagcgctggattccaaagtgctttgtaggttagaaacttcagagacagcgagccgcttcggagttgggagcagcagcaaagggaggttcagccgggggagatcaagctcagaaaatggcgcgaggactgaagaagcatttgaagaggctcaatgcccccaagcattggatgcttgacaaattgggtggtgcatttgcccccaagccctcatctggacctcacaagtcgagggagtgtcttccattgatcattatcttgcgaaaccggttgaagtatgctctgacataccgtgaggtcattgccatcttgatgcaacgtcatgttatggttgatgggaaagttaggactgataagacttatccttctggtttcatggatgttgtctcaatccccaagacaaatgagaatttccgtctcctttatgacaccaaaggacggttccgtctgcattcaatcagggatgaagaggcaaagttcaaactctgcaaggtccgttctgtgcagtttggccaaaagaatatcccttacattaatacctatgatgggagaacaattcgttaccctgatcctctcatcaaggcaaatgacaccatcaagcttgatttggagaccaacaagattgttgacttcatcaagttcgatgttggtaatgttgtcatggtgacaggtggtaggaacagagggcgagttggagtaatcaagagcagggagaagcataagggaagctttgagactattcacgtccaggacgccactggacatgaatttgcaacccgtttggggaatgtgttcacaattggtaagggtaccaagccatgggtaagccttcccaagggtaagggtattaagcttactatcattgaggaggccaagaagaggcaagctgcccaagccacagctgcagcctagatgttttcggtgaaaacaatttaagtcttatctgaagaatttcactagaacttttgtaatttttactaaattagctttggaatttatgctgcaaattttgtcttcgtgttcttcatttgttttgatacagatcagacttaaattttatgctatgttgaagtaaagtttctctgagtagtgtctgcatgctgttcc

SEQ ID NO: 4129 - DNA, 1050 bp, Thellungiella halophila
gatcgcagaagaatcagaagtcgtcagctccggaacacctgcaaacatggcaagaggattgaagaagcatctaaagaggctcaatgcccccaaacattggatgcttgacaaacttggcggtgccttcgcccccaagccatcttctggacctcacaagtcgagggagtgtcttcctcttgtcctaatcatcaggaacaggttgaagtatgctttgacataccgtgaagtgatctccatcctgatgcagaggcacatccaagttgatggaaaagtgaggactgacaagacgtaccctgctggcttcatggatgttgtatcgatccccaagacaaatgagaacttccgtcttctgtatgacaccaagggacgtttccgtcttcactccatcagggacgaggaagctaagttcaagctttgcaaggttaggactatccagtttgggcagaagggaattccttacctgaacacttatgatggtcgcactatccgttaccctgacccgctcatcaagccaaacgacaccatcaagctggatcttgaggagaacaagattgtggagttcatcaagtttgacgtgggaaacgttgtgatggtgactggaggcagaaacagagggcgtgtgggtgtgattaagaaccgtgagaagcataagggaagcttcgagacgatacacatccaagactcaacaggtcatgagtttgccacaaggttgggcaatgtgttcacaatcggcaaaggaacgaagccgtgggtgtctcttccaaagggcaaaggtattaagctgtccatcattgaggaagccaggaagaggctttctgcacaacaagctgcttaaaaaacgtgaatcatcaaaggccgtttcgtgttactcttgtgttatagactcgcttcttgcctcagttttgaagctttttcctatttcatgttgttggtttgcaagacccggttataaaaaaacagctgaaaattccattagagcgttttgtaatgtttgtatggattttagtaatttactcattaaattcagttgacttaaataaattaaaagcc

SEQ ID NO: 4130 - DNA, 1040 bp, Trigonella foenum-graecum
gcttcagcttttgaacccacgcagtagaacttcatctctgaggagcagattcagcacaacgcttcaacatggctagaggattgaagaaacacttgaagagactcaatgctccaaaacattggaatcttgacaaacttggtggagcctttgcaccaaagccatcatctggaccccacaagtcaagggagtgcctacctttgatcctcatcctgcgaaacagactgaaatatgcgctaacatatagagaagttattgccatcttgatgcagcgccatgttcttgttgatggcaaggttaggactgacaagacatatccagctggtttcatggatgttgtttctattcccaaaactaatgaaaacttccgtcttctgtatgacaccaagggccggttccgtctccactctgtgagggatgatgaggcaaagtttaagctctgcaaggttcgatctgttcaattcggacagaagggcattccctatctgaacacctatgatggccgcaccatccgctatccagatccactaattaaggctaatgacaccatcaaacttgaccttgaaaacaacaagatcactgattttatcaagtttgatgtggggaatgttgtcatggttactggaggaaggaatagaggtcgtgttggtgtcatcaagaacagggagaagcataagggaacctttgagactatccatgttcaggatgcaactggtcacgagtttgccactcggttgggcaatgtgttcactattggcaaaggaacaaagccttgggtgtctcttcctaaaggcaaaggtatcaaattgactgttattgaagaggctagaaagaggcaggctgctcaaaatgtaactgctgcttaatttttttgatcaaattacattgctagcaaattttagttattttaagatgagtgagcatttttgttgactgggcggttgtttttgaagtgactgagcatattttttattgtgctattctgaactgttttcatgttatttcagtttaatcatctttatgaatattatggtgacatgttc

SEQ ID NO: 4131 - DNA, 1036 bp, Trigonella foenum-graecum
cgcggcaaccttgccatcgcgccgttcgtctctgttcacagaacactaacatggcaagagggttgaagaaacatttgaagcggctcaatgctccaaaacattggatgcttgataagcttggtggcgcctttgctccaaagccgtcatctggaccacacaaatcaagggagtgtctgcctttgatccttatcctgaggaacagactcaaatatgctctcacatatagagaagttattgccatcttaatgcagcgtcatgttcttgttgacggcaaagttaggactgataagacatatcctgctggttttatggatgttgtgtctattcccaagacaaatgaaaatttccgtcttctctatgacacaaagggccgattccgtcttcactctattagggatgatgaggcaaagttcaagctttgcaaggtgcgatctgttcagtttggtcagaaggggataccctatctgaacacctatgatgggcgcaccatccgctaccctgatcctctaattaaggctaatgacacaatcaaactagacttggaacttaacaagataaccaatttcatcaaatttgatgtggggaatgttgttatggtgactggaggaaggaacagaggtcgtgttggtgtcatcaagaacagggaaaagcataaggggacttttgagaccattcacgtcgaggatattactggtcatgagtttgcaacccgattgggtaatgtcttcgtcattggcaaagggacgaaaccttgggtgtctcttcccaaaggaaaaggtatcaaattgactgtcattgaggaggctaggaagcggattgctgcttctaaacaagtggcagctgcttaaatttgattacattatattgttggaaaatttagccatttagattgtttgagactgttttgcggctaatatgacatcacaatatcttaattttgaactagacttgatgtgaggtcaatttgttaacatatgatggatgccgtttctttttcccaattttgtcttccaatggtatcacaattacgaatgaa

SEQ ID NO: 4132 - DNA, 1215 bp, Phaseolus coccineus
atcaacgcagagtggccattacggcgggttttaaagagacgcaactcctctgctctgtttcttcagttcggtggtgccgtagcagggagcttcagcgtatcactcaattccagaatggctagaggattgaagaagcatttgaagaggctcaatgccccaaagcattggatgcttgacaaactgggtggtgcatttgctcccaagccctcatctggaccacacaaatctagggaatgcctaccactgattctcattttgcgaaaccggctgaagtatgccctgacataccgtgaagtcatttctattctgatgcaacgacatgtcctcgttgatggcaaagtcaggacagacaagacatatccttctggttttatggatgttgtatccatccctaaaacaaatgagaacttccgcctgctgtatgacactaaaggcagattccgtcttcactcagtcagggacgaagaagctaagttcaagctttgcaaggttcggtcagtgcagtttgggcaaaagggcatcccatacctgaacacctatgacgggcgcactatccgctacccagaccctctcatcaaggctaatgacaccatcaagttggacttggaggaaaacaagattgttgagttcatcaaatttgatgttgggaatgtagtcatggtgacaggtggaaggaatagagggcgtgttggagtgatcaagagcagagataagaacaagggaagttttgagactatccatgtccaagatgctactgggcacgaatttgcaactcgtttgggcaatgtgtttaccatcggcaagggaacaaaaccttgggtatctcttcccaagggtaaaggtatcaagctttccatcatcgaggaagctaggaagaggatttccgcccaacaagctactgctgcttaaatcatcattaggatatcaatagacttttgagtgcttttagttttcatgcgatgctttttgcttctaaattttattatctggagattttatccgttgaattttgtctcttcaatgcactatagaacttttattgctgctgctatatagtcatgaaggaatccttccattccatagttttttttaatgttgttttagctggaacaagtctcttaagcaagtccactcaatgcatctttttaagaaactactcttgtttctatttcagattgtttttcccttctaaaacgttctttcgtaataattcaa

SEQ ID NO: 4133 - DNA, 1822 bp, Gossypium raimondii
caaaaataacataagtaccacattaaaaaaatgtcaaacttgagtaccaaatgatgaaaatacaagtacaaaaaccataagttaaacctatattgtatatggttaaaatatgtcaaagtccttatactctttataaatttgaaattaaatctttgtacttttatttttaggaatttaacccctctactttttagatgtcagaaatcaggtctaactattaacataattaaaattattttattaaattcaggttcagtgcaccccatattttagttccattattattaagtgagtattttttttatttcaaaatgtcacaccaacaaatttaacaatattaacaattggacccgaattttaaaatctgaaaagtggagagattaaattctaaatgttaaaagtacagggacctatagcatattttaaccattgtatattcccaaaagaacttgagcaacttcaataaaaaaaagaggggataatgaacccaaaattttatcttttttgtgggctaatggcccataaacatagttttggtcatggcagacgccaaattcatatttggatcgaaatctcgataatgccctcatctattaatatatgcagctattagggtttcttgtttgaagaccctagcaagacacagactttgagcaaagcagcctcatttctccaatatggctagagggttgaagaaacatttgaagaggctcaatgcccccaggcattggatgcttgacaagcttggtggtgcttttgcacccaagccatcgtctggtccccacaagtccagggaatgcttgccattgatccttattttgcgaaaccgattgaagtatgctctcacctatagagaagtcattgctattcttatgcagaggcatgttatggttgatgggaaggttaggacggataagacctatccagctggtttcatggatgttgtgtccattcctaaaacaaatgaggacttccgtctactttacgacaccaaagggcgatttcgtctccatgccatcactggcgatgaaaccaagttcaagctctgcaaggttcgatctgtccagtttggccagaaaggtattccatacttgaatacatatgatggtcgtactatccgttaccctgatcctttgatcaaggctaatgacaccatcaagctagaccttgaaagcaacaaaattgttgatttcatcaagtttgatgttgggaatgttgtcatggtcactggagggaggaacagagggcgagttggagtaattaagaatagggagaagcataagggcagctttgagacaatccatgttcaagatgctgctgggcatgagtttgcaactcgtctcggcaatgtcttcaccatcggaaaaggaacaaagccatgggtgtcccttcctaagggtaagggtatcaagttatccatcattgaggaagctaggaagaggcttgctgcccaaaatgctgcctaaactttagcataagacatccagatatgtattgctgcagtagttttttctaaagattagctggagttgtttatttatgaagttgtgaccaaaattttgagaactatttacttcttgcaatttatctttttttctgggtgatgttacctactttaccaccaggctttaaattatcgaatactcggctgtttcatgaatattagtgcttttgttggttaaatgagagttgcctcctttgggatgaactccttcccagctaatgcaatatttgtttccatgccagtcattttcattgtaaagtaatggcattgcaacgcaggtgaaaatttatcaaaagcaagcttgtgacattatagttt

SEQ ID NO: 4134 - DNA, 1055 bp, Gossypium raimondii
agcccctcgcgtcatcgtcttcaaagaacgcttaaccatcaaaaccagctagctaaatcaaccgcatttcaccaggatggctagaggattgaagaaacacttgaagaggctcaatgcccctaggcattggatgcttgacaagcttggtggtgcttttgcacccaagccatcatctggaccccacaaatccagggaatgcttgccattaattctcattctgcgaaacagattgaagtatgctctcacgtacagagaagttattgctattctcatgcagaggcatgtcatggttgatgggaaggttcggaccgataagacttatcctgctggtttcatggatgttgtgtccattcctaaaacaaatgaggacttccgtctcctttatgacaccaaagggcgtttccgtctccatgccatcacgggtgatgaaaccaagtttaagctttgcaaggttaggtctgtccagtttggccagaaaggcattccatacctcaatacatatgatgggcgtaccatccgctacccggaccctctgatcaaggctaatgacaccatcaagctggaccttgagagcaacaaaattgttgatttcatcaagtttgatgtcggaaatgttgtcatggtgactggaggaaggaacagaggtcgtgtgggagtgattaagaacagggagaagcacaagggtagctttgagacaatccacgttcaggatgctgctgggcatgagtttgcaactcgtcttggtaatgtgttcacaattggaaaaggaacgaagccatgggtatcccttcccaagggcaagggtattaagttgtccatcattgaggaagctaggaagaggcttgcagcccaaaatgctgcttgaacattaacacaagatatctagatatgtcttgctgctgtagtttattctggagttactagatttcttgctttcggttatgaagaaaattttgagaactattttcttcttgcaatcttaaattgttcggttggctaatgttagtgaacttacaaggctatattttaaatgaatgcttggacttggatgcttt

SEQ ID NO: 4135 - DNA, 1043 bp, Tropaeolum majus
gttttttcttgagcagatactggaacttgcaaaatggctaggggtttgaagaaacatttgaagaggctcaatgccccaaagcactggatgcttgacaaacttggtggagcatttgcccccaagccatcatctggcccacacaagtcaagggaatgcctgcctctgatccttatcttgcgtaacaggctcaaatatgctcttacatatcgtgaggttattgcaatcttgatgcagcgccatattcttgttgatgggaaagttaagactgataagacataccctgctggtttcatggatgttgtttctattcccaagacaaatgagaatttccgtctcctttatgacaccaagggccgtttccgcctccactcaatcagggatgaagaatccaagtttaagctttgcaaggtcagatctgtccagtttgggcagaaaggtatcccttacatcaacacctatgatggccgaaccatccgctatccagacccacttatcaaggccaacgacaccatcaaactagacctggattcccaaaaaattgttgatttcattaagtttgatgttggaaatgtggtcatggtcactggtggaagaaacagagggcgtgttggagtgatcaagaacagagagaaacataagggtagctttgagaccatccatgttcaagattctcttggtcatgaatttgcaactaggttgggcaatgttttcacaattggcaaaggaacaaagccatgggtgtctcttcctaagggcaagggtattaaattgaccatcattgaggaagcaaggaagaggcttgctgcccaacaggcctcataagtcttacctttttgagaaaaatgctgaattttgctttcattaagtgataccttctagaaatgactgctttgtttaatttacattatgaccaaattcggactcggttgtttatggtgtttttctgggctaagatgtctctttcttttttgtgcgctatttgatatctgttacacagataatatgctacttaggccatcattttgttactttatatttaccat

SEQ ID NO: 4136 - DNA, 1095 bp, Eutrema halophilum
atgcttgatgtccagttgaattaccacgacaacctgcttggatgccattttttagcacccatcaatggtatcatgctgtcatcacttttttcgttcggaggaaaacgagagaagtcacctggatcggagctacgcttgcaaactccaaacatggcgagaggtttgaagaagcatctgaagaggcttaatgccccaaagcattggatgcttgacaaacttggtggtgcatttgctccaaagccatcatctggaccccataagtcgagggagtgccttcccctcgtcctcatcatcaggaacaggttgaagtatgctcttaactaccgtgaagtggtttccatcttgatgcaaaggcatatccaggttgatggaaaagtgaggactgacaagacctaccctgctggtttcatggatgttgtctctatccctaagacaaacgagaacttccgtcttctctatgataccaagggacgtttccgtctgcactccatcagagatgaggaagcaaagtataagctttgcaaggtccgaactatccaattcgggcagaagggcattccttacttgaacacatacgatggtcgtaccatccgttaccctgacccgcttatcaagcctaatgacaccattaagctcgaccttgaggcaaacaagattgtggagttcatcaagtttgatgtgggcaatgttgtgatggttaccggaggaagaaacagagggcgtgttggtgtgattaaaaaccgtgagaagcataagggaagctttgagacaatccacatccaagactcaactggacatgagtttgcaacaaggttggggaatgtgttcaccattggcaaaggaacaaagccatgggtgtctcttcctaaaggcaagggtatcaagctgaccatcattgaggaggccaggaagaggcttgctgctcaacaggctgcttaattttgtgatttccagttctttgttatgcttcccttagacgacttatgttgctagacttacttcccttcttttggttctctgctcagttttgaaaaacttgtgttattttatttatgttaaagagttcaaaaatttttttatcttccttttagtatc

SEQ ID NO: 4137 - DNA, 1021 bp, Castanea mollissima
cacgagcagcttcgttcacaaaaccttcctggctttgcaaagagcttagagagaccaaagacttgctctacttgtacgccacaccaaaacaaaaatggctagagggttgaagaagcacttgaagaggctcaatgcccctaagcattggatgcttgataaacttggtggtgcatttgctcccaagccttcatctggacctcacaaatctagggaatgtcttccattgatccttatcttgcgaaacagattgaaatatgctctcacgtaccgtgaggtcatttccatattgatgcaacgacatgttctggttgatgggaaagtcaggacagataagacctatccctcaggtttcatggatgttgtttcaatccccaagactaatgagaatttccgcctgctttacgacactaagggtcgattccgtcttcactcaatcagggacgaagaggcaaagtttaagctctgcaaagtcaggtcggtgcaatatgggcaaaagggtatcccatacctcaacacccatgatgggcgaaccatccgctacccagaccctctcatcaaggccaatgacaccatcaagctggacttggagagcggcaagatcactgatttcatcaaatttgatgttgggaatgtagtcatggtgactggtggaagaaatagaggccgtgttggagtaatcaagaacagagagaagcataagggaacctttgagacagtccacatccaggatgccacagggcatgaatttgctactcgtttgggcaatgtgtacactattggcaaggggacaaagccttgggtttcccttcctaagggcaagggaataaagctaactatcatcgaagaggccaagaagaggcttgcggctcaaggggcagccacagcttaaatgaatacagtgaaaataaccttcaaacatatctgatggttatttgtttttgtagctcctgaccttttagttccttaaattatgttccttttttttgctgtttcatgcttggtaacaataatatagttgtta

SEQ ID NO: 4138 - DNA, 1195 bp, Citrus clementina
aagtagggcatcaagctcaaacttccgtgtcctatatctatctaaatgccaatgttagggttttgcgggagtggagctagcagcgcttgtgagtgcatttttcacttcgtttttgttttgcaggactgtgacacgccgttggcgaatccaagctcaggctcacgaacacaaaaatggcgagaggtttgaagaaacatttgaagaggcttaatgccccaaagcactggatgcttgacaaacttggtggagcatttgctcccaagccttcatctgggccacacaaatcaagggagtgtttgcccttaattcttatcttacgtaaccgcttgaagtatgctcttacataccgagaagtcattgcaattttgatgcaacgacatgtgttggttgatgctaaggttcgcacagataagacttaccctgctgggttcatggatgttgtgtcaattccaaagacgaatgagaacttccgtctcctgtacgacaccaagggccggttccgccttcattcaatcagggatgaggaggctaagttcaagctctgcaaggtccgatcagtgcaatttgggcagaagggaatcccttacatcaacacttatgatgggaggactattcgctacccagacccactcatcaaggccaatgataccatcaagctggacctggagactaacaagatcaccgagttcatcaagtttgatgttggaaatgttgtgatggtgactggagggagaaacagaggacgtgttggaatcattaagaacagagagaagcataagggtagctttgaaactatccacatccaggatgctcttggtcatgagtttgcaactcgtcttggaaatgtgttcaccattggcaagggtacaaagccatgggttgctcttcccaagggcaagggtattaaactatccatcattgaggaggcaaggaagagacaagccctggcgacttcagcagccgcccaatgatgataaacttcatgtgtcttggcgatatggttttataaagtttactagatgaaagttttgcagtttgacacttttgtgattgcttgttcgattttcttgttggtgatactagttatcataaagtttttgagtcgtaatactggtttcaattttagttttgtgacaaaacaggtgactcttttattttatctgcgtcaatattattggcaatgaatttttggccc

SEQ ID NO: 4139 - DNA, 1142 bp, Gossypium hirsutum
atgggctagcaagacacagactttgagcaaagcagcctcatttctccaagatggctagagggttgaagaaacatttgaagaggctcaatgcccccaggcattggatgcttgacaagcttggtggtgcttttgcacccaagccatcgtctggtccccacaagtccagggaatgcttgccattgatccttattttgcgaaaccgattgaagtatgctctcacctatagagaagtcattgctattctcatgcagaggcatgttatggttgatgggaaggttaggacggataagacctatccagctggtttcatggatgttgtgtccattcctaaaacaaatgaggacttccgtctactttatgacaccaaagggcgatttcgtctccatgccatcagtggcgatgaaaccaagttcaagctttgcaaggttcgatctgtccagtttggccagaaaggtattccatacttgaatacatacgatggtcgtactatccgttaccctgatcctttgatcaaggctaatgacaccatcaagctagaccttgaaagcaacaaaattgttgatttcatcaagtttgatgttgggaatgttgtcatggtcactggagggagaaacagagggcgagttggagtaattaagaacagggagaagcataagggcagctttgagacaatccatgttcaagatgctgctgggcatgagtttgcaactcgtctcggcaatgtcttcaccatcggaaaaggaacaaagccatgggtgtcccttcctaagggtaagggtatcaagttatccatcattgaggaagctaggaagaggcttgctgcccaaaatgctgcctaaactttagcataagacatccagatatgtattgctgcagtagttttttctaaagattagctggagttgtttatttatgaagttgtgaccaaaattttgagaactatttacttcttgcaatttatctttttttctgtcgggtgatgttacctactttaccaccaggctttaaattatcgaatactcggctgtttcatgaatattagtgcttttgttggttaaatgagagttgcctcctttgggatgaactccttcccagctaatgcaatatttgtttccatgccagtcattttcattgtaaagtaa

SEQ ID NO: 4140 - DNA, 1156 bp, Gossypium hirsutum
ctagcaagacacagactttgagcaaagcagcctcatttctccaatatggctagagggttgaagaaacatttgaagaggctcaatgcccccaggcattggatgcttgacaagcttggtggtgcttttgcacccaagccatcgtctggtccccacaagtccagggaatgcttgccattgatccttattttgcgaaaccgattgaagtatgctctcacctatagagaagtcattgctattcttatgcagaggcatgttatggttgatgggaaggttaggacggataagacctatccagctggtttcatggatgttgtgtccattcctaaaacaaatgaggacttccgtctactttacgacaccaaagggcgatttcgtctccatgccatcactggcgatgaaaccaagttcaagctctgcaaggttcgatctgtccagtttggccagaaaggtattccatacttgaatacatatgatggtcgtactatccgttaccctgatcctttgatcaaggctaatgacaccatcaagctagaccttgaaagcaacaaaattgttgatttcatcaagtttgatgttgggaatgttgtcatggtcactggagggaggaacagagggcgagttggagtaattaagaatagggagaagcataagggcagctttgagacaatccatgttcaagatgctgctgggcatgagtttgcaactcgtctcggcaatgtcttcaccatcggaaaaggaacaaagccatgggtgtcccttcctaagggtaagggtatcaagttatccatcattgaggaagctaggaagaggcttgctgcccaaaatgctgcctaaactttagcataagacatccagatatgtattgctgcagtagtttattctaaagattagctggagttgtttatttatgaagttgtgagcaaaattttgagaactatttacttcttgcaatttatctttttttctgtcgggtgatgttacctactttaccaccaggctttaaattatcgaatactcggctgtttcatgaatattagtgcttttgttggttaaatgagagttgcctcctttgggatgaactccttcccagctaatgcaatatttgtttccatgcccatcattttcattgtaaagtaacggcattgcaacgcaggtg

SEQ ID NO: 4141 - DNA, 1038 bp, Gossypium hirsutum
aagaacgcttaaccatcaaaaccagctagctaaatcaaccgcatttcaccaggatggctagaggattgaagaaacacttgaagaggctcaatgcccctaggcattggatgcttgacaagcttggtggtgcttttgcacccaagccatcatctggaccccacaaatccagggaatgcttgccattaattctcattctgcgaaacagattgaagtatgctctcacgtacagagaagttattgctattctcatgcagaggcatgtcatggttgatgggaaggttcggaccgataagacttatcctgctggtttcatggatgttgtgtccattcctaaaacaaatgaggacttccgtctcctttatgacaccaaagggcgtttccgtctccatgccatcacgggtgatgaaaccaagtttaagctttgcaaggttaggtctgtccagtttggccagaaaggcattccatacctcaatacatatgatgggcgtaccatccgctacccggaccctctgatcaaggctaatgacaccatcaagctggaccttgagagcaacaaaattgttgatttcatcaagtttgatgtcggaaatgttgtcatggtgactggaggaaggaacagaggtcgtgtgggagtgattaagaacagggagaagcacaagggtagctttgagacaatccacgttcaggatgctgctgggcatgagtttgcaactcgtcttggtaatgtgttcacaattggaaaaggaacgaagccatgggtatcccttcccaagggcaagggtattaagttgtccatcattgaggaagctaggaagaggcttgcagcccaaaatgctgcttgaacattaacacaagatatctagatatgtcttgctgctgtagtttattctggagttactagatttcttgctttcggttatgaagaaaattttgagaactattttcttcttgcaatcttaaattgttcggttggctaatgttagtgaacttacaaggctatattttaaatgaatgcttggacttggatgctttcgtgaa

SEQ ID NO: 4142 - DNA, 1097 bp, Solanum melongena
cggggagggtttaagacactcacctctcgccggcagccgacactcccagcacagctaatcaagtcggaataccaccaaaatggcaagagggttgaagaaacatttgaagaggctcaatgcgcctaagcattggatgcttgataaactaggaggtgcttttgcccccaagccttcttctggtccacataaatcaagggaatgtttgccattggttattatcctcaggaacaggttgaaatatgcattgacttaccgtgaggtcatttccatcttgatgcaacgacaagttttggttgatgggaaagttaggacagataagacttaccctgctggtttcatggatgttgtttcaattccaaagacaaatgagaacttccgacttctttatgacaccaagggtcgctttcgtctccactcactccgagatgaggaagccaagttcaaactttgtaaggttcgatcagtgcagtttggacagaaggggatcccatatctcaacacctatgatggaagaacaatccgctaccctgatcccctcatcaaggccaatgacaccatcaagctggacttagaatccaataagattgttgacttcatcaaatttgatgttggaaatgtggtgatggtgactggtggtagaaacaggggacgtgttggaattcttaagaacagggagaagcacaagggtagctttgagacagttcacattcaggattccctggggcatgagtttgctacccgcttgggaaatgtgttcactcttggtaaaggcactaagccatgggtgtccctacccaagggtaaaggtatcaaattatctatcattgaagaggctcgcaagaggctggctgctcaatcagcaacagctgcttaaaaaaactaggttgaacttgagatgaattcaataggttgggccatgtttctctttgtttagagatacctatcttattttgtatgttggatttagtgttttcgtactcggtagtgttttacattacctttgtcggaaaaagaggttgactgagttgagatctttcatttgctttttatgtgatactagaattttgtttgcaaagggtttaacggccttgactatg

SEQ ID NO: 4143 - DNA, 1161 bp, Humulus lupulus
tctctcgcacacagtcgatacagtgcgccataacctcggaggctcagctaccgcccctctgagatcttgtagctcagaatcccaaaatggcgagagggttgaagaagcacttgaagaggcttaatgccccaaagcattggatgcttgacaaacttgggggagcatttgcacccaagccttcatcaggacctcacaagtccagggaatgtttgccattgatcctcatcttgcgaaacagattgaagtatgctcttaattaccgtgaggttgtttctattttgatgcaacgacatatcatggttgatgggaaagtcagaactgataaaaaatatccttcaggtttcatggatgttgtatcaatccccaaaacaaatgagaatttccggctcctttacgataccaagggccggttccgtctccactcgatcagggatgaagaggcaaagttcaagctttgcaaagtccggtctgtgcagtttggccaaaagggtatcccatatttgaacacctatgatgggcgaaccatccgctaccctgatcctctcatcaaggccaacgacactatcaagctggacctggagagcaacaaaattgttgatttcatcaaatttgatgttgggaatgtagtgatggttactggtggaaggaacagaggtcgtgttggagttattaagaacagggagaagcataagggaacttttgagacaattcacgttcaggatgccactggccatgaatttgctactcgattgggcaatgtgttcaccattggcaagggcaccaagccatggataactcttcccaagggtaaaggtatcaagctgaccatccttgaagaggccaagaagagacttgcatcccaagcagcagccacagcttaaagaagtactttgtagccatcaaatatgtgactttggcaggtgtttgtttttgtcgtagctggaccttattatggatttttatgcgccaaattttgctcttgcttacggttggtactggtaaattaattgttgaattatgagttttagtactttgttttcaggaaagctattcatcggatttccccgctatatctttgccctttcttaaggattgtcccgttgtggttgctgcacatttactaattgcttagtctgatggaatttgctaccataattctca

SEQ ID NO: 4144 - DNA, 1103 bp, Ipomoea batatas
gcattacggcggggcatttgaggtggcaatttcagcatcaagcgcccgaatcctacagaacagacggcgaaggctgaagacttagcgcggcggcgattctcagttcaccaccaccaacatggcgagagggttgaagaagcacatgaagaggctcaatgcccctaagcattggatgcttgacaaacttgggggagcttttgcccctaagccttcctctggacctcacaagtcaagggagtgcttgccattgatcctcatcattcgaaacaggcttaagtatgcccttacttatcgtgaggtcatttcaattttgatgcaacgccatgttctggttgatggcaaggttaggacagacaagacataccctgctggtttcatggatgttgtttcaattcctaagacaaatgagaacttccgtctactttatgataccaaaggacggttccgtcttcactccattagagatgaagaggcaaagtttaagctttgcaaggtccgctctgtgcaatttggaaaaaagggaattccatacattaacacctatgatggcaggaccatccgttatcctgatcccctcatcaaggccaacgacactgtcaagttggacttggagagcaacaagattgttgaattcatcaagtttgatgttggaaatgttgttatggtgactggtggaagaaacagggggcgtgttggagtgattaagaacagggagaaacataagggtagctttgagactgtccacattcaggatgcccttggacacgagtttgctacccgcttaggaaatgtgttcaccattggcaaaggtaccaagccctgggtatctctacccaaggggaaaggtatcaagttgaccatcattgaagaagccaagaagaggctcgctgctcagtctgcaaccactgcttaatacaactgtcagcattactttatagccttatatccaatttaagtattttatcacttgaacgggattttgtttcaccaacttgcttttagcgacacttatagtcttatcaatgtgagctgtttttgcatttgacaaatttgtgtttctgcatttctttttgtgggacataaggtagagtactgttttataa

SEQ ID NO: 4145 - DNA, 1139 bp, Ipomoea nil
agcctttgaagtggcagtttcagcatcaagcggccgaaccctacagaacagccggcggaggctgaacacttagagcggcggcgattctcagttcaccaccaccaacatggcgagagggttgaagaagcacatgaagaggctcaatgcccctaagcattggatgcttgacaaacttgggggagcttttgcccctaagccttcctctggacctcacaagtcaagggagtgtttgccattggtcctcatcattcgaaacaggcttaagtatgcccttacttatcgtgaggtcatttcaattttgatgcaacgccatgttctggttgatggaaaggttaggacagacaagacttaccctgctggtttcatggatgttgtttcaattcctaagacaaatgagaacttccgcctactttatgataccaaaggacggttccgtcttcactccattagagatgaagaggcaaagtttaagctttgcaaggtccgctctgtgcaatttggaaagaagggaattccatatattaatacctatgatggcaggaccatccgttatcctgatcccctcatcaaggccaacgacactgtcaagttggacttggagagcaacaagattgttgacttcatcaagtttgatgttggaaatgttgttatggtgactggtggaagaaacagggggcgtgttggagtgcttaagaacagggagaaacacaagggtagctttgagactgtccacattcaggattcccttggacacgagtttgctacccgcttaggaaatgtgtacaccattggcaaaggtaccaagccctgggtatctctacccaaggggaaaggtatcaagttgtccatcattgaagaagccaagaagaggcttgctgctcagtctgcaaccactgcttaaacaactgtcagcattacttaatagccttatatccaatttgaagtattttgtcacttaaacgggattttgtttcaccaaactcattcgacttcttgcttttagcgacacttatagtgttatcaatgtgagctgtttttgcatttgacaaatttgtgttgttgcatttctttttgttggatgtaaggtagaggttttatattaattcagcatatccctttagtattaaatcagatcagat

SEQ ID NO: 4146 - DNA, 1241 bp, Lotus japonicus
tctagatcgatcacattcaccccacacactgagcaagaggcgcagcgccgccgcaacctcgccgtcacgacgttgctctctgcttacgagacaccaaaatggcaagagggctgaagaaacacttgaagcggctaaatgccccaaaacattggatgcttgataagcttggtggtgcctttgcaccgaagccatcatctggaccccacaaatcgagggaatgcctgcctttgatccttatcctccgaaacaggctgaagtatgctctcacatatagagaagttattgccatcttaatgcagcgccatattcttgttgatggcaaggttaggactgacaagacatatcctgctggtttcatggatgttgtatctattcccaagaccaatgaaaatttccgtcttctttatgatacaaagggccgtttccgtctccactctgtaagggatgatgaggcaaagtttaagctttgcaaagttcgatctgttcagtttgggcagaaaggaatcccctatctgaacacctatgatggccgcaccatccgctatcctgatcccctcattaaggcaaatgacactatcaagctagacttggaacttaacaagatcactgaattcatcaagtttgatgttgggaatgttgttatggtgactggaggaaggaacagaggtcgagttggtgtgatcaagaacagggagaagcaaaaaggaagttttgataccatccatgtccaggatgccactggtcatgagtttgcaactcgcttgggtaatgtctttatgattggcaaaggatcaaagccttgggtgtctcttcctaaaggccgtggtatcaagttatctatcattgaagaggctaggaagaggcaagctgctcaacagcaggcagctgcttaagaggctgttcgaatacatgcttattggagcttatctactaaaaaaagcaccaaataagctctaaaaagtgcatttttggtccgcgttcaaacaggctataaatttgattcctttttattgctactgctattttagtttattttaagactgccttgaggttaaggatgagaaagttatgcgtttatttaacatctcaaattttgaactagccttattgatgagttcaattggttaaacttgtccctttttttttcattccattttgtcatccccttttatttcggtaactatgtgctggttgtggtaccgtcttatgattgaaaatgacatgcgaaagcttgagtgtgt

SEQ ID NO: 4147 - DNA, 1077 bp, Elaeis guineensis
tgacctttctttcaagagccgaacgggatctccgcgcgacttccagctcttgcagcaggaggagaaggtggagatctaaaacaacaatggcaaggggattgaagaagcatctgaagaggcttaatgccccaaagcattggatgctggacaagcttggtggtgcctttgcccccaagccatcttctggcccacacaaagcaagggagtgtttgcccctcattctgatcctaaggaataggttgaagtatgctcttacttatcgtgaagtcattgcaattctgatgcaaagacatgtaatggttgatggaaaggtcaggactgataagacctatccatctggtttcatggatgttgtatcaatacctaagactaatgagaactttcgtctcctctatgacaccaaagggcgattccgtctccactcgatcagggatgaggaggctaagttcaagctatgcaaggtccggtctgttcaatttggtcagaaaggcattccttatctgaatacttttgatggtcgcacaattcgttatccagaccccctgattaaagctaacgacactattaagcttgatctggaggctaacaagatcgttgacttcatcaagtttgatgttggaaatgttgtcatggtgactggtggaaggaacaggggacgtgtgggtgttatcaagaacagggagaagcacaagggtagttttgagactatccacctccaagatgcacttggtcatgagtttgcaactcgtattggcaacgtcttcaccattggcaaggggacaaagccatgggtttttcttcccaaaggcaagggtatcaagctcagcatcatcgaggaggctaggaagcggctcgccgcctctggtgctgctgctaccgtctgagtattgagcatgcttccatattttgtaagggatattcagatgtattttgtggacatgcaaggggggatgttttgagcccttttagttgttggtgtcaaattttccaagttttgtttgctttgaaatagggatatcagaccttttagttctcttaaattcaattaacagccagatagtgcttggtttttactta

SEQ ID NO: 4148 - DNA, 1086 bp, Elaeis guineensis
  misc_feature (966)..(966): n is a, c, g, or t
  misc_feature (976)..(976): n is a, c, g, or t
  misc_feature (987)..(987): n is a, c, g, or t
  misc_feature (1074)..(1074): n is a, c, g, or t
  misc_feature (1084)..(1084): n is a, c, g, or t
aagcacgcgagtccgggaggtcctggagtggaagaccgctgcggttaggaggacaaaatggctaggggattgaagaagcatctgaagaggctcaatgccccaaagcattggatgctggacaagcttggtggtgcctttgcccccaaaccatcttctggcccacataaggctcgtgagtgtttaccattaatccttatcctaagaaatagattgaaatatgctcttacataccgcgaagtcattgcaattctgatgcaacggcatgtactggttgatggaaaggtcaggactgacaagacctatcctgctggtttcatggatgttgtatcgataccaaagacaaacgagaattttcggctcctgtatgacaccaaggggcgctttcgtctccactccgtcagagatgaggaggccaagttcaagctatgcaaggtccggtctattcaatttggacacaaaggcattccttatcttaatacttatgatggtcgtacgatccgttatccggaccctctaatcaaggcgaatgataccattaagcttgatttggagacttgcaagattgtagatttcatcaagtttgatgtgggaaatgtagtcatggtcactggaggaaggaacagaggacgtgttggtatcatcaagaacagggagaagcacaagggcagttttgagactatccacctccaagatgcaaccggtcatgagtttgcaactcgcctcggcaatgtcttcaccattggcaaggggacgaagccttgggtttctcttccaaaaggcaagggtatcaagctcagcatcattgaggaggctaggaagcggctagctgcctctggtgcagctgccactgtctaatcatgttggttgctttcatattttgtctgggttggccggtgttcttttgtggacattttaggcccaatttatggggatgctgcaaaacctcgtaactgtttttgctgatgnccaattctgnttaagtttggntttcatctgaacaggggtatggagctcttatattctattgcatctaagtatgtattttctgataatggacaattgatacttaagtanattgggttanct

SEQ ID NO: 4149 - DNA, 1029 bp, Orobanche aegyptiaca
agagtgagagtgagagagactgaggggccgtcgccaaatttgacatccaccatcgaaaatggctagaggtttgaagaaacacttgaagaggctcaatgcccctaaacattggatgctggacaaacttggtggtgcttttgcccccaaaccatcatccggaccccataagtccagggagtgcctgccattgattcttattttgcgaaacaggcttaaatatgccctaacttaccgtgaggtgattgctatcttgatgcaacgtcaaatcttggttgatgggaaggttagaactgataagacatatccttctggtttcatggatgttgtctctattccaaagaccaatgagaacttccgactgctgtatgataccaagggtcggttcaggctgcactctattcgggatgaagaggctaagttcaagctgtgcaaagtacgttctgttcagtttggccagaagggtattccctacatcaacacatatgacggaaggacaattcgctatcctgaccctctgatcaaagccaacgacaccatcaagctcgacttagagagcagcaaaatcgtagatttcatcaaatttgatgttggaaatgtcgtgatggttaccggtggcagaaacaggggacgtgttggagtaatcaagaaccgagagaagcataagggtagttttgaaactattcatatccaagattctaccgggcatgagtttgctactaggttgggtaacgtgttcacgattggaaagggtacgaagccgtggatttctcttccaaagggcaaaggtattaagctttcgattattgaggaggctaggaagaggcttgctgcccaatctgcttgagctaagtagatgtgtttgggtttgcttctgaacgtgttgaagtactccatgaaatggatgactttattttggtattttaggatgtgtgtatttatgttttaaagagattaaaagcttttacatttatattgtttttcacaattgcttgatccatggatatttactgagaaatttgagaattttta

SEQ ID NO: 4150 - DNA, 963 bp, Phalaenopsis aphrodite
ccctaatcgctacgcctcctcgtgaagggaaagaagcggatcaaaaatggccagaggattgaagaagcatcttaagcggctcaatgcccccaagcattggatgcttgacaagcttggtggtgctttcgcgccaaagccatcttctggtccccataaagctcgggaatgtttgccgctaatcctcattttaaggaacaaattgaaatatgcgttgacttatcgtgacgtgattgctattttgatgcaacgccatgtgatggtagacggaaaggttaggacagataagacctatcccgcaggttttatggatgttatccaaatccctaaaacgaatgagaattttcggcttttgtatgacacgaagggacgctttcgtctgcattcaattagggatgaagaggcaaagttcaagctttgcaaggttcgttccgtccagtttgggcagaaaggcattcctttcctgaacacctatgatggccgcacaattcgctaccctgaccctctgataaaggcgaacgatacgataaaactcgatcttgagtcgaacaaaattgtcgactttatcaaattcgatgtcggaaatgttgtgattgtcaccggaggaaggaacagaggtcgtgttggtgtgatcaagaacagggagaagcacaagggcacgttcgagacgattcacatccaggatgcggcggggcacgagttcgcgactcggctcggcaatgtgttcaccattggaaagggaacaaagccatgggtctctcttcctaaaggtaagggtattaagctctctattattgaggaggccaggaagcgcttagctgctgcttctgctgccactgcttgatgtttctgagggtatttagagaattttcgtcgttttgttttggtgtgttttgaatgaagaatgaagaattcagtggacaaattttgtttgtggtttttgtttattgtaacttgatgtttaac

SEQ ID NO: 4151 - DNA, 1209 bp, Populus trichocarpa
acaagtagggtttttgcatctctctaagcagcaaaggtaggcgcagcccagcagagtcaccaacatcttgagctatacagttgcaaaatggctagagggttgaagaagcacttgaagaggcttaatgctccaaaacattggatgcttgataaacttggtggtgcttttgcccccaagccctcatccggaccccacaagtctagggaatgcttgcctctgattctcattctgcgaaacaggctcaagtatgctttgacataccgtgaagtgatttctattttgatgcagagacatgttcttgttgatgggaaggttaggacagataaaacctacccatctggtttcatggatgttgtgtcaatcccaaagacaaacgagagcttccgtctcctctatgacaccaaaggccgcttccggctccactccctcagagaggacgaggctaagttcaagctttgcaaagttcggtcaattcagtttgggcagaaaggaattccctatctgaacacctatgatgggcgcaccatccgctacccagatcccctcattaaggccaatgacaccatcaagctggatctagagagcaacaagatagttgacttcatcaagtttgatgtgggaaatgttgtcatggtcactggaggaaggaatagaggccgagttggagtaatcaagaacagggagaagcataagggaagctttgagacaatccatgttcaagatgccactggccatgagtttgccactcgcctgggcaacgtgttcaccattggaaagggctccaagccatggatttctcttcccaagggcaagggtattaaattgtccatcattgaggaggctaaaaagaggcttgcagcatctcaggctgctgcatgaagttcttgaattttcgttggcattttatggctagttatgttttgctaatgatagaatgaatgttgtgtttgcataatttagtgcacatttttgaacaatgtttgcttttgcatttcaatttttactgctgggatacattttaaaaaagcatgcatgagattttctgtagcatcaagaacacatcctgtgtaatctgtttttgcctgtttgtgtcaactagaacttcagttaattttattattctctgtgaacaatatcttagattttttttttgtagatttggattgtcaataggtctttctccaggtggtgcttggaaatttttacccg

SEQ ID NO: 4152 - DNA, 1157 bp, Populus trichocarpa
cctaatactgtacgtagctataaattatagtactgttttttcatctctctcaaccggtttaggcttagaagcccgcaacagaggaggagactcaagagaggctcagctcagcagagttacttgcctcttgatctttacgtttataaaatggctagagggttgaagaaacacttgaagaggctcaatgctcctaaacattggatgcttgacaaacttggtggtgcatttgcacccaaaccctcatctggaccccacaaatcaagggaatgcttgcctctgattctcattctgcgaaacaggctgaagtatgctttgacgtaccgtgaagtgattgctattttgatgcagagacatgttctggttgatgggaaggttaggacagataaaacttacccatctggtttcatggatgttgtgtcaatcccaaagacaaatgagagcttccgtctgctctatgacaccaaaggtcgcttccggcttcactcccttagagatgacgaggccaagtttaagctttgcaaagttcggtctattcagtttgggcagaaagggatcccttacctgaacacctatgatggacgcaccatccgctacccagatcccctcattaaggccaatgacaccatcaagctggacctagagagcaacaaaatagttgacttcatcaagtttgatgtgggaaatgttgtcatggtcactggaggaaggaacagaggccgagttggagtaattaagaacagggagaagcataagggaagctttgagacgatccacgttcaagatgccactggccatgagttcgccactcgtttgggcaatgtgttcaccattggaaagggctccaagccatggatttctcttcccaagggcaagggtattaaattgtctatcattgaggaggctagaaagaggcaggcagcatcccaaactgctgcatgaagctcatgatttttccttgaatactgggtttagtttttagttttgctaatgctataatggatgtttgtttgtgtaatttagtgcacaattttgaacattgtttttacatttcaattttaacttttgcgatatgcattgacaaagcaggcacgagagttttcggtagcctatttcagaactcattctgaggaatcttttttgcctgtttggttaagaaa

SEQ ID NO: 4153 - DNA, 1165 bp, Populus trichocarpa
acagccttcgcagctctctctaccagactatacttggaagccgtaagagaggagaagaggctcaagagaggcgcagctcagcagagttactgaccttttcaactttacgtttgcaaaatggctagagggttgaagaaacacttgaagaggctcaatgctcctaaacattggatgcttgacaaacttggtggtgcatttgcacccaagccctcatctggacctcacaaatctagggaatgcttgcctctgattcttattctgcgaaacaggctgaaatatgctttgacataccgtgaagtgattgctattttgatgcagagacatgtccttgttgatgggaaggtcaggacagataaaacttacccatctggtttcatggatgttgtgtcaatcccaaagacaaatgagagcttccgtctcctctatgacaccaaaggccgcttccggctccactcactcagagatgatgaggccaagtttaagctttgcaaagttcggtctattcagtttgggcagaaaggaatcccttacctgaacacctatgatgggcgcaccatccgctacccagatcccctcatcaaggccaatgacaccatcaagctggacctagagaacaacaaaatagttgacttcatcaagtttgatgtgggaaatgttgtcatggtcactggaggaaggaacagaggccgagttggagtaatcaagaacagggagaagcataagggcagctttgagacaatccatgtccaagatgccactggccatgagtttgccacccgcttgggcaatgtgttcaccattggaaagggcaccaagccatggatttctcttcccaagggtaagggtatcaagttgtctatcattgaggaggctagaaagaggcttgcagcatcccaagctactgcatgaagttcatgatttttccttgaattccggtgtcagttgtgttttgttatcataattttgtactcaactttgaacaatgtttgtttttaaagacaattctagggattccaatgccaggattggttgcaaagcgcaatgtcattagtagattaaaaggcgttacatgaaagcgatataaattgttggggaaaaaaaataaaaacaagaaagagatgcgaagacagcccaaaaaaatcgaaggatatcatagctattaaat

SEQ ID NO: 4154 - DNA, 946 bp, Scabiosa columbaria
ctacagaagcaggagtgagagaggcgcagctttagggtggaatctgacctccctcaaatcaacacaagatggcaagaggtttgaagaagcatttgaagaggctcaatgcaccaaagcattggatgcttgacaagcttggtggtgcttttgccccaaaaccatcatctggtccacacaaatctagggaatgccttcccttgattcttatcttacgaaacaggctgaagtatgctcttacataccgtgaggtccaatctatattgatgcagcgtcatgttcttgttgatggcaaagtcaggactgataagacttatccttcaggtttcatggatgttgtctccattcccaagacaaatgagaatttccgtctcctttatgacaccaaggggcgattccgtcttcattccgttagggatgaggaatcaaagtttaagctctgcaaagttcgatcagtccagttcggttcgaaagggatcccatacatcaacacatatgatggtcgcaccattcgctatccagaccctctgattaaggccaatgacaccattaagctggacttggagaccaacaagatcacagatttcattaaatttgatgtcggcaacgttgtcatggtcacaggaggtagaaacaggggacgtgttggtgtcattaagaacagagagaagcataagggtagtttcgagacggttcacattcaagatagcctaggccatgaatttgctacacgtttggccaatgttttcaccattggtaagggaacaaaaccatgggtttcacttcctaagggcaagggtatcaaattgaccatcattgaggaggctaagaggagacttgctgctcaatctgctactaccgcataaggtgtttctttgaaatgtgggttttcttcccatcttttgttttagggttatatgttgaattaagatggttgaaggcaggtaga

SEQ ID NO: 4155 - DNA, 1166 bp, Fragaria vesca
gcctctccgccgtttctcccctctgtctcttcgctcatctcatctagggtttctccatcttcctctgcaaccatggcgagaggtttgaagaagcatctgaagaggctcaatgccccaaagcattggatgctcgacaagcttggtggtgcttttgctcccaaaccatcatctgggccacacaaatcgagggagtgtcttcccctgatcatcattctgaggaacaggttgaagtatgctctcacttaccgtgaggtcattgctattctcatgcaacgtcatgttttggttgatggcaaggtcaggactgacaagacctacccttctggtttcatggatgttgtttccatcccaaaaaccaatgagaatttccgtctgctgtatgacaccaagggtcgtttccgtctccattcgatcagggatgaggaggcaaagtttaagctctgcaaggttcgctccgtgcagtttgggcagaagaacatcccatatatcaacacttatgatggtagaactattcgctacccagacccacttatcaaggccaatgatactatcaagctggacttggagaccaacaaggtcatcgacttcattaagtttgatgttggaaatgttgtcatggtgactggtggaaggaacaggggacgtgtcggagtcatcaagaacagggagaagcataagggaagctttgagaccatccacgttcaggatgctgctggtcatgagtttgccacccgtcttggcaatgtgttcaccatcggcaagggtacaaagccttgggtgtcacttcccaagggcaagggtatcaagctcaccatcattgaagaggcaaggaagcgacaagcagcactacaaactgctactgcttaaacaatatggtggcaactacagtgttgttcctatagtttagacggtacttagtttgaatcagttaagaagttggtctgttatcagcttatgctcaggatttcattttcattttgttgtcctgctttatggattactttctaagtatgaacactgatgtgaattttattatgttttgcacttgagcgagatgtgtattgaaccatttttaattgccttggcctttaaattatacaaatattagcagttttattgttccattttttatgtttgatgaaattcctagcattacatactcctgg

SEQ ID NO: 4156 - DNA, 1089 bp, Nicotiana tabacum
  misc_feature (1078)..(1078): n is a, c, g, or t
ctcgtcttcttcactgaagcaggaaaaacacagaaaatccttacaccaacaaaatggctagagggttgaagaaacatctgaagaggctcaatgccccgaaacattggatgcttgataagcttggtggagcatttgctcccaagccatcatctggtccacacaaatcaagggaatgcttgccgttgatcattatcttgcgaaacaggctgaagtatgctctcacatacagagaggtgatctcaattttgatgcaacgtcaagttatggttgactccaaagttagaaccgataagacttatccagctggtttcatggatgtggtttcaattccaaagactaatgaaaacttccgcctcctttatgacaccaaaggccgatttcgtcttcactcagtcagggacgaggaagccaagtttaagctttgcaaggtccgctctgttcagtttggccagaagggaattccatacctaaacacttacgacggaagaacaatccgctatcccgatcctcttatcaaagccaatgataccataaagctggacctggaatccaataagattgtcgatttcatcaagtttgatgttgggaatgttgtgatggttactggaggtagaaacaggggacgtgttggcgttattaagaacagagagaagcataagggtagcttcgagactgtccacattcaggatgcgttgggacatgaatttgctacccgtttgggtaatgtgttcactcttggaaagggtactaagccatgggtttcacttcctaaaggtaaaggtattaagttgtccatcatcgaggaggcacggaaaaggctggcagctcaatcagcaactactgcttaaattttcttggtggtttcatccaccgttcaagtcaatttcacgctgttggagcgtagatggagagttaagttttacagttttgagtttgaatgtttcggtttgtttagcaatacctattttattttgcgaactgccctttgaatatttgtttactttgaatatgagagagagtgattaagactcctttatggatcaaatcttgttcttttggttctaaatgtgctttactntgaccaggttt

SEQ ID NO: 4157 - DNA, 1058 bp, Valeriana officinalis
agagaacacagagagacgctaaggaggcgcagttaggctttgaggacaagaagacatcaaccatggctaggggtttgaaaaaacatttgaagaggctcaatgcccccaaacattggatgcttgacaagcttggcggtgcattcgctcccaaaccatcttctggtccccacaagtctagggaatgtttgcctttggttcttattctgaggaacaggcttaaatatgctctcacataccgtgaagtgcaatctatcttaatgcaacgccatgttcttgtcgatggcaaagtcaggacagacaaaacctacccttctggttttatggatgttgtttcaattcccaagacgaatgagaatttccgtcttctgtatgacacaaagggccgattcaggctacactctatcagggatgaagaagcaaagttcaaactttgcaaagttcggtcagttcagtttgggcagaagggtattccatacatcaacacgtatgacggtcgtaccatccgctacccggaccccctaatcaaggctaacgacaccatcaagctggatctagagacaaacaagatcacagacttcatcaagtttgacgtgggaaacgttgtgatggtgactggtggcaggaacagaggacgtgttggagtgctcaagaacagggagaagcataagggtagttttgaaaccgtccacattcaagattcgcttggtcatgaatttgccacgcgtttgtcgaatgtttacacaattggtaagggcacaaaaccatgggtttcgcttcccaagggtaagggtatcaagttgaccatcattgaagaggcgaagaagaggcttgccgcccaatctgctgcaacagcttaagttttcttttcttgaaaagaaaaactggtttaagtttcatgagttagctgctaccctagttattcagttttcttgttttcgtccaattttgaattctagtttggtttttaaaattactactatatcaaatgaggtgcttttgactttggattgtggatttatatttgattcctgatcaagcacggtgttatccttttgtta

SEQ ID NO: 4158 - DNA, 1254 bp, Vinca minor
agcagttttcttgtacctcaggagcagcagacgccatcactggagcggcgatacaaggtttctggtcttcaacatggcgagaggtttgaagaagcatttgaagaggctcaatgcccccaagcactggatgcttgacaagcttggaggagcatttgctcctaagccatcttctgggccacacaaatcgagggagtgcttacccttgatccttatcctgcgaaataagttgaaatatgctcttaactacagagaagttgttgctattctgatgcaacgacatgttatggttgatgggaaggtcaggaccgataagacttacccttctggctttatggatgttatttccattccaaagacaaacgagaacttccgtctcctttacgacaccaagggtcgtttccgtctccattccctcagggacgaggaggcaaagttcaagctttgcaaagtgcgatcagtccagttcggacagaagggaattccattcctgaacacttatgatggaaggaccatccgctatcctgatcctctcattaagcccaacgataccatcaagttggatttggagaataacaaaatcgttgacttcattaagtttgatgtgggaaatgttgtcatggttactggaggaagaaacaggggacgtgttggtgttattaagaatagagagaagcagaagggtagttttgagaccatccacgttcaagatgccactggacatgaatttgctactcgtcttggaaatgtgtttacaattggaaagggtaccaaaccctggatctctctacccaagggcaaaggtattaagttgtccattattgaggagcaaaagaagagacttgctgctacccagtctgctgctaccgcctaataatgatactttgctttttaagatgctgttcttgttttttcccatctaagattagatgttagctttcgctgctggagttttttttttaaaacaaatgatacaacgttgaacttttgatggtactgtaattttgatttgaagtagctatgcttgcttttggatttttggttagacaattttgagtattacattatgattttatgggaaaaatttcctatgggacgtaccttgtgggtacctgtgaaacatggaggtctgcaggatctaccctgcaggtggatcctttctaaatttatgtgaggagtgtgggaccgtacccacaagggctgctccatgccagattttcccgattttatgatatgtttgcctactttgtagtttat

SEQ ID NO: 4159 - DNA, 1243 bp, Cajanus cajan
gggttttgtgaactacctcccttcataagtgcgcggcgactccattagtttcttcagtttggtgtggtagggtttggagcactagcttgttcggaacaccaaaatggctaggggattgaagaaacatttgaagaggctcaatgctcctaagcattggatgcttgacaaactgggtggtgcatttgctcctaagccctcatcaggacctcacaagtccagggagtgccttcctcttatactcatcctgcgaaaccggctgaagtacgctctgacttaccgtgaagtcattgctattctgatgcagcgtcatgttcttgttgatggcaaagttaggacagacaagacctacccttctggttttatggatgttgtatcaatccccaagacaaatgagaactttcgtctgctctatgacactaagggccgattccgtctccattcagtcagggatgatgaggcgaagttcaagctctgcaaggttaggtcagtgcagtttggccagaagggtatcccatatctgaatacctatgatggtcgtaccatccgttacccagaccccgtcatcagggccaatgataccattaagctagatctggaggaaaacaagattgttgattttatcaaatttgatgttgggaatgtagttatggtgacaggtggaagaaacagggggcgtgttggagtgatcaagagcagggagaaacataagggaagctttgagacaatccacttgcaggatgccactggccatgaattcacaacccgtatgggcaatgtgttcaccattggcaagggaactaaaccatgggtatcactgcccaagggtaagggtattaagctatcaatcattgaggaagctcggaaaaggattgctgcccagcaagccactgctgcataaacccctttcggatgaatagacttgagtgctttggtagttttatttaatgtttttggtttctaagttcttttgtctgagatattttatccgttgaattttgactcatgcactatacaactttattgtggctgctatattcatgaagtaatttttccatttcgtagttttgacttgggctgtggtagtctaaaataactagatcaagtcccaccctaaaaaaatgctgtggtatttggagtgggatcctgtaactattgaaatatgttttatgattgtttgcgtgttttttattaaatacttaaatgcacaagtcattgtagtagtaaggagatgtgttttgctgcg

SEQ ID NO: 4160 - DNA, 1006 bp, Brassica juncea
cagacgggagacgagaactgccgccaccacagaggaagaagaagaggaagaagtcgtcgtcgtctgctccgagacagctgcaaacatggcgaggggattgaagaagcatctgaagaggctcaatgcacccaagcattggatgcttgacaaactcggtggtgccttcgctcccaagccctcttctggacctcacaagtcgagggagtgtcttcctcttgtcctgatcatcaggaacaggttgaagtatgctttgacataccgtgaagtcatctccatcctcatgcagaggcatatccaagttgatggaaaagtcaggactgacaaaacataccctgctggtttcatggatgttgtctcgatccccaagaccaatgagaacttccgtcttctttacgacaccaagggacgtttccgtctccactccatcagagatgaggaagcaaagttcaagctttgcaaggtgaggactatccagctcggacagaagggaatcccttacctcaacacttacgacggtcgcaccatccgttaccccgacccgctcatcaaacccaacgacaccatcaagctcgaccttgaggagaacaagattgtggacttcatcaagtttgacgttggcaacgttgtgatggtgactgggggtaggaacagagggcgtgtgggtgtgatcaagaaccgtgagaagcataagggaagctttgagacgattcacatccaagactcgacgggacacgagtttgccacgaggttgggcaatgtgtttaccctcggcaaaggaacaaagccgtgggtttctcttccaaagggcaaaggtattaagctgaccatcattgaggaagctaggaagaggctttctgctcaacaagctgcttaaagttgaatttattcaagaccttttgttcgcttcttgcttcagttttgagttttttttttattacatgtttcttgcttgcaaacccccataaaaaaaaaacagctgaacatcttagagcgttttgtaatgtat

SEQ ID NO: 4161 - DNA, 1065 bp, Fagus grandifolia
gtgcagtcgtgtttagcaaaatcttggctttgcagagagcttcgagagagtgagcagactcggctacttcttatccacacacaccacaaaatggctagaggattgaagaagcatttgaagaggctcaatgcccctaagcattggatgctggacaaacttggtggtgcatttgcccccaagccttcatctggaccccacaaatctagggaatgcttgccactggtccttatcttgcgaaacaggttgaaatatgctctcacataccatgaggtcatttcaatattgatgcagcgacatgttctggtcgatgggaaggtcaggacagataagacctatccttcaggtttcatggatgttgtctcaatccccaaaactaatgagaacttccgcctgctctatgacactaagggtcgatttcgtctccactcagtcagggatgaagaggcaaagtttaagctctgcaaagtcaggtccgtgcagtttgggcaaaaaggaatcccatatctgaacacctatgatgggcgaaccatccgttacccagaccctattatcaaagccaatgacaccatcaagctggacttggaaatcaacaagattgctgactttatcaagtttgatgttgggaatgtggtcatggtgactggtggaaggaacaggggccgtgttggagtaatcaagagcagagagaagcataagggaagctttgagacggtccacatccaggatgccagtggacatgaatttgcaactcgtttgggcaatgtgttcaccattggcaaggggacaaagccttgggtttcccttcctaagggtaagggtataaagctaaccattattgaagaggcaaggaagaggcttgcagcccaaggagcatccacagcttaaatggatatggtgaaaaataaccttccaacttatttgatggttatttgttttgtagccctgaccttttagcttcttaatttatgctccattttttttttactatttcatgcttggtaccaataatatagttgttatgagatcttgatgcatctttctcttggttttctgtagctctgaatt

SEQ ID NO: 4162 - DNA, 1046 bp, Beta vulgaris
ggccggggggaacttaattcataagatcccctaacaatatgataaaggggagggaaagacttaacaaaaatcaatctttatgttgggctctagcagagtagcaggggcataaacaaaccaaagatagaactttctcgtgagccaaggtgttacatattgcggagaaccggcggccacaactgcatattcacactccaatttcaacatggcgagaggtttgaagaagcatatgaagaggctcaatgcccccaagcattggatgcttgaaaaacttggtggagcttttgcccccaagccatcctctgggcctcacaaggctagggagtgtttgccccttatcctaattttgcgtaacaggttgaagtatgctttggtttaccgtgaagttattgctatattgatgcaacgccatgttctggttgatgggaaggtcaggactgacaagacctatcctgctggtttcatggatgtcatatcgattcccaaaacaaatgagaactttcgtctcctgtacgatgccaagggtcgtttcaggctgcactcaatcagggatgaggaagccaagttcaagctttgcaaggtaaggaatgtgcagtttggcactaaaggaattccataccttaatacttatgatgggaggaccatccgttaccctgaccccctcatcagggctaatgatactattaagcttgacttggaggagaacaagattgttgacttcatcaagtttgatgttggaaacgttgttatggtcactggaggaagaaacagaggccgtgttggagtcattaagaacagggaaaaacataagggaagctttgagacaatccacattcaagattcacaaggtcacgagtttgctactcgtatgggaaacgtctttaccattggtaaaggaacaaaaccttgggtgtctctccccaaggggaagggtatcaagcttaccatcatcgaggaggcacgtaagagagcggagaagactgcaactgcctgatcacaatatgcaaatgacaggatccagtttttgtcctttgggacacttgagt

SEQ ID NO: 4163 - DNA, 904 bp, Cicer arietinum
ggcaagaggattgaagaagcatttgaagaggctcaatgcccccaaacattggatgcttgacaaattgggtggtgcttttgctccaaaaccctcatctggaccacacaagtccagggaatgtctcccactcattctcatcttgcgtaacagattgaagtatgctttgacctaccgtgaagtcattgctattctgatgcaacgccatgtccttgttgatggcaaagttaggactgacaagacctatccatctggattcatggatgttgtgtcaatcccgaaaacaaatgagaactttcgcctgctctatgacactaaaggccgattccgtctccactcagtcagagatgatgaggcaaagttcaagctctgcaaggttcggtctgtgcaatttgggcagaaaggtatcccatacctgaacacttatgatggccgcactatccgctacccagaccctgtcatcaaggcaaatgacaccattaagctggatctggaagaaaacaagattgttgatttcatcaaatttgatgttggcaatgtagttatggttactggtggaaggaacagggggcgtgttggagtgatcaagaacagggagaagcataagggaacatttgagacaatccacgttcaggatgccactggacacgaatttgcaactcgtttgggcaatgtgtttactattggcaaggggacaaagccatgggtatctcttcccaagggtaagggtattaaactcacagtcatcgaagaagctagaaaaagggctgcagcccaacaagcaattgctgcttaaatctttatggaatgaatttataatagacttgtgtgttagttttgttcaacaattttggtttttaatgtttgttgttaatcttgtcatagaatctctcttaattatctaatg

SEQ ID NO: 4164 - DNA, 1091 bp, Gossypium hirsutum
agcccctcccatcatcttcttccacttgagtagccggctctcgcaacaaaaccagtccttgagctaacacagccgcgtttcaccaggatggctagagggttgaagaaacatttgaagaggcttaatgcccctaggcattggatgcttgacaagcttggtggtgcttttgctcccaagccatcatctggtcctcacaagtctagggaatgcttgccattgatcctcattctgcgaaacagattgaagtatgctctgacctatagagaagtcattgctattctcatgcagaggcatgttatggtagatgggaaggttagaactgataagacctaccctgctggtttcatggatgttgtttccattcctaaaacaaatgaggacttccgtctcctttacgacactaaaggacgtttccgtctccatgctatcactggcgatgaaaccaagtttaagctttgcaaggttcgatctgtccaatttggccagaagggcattccatacctgagcacatacgacgggcgtactattcgctacccagaccccttgatcaaggcaaatgacaccattaagctggaccttgagagcaacaagattgtcgatttcatcaagtttgacgttgggaatgttgtcatggtcaccggaggaaggaatagaggtcgtgttggagtaattaaaaacagggagaagcataagggtagctttgagaccattcatgttcaagatgctgctgggcacgaatttgcaactcgtctcggtaatgtcttcacaatcggaaaaggaacgaagccatgggtgtcgcttcccaagggcaaaggtatcaagttatccatcatcgaggaagctcggaagaggcttgcagcccaaaatgcagcataaactttagcatgagatatccagatatgtcttgttttcacctgaagagtaaaattttgagaactaatttcttcttgcagtttaaagtgtttgtgttgtgggggatgtcattgacttttattttatagaatattttgatgttttcttgattatcaaccctgctgttttcaaactaatctttgtatgctttttgcttaaactaatattttatttatgtt

SEQ ID NO: 4165 - DNA, 1030 bp, Eschscholzia californica
gttaactcagaggcggaagaaaagatcgggggattaggaggcgtcgaagaagaagaagaaggataagaacagtttcaacatggctaggggactcaagaagcatttgaagaggctcaatgccccaaagcattggatgctcgacaaacttggcggtgcatttgctcccaaaccatcatctggaccacacaaatccagagaatgcctgcctttgattcttatcttgcgaaataggctgaagtatgctcttacttacagggaggttgttgccattttgatgcaaagacatattttggttgatgggaaggtgaggacagatcagagatacccatccggcttcatggatgttgtgtcaattccaaagacaaatgagaatttccgtcttctctatgacaccaaaggtcgtttccgtctccattcaattaaggatgaagaggctaagttcaagctctgcaaggtccgtaatgtgcagtttggacaaaaggggatcccttacattaacacctacgatgggcgcacaatccgctaccctgacccacttatcaaggctaatgacaccattaaactcgacctagagaccaacaaaatcactgacttcatcaagtttgatgtaggaaatgttgttatggtgactggtggaaggaacagaggaagggtcggaattatcaagaacagagagaagcataagggaagtttcgaaacaatacatgtccaagattctactggtcacgagtttgctactcgtctgggcaatgtcttcactattggcaagggaaccaagccgtggatttccctacctaagggcaagggtatcaagctgtccatcattgaagaggccagaaagaggcttgctgctcagggaggtgcatctgcttaagctttgttgaaggcaataatagagcatcaggtatacctagagaatttcttagataagttttgttgtggaagcttgggtttactcttagcttgagaaacatctggtttaacttattatgtactgtttcagtttactcgttaagttggtttgacttat

SEQ ID NO: 4166 - DNA, 1151 bp, Elaeis guineensis
gtgccacgcgagggcttggctcctctgttgccgaagcacgcgagtccgggaggtcctggagtggaagaccgctgcggttaggaggacaaaatggctaggggattgaagaagcatctgaagaggctcaatgccccaaagcattggatgctggacaagcttggtggtgcctttgcccccaaaccatcttctggcccacataaggctcgtgagtgtttaccattaatccttatcctaagaaatagattgaaatatgctcttacataccgcgaagtcattgcaattctgatgcaacggcatgtactggttgatggaaaggtcaggactgacaagacctatcctgctggtttcatggatgttgtatcgatgccaaagacaaatgagaattttcggctcctgtatgacaccaaggggcgcttccgtctccactccatcagggatgaggaggccaagttcaagctatgcaaggtccggtctattcaatttggacacaaaggcattccttatcttaatacttatgatggtcgtacgatccgttatccggaccctctaatcaaggcgaatgataccattaagcttgatttggacacttgcaagattgtagatttcatcaagtttgatgttggaaatgtagtcatggtcactggaggaaggaacagaggacgtgttggtatcatcaagaacagggagaagcacaagggcagttttgagactatccacctccaagatgcaaccggtcatgagtttgcaactcgcctcggcaatgtcttcaccattggcaaggggacaaagccttgggtttctcttccaaaaggcaagggtatcaagctcagcatcattgaggaggctaggaagcggcttgctgcctctggtgcagctgccactgtctaatcatgttggttgctttcatatttgtctgggttggccggtgttctttgtggacacttaggccatttcggggggatgctgcaaatcctcgtacctgtttttgctgatgccaattctgtttaagtttggttttcatctgaacaggggtattgatgctcttatattctattgacatctaggtatgtattttctgataatggacaattgattactcaagttatatttgtgtttatcttattctatggtgattaaatcagttaaatctg

SEQ ID NO: 4167 - DNA, 895 bp, Eutrema halophilum
gaaggtgagtggagaaagaacggctgcttcagccgtcggagaaatcagaacgcattcggagattcgcctgcaaacatggcaaggggattgaagaagcatctgaagaggcttaatgcccctaagcattggatgctcgacaaacttggtggtgcctttgcccccaagccatcttctggaccacacaagtcgagggagtgccttaccctagtgctaatcatccgtaatagcttgaagtatgctctcacttaccgtgaggtgatttcgatcttgatgcagaggcatattcaagttgatgggaaagtcaggactgacaagacataccctgctggtttcatggatgttgtgtctatcccgaaaacaaacgaaaacttccgtcttctgtatgacaccaagggacgtttccgtctccattctatcagggatgaggaagcaaagttcaaactgtgcaaagtgagatctatccagtttggtcaaaagggcattccatacctgaacacctacgatggtcgcaccatccgttaccccgacccgcttatcaagcctaacgacaccatcaagctcgacctggaggagaacaagatcgtggagttcatcaagtttgatgtgggaaatgttgtgatggtgactggaggaagaaacagagggcgtgttggtgtgatcaagaaccgtgagaaacacaagggaagctttgagaccattcatattcaggactcgacgggacatgaattcgccacgaggttagggaatgtgttcactattgggaaagggacaaagccatgggtgtctcttccaaagggaaaaggtattaagcttaccatcattgaggaagctaggaagaggctttctgctcaacaagccgcttaaactgttttttcctcggtttcagaagactgtt

SEQ ID NO: 4168 - DNA, 1068 bp, Gossypium hirsutum
ttttttttgttagcccctcgcgtcatcgtcttcaaagaacgctttaccatcaaaaccagctagctaaatcaaccgcatttcaccaggatggctagaggattgaagaaacacttgaagaggctcaatgcccctaggcattggatgcttgacaagcttggtggtgcttttgcacccaagccatcatctggaccccacaaatccagggaatgcttgccattaattctcattctgcgaaacagattgaagtatgctctcacgtacagagaagttattgctattctcatgcagaggcatgtcatggttgatgggaaggttcggaccgataagacttatcctgctggtttcatggatgttgtgtccattcctaaaacaaatgaggacttccgtctcctttatgacaccaaagggcgtttccgtctccatgccatcacgggtgatgaaaccaagtttaagctttgcaaggttaggactgtccagtttggccagaaaggcattccatacctcaatacatatgatgggcgtactatccgctacccggaccctctgatcaaggctaatgacaccatcaagctggaccttgagagcaacaaaattgttgatttcatcaagtttgatgtcggaaatgttgtcatggtgactggaggaaggaacagaggccgtgtgggagtgattaagaacagggagaagcacaagggtagctttgagacaatccacgttcaggatgctgctgggcatgagtttgcaactcgtcttggtaatgtgttcacaattggaaaaggaacgaagccatgggtatcccttcccaagggcaagggtattaagttgtccatcattgaggaagctaggaagaggcttgcagcccaaaatgctgcttgaacattaacacaagatatctagatatgtcttgctgctgtagtttattctggagttactagatttcttgctttcggttatgaagaaaattttgaatatgttaatgaacttacaaggctatattttaaatgaatgcttggacttggaagctttcgtgaatatgttaatgctttgattcattatacaatatctttg

SEQ ID NO: 4169 - DNA, 1283 bp, Amborella trichopoda
atatctcattgttaacatattctttcgatctgaaccgtccatgctaaccacatggcatagaaatggaggttataagatgggagggaagcagagtcaagggggagggtttttacttgtcgaaaggggcgcagaagatcatcaagctctggtcactaaaccctaaaaaatggctcgtgggttgaagaaacatttgaagaggctcaatgctcccaagcattggatgttggacaagcttggtggtgcctttgctcctaagccatcatctgggccccacaaatcaagggaatgcttgcccctgattcttatcctgagaaacaagttgaagtatgccttgacataccgtgaagtcatctccatactgatgcagaggcatgttttggtggatggaaaggtccggactgataaaacgtaccctgctgggtttatggatgttgtatcgatccccaagacaaatgagaattttcgtcttctctatgacaccaaaggccgcttcagactccactcagtcaaagatgaagaggctaagttcaaattgtgcaaggtgcgttcagtccagtttggacagaagagcattccctacctaaacacctatgatggccgcaccatccgctaccctgacccattgattaaggccaatgacaccatcaagctggacctcgagaccaacaaaattgtcgacttcatcaaattcgatgtgggcaacgtggtcatggtcactggaggaaggaacaggggccgagttggtttgattaagagcagggaaaggcataagggaagctttgatatcatccacattgaggatgcggcgaagcatgaatttgcgactaggcttggaaatgtgttcactattggtaaggcaagcaagccttgggtctcgttgccaaagggcaagggtattaagctctctattattgaggaggcaaggaagaggaatgcagcagctgccactgctgctgcttgagagtttccttaggtatgagtttatcttttagacgggtccgagattcaactttttttcatgtttctttggtaatatagaaattgatgctggattttattagtgcttgagaaatagatttgaaattttgggactgtttgctctttgttctttgatgaacaagtttgggatctaattcggcgatgtgtgttaaaaattagttcgatgtttacttggactctactttttgagtggctttgggtttttcttcatgctaactaagtttcttgtttttctatctatttaatgctttccaaatccattaatatatggaaaaagtttatat

SEQ ID NO: 4170 - DNA, 1086 bp, Amborella trichopoda
gcagaagatcatcaagctctggtcactaaaccctaaaaaatggctcgtgggttgaagaaacatttgaagaggctcaatgctcccaagcattggatgttggacaagcttggtggtgcctttgctcctaagccatcatctgggccccacaaatcaagggaatgcttgcccctgattcttatcctgagaaacaagttgaagtatgccttgacataccgtgaagtcatctccatactgatgcagaggcatgttttggtggatggaaaggtccggactgataaaacgtaccctgctgggtttatggatgttgtatcgatccccaagacaaatgagaattttcgtcttctctatgacaccaaaggccgcttcagactccactcagtcaaagatgaagaggctaagttcaaattgtgcaaggtgcgttcagtccagtttggacagaagagcattccctacctaaacacctatgatggccgcaccatccgctaccctgacccattgattaaggccaatgacaccatcaagctggacctcgagaccaacaaaattgtcgacttcatcaaattcgatgtgggcaacgtggtcatggtcactggaggaaggaacaggggccgagttggtttgattaagagcagggaaaggcataagggaagctttgatatcatccacattgaggatgcggcgaagcatgaatttgcgactaggcttggaaatgtgttcactattggtaaggcaagcaagccttgggtctcgttgccaaagggcaagggtattaagctctctattattgaggaggcaaggaagaggaatgcagcagctgccactgctgctgcttgagagtttccttaggtatgagtttatcttttagacgggtccgagattcaactttttttcatgtttctttggtaatatagaaattgatgctggattttattagtgcttgagaaatagatttgaaattttgggactgtttgctctttgttctttgatgaacaagtttgggatctaattcggcgatgtgtgttaaaaattagttcgatgtttactggactctactttttgagtggctttgggtttttcttcatgcta

SEQ ID NO: 4171 - DNA, 1175 bp, Amorphophallus konjac
cggccgggggctccccacactatataacgccccaccgcggcttccccctcccttcgccagcagagtttagggttttgtcttcggcggcggcgcggcagggcagccgagctcccacccactccctccattgctgctgccaaccttccgccatggctcgtggacttaagaaacacctgaagaggctcaatgcgcctaagcattggatgcttgacaagctgggtggtgcctttgcacctaaaccctcatctgggcctcacaaagctcgagaatgccttcctttgatcctcattttgaggaacaagctcaagtatgctctcacatatcgtgaggtcatttcaattttaatgcaacggcatgtcatggttgatgggaagatcagaacagacaaaacatttcctgctggtttcatggatgttgtgtcaattccgaagacaaatgagaatttccggctgctttatgacaccaaggggcgcttccgtcttcatcgcataaaggatgaggaggcaaagttcaagttgtgcaaggtccgctcggttcagtttggagacaaggggatcccttatctcaacacatacgatggtcgcaccatccgttaccccgaccctctgatcaaagcaaacgacaccatcaagctagacctggaaaacaacaagatcgtcgacttcatcaagtttgacgtggggaatgtggtcatggtgacgggtggaaggaacaggggccgtgtgggtctgatcaagaacagggagaagcataagggcacatttgagacgatccacgtccaggacgctgccggccacgagttcgcgacccgtctcggcaatgtgttcactatcggcaagggctcgaagccgtgggtgtcgcttccaaagggcaagggtgtcaagcagtctatcatcgaggaacaaaggaagcgggctgctgctgcggctgcaactactgcttgaagtgaattgaggtgagatgagatgaggtgttttttttctaatccgattatgagattgggaattatgagatttctctgtaatttgttaagaactttttatgttgagcgtttttgtttctttgcactttgagtaggctaatatttatctttatgctgctttcctgttatgttttggggatatagttaccggaatacctaagaggttgcttaattaatatttctctcttttgac

SEQ ID NO: 4172 - DNA, 1063 bp, Arabidopsis lyrata
ctctcacttcttctctcaagtcgttcggagctgttcttaggaaaacaagacaagtagttcggatcagagctacgcttgcaaatctcaaaacatggcgaggggtttgaagaagcatttgaagaggcttaatgcgcctaagcattggatgcttgacaaacttggtggtgcatttgccccaaagccgtcttctggaccacataagtcgagggagtgccttcccctcgtccttatcatcaggaacaggttgaagtatgctcttacctaccgtgaagtgatttctatcttgatgcaaaggcatatccaagttgatgggaaagtcaggactgacaagacctaccctgctggtttcatggatgttgtgtctatccctaagaccaatgagaacttccgtcttctctatgataccaagggccgtttccgtctccactccatcagggatgaggaagcacagttcaagctttgcaaggtccgatctatccagtttggacagaagggcattccatacctgaacacatacgatggtcgcaccatccgttaccctgacccgctcatcaagcctaatgacaccattaagctcgaccttgaggccaacaagattgtggagttcatcaagtttgatgtcggcaatgttgtgatggttacaggaggtagaaacagagggcgtgttggtgtgattaaaaaccgtgagaagcataagggaagctttgagactatccacatccaagactcaacaggacatgagtttgcaacaaggttggggaatgtgtttaccattggcaaaggcacaaagccatgggtgtctcttcccaagggtaaaggtattaagctgactatcattgaggaggccaggaagaggcttgctggtcaacaggttgcttaattttgtgatttccagttctctcgtttatgcttccttagacgtttcatatttcctagactcacttcgtttcttttggtactctgctcagttttgaaacttatgttatattatttatttcaagagttaaaaacttcaaacatccattgtgtcctttcttgttttctactatcttcaagagttgat

SEQ ID NO: 4173 - DNA, 1015 bp, Arabidopsis thaliana
agcctcagtggaaacagagcagctgcaaacatggcaagaggattgaagaagcatctaaagaggctcaatgctcctaagcattggatgcttgacaaacttggtggtgccttcgctcccaaaccatcttctggacctcacaagtcgagggagtgtcttcctcttgtcctgatcatcaggaacaggttgaagtatgctttgacttaccgtgaagttatctctatcttgatgcaaaggcatatccaagttgatggcaaagtcaggactgacaagacttaccctgctggtttcatggatgttgtatccatccccaagaccaatgagaacttccgtcttctctacgacaccaagggacgtttccgtctccactccatcaaggatgaggaagcaaagttcaagctttgcaaggttagatctatccagtttggtcagaagggaattccatacctgaacacttatgatggtcgcaccatccgttaccctgacccgctcatcaagccaaatgacaccatcaagctggaccttgaggagaacaagattgttgagttcatcaagtttgacgtgggtaacgttgtgatggtgactggaggcagaaacagagggcgtgtgggtgtgattaagaaccgtgaaaagcataagggaagctttgagacaatccacattcaagactcaacagggcatgagtttgccacaaggttggggaatgtgtacacaatcggcaaaggaacaaagccatgggtgtctcttccaaagggcaaaggtattaagctgaccatcattgaggaagccaggaagagacttgcttcccagcaagctgcttgaaagtccaactgctttgaatcatcaagacccgtttcttttacagactcgctgcttgtctcagtttgtgagtctatttcttttcttatgttgttggatttcaaaacccatcaaaaaatagctgagtagtgctttttgtaatgtttgtatggtggattttttggtgatttaccgtttaaatcagatgacagttggtcca

SEQ ID NO: 4174 - DNA, 1139 bp, Arabidopsis thaliana
cgtgctctcactttttctctcaagtggttcggagctgtttctaagaaaacaacaggtagttcggatcggagctacgcttgcaaaactcaaaacatggcgaggggtttgaagaagcatctgaagaggcttaatgcgcctaagcattggatgcttgacaaacttggtggtgcatttgccccaaagccgtcttctggaccacataagtcaagggagtgccttcccctcgtccttatcatcaggaacaggttgaagtatgctcttacctaccgtgaagtgatttcaatcttgatgcaaaggcatatccaagttgatgggaaagtcaggacggacaagacctaccctgctggtttcatggatgttgtgtctatccccaagaccaatgagaacttccgtcttctctatgataccaagggacgtttccgtctccactccatcaaggatgaggaagcaaagttcaaactttgcaaggttcgatctatccagtttggacagaaaggcattccttacctgaacacttacgatggtcgcaccatccgttaccctgacccgctcatcaagcctaatgacaccatcaagctcgaccttgaggccaacaagattgtcgagttcatcaagtttgatgttggcaatgttgtgatggttacaggaggtagaaacagagggcgtgttggtgtgattaaaaaccgtgagaagcataagggaagctttgagacaatccacatccaagattcaacaggacatgagtttgcaacaaggttgggtaatgtgtacaccattggcaaaggaacaaagccatgggtgtctcttcccaagggcaaaggtatcaagctgactatcatcgaggaggccaggaagaggcttgctagtcaacaggctgcttaattttgtgattttcagttctttgttatgcttctttagacgtttcatatttcctagactcacttcgtttcttttggtactctgctcagttttgaaacttctcttatattatttatttcaagagttaaaaacatcaaatatccattgtgtcctctcttgttttttactatcttcaagagttggtactagttggttatggttacttggtgatagttacacaattattgagaatcagtaaaataatgaaaaatcttgtgttg

SEQ ID NO: 4175 - DNA, 1313 bp, Manihot esculenta
aaagtaattagggttttggggttggaggagaaacgagagtttggaatatttaaagccctacagccgcagacccttcccttgggattcagcagcagagcaacacagcggaaggcggaagtagagggaggagaacgctcttcagagaatggcaagagggctgaagaaacacttgaagaggcttaatgccccaaagcattggatgcttgacaagcttggaggtgcatttgcccccaaaccatcatctggacctcacaagtcaagggaatgcttgcctctgatccttattctgcgtaacaggctgaaatatgctctcacatatcgtgaagttattgctattttgatgcagagacatgttcttgttgatgggaaggttaggacagataagacttacccttcgggtttcatggatgttgtgtcaattcccaagacaaatgagaacttccgccttctatatgacactaaaggacgcttccgtctgcactccatcagagatgatgaggctaagttcaagctttgcaaagttcgatcagttcaatttggccaaaaaggtatcccttacataaacacctatgatgggcgcaccatccgctacccagatccacttatcaaggctaatgacaccatcaagctagacctagagagtaacaagattgcagacttcatcaagtttgatgtgggaaatattgtcatggtcactggaggaaggaatagggggcgagttggaattataaagaatagggagaagcacaaggggagtttcgagacaattcacattcaagatgccactggtcatgagttcgccactcgtttgggcaatgtattcactattggaaagggaaacaaaccatgggtgtcccttcccaagggcaagggtatcaagttgtcaattattgaggaggctaagaagaggcttgcagcagccccaactgttgcctaaagatttcttgaattattgtcttggaagttctcccatgatgagggaaattgttagttgcttttcatttggtgcacaagagatttttatgtggacagttttgaattatatttgtctccataacttttaactgtttttgtatttcaatttagtcacaaaattttcccgttactgagatgaaaagtaagcctttatgtttgtcagtgttatgctagcttttttgagtttttccggaccttgacgagggttttgttctagcgttatgttttgggtagcagaattgatattctagtacagaagctatagcaggtttgaagcttgcaaagatttgtggccacgcttaacttctgtttattattcattgttgaaaattttcaat

SEQ ID NO: 4176 - DNA, 2201 bp, Gossypium hirsutum
gcgtcatcgtcttcaaagaacgctttaccatcaaaaccagctagctaaatcaaccgcatttcaccaggatggctagagggttgaagaaacacttgaagaggctcaatgcccctaggcattggatgcttgacaagcttggtggtgcttttgcacccaagccatcatctggaccccacaaatccagggaatgcttgccattaattctcattctgcgaaacagattgaagtatgctctcacgtacagagaagttattgctattctcatgcagaggcatgtcatggttgatgggaaggttcggaccgacaagacttatcctgctggtttcatggatgttgtgtcaattcctaaaaccaatgaggacttccgtctcctttatgacaccaaagggcgtttccgtctccatgccatcacgggtgatgaaaccaagtttaagctttgcaaggttaggtctgtccagtttggccagaaaggcattccatacctcaatacatatgatgggcgtactatccgctacccagaccctctgatcaaggctaatgacaccatcaagctggaccttgagagcaacaaaattgttaatttcatcaagtttgatgtcggaaatgttgtcatggtgactggaggaaggaacagaggccgtgtgggagtgattaagaacagggagaagcacaagggtagctttgagacaatccacgttcaagatgctgctgggcatgagtttgcaactcgtcttggtaatgtgttcacaattggaaaaggaacgaagccatgggtatcccttcccaagggcaagggtattaagttgtccatcattgaggaagctaggaagaggcttgcagcccaaaatgctgcttgaacattaacacaagatatctagatatgtcttgctgctgtagtttattctggagttactagatttcttgcatttggttatgaagaaaattttgagaactattttcttcttgcaatcttaaattgttcggttgggtaatgttagtgaactttcaaggctatattttaaatgaatgcttggacttggatgctttcgtgaatatgttaatgctttgattaattatacaattatctttggggaaatgcaaatggttccaaatcacattgttattccacatttactcaacgccttcaaaaaccaagctgtttattgtctcttacatggcaaatgttaaggggctgctacaatggcatatagatatagatattctacaacaatttattcttctccactacctgtccctcatcatatatgtatatatagtagaacatctgtgaagcactaaaacaacagaaagatgcagcatttagatggtgattatgggcagcatcacgccccttcgtggagtagcatttgatcgaagtgccacacgccatgtccttttccaacccgccttaattgagaaacatattctgatatcttcttaatggcttcaacctgctcagctaaaaattcgctttcgatgaaatcggccatctgagcatcattgttttgcaccgcgacatcgtgcaggcacaaaagcttctcgtttgtcagcttctccaaggacaatgctaattccatagcgtatagtgcatctcccttctcagcatgatcaaactctgaagggggcatcagaatagagtgtagttttactcttcctcctcgtttgttctgatattccatcagcttctctgcatgctctctttcttcttcacttgattccttgaagaatttggcaaagcctttgagcgcaacgttgtctctgtcgaagtaagcatacaacgagtggtacacataggaaacgttgtattccacattgatttgctcattgatggcggcttcacaggcatcagcatatttctggcgagccagcgaaagatgaggagcgattgggatgtcaagttcctcctttttcacctcttcaaaaggctggaacactacccctgtaagtgcatgattgttggttcctatggatgcataaacacccaaagcccttccatgttttctgggaagaaaactcagagcagatgatgatgatgatgttacaggggagcccttaagggaacaaattagattatccccttgcttggcttgcacacacaaagatgaaactggtctcaaaagcattgtggagagatttttaggaatggagaagaaatgaaggaagattgttccccatgtactctgcgttgataacctgcgcgg

SEQ ID NO: 4177 - DNA, 2102 bp, Gossypium hirsutum
cacaagggtagctttgagacaatccacattaccaagacgagttgcaaactcatgcccagcagcccctcgcgtcatcgtcttcaaagaacgctttaccatcaaaaccagctagctaaatcaaccgcatttcaccaggatggctagagggttgaagaaacacttgaagaggctcaatgcccctaggcattggatgcttgacaagcttggtggtgcttttgcacccaagccatcatctggaccccacaaatccagggaatgcttgccattaattctcattctgcgaaacagattgaagtatgctctcacgtacagagaagttattgctattctcatgcagaggcatgtcatggttgatgggaaggttcggaccgacaagacttatcctgctggtttcatggatgttgtgtcaattcctaaaaccaatgaggacttccgtctcctttatgacaccaaagggcgtttccgtctccatgccatcacgggtgatgaaaccaagtttaagctttgcaaggttaggtctgtccagtttggccagaaaggcattccatacctcaatacatatgatgggcgtactatccgctacccagaccctctgatcaaggctaatgacaccatcaagctggaccttgagagcaacaaaattgttaatttcatcaagtttgatgtcggaaatgttgtcatggtgactggaggaaggaacagaggccgtgtgggagtgattaagaacagggagaagcacaagggtagctttgagacaatccacgttcaagatgctgctgggcatgagtttgcaactcgtcttggtaatgtgttcacaattggaaaaggaacgaagccatgggtatcccttcccaagggcaagggtattaagttgtccatcattgaggaagctaggaagaggcttgcagcccaaaatgctgcttgaacattaacacaagatatctagatatgtcttgctgctgtagtttattctggagttactagatttcttgcatttggttatgaagaaaattttgagaactattttcttcttgcaatcttaaattgttcggttgggtaatgttagtgaactttcaaggctatattttaaatgaatgcttggacttggatgctttcgtgaatatgttaatgctttgattaattatacaattatctttggggaaatgcaaatggttccaaatcacattgttcttccacatttactcaacgccttcaaaaaccaagctgtttattgtctcttacatggcaatgttaaggggctaccacaatgacatatagatatagatattctacaacaatttattcttctccactacctatccctcatcatatatgtatatatagtagaacatctgtgaagcactaaaacaacagaaagatgcagcatttagatggtgattatgggcagcatcacgccccttcgtggagtagcatttgatcgaagtgccacacgccatgtccttttccaacccgccttaattgagaaacataatctgatatcttcttaatggcttcaacctgctcagctaaaaattcgctttcgatgaaatcggccatctgagcatcattgttttgcaccgcgacatcgtgcaggcacaaaagcttctcgtttgtcagcttctccaaggacaatgctaattccatagcgtatagtgcatctcccttctcagcatgatcaaactctgaagggggcatcagaatagagtgtagttttactcttccacctcgtttgttctgatattccatcagcttctctgcatgctctctttcttcttcacttgattccttgaagaatttggcaaagcctttgagcgcaacgttgtctctgtcgaagtaagcatacaacgagtggtacacataggaaacgttgtactccacattgatttgctcattgatggcggcttcacaggcatcagcatatttctggcgagccagcgaaagatgaggagcgattgggatgtcaagttcctcctttttcacctcttcaaaaggctggaacactacccctgtaagtgcatgattgtcggttcctatggatgcataaacacccaaagcccttccatgttttctgggcagaaaactcaaagcagatgatgatgatg

SEQ ID NO: 4178 - DNA, 1100 bp, Gossypium hirsutum
ccacttgagtagccggctctcgcaacaaaaccagtctttgagttaacacagccgcatttcaccaggatggctagagggttgaagaaacatttgaagaggctcaatgcccctaggcattggatgcttgacaagcttggtggtgcttttgcacccaagccatcatctggtcctcacaagtctagggaatgcttgccattgatcctcattctgcgaaacagattgaaatatgctctgacctatagagaagtcattgctattctcatgcagaggcatgttatggtagatgggaaggttagaactgataagacctaccctgctggtttcatggatgttgtttcgattcctaaaacaaacgaggacttccgtcttctttacgacactaaaggacgtttctgtctccatgctatcactggcgatgaaaccaagtttaagctttgcaaggttcgatccgtccaatttggccagaagggcattccatacctgaacacatacgacgggcgtactattcgctacccagaccccttgatcaaggcaaatgacaccattaagctggaccttgagagcaacaagattgtcgatttcatcaagtttgacgttgggaatgttgtcatggtcaccggaggaaggaacagaggtcgtgttggagtaattaaaaacagggagaagcataagggtagctttgagaccattcatgttcaagatgctgctgggcacgaatttgcaactcgtctcggtaatgtcttcacaatcggaaaaggaacgaagccatgggtgtcgcttcccaagggcaaaggtatcaagttatccatcatcgaggaagctcggaagaggcttgcagcccaaaatgcagcataaactttagcatgagatatccagatacgtcttgttttcacctaaagagtaaaatttggagaactaatttcttcttgcagtttaaagtgtttgtgttgtgggtgatgtcatagacttttattttatagaatattttgatgttttcttgattatcaaccctgcttttttcaaactaatctttgtatgctttttgcttaaactaatattttatttatgtttaatataatgccccttaaaagcattgaaag

SEQ ID NO: 4179 - DNA, 1056 bp, Solanum melongena
tcttcttcagagcagcagcaaaaatacagagaaatttcttaagactaacaaaatggctagaggtttgaagaagcatctgaagaggctcaatgccccaaagcattggatgcttgataagcttggtggagcatttgctcccaagccgtcctctggtccacataaatcaagggagtgcttgccattggtcatcatcctgcgaaacaggttgaagtatgctctcacataccgagaagtgatttcaattttgatgcaacgacaagttctggtcgatgggaaagttaggacagacaagacatatccggctggtttcatggacatcgtttcaattccgaagactaatgagaacttccgtctgctttatgacaccaagggacgcttccgtcttcactcagttagggatgaggaagccaagtttaagctttgcaaggtccgctctgtgcagtttggtcagaagggaatcccatacctgaacacttacgatggaagaacaatccgctatcctgatcctctcatcaaggccaacgataccataaagctggacttggaatctaataagattgttgatttcatcaagtttgacgttgggaatgttgtgatggtgactggaggtagaaacaggggacgtgttggtattattaagaacagggagaagcataagggtagctttgagaccctccacattcaggatgcaacgggtcatgaatttgctacacgtttgggaaatgtgttcactcttggcaagggtactaagccgtgggtttcactacccaaaggtaaaggaattaagttgtccattatcgaggaggcacggaagaggctggctgctcaatctgccaccgctgcttaaactgtctggattgcttcatccattgttcaactctatttcatgcttttgctgcgtggataaagttaagttttgtagtttgctttgtttagtaatacatattttgttctgcaagcagcctttcgaatattttgtgttcttagttttagcatgcctagctttttgatgagaagatgattagattcctttattgatcaaatcttgttctttgt

SEQ ID NO: 4180 - DNA, 1062 bp, Fagopyrum esculentum
ggctgccgtagtgttctcaaaacctagttttccatctctcgagggacttctcctccacatcttccaccatggcgagaggtttgaagaagcacatgaagaggcttaatgcccccaagcattggatgcttgataaacttggtggagcttttgcccctaaaccctcatctggaccacacaagtctagggagtgtttgcccttgatccttattctaaggaacagattgaagtatgctcttacctaccgtgaagtcatttctatcttgatgcaaaggcatgtgcttgttgacaacaaagtcaggactgacaagacttaccctgctggtttcatggatgttgtttctattcccaagaccaatgagaacttccgtctgatgtacgataccaaaggcaggttccgtctccactctgtcagggatgaggaggctaagttcaagctctgcaaggtaagatctgttcaattcggtcagaagggaattccttacatcaacacctatgatggtcgcaccatccgctacccagaccctctcatcaaagctaacgacaccatcaagctagaccttgagaccagcaagattgtcgatttcatcaagtttgatgtcggtaatgttgtgatggtcactggtggtagaaacagaggccgtgttggagtcattaagaacagggaaaagcataagggaagttttgagaccattcatgttacagattcccagggccatgagtttgccactaggttgggcaatgtgtttatcatcggaaaaggaacaaagccgtgggtgtctcttcccaagggcaagggtatcaagctaactatcatcgaggaggccaagaagaggcagcaacaagcccaagcatctactgcttaatgaaatttcactctatgctgaggaaaacacaactctacatggtagcagcactgcttaatgaactttcttgttatgctgaggaacacatcctattttgtttttttgaatctctaaaattttgattattagtctcgaattagtttattgctatggatgtttttaatgagctgtagattgacattatttgctactaccattt

SEQ ID NO: 4181 - DNA, 1122 bp, Fagopyrum esculentum
agggtaatacatattgccaggaagaagagagcagccgaagaaggcctcgaatcgtctgcaaacctagagggaacccccggagttcatcatctccttccaccatggcgagaggtttgaagaagcatatgaagaggctcaatgcccccaagcactggatgcttgataaacttggtggtgcttttgcccctaagccatcatctggaccacacaagtcgagggaatgcttgcccttgatccttatcttgaggaacaggttgaagtatgcccttacataccgtgaagtcatttctatcttgatgcaaaggcatgtgcttgttgacaacaaagttaggactgataagacttacccagctggtttcatggatgttgtttccatccccaagaccaatgagaacttccgcctcatgtatgacacaaagggcaggttccgtcttcactctgtcagggatgaggaagctaagttcaagctatgcaaggtacgatctgtgcaatttggccagaagggaattccatacatcaacacttatgatggacgcactatccgctaccccgacccactcatcaaagccaacgacaccatcaagcttgacctcgaaaccagcaagattgttgatttcatcaagttcgatgttggtaatgttgtgatggtcactggtggtagaaacagaggccgtgttggagtcatcaagaacagggagaagcataagggaagcttcgagaccatccacgtgacagattcccagggccacgagtttgccactcgtttgggtaatgtgttcatcatcggcaagggtactaagccgtgggtgtctcttcccaagggcaagggtatcaagcttaccatcatcgaggaagccaagaagaggcaacaacaagctcaagctacaaccgcataagtcattttcagatgaacctaagaaatacattctactttgttttctattcagtacaattttggttactagacccgttttagtttatttctatcagtgctcctcactgttgttttgtttgatgaattttcaatgcagtttcagaatctggaatagtttgtagcttaaatttgtgtgctcttttgatttgctatcgttttatgaaaactaaatttccagttttatctcg

SEQ ID NO: 4182 - DNA, 1090 bp, Fagopyrum esculentum
gcggccgtagtgtcctgaaaacctagttttccatctctccagtgacttctcccccacagcttccaccatggcgagaggtttgaagaagcatatgaagaggcttaatgcccccaagcattggatgctcgataaacttggtggagcttttgcccctaaaccatcatctggaccacacaagtctagggagtgcttgcccttgatccttattctaaggaacagattgaagtatgctcttacctatcgtgaagtcatttccatcttgatgcaaaggcatgtgctcgttgacaacaaagtcaggactgacaagacttaccctgctggtttcatggatgttgtttctattcccaagaccaatgagaacttccgtctgatgtacgataccaaaggcaggttccgtctccactctgtcagggatgatgaggctaagttcaagctctgcaaggtaagatctgttcaattcggccagaagggtattccttacatcaacacctatgatggtcgcaccatccgctacccagaccctctcatcaaggccaatgacaccatcaagctagaccttgagaccagcaagattgttgatttcatcaagtttgatgtcggtaatgttgtgatggtcactggtggtagaaacagaggccgtgttggagtcattaagaacagggaaaagcataagggaagttttgagaccattcacgttacagattcccagggccatgagtttgccactcggttgggcaatgtgtttatcatcggaaaaggcacaaagccgtgggtgtcacttcccaagggtaagggtatcaagcttacaatcatcgaggaggccaagaagaggcagcaacaagcccaagcagctactgcttaatgaactttcaggctatgctgctgaatacacaacctacatggtagcagcactgcttaatgaactttcttgttatgctgaggaacacatccaactttgttttttgaatctctaaaattttggttattagtctcaaattagtttattgctatggatgtttttaatgagctgtagatttgacattgtttgctactaccatttgaagattttctgcagttctcattttgctca

SEQ ID NO: 4183 - DNA, 1098 bp, Ipomoea nil
agacaacagaccgcggagcagcaccaccggcaacggccgaacatctcagggagtagagtttcagcaaacaaccgccaacatggctagagggttgaagaagcatttgaagaggctaaatgccccaaaacattggatgctggacaagttgggtggggcatttgctcctaaaccttcttctgggccacacaaatccagggagtgcttgccattggtgcttatcattcgaaacaggttgaagtatgcccttacctatcgtgaagtcatttcaattttaatgcagcgacatgttttggttgatggtaaggtcaggacagacaagacttaccctgctggtttcatggatgttatatcaattccaaagacaaatgagaacttccgcctcctctatgataccaaagggcgattccgacttcactcaatcagggacgaggaggctaagtttaagctttgcaaagtccgctctgtccagtttggaaagaagggaattccattcatcaacacctatgatggtagaaccatccgctaccctgatcctctcatcaaggctaatgacacagtaaagctggacctggagagcaacaaggttgttgacttcatcaagtttgacgtggggaatgttgttatggtcactggtggaagaaacaggggacgtgttggtgtcctcaagaatagggagaagcataagggaagcttcgagactgttcacatccaggatgccactgggcatgagtttgctactcgtttggggaatgtgtacactattggaaaaggcaccaagccatgggtttctcttcccaagggtaagggtatcaagctctccatcatcgaagaggcaaagaagaggcttgctgctcagtctgcaatcactgcttaaatgcactgtaggctttcttccaataccccatatctgctttgaagtaattagagtttgatagaattttgttttgcaggttgaactaattttactttttgttagcaatagatttattattttaatgtgtaattctgtcctgttttccgaattcctattactcagttgcatacttttttcctgagatggaaattgactgttggaagctctactccttttatctcaat

SEQ ID NO: 4184 - DNA, 1033 bp, Lactuca sativa
cgcagagtggccattacggccggggagagctgaaggagagagtggagcagtaagtgcagaggaccgccgcagtttcgccgtacatctataccggagattcccatctcctacaccacacgccgcagccatggctcgaggattgaagaaacacatgaagaggctcaatgcccccaagcattggatgcttgataaactcggtggcgcttttgctcctaagccgtcatcaggacctcacaaatcaagggaatgtctcccattgatcctcattctgaggaacagattgaaatacgctttgacataccgtgaggtccaatccattctcatgcaacgccatgttcttgttgacaacaaagtcagaactgacaagacttaccctgctggtttcatggatgttgtctcaatccccaaaaccaatgaaaacttccgtcttctatatgacaccaagggtagattcagactccactcagtgagagatgaggaagccaagttcaaattgtgtaaggttagatcagttcaattcgggtcaaaaggcattccatacatcaacacatatgatgggagaacaattcgctacccggacccactcatcaaagcaaatgacaccatcaaactggatttggacaccaacaagattgtggatttcatcaaatttgatgttgggaatgttgtgatggtgacaggtggcaggaacacagggcgtgttgggattttgaagaacagggaaaaacataagggaagttttgagactgttcatatccaggattcaacgggtcatgagtttgcgacccgtttagggaatgtgtttactcttggaaaggggacaaagccgtgggtgtcgctgcccaagggcaaggggattaagttgactattattgaggaggctaggaagaggcaggctgcccaagctgcccaagttgcttgatttttgtgttgttgaatgttggttttgttgagacttatatggtagttgttggattttagaggtggttatgtttttgattttggtacaattttgaatgttgggttttgtttg

SEQ ID NO: 4185 - DNA, 887 bp, Lactuca sativa
gagagagtggcgcagtaagtgcagaggaccgccgcagtttcgccgtacaactataccggagattcctatctcctacaccagacgccgcagccatggctcgaggattgaagaaacacatgaagaggctcaatgccccaaagcattggatgctcgataaactcggtggcgcttttgctcctaagccatcatcaggacctcacaaatcaagggaatgcttacccttgatcctcattctgaggaacaggttgaagtatgctttgacatatcgtgaggtccaatccattctcatgcaacgccatgtccttgttgacaacaaagtccgaactgataaaacctaccctgctggtttcatggatgttgtctcaatccccaaaaccaatgaaaacttccgtcttctatatgacaccaagggtagattcagactccactcagttagagatgaagaagcaaagttcaagttatgcaaggttcgatcagttcaatttgggtcaaaaggcattccatacatcaacacatacgatgggcgaacaattcgctacccggacccactcatcaaagccaatgacaccatcaagcttgacctggacaccaacaagattgttgacttcattaaatttgatgttggcaatgttgtgatggtgacaggtggcaggaacacggggcgtgttgggatccttaaaaaccgtgaaaaacataaggggagctttgagacggttcatatccaggattcgacgggtcatgagtttgcgacccgtttggggaatgtgtttactcttggaaaggggacaaagccatgggtttcgctgcccaagggcaagggaattaagctgaccattattgaggaggctaggaagaggcaggctgcccaagctgcccaaagtgcttga

SEQ ID NO: 4186 - DNA, 1148 bp, Quercus alba
gggttttgaagtctctctgtgtgtctctctcagaacaagaggatctcacttctaagagcgcttgagcgaggctgagccacttccccagagatctctagctcacaataccaaaatggctagaggattgaagaagcatttgaagaggctcaatgccccaaagcattggatgcttgacaaacttggtggtgcatttgctcccaagccttcttctggacctcacaaatcaagggagtgcctgccattgatccttatcttgcgaaacaggttgaagtatgctctcacataccgtgaggtcatttccattttgatgcaacgccatgtactggttgatgggaaggtcaggacagataaaacctatcctgcaggtttcatggatgttgtatcaatccccaaaacgaatgaaaatttccgtctcctttatgacaccaagggtcgattccgtctccactcaatcagggatgaagaggcgaagtttaagctatgcaaagttcgctctgtgcagtttgggcaaaaaggtatcccatacctgaacacctttgatggacgaaccatccgctacccagaccctttaatcaaggccaacgacacaatcaagctggacctggagagccaaaagatcactgagttcatcaagttcgatgttgggaatgtagtcatggtgacaggtggaaggaacagaggacgagttggagtcatcaagaacagggagaagcataaggggacttttgagactgtccatattcaggatgccactgggcatgaattcgcaactcgtttgggcaatgtgttcaatattggcaaggggacaaaaccatgggtatcccttcccaagggtaagggtattaagctaaccatcattgaagaggccaggaagaggcttggagcccaaacagcgtccacatcataagatattgtggtaaaagttgtcatgaagtttaaaagtgttattttgtagtttgatcctggattttggttccaatttttgtcatgttttccatactttaaagttgaacagccgatcttaaacttttgttattttgaattaaattttgctggactaactaatgttgattgtctatttttttttctttacctggacgaatttcttggtgtttctggcaaatatcttggtaagtttctattgcaac

SEQ ID NO: 4187 - DNA, 994 bp, Capsicum annuum
cttacactaccaaaatggctagaggtttgaagaagcatctgaagaggctcaatgcccctaaacattggatgcttgataagcttggtggagcatttgctcccaagccgtcttctggtccacacaaatcaagggagtgtttgccattgatcattatcttgcgaaacaggttgaagtatgctctcacataccgagaggtgatctcaattctgatgcaacgacaagttttggttgatgggaaagtaaggacagataagacttatccagctggattcatggatgttgtttcaattccaaagactaatgagagcttccgtctcctttatgacaccaagggccgattccgtcttcactcactcagggatgaggaggccaagtttaagctctgcaaggtccgctccgtgcagtttggtcagaaggggataccataccttaacacttacgatggaagaacaatccgctatcctgatcctctcatcaaggcaaatgataccataaaactggacttggaatctaacaagattgttgatttcattaagtttgacgttgggaatgttgtgatggtgaccggaggtagaaacagaggacgtgttggtgttattaagaaccgggagaagcataagggtagctttgagaccgtccacattcaggatgcacaaggtcatgaatttgctacacgtttggggaatgtgtttactcttggcaagggtaccaagccatgggcatcactacctaaaggtaaaggtattaagttgtccatcatcgaggaggcacagaagaggctggccgctcaatccgccaccactgcttaaaactgttttggttgttgtccaagtcacttttttgctactgcagttttgtagtttggattcttaaatgtttactttgtttagtacctattttgaatatttgtgtatttgtatgcccagtattttgatgagaaagtgattagacaaagtcagatataaaaggtgataataccaccatgcttatttta

SEQ ID NO: 4188 - DNA, 1030 bp, Capsicum annuum
ggacgaggttcttcaccaaagcagctaaaattcttacactaccaaaatggctagaggtttgaagaagcatctgaagaggctcaatgcccctaaacattggatgcttgataagcttggtggagcatttgctcccaagccgtcttctggtccacacaaatcaagggagtgtttgccattgatcattatcttgcgaaacaggttgaagtatgctctcacataccgagaggtgatctcaattctgatgcaacgacaagttttggttgatgggaaagtaaggacagataagacttatccagctggattcatggatgttgtttcaattccaaagactaatgagagcttccgtctcctttatgacaccaagggccgattccgtcttcactcactcagggatgaggaggccaagtttaagctctgcaaggtccgctccgtgcagtttggtcagaaggggataccataccttaacacttacgatggaagaacaatccgctatcctgatcctctcatcaaggcaaatgataccataaaactggacttggaatctaacaagattgttgatttcattaagtttgacgttgggaatgttgtgatggtgaccggaggtagaaacagaggacgtgttggtgttattaagaaccgggagaagcataagggtagctttgagaccgtccacattcaggatgcacaaggtcatgaatttgctacacgtttggggaatgtgtttactcttggcaagggtaccaagccatgggcatcactacctaaaggtaaaggtattaagttgtccatcatcgaggaggcacagaagaggctggccgctcaatccgccaccactgcttaaaactgttttggttgttgtccaagtcacttttttgctactgcagttttgtagtttggattcttaaatgtttactttgtttagtacctattttgaatatttgtgtatttgtatgcccagtattttgatgagaaagtgattagacaaagtcagatataaaaggtgataataccaccatgcttattttactgt

SEQ ID NO: 4189 - DNA, 1033 bp, Populus trichocarpa
ccgtgatatatagcttgcgtctctctcaacctgtaaggactttagaagccgcaacaggggaggagactcaagagaggagcagctccgcagaattacttaggaacctttacgtttccaaaatggctagagggttgaagaagcatttgaagaggcttaatgcccctaaacattggatgcttgacaaacttggtggtgcatttgcacccaagccatcatctggaccccacaagtctagggaatgcttgcctctgattcttattctgcgtaacaggctgaagtatgctctcacaggccgtgaagtgcttgctattttgatgcagagacatgtccttgttgatggcaaggtcaggacagataaaacttacccatctggtttcatggatgttgtgtcaatcccaaagacaaatgagagctttcgtctcctctatgacaccaaaggccgcttcaggctccactccctcagagatgatgaggccaagtttaagctttgcaaagttcggtctgttcagtttggacagaaaggaatcccttacctgaacacttatgatgggcgcaccatccgctacccagatcccctcattaaggccaatgacaccatcaagctggacctagagaacaacaaaatagttgatttcatcaagtttgatgtgggaaatgttgtcatggtcactgggggaaggaacagaggccgagttggagtaatcaagaaccgggagaagcacaagggaacttttgagacaatccatgttcaagatgccactggccatgagtttgccactcgcttgggcaatgtattcaccattggaaagggcaccaagccatggatttctcttcccaagggcaagggtattaagttgtctatcatcgaggaggctaaaaaaaggcttgcagcatcccaagctgctgcctgaagttaatgatttttccaataatcttggcctcagttatgttttgttaacgctataattactgtttttgtttaggagtgcacgattttgaacgatgttttcacatttcaattataacttttgca

SEQ ID NO: 4190 - DNA, 934 bp, Scabiosa columbaria
ctctccgttccctcaactaaacagagtgcgagaaacaaacgcagctttagagaggaggatcctcatcttcatccagttattaacacaatatggctaggggtttgaagaagcatttgaagaggctcaatgccccaaaacattggatgcttgacaagcttggtggtgcatttgctccaaaaccatcatctggtcctcacaagtcaagggagtgtcttcctttgattctgatcctacgaaacagactaaagtatgctcttacgtaccgtgaggttcaatctatattgatgcagcgtcatgtactcgttgatggaaaagttaggactgataagacatatccttcaggttttatggatgttgtctccattcctaaaacaaatgaaaatttccgtctcctttatgataccaagggacgtttccgcctgcactctgttagggatgaggagtctaagttcaagctctgcaaagtccgttcagtccagtttgggtcgaagggtattccttacatcaatacctatgacggtcgtaccatccgctaccctgaccctctaatcaaggccaatgacaccatcaagcttgacttggaatccaacaagatcactgatttcatcaaattcgatgttggcaatgttgtcatggtcacaggaggtagaaacaggggacgtgttggtgttatcaagaacagagagaagcataagggtagctttgagactgttcacattcaagatagtcttggacatgaatttgcaacccgtttggccaatgtgtttaccattggtaagggaactaagccatgggtttcacttcccaagggcaagggtattaagctgactataattgaggaggctaaaaggaggctcgctgctcaatctgctacaactgcttgaggtttaatatttatcaaatgaaatgttgggttgttcttataggatgtttc

SEQ ID NO: 4191 - DNA, 1165 bp, Nicotiana tabacum
agggtttaagtggctctctcgtcttcttcactgaaaagcaggaaaaaaagacagaaaatccatacaccaccaaaatggctagagggttgaagaaacatctgaagaggctcaatgccccgaaacattggatgcttgataagcttggtggagcatttgctcccaagccatcctctggtccacacaaatcaagggaatgcttgccgttgatcattatcttgcgaaacaggttgaaatatgctctcacatacagagaggtgatctcaattttgatgcaacgtcaagttatggttgactccaaagttaggactgataagacttatccagctggtttcatggatgtggtttcaattccgaagactaatgaaaacttccgcctcctttatgacaccaagggccgattccgtcttcactcagtcagggacgaggaagccaagtttaagctttgcaaggtccgctctattcagtttggccagaagggaattccatacctgaacacttacgacggaagaacaatccgctatcctgatcctctcatcaaagccaacgataccataaagctggacctggaatccaataagattgttgatttcatcaagttcgatgttgggaatgttgtgatggttaccggaggtagaaacaggggacgtgtcggtgttatcaagaacagggagaagcataagggtagcttcgagactgtccacattcaggacgcattggggcatgaatttgccacccgtttgggtaatgttttcactcttggaaagggtactaagccatgggtttcactacctaaaggtaaaggtattaagttgtccatcatcgaggaggcacggaaaaggctggccgctcaatcagcaaccactgcttaaaacttcttggttgtttcatccaccgttcaagtcaatttcacgctgttggagcatagacggagttaagttttgcagtttgagtttaaatgtttcggtttgtttagcgatacatattttattctgcgacttgccctctgaatatttgtttacttggtagttgatacttgtatggctagcattttgatgagagaaaatgattaagactcctttatggatcaaatcttattcttttggttctaaatgtgctttgctgtgaccaggtttggttttaataaggattcatgccagtttggttt

SEQ ID NO: 4192 - DNA, 1018 bp, Solanum lycopersicum
taggattttaggatttctctcgtgttcttcatcgaagcagcaaaaaaaaataaaataaagagaaattcttagaccaacaaaatggctagaggtttgaagaagcatctgaagaggctcaatgccccaaagcattggatgcttgataaacttggtggagcatttgctcccaagccatcctctgggccacacaagtcgagagagtgcttgccgttggtcattatcatgcgaaacaggttgaaatatgctctcacataccgagaggtgatctcaattctgatgcaaagacaagttatggttgatgggaaagtaaggacagataagacatatcctgctggtttcatggatgttgtttcaatcccgaagactaatgagaacttccgtcttctttacgacactaagggccgattccgtcttcactcggtcagggatgaggaatccaagtttaagctttgcaaggtccggtctgtgcagtttggtcagaaggggatcccatacctgaacacttacgatggaagaacaatccgctatcctgatcctctcatcaaggccaacgataccataaagctggacttggaatctaataagattgttgatttcatcaagtttgatgttgggaatgttgtgatggtgactggaggtagaaacaggggacgtgttggtgttattaagaacagggagaagcataagggtagctttgagaccctccacattcaggattcacagggtcatgaatttgctacacgtttgggaaatgtgttcactctaggtaagggtactaagccgtgggtttcactacccaaaggtaaaggaattaagttgaccatcatcgaggaggcaaggaagaggctggctgctcaatctgccacccctgcttaaacaaactgtccttgttgcttcatccactgttcaagtcaatttcacgctttacagcgtgataaagttaagttttgtagtttgagctctaaatgttttctttgtttagtgacgcactttttttattctgcgagcagccttctga

SEQ ID NO: 4193 - DNA, 887 bp, Utricularia gibba
gattgaagaagcacttgaagaggctcaatgccccaaagcattggatgctcgacaagcttggaggagcatttgcaccaaaaccctcatccgggccacacaagtcgagggaatgcctgcctctgattctcattcttcgaaataggctgaagtatgctttgacataccgtgaagtcattgcaatcttgatgcagcgcttggtgcttgttgataacaaggtcaggaccgacaagacatacccagcaggattcatggatgtggtctctattccaaagaccaatgagaatttccgcctactgtatgacaccaagggccgcttccgcctgcattcaatcagagacgaggaggcaaagttcaagctttgcaaagtgaggtcagtccagtttggaaagaagggtattccatacctcaacacgtacgatgggaggaccatccgctaccctgatccactgatcaaggccaacgacaccataaagctggatttggaggagaacaaaatcgtggacttcatcaagtttgacgtcggaaatgtggtgatggtcaccgggggaagaaacaggggccgtgtgggtgtgatcagaaacagggagaaacacaagggaaccttcgagaccatccacgtggaggacgccacaggtcatgccttcgccacccgactgagcaacgtcttcaccatcgggaagggctccaagccctgggtgtctctccccaaggggaagggcatcaagctgtccatcatcgaagagtcgaggaagaggctcgctgcccaagctcctgccgccgcctcttaactccatgaaatgcaaaggtgctctcctgctgctcctccatctgctcgcctcgcgaaagtctcttgttttaagtttgatcatcgcctgttaggtttttgt

SEQ ID NO: 4194 - DNA, 1217 bp, Lactuca sativa
cggcagagttgaaggagagagtggagcagtaagtgcagagcaccgccgcagtttcgccgtacatctataccggagattcctatctcctacaccacacgccgcagccatggctcgaggattgaagaaacacatgaagaggctcaatgcccccaagcattggatgcttgataaactcggtggcgcttttgctcctaagccatcatcaggacctcacaaatcaagggaatgtctcccattgatcctcattctgaggaacagattgaaatacgctttgacataccgtgaggtccaatccattctcatgcaacgccatgttcttgttgacaacaaagtcagaactgacaagacttaccctgctggtttcatggatgttgtctcaatccccaaaaccaatgaaaacttccgtcttctatatgacaccaagggtagattcagactccactcagtgagagatgaggaagccaagttcaaattgtgcaaggttagatcagttcaattcgggtcaaaaggcattccatacatcaacacatatgatgggagaacaattcgctacccggacccactcatcaaagcaaatgacaccatcaagcttgacttggacaccaacaagattgtggatttcatcaaatttgatgttgggaatgttgtgatggtgacaggtggcaggaacacagggcgtgttgggattttgaagaacagggaaaaacataagggaagttttgagactgttcatatccaggattcaacgggtcatgagtttgcgacccgtttagggaatgtgtttactcttggaaaggggacaaagccgtgggtgtcgctgcccaagggcaaggggattaagttgactattattgaggaggctaggaagaggcaggctgcccaagctgcccaagttgcttgatttttgtgttgttgattgttggttttgttgagacttatatggtagttgttggattttagaggtggttatgtttttgattttggtacaattttgaatgtttgggttttgtttgttgggttaatttgattacaagttgaagactttgtgttttttggttttgacttgtatgctttttgaatcttttgatgcataaaacaaaactttttttacatctcatatttgaacaaggaaaagaactgcaagactgaaaaaacttggttttgaaaaaaaatatttttttattttctcgactttttcaggtgaaaaaagttgttga

SEQ ID NO: 4195 - DNA, 982 bp, Cajanus cajan
cggcgactccattagtttcttcagtttggtgtggtagggtttggagcactagcttgttcggaacaccaaaatggctaggggattgaagaaacatttgaagaggctcaatgctcctaagcattggatgcttgacaaactgggtggtgcatttgctcctaagccctcatcaggacctcacaagtccagggagtgccttcctcttatactcatcctgcgaaaccggctgaagtacgctctgacttaccgtgaagtcattgctattctgatgcagcgtcatgttcttgttgatggcaaagttaggacagacaagacctacccttctggttttatggatgttgtatcaatccccaagacaaatgagaactttcgtctgctctatgacactaagggccgattccgtctccattcagtcagggatgatgaggcgaagttcaagctctgcaaggttaggtcagtgcagtttggccagaagggtatcccatatctgaatacctatgatggtcgtaccatccgttacccagaccccgtcatcagggccaatgataccattaagctagatctggaggaaaacaagattgttgattttatcaaatttgatgttgggaatgtagttatggtgacaggtggaagaaacagggggcgtgttggagtgatcaagagcagggagaaacataagggaagctttgagacaatccacttgcaggatgccactggccatgaattcacaacccgtatgggcaatgtgttcaccattggcaagggactaaaccatgggtatcactgcccaagggtaaggtattaagctatcaatcattgaggaagctcggaaaaaggattgctgcccagcaagccactgctgcataaacccctttggatgaatagacttgagtgctttggattttatttaatgtttttggtttcttaagttcttttgtctgagtatattttatccgttgaattttgactcattgcactatacaac

SEQ ID NO: 4196 - DNA, 1306 bp, Quercus alba
atgggggatctgtaaccatatatattcacaagcagcttcgttcacaaaaccttgctgcctttgcagagagcttagagagacaacagacttgctctacttgtacaccacacccaaacaaaaatggctagagggttgaagaagcacttgaagaggctcaatgcccctaagcattggatgcttgacaaacttggtggtgcatttgctcccaagccttcatctggacctcacaaatctagggaatgcctgccattgatccttatcttgcgaaacagattgaaatatgctctcacataccgtgaggtcatttccatattgatgcaacgacatgttctggttgatgggaaagtcaggacagataagacctatccctcaggtttcatggaatccccaagactaatgagaatttccgcctgctttacgacactaagggtcgattccgtcttcactcaatcagggacgaagaggcaaagtttaagctctgcaaagtcaggtcggtgcagtttgggcaaaagggcatcccatacctcaacacccatgatgggcgaaccatccgctacccagaccctctcatcaaggccaatgacaccatcaagctggacttggagagtggcaagatcactgatttcatcaaatttgatgttgggaatgtagtcatggtgactggtggaagaaatagaggccgtgtcggagtaatcaagaacagagagaagcataagggaacctttgagacagtccacatccaggatgccactgggcatgaatttgctactcgtttgggcaatgtgtacactattggcaaggggacaaagccttgggtttcccttcctaagggcaagggaataaagctaaccatcattgaagaggccaagaagaggcttgcagctcaaggggcagccacagcttaaatgaacatggtgaaaataaccttcaaacttatctgatggttatttgtttttgtagctctgaccttttagctccttaaattatgttccattttttttgtctgtttcatgcttggtaacaataatatagttgttatgagatcttgatgcttgtttgtcttggttttctgtagaagctctgaattgggtattcaattcttttaagttaatattgatatttgataatctgagttttatccttatgttgcatgaggattatgtgtagattcagagaagttgtactaattgctataggcaaacttcttcacccactcatattatttaaagagacttttgcgtgcaatagttattacttatacaaaaaaaaaacttttagcgtgcaatagatgaaatgcatatgctag

SEQ ID NO: 4197 - DNA, 1083 bp, Papaver somniferum
aggcggaggagggttagctccagaggcggaagaagaagaaggagaagaagattagggtaaacctaatttacagtcgaagaaccaatcatggcgaggggattgaagaagcatttgaagaggcttaatgccccaaagcattggatgctcgataaacttggaggcgcatttgctcccaagccatcatcaggtccacacaaatctagggaatgtctacccttgattcttatcctgcgaaacagattgaagtacgcccttacctaccgcgaggttattgctattttgatgcaaaggcacattcttgttgacgggaaagtacgaacagacaagacctatccatctggattcatggatgttgtatcgattcccaagacaaacgagaacttccgtcttctgtatgacaccaagggtcgcttccgtctccactcgatcaaggatgaagaagctaagttcaagttatgcaaggttagaaatgtacactttggaagtaagggtatcccatacattaacaccttcgatggtcgcaccatccgttaccctgaccctctcatcaaggctaatgacaccatcaagctagatctcgagagcaacaagattgtggattttatcaagtttgatattggtaatgtcgtcatgtttactggaggtagaaacagaggccgtgttggtgttatcaagaacagagaaaagcataagggaagtttcgatacccttcacatccaggactctacaggccatgaatttgccacccgtctgggccaatgtgttcaccattggtaagggtaccaagccatgggtttcactccccaagggcaagggtatcaagttgtctatcatagaagaagcaagaaagagacttgctgctcaaggagctgcaaccgcataaagctcatggaagtgtcagccatcatgaggtggtaatgttttgaggcttatttagtggatcttagctaaaaaaacattgctgtttaggttatccctactttattgaacaaaatttgaagctaactctgctttgctgaggatgtatagtttgatctgcttcttagtgtcattactctttctgagaaaagagatagagactca

SEQ ID NO: 4198 - DNA, 902 bp, Brassica juncea
gacaacttcactagtcgtctgagtcggagctacgcttgcaaactccaatcatggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaagtcatctccatcttgatgcaaaggcacatccaggttgatggcaaagtcaggactgacaagacctaccctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccccgacccactcatcaagcctaacgacaccatcaagctcgacctggaagagaacaagattgttgagttcatcaagtttgatgttggcaatgttgtgatggtgactggaggaagaaacagagggcgtgttggtgtgattaagaaccgtgagaagcataagggaagcttcgagacgatccacatccaggactcgacaggacatgagtttgcaacaaggttgggtaatgtgtttacccttggcaaaggaacaaagccgtgggtgtctcttcccaagggtaaaggtattaagcttaccatcattgaggaagccaggaagaggcttgctggtcaacaagctgcttgaattttgtgattttccagctctttgttatgtactttttagacgtcatatgttttcgtagactca

SEQ ID NO: 4199 - DNA, 1050 bp, Musa acuminata
aactaatgtaccttgtcgcttttcaggctagaggattgaagaaacatctgaagaggctcaatgccccaaaacactggatgttagacaagcttggtggtgcctttgcccccaagccatcatctggtcctcacaaagcaagagaatgtttgcccttaattcttattttgagaaacaaactgaaatacgctcttacatatcgggaagtgattgcaattttgatgcaacgtcatgttatggttgatggaaaggtcaggactgacaagacctaccctgctggatttatggatgttgtttcgattcctaagacaaacgagaatttccgactcctttacgacactaaaggacggtttcgtctccattcagtcagggatgaagaggctaagttcaagctctgcaaagtacgttcagttcaatttgggcaaaagggaattccttatctgaacacatatgatggtcgtaccattcgctacccggaccctcttatcaaggcaaatgataccatcaagcttgatctggagaccaacaaaattgtggacttcatcaagttcgatgttgggaacgttgtcatggtgacagggggaagaaacactggtcgtgttggggtgatcaagaacagggagaagcacaaggggagcttcgagaccattcacatccaggactcgaccggccatgagtttgcaactcgccttgggaatgtcttcaccatcggcaagggaaccaagccctgggtctctcttcccaaaggcaagggtatcaagctcagcataatcgaggaggcaaggaaacgcttagctgctgctggtgcagctgccacaacttagtgatagcccaaactctgttatcatggtcattgtagtccatggaggtaggtggtactgaacgctgtgttctttagcttttagttttggaatttggtacttaatttcttgaaattaagaagtgaaatgttcatttaattgtttgtgttccagacaatcagagattgagttttaaaaggcaattcatttgttaagtaatagatttttaaattttggacaatttttgaagtaa

SEQ ID NO: 4200 - DNA, 1121 bp, Fagus grandifolia
ctggaccttggctgtcactcagttccaacacgatattagggtttcggaggctctttctcacactctctcacaactaaacgatctcacttctcagactgctacagcgagcagaggaggcacagccacttcgctcacagaacccaaaatggctagaggattgaagaagcatttgaagaggctcaatgccccaaagcattggatgctcgacaaacttggtggtgcatttgcccccaagccttcatctggacctcacaaatccagggaatgtatgccgttgatccttatattgcgaaacaggttgaagtatgccctcacatatcatgaggttgtttccattttgatgcaacgccatgtcatggttgatgggaaggtcaggacagataaaacatatccttcaggtttcatggatgtaatatcaatccccaaaacaaatgagaacttccgtcttctttatgacaccaagggtcggttccgtatccactccatcagggatgaagaagcaaagttcaagctatgcaaagtccgctctgtgcagtttgggcaaaaaggtatcccatacctgaacacctatgatgggcgaaccatccgctacccagaccctattatcaaggccaacgacaccatcaagctggacctggagggcaacaagattgctgatttcatcaagtttgatgttgggaatgtagtcatggtgacaggtggaaggaacaggggacgagttggagtcatcaagagcagggagaagcataaggggacttttgagactgtccatattcaggatgccactgggcatgaatttgcaactcgtttgggcaatgtgttcactatcgggaagggcactaagccatgggtatctcttcccaagggtaagggtattaagctaaccatcattgaagaggccaggaagaggcttggagcccaagcagcatccacagcataaaggtttatggtaaaaactgtcttcaagtttaagtggacttagtgatggttattttgtagtttgatcccggattaatgctccaattttggtcatgttcttatgctttaaaccaaaagctgatcttaaactgttgttgttttgaattatgaattagaattattgcttgactagctaatgtttg

SEQ ID NO: 4201 - DNA, 979 bp, Beta vulgaris
aagagagggaaggtggtgttacatataaatagagggttagggtttttgcgcagcatttggaccctcttttatctctctcgttatcacgcagcggagcaccggcggccacaactgcagattcacactccaatttcaccatggcgagaggtttgaagaagcatatgaagaggctcaatgcccccaagcattggatgcttgacaaactgggaggagcttttgcccccaagccatcctctgggcctcacaaggctagggagtgtttgccccttatcctaattttgcgtaacaggttgaagtatgctttggtttaccgtgaagttattgctatattgatgcaacgccatgttctagttgatgggaaggtcaggactgacaagacctatcctgctggtttcatggatgtcatatcgattcccaaaacaaacgagaacttccgtctcctgtacgacgccaagggtcgtttcaggctgcactcagtcagggacgaggaagccaagttcaagctttgcaaggtaaggaatgtgcagttcggcactaaaggaattccataccttaatacttacgatgggaggaccatccgttaccctgaccccctcatcagggccaatgatactattaagcttgacttggaggagaacaagattgttgacttcatcaagtttgatgttggaaatgttgttatggtcactggaggaagaaacagaggccgtgttggagtcatcaagaacagggaaaaacataagggaagctttgagacaatccacattcaagattcacaaggtcacgagtttgctactcgtatgggaaacgtctttatcattggtaaaggtacaaaaccttgggtgtctctccccaagggcaagggtatcaagcttaccatcatcgaggaggcacgtaagagagcggagaagactgcaactgcttgatcaccaatatgcaaatgagagtatccagtttttgtcttttgggacacttgagt

SEQ ID NO: 4202 - DNA, 1103 bp, Eschscholzia californica
gggagagagagaggcagtactacagactacagaggactcacaggcggaaggagaaggcggggagttttcaagcgaagaagaataactcaatcatggcaagaggactgaagaagcatttgaagaggctcaatgccccaagccactggatgctcgacaagcttggtggtgcatttgctccaaaaccatcctctggaccccacaaatccagggaatgcctcccattgattcttatcctgcgaaataggttgaaatatgctcttacatatagggaggttgttgctattttaatgcaacgacatattttggttgatggaaaggtgcgaacagaccagagatatccatcaggcttcatggatgtcgtgtcgatcccgaaaacaaatgagaacttccgtcttctctatgataccaagggtcgcttccgtctccattcaatcaaggatgaagaggctaagttcaagctctgcaaggtccgtaatgtgcagtttggacagaagggtatcccttacattaacacctatgatggacgcacaatccggtaccctgacccacttatcaaggctaacgacaccatcaaacttgacctcgagaacaacaaaatcaccgatttcatcaaatttgacgtaggaaatgttgtcatggtgactggtggaagaaacaggggacgagttggtgttattaagaacagagaaaagcacaagggaagctttgagacaatccatgtccaggatgcaactggtcatgaatttgcaactcggttgggcaatgtgtttactatcggcaagggaaccaagccatggatttcacttcccaagggcaagggtatcaagttatcaatcatcgaagaagcgagaaagaggcttgctgctcaaggagctgccaccgcttagctttactgaaaggtaatagccatcaggtataagacttcaaagttttctagatgaatttactgttcaagattagctgaagaaaaacagttgtttttaattagtgtatgaacaaagttttgaagttggttcaagttttatgttggagaaacaatatggtggactagtatcaccgaatcagatgttcttatattgtctttacaactagtagcagtttat

SEQ ID NO: 4203 - DNA, 1377 bp, Gossypium raimondii
ctaagtttaaaccataaattgccactgaatatagattagggttttttcgtctctctcttattcgcaccttccctggaaaggtaaaggctttcagcggaaacagcttcattccaccaaaatggctagagggttgaagaaacatttgaagaggctcaatgctcctaggcattggatgcttgacaaacttggcggtgcatttgcaccaaagccatcatctggacctcacaaatccagggaatgcttaccactagttctcattcttcgaaacagattaaaatatgctctgacatatagagaagtgattgctattcttatgcagaggcatgttatggtagatgggaaggttagaactgataagacttatccagctggtttcatggatgttgtgtcaattccaaagacaaatgaggacttccgtctcctctacgatacaaaaggtcgattccgccttcatgccatcactggtgatgagtccaagtttaagctctgtaaagttcggtctgtccagtttggccagaagggtattccatacctcaatacttatgatggccgaacaatccgctacccagatccattgatcaaggctaatgacaccatcaagcttgacttagagagcaacaaaattgtcgatttcatcaagtttgatgtcgggaatgttgtcatggtcactggaggaaggaacaggggacgtgttggagtgattaagaacagagagaagcataagggtagctttgagacaatccatgttcaagatgctgctggccacgagtttgcaacccgtcttggcaatgtgtttacaattggtaaggggacaaagccgtgggttttgcttcctaagggcaagggtatcaagttgtcgatcattgaggaagcccggaagaggcttgcagcccaatccgccgcgtaagtttgataatatttggagctgtttaaagaattgatgagttggatgcttgctggctggtactttgtgttggttcttctgtaagttctatcctctgcttttcaactcatgagcggcagttttagaccaatcgtcttcttgaaatttagttgcagtagtttagtttgttacatttgttttatcgaaggaagttgttacatttttagtaaatcattatatagcatagtaaaattcttgtttgctaaaatctgctttgcatcttggctcacttttatttcctatataggtcaagccaggtcgatgtatggtttcaataaattacatatttgtctagatccaatatgtgataatgggttttgaattttgtaactctggaagaagctaactgaaatcaacaattaaatatagcattagcttcctatgttaaaatttgtttctttccccaatcattttcattaattttgattgaaaga

SEQ ID NO: 4204 - DNA, 1210 bp, Gossypium raimondii
aattcatatatggatctcaaaccctaaaatgccctcatcaaatttagactagtatagatagataggcgttattagggttttcgttagcccctcccatcatcttcttccacttgagtagccggctctcgcaacaaaaccagtctttgagttaacacagccgcatttcaccaggatggctagagggttgaagaaacatttgaagaggctcaatgcccctaggcattggatgcttgacaagcttggtggtgcttttgcacccaagccatcatctggtcctcacaagtctagggaatgcttgccattgatcctcattctgcgaaacagattgaaatatgctctgacctatagagaagtcattgctattctcatgcagaggcatgttatggtagatgggaaggttagaactgataagacctaccctgctggtttcatggatgttgtttcgattcctaaaacaaacgaggacttccgtcttctttacgacactaaaggacgtttctgtctccatgctatcactggcgatgaaaccaagtttaagctttgcaaggttcgatccgtccaatttggccagaagggcattccatacctgaacacatacgacgggcgtactattcgctacccagaccccttgatcaaggcaaatgacaccattaagctggaccttgagagcaacaagattgtcgatttcatcaagtttgacgttgggaatgttgtcatggtcaccggaggaaggaacagaggtcgtgttggagtaattaaaaacagggagaagcataagggtagctttgagaccattcatgttcaagatgctgctgggcacgaatttgcaactcgtcttggtaatgtcttcacaattggaaaaggaacgaagccatgggtgtcgcttcccaagcgcaaaggtatcaagttatccatcatcgaggaagctcggaagaggcttgcagcccaaaatgcagcttgaactttaacatgagatatccagatacgtcttgttttcacctaaagagtaaaatttggagaactaatttcttcttgcagtttaaagtgtttgtgttgtgggtgatgtcatagacttttattttatagaatattttgatgttttcttgattatcaaccctgcttttttcaaactaatctttgtatgctttttgcttaaactaatattttatttatgtttaatataatgccccttaaaagcattgaaagaaaa

SEQ ID NO: 4205 - DNA, 1174 bp, Cajanus cajan
tacaagggggagggttttgggtatctctcttcattcaggcgcgcgcagaggaacttgttctctgaagagctgaagcctccaacatggctagaggattgaagaaacacttgaagaggctcaatgcaccaaaacattggatgctagacaaacttggtggtgcctttgcacccaagccatcatctggaccacacaagtcaagggagtgcctgcctttgatcctaatcctgcgaaacagactaaagtatgctctaacatatagagaagttattgccatcttgatgcagcgccatgtttttgttgatggcaaggttaggactgacaagacatatcctgctggtttcatggatgttgtttccattcccaaaacaaatgaaagtttccgtcttctgtatgacacaaagggtcgtttccgactccactctgtaagggacgaagagtcaaagttcaagctctgcaaggtgcgatctgttcaatttgggcaaaagggcattccctatttgaacacatacgatggacgcaccatccgctatcccgatcctctaatcaaggctaatgacaccatcaagctggacctggagagcaacaagatcactgatttcatcaaatttgatgtaggaaatgttgtcatggttaccggtggaaggaacagaggtcgtgtcggtgtcatcaagagccgggaaaagcacaagggaagttttgagaccatccatatccaggatgctactggtcatgagtttacaactcgcatgggtaatgtcttcattattggcaaagggacaaagccttgggtgtctcttcccaaaggccggggtatcaagttgtctatcatcgaggaggctagaaagaggcaggctgctcaacatgaaacaactgcctaaattttattaaacaattttgctaacaattttgctgccaagttttagctggttttgctcttcggctgtctgagcataggatttttggtgaaatgtctgagcgtagttttgtgacaaacttaatattacaattgtgatgtgtttttcagtttttattaccttatcaatattatgttgacatgttactgaatttttagggggtaaaagatacttccctattatttacttatagttgcatttttcacctgaaaatattcagtatattataccttaatttagttatttatttatttatcagg

SEQ ID NO: 4206 - DNA, 1286 bp, Papaver somniferum
agctccagaggcggaagaagaagaagaaaattagggtaaacctaatttacagtcgaagaaatcaatcatggcgaggggattgaagaagcatttgaagaggcttaatgcccccaagcattggatgctcgataaacttggaggcgcatttgctcccaagccatcatcaggtccacacaaatctagggaatgtctacccttgattcttatcctgcgaaacagattgaagtacgctcttacataccgtgaggttattgctattttgatgcaaaggcacattcttgttgatgggaaagtccgaacagacaagacctatccatctggattcatggatgttgtatcgattcccaagacgaatgagaacttccgtctcctgtatgacaccaagggtcgcttccgtctccactcaatcaaggatgaagaagctaagttcaagctctgcaaggttagaaatgtgcacttcggatctaaaggtatcccatacattaacaccttcgatggtcgcaccatccgttaccctgaccctcttatcaaggctaatgacactatcaagctagatctcgagagtaataagattgttgattttatcaagtttgatattggtaatgtcgtcatggtcactggaggtagaaacagaggccgtgttggtgttatcaagaacagagaaaagcataagggaagtttcgatacccttcacatccaggactctacaggccatgagttcgccacccgtttggccaatgtgttcaccattgggaaaggtaccaagccatgggtttcactccccaagggcaagggtatcaagttgtctatcatcgaagaagcaaggaaaagacttgcagcacaaggagctgcaacagcataagcttattgaaggtttcatgaggatttttggcggcttgtttagttaattgtagcttaagataaacaattcctgttttagttcatctctactttgttgaacaaaatttttaagttgactctgtttttgtgtttcagaccaaggagaatattttattttgatcttctgagttagtatcatcttactgtttccttgtgttgttattcttttacagcagtcaattcatcatgcatttttgcatggacatctgtttcccactatttgttttctgtatctgttacccaaagcaatctgtttactgatttgacagaagaattgggtgatatattttgcatattcatagagataaataatggtgaaataatattatggtgatggtgagtttggaactttggatgtataattttaaaggttggatttattggtc

SEQ ID NO: 4207 - DNA, 1230 bp, Papaver somniferum
gtaaatgacactaagaagcagatcaaactataacattctcagaaagaaagtggcgaggagggttagctccagaggcggaagaagaagaaggagaagaagattagggtaaacctaatttacagtcgaagaaccaatcatggcgaggggattgaagaagcatttgaagaggcttaatgccccaaagcattggatgctcgataaacttggaggcgcatttgctcccaagccatcatcaggtccacacaaatctagggaatgtctacccttgattcttatcctgcgaaacagattgaagtacgcccttacctaccgcgaggttattgctattttgatgcaaaggcacattcttgttgacgggaaagtgcgaacagacaagacctatccatctggattcatggatgttgtatcgattcccaagacaaacgagaacttccgtcttctgtatgacaccaagggtcgcttccgtctccactcgatcaaggatgaagaagctaagttcaagttatgcaaggttagaaatgtacactttggaagtaagggtatcccatacattaacaccttcgatggtcgcaccatccgttaccctgaccctctcatcaaggctaatgacaccatcaagctagatctcgagagcaacaagattgtggattttatcaagtttgatattggtaatgtcgtcatggttactggaggtagaaacagaggccgtgttggtgttatcaagaacagagaaaagcataagggaagtttcgatacccttcacatccaggactctacaggccatgaatttgccacccgtctggccaatgtgttcaccattggtaagggtaccaagccatgggtttcactccccaagggcaagggtatcaagttgtctatcatagaagaagcaagaaagagacttgctgctcaaggagctgcaaccgcataaagctcatggaaggtgtcagccatcatgaggtgtaatgttttgaggcttatttagtgaatcttagcttaaaaaaacaattgctgttttagtttatccctactttattgaacaaaattttgaagctaactctgctttgctgaggatgttatagtttgatctgctttctttagtgtcatttactccttttcttatgttaatactttgtttttcagttctgcatcattcaatccatctttagcttcaaaaaatgtatgttcagttgcttagtcaaaacaggattcccatccttgttgaggaac

SEQ ID NO: 4208 - DNA, 1144 bp, Gossypium hirsutum
ttgctgcgcctgcaggtgcgacactagatggatccaaacaattcggcgcgagtcttcttgccttgagtagccggctctcgcaacaaaaccagtctttgagttaacacagccgcatttcaccaggatggctagagggttgaagaaacatttgaagaggctcaatgcccctaggcattggatgcttgacaagcttggtggtgcttttgcacccaagccatcatctggtcctcacaagtctagggaatgcttgccattgatcctcattctgcgaaacagattgaaatatgctctgacctatagagaagtcattgctattctcatgcagaggcatgttatggtagatgggaaggttagaactgataagacctaccctgctggtttcatggatgttgtttcgattcctaaaacaaacgaggacttccgtcttctttacgacactaaaggacgtttctgtctccatgctatcactggcgatgaaaccaagtttaagctttgcaaggttcgatccgtccaatttggccagaagggcattccatacctgaacacatacgacgggcgtactattcgctacccagaccccttgatcaaggcaaatgacaccattaagctggaccttgagagcaacaagattgtcgatttcatcaagtttgacgttgggaatgttgtcatggtcaccggaggaaggaacagaggtcgtgttggagtaattaaaaacagggagaagcataagggtagctttgagaccattcatgttcaagatgctgctgggcacgaatttgcaactcgtcttggtaatgtcttcacaattggaaaaggaacgaagccatgggtgtcgcttcccaagcgcaaaggtatcaagttatccatcatcgaggaagctcggaagaggcttgcagcccaaaatgcagcttgaactttaacatgagatatccagatacgtcttgttttcacctaaagagtaaaatttggagaactaatttcttcttgcagtttaaagtgtttgtgttgtgggtgatgtcatagacttttattttatagaatattttgatgttttcttgattatcaaccctgcttttttcaaactaatctttgtatgctttttgcttaaactaatattttatttatgtttaatataatgcccctt

SEQ ID NO: 4209 - DNA, 1037 bp, Arabidopsis lyrata
acacatgttaaaaacttaaaattagggttttgtgtttcgcttcttctgaaaccctagaagatataagtgagactggtttgctcagccgcggagaactcagaactcattcgctgcaaacatggcaagaggtttgaagaagcatttgaagaggctcaatgctcctaagcattggatgcttgataaacttggtggtgcctttgcccccaagccgtcttctgggccacacaagtctagggagtgtttacccctggttcttatcatcaggaacaggttgaagtatgcccttacatacagagaagtgatctcgatcttgatgcaaaggcatattcaagttgatgggaaagtgaggactgacaagacttaccctgctggtttcatggatgttgtttctatcccgaaaacaaatgagaacttccgtcttttgtatgacaccaagggacgcttccgtctccactccatcaaggatgaggaagccaagttcaagctttgcaaggtgagatcgatccagtttggccagaagggtattcccttcttgaacacatatgatggtcgcaccatccgttaccccgacccgctcatcaagcctaacgacacaatcaagctcgacctcgaggagaacaagattgtggagttcattaagtttgatgtgggcaatgtagttatggtcactggaggaagaaacagagggcgtgttggtgtgattaagaaccgtgagaaacacaagggaagctttgaaaccatccacattcaagactcaacaggacatgagtttgctacaaggttgggaaatgtgttcacaatcgggaaaggaacaaagccatgggtgtctctaccaaagggcaaaggtattaagttgaccatcattgaggaagccaggaagagactttctgctcaacaagcttaatactattctctgttttccagtttcagaacaaaccatgctttagtttgcagcttttcaatgagtctacttttgttttaaaacttatcttttgggattgttatgagctattttttggaccttttgtgctattaat

SEQ ID NO: 4210 - DNA, 1079 bp, Arabidopsis thaliana
acacatgttaaaaacttaaaattagggctttgtgtttcgcttcttctcaaaccctagaagatataattgagactggcttgcttagccgcggagaactcagaactcattcgctgcaaacatggcaagaggtttgaagaagcatttgaagaggctcaatgctcctaagcattggatgcttgataaacttggtggtgcctttgcccccaagccgtcttctgggccacacaagtctagggagtgtttacccttggtccttatcatcaggaacaggttgaagtatgctctgacatacagagaagtgatttcgatcttgatgcaaaggcatattcaggttgatgggaaagtgaggactgacaagacttaccctgctggtttcatggatgttgtgtctatccccaaaacaaatgagaacttccgtcttttgtatgacaccaagggacgtttccgtctccactccatcaaggatgaggaggctaagttcaagctttgcaaagtgagatcgatccaatttggtcagaagggtattccctacttgaacacatatgatggtcgcaccatccgttatcctgacccgctcatcaagcctaacgacaccatcaagctcgaccttgaggagaacaagattgtggagttcattaagtttgatgtgggcaacgtagttatggtcactggaggaagaaacagagggcgtgttggtgtgattaagaaccgtgagaaacacaagggtagctttgaaaccatccacattcaagactcaacaggacatgagtttgcaacaaggttgggaaatgtgtacacaatcggtaagggaacaaagccatgggtgtcccttccaaagggtaaaggtattaagttgaccatcattgaggaagccaggaagagactttctgctcaacaagcttgatagttaatactatgctctgttttccagtttcagaacaaaccatgctttagtttgcagcttttcaatgagtcacttttgttttaaaacttatcttttcggattgttatgagctatattttggaccttttgcgctattaatattaagtttgaactcaaccttgtttcttcagatagt

SEQ ID NO: 4211 - DNA, 865 bp, Musa acuminata
tagagaggaggcggaggaaggaaccggagatccgaaaatatggcaaggggattgaagaagcatctgaagaggctcaatgccccaaagcactggatgctggacaagcttggtggagcattcgctcccaagccgtcgtctggccctcataaagccagggaatgcttgcccttgatccttattctaaggaacaaactgaaatatgctcttacgtaccgtgaagtcattgctattctgatgcaacgccatgtgatggtggatggaaaagtcaggactgataagacttaccctgctggtttcatggatgttgtatcaatacccaagacaaatgagaactttcgactcctttatgacaccaagggacgctttcgtctccactcagttagggatgaagaggcaaagttcaagctctgcaaggttcgctccgtgcagtttggacagaagggcattccctacctgaacacatatgatggtcgtaccattcgctaccctgatcctcttattaaggccaatgacaccatcaagcttgacttggaaaccaacaagatcgtcgacttcatcaagtttgatgttggaaatgttgtgatggtgactggtgggagaaacaccggtcgtgtcggtgtgattaagaacagggagaagcacaaggggagctttgataccatccacgtccaagatgccactggccatgagtttgcgactcgcatgggcaacgtcttcacgatcggcaagggacaaagccatgggtgtctcttccaaaggcaaggaatcaagctcagcatcattgaggaggcacgaaagcgcttggctgctgctggcgcaactgccactgcttagttctatgctctgcatccatctgaattttgtc

SEQ ID NO: 4212 - DNA, 1133 bp, Phaseolus coccineus
cactcgggggagggttttaaagagacgcaactcctctgctctgtttcttcagttcggtggtgccgtagcagggagctccagcgtatctctcaattccaagatggctagaggattgaagaagcatttgaagaggctcaatgccccaaagcattggatgcttgacaaactgggtggtgcatttgctcccaagccctcatctggaccacacaaatctagggaatgcctgccacttattctcattttgcgtaaccggctgaagtatgccctgacataccgtgaagtcatttctattctgatgcaacgacatgtcctcgttgatggcaaagtcaggacagacaagacatatccttctggttttatggatgttgtatccatccctaaaacaaatgagaacttccgcctgctgtatgacactaaaggcagattccgtcttcactcagtcagggacgaagaagctaagtacaaactctgcaaggttcggtcagtgcagtttgggcaaaagggcatcccatacctgaacacctatgacgggcggactatccgctaccctgaccctgtcatcagggctaatgacaccatcaagttggacttggaggaaaacaagattgttgagttcatcaaatttgatgttgggaatgtagtcatggtgacaggtggaaggaatagagggcgtgttggagtgatcaagagcagagataagaacaagggaagttttgagactatccatgtccaagatgctactgggcacgaatttgcaactcgtttgggcaatgtgtttaccatcggcaagggaacaaaaccttgggtatctcttcccaagggtaaaggtatcaagctttccatcatcgaggaagctaggaagaggatttccgcccaacaagctactgctgcttaaatcatcattaggatatgaatagacttttgagtgcttttagttttcatgcgatgctttttgcttctaatttttattatctggagattttatccgttgaattttgtctcttcaatgcactatagaacttttattgctgctgctatatagtcatgaaggaatccttccattccataattttttttaatgttgttttagctggaacaagtctcttaagcaagtccactcaatgcatcttttt

SEQ ID NO: 4213 - DNA, 1151 bp, Theobroma cacao
tgcagcccctcccacctcctcattcaaagaacggcttgagcaaaacctcaggctttgagctagcacagccgcattttcaacaagatggctagagggttgaagaaacatttgaagaggctcaatgcccctaagcattggatgcttgacaagcttggtggtgcttttgctcccaagccatcatctggcccccacaagtccagagaatgcttgcccttgatcctcattctgcgaaacagattgaagtatgctctcacatatagagaagtcattgctattcttatgcagaggcatgttatggtagatggaaaggttaggacagataagacctatcctgctggtttcatggatgttgtttccattcctaaaacaaatgaggacttccgtctactttatgacaccaaagggcgtttccgtctccatgctatcactggtgacgaaaccaagtttaagctttgcaaggttcgatccgtccagtttggccagaaaggaattccatacctcaatacatatgatggacgtactatccgctacccggaccctctgatcaaggctaatgacaccatcaagctggaccttgaaagcaacaaaattgttgactttattaagtttgatgttgggaatgttgtcatggtcactggagggaggaacagaggtcgtgttggagtaattaagaacagggagaagcacaagggtagctttgagacaatccatattcaagatgctgctggacacgagtttgccactcgtcttggtaatgtcttcacaattggaaaaggaacaaagccatgggtttcacttcctaagggcaagggtatcaagttatccgtcattgaggaagctaggaagaggcttgcagcccaaaatgctgtttaaactttagcataaggtacccagatatgttttgctgtggtagtattttctggagatactaggtttcttgtttttaacttatgagcacaattttgaaaaccattttgttcttgcaatttaagtccttttcggttgggtgatgttagtgacatatcaggctatgaattatcgaaaacttggttgttgtcgtgaatatttctgatttagttggttaattgagagagttgcttctgccaccctttatatcctttgaaataaatatttaaattgctattgttatc

SEQ ID NO: 4214 - DNA, 986 bp, Brassica napus
cactcgttcagagctaaacgagagaagccgtctgtatcggcgctacgcacatggcgagaggtttaaagaagcatttgaagaggctcaatgcccctaagcattggatgcttgacaaacttggtggtgcttttgcccccaagccatcttctggaccacacaagtctagagagtgccttcctcttgttcttatcattaggaacaggttgaagtatgctcttacctaccgtgaagtcatctccatcttgatgcaaaggcatattcaggttgacggcaaagtcaggaccgacaagacctaccctgctggtttcatggatgttatctctatccccaagactaacgagaacttccgtcttctctatgacaccaagggtcgtttccgtcttcactccatcagggatgaggaagccaagtttaagctttgcaaggttcgaactatccaggtcggacagaagggcattccttacctcaacacatacgatggtcgcaccatccgttaccctgacccgctaatcaagcctaacgacaccatcaagctcgatcttgaggagaacaagattgttgagttcatcaagtttgatgtcggcaatgttgtgatggttaccggaggaagaaacagggggcgtgttggtgtgattaagaaccgtgagaagcataagggaagctttgagactatccacatccaagactctacgggacatgagtttgcaacacggttgggtaatgtgttcacccttggcaaaggaacaaagccgtgggtgtctcttcccaagggtaaaggtattaagcttaccatcattgaggaggccaagaagaggcttgctggtcaacaggctgcttgattttgttattttccagctcgttatcatgtctttttagacttcttatgttttcgtagactcgctttgcttcttgttttggaacttgtgttaatttctctgtttcaagaattcaacaaaaaaacataaaagcatcacagcctttagttt

SEQ ID NO: 4215 - DNA, 1103 bp, Brassica napus
aacttcactagtcgtctgaatcggagctacgcttgcaaactccaatcatggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaggtcatctccatcttgatgcaaaggcacatccaggttgatggcaaagtcaggactgacaagacctaccctgctggtttcatggatgttgtctctatccccaagactaacgagaacttccgtcttctctatgacaccaagggtcgtttccgtctccactccatcagagatgaggaagccaagtttaagctttgcaaggttcgaactatccaggtcggacagaagggtattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgttggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaaggtattaagctcaccatcatcgaggaagccaggaagaggctcgctggccaacaagctgcttaagttttcgactttcagctctttatcatgtcgttttagatgacttttgtttccttagactctcactttgcatcttttggtttgctactcagttttggaacttaagttattttatctatttcaagagtttttaaaaactgactctagtacaacacaaggacaacactgtaccaattcgttggttaggacttaacttccgaagtctttaggtacggtaaaacttaacattaagtttaacttagattacgttttaaatagttaggttaaacg

SEQ ID NO: 4216 - DNA, 1091 bp, Castanea mollissima
cgcaggtgcagccgagtgagaagaccagctccaacgtcggcgccgagatctacgataccacaactccaacatggctagaggtttgaagaaacatttgaagaggcttaatgcgccaaagcattggatgcttgacaaacttgggggtgcatttgctcccaagccgtcgtctggcccccacaaatcaagggagtgcttgcccttgattcttatcctgaggaacaggttgaagtatgcactcacataccgtgaggtcattgccattctgatgcaacgacatgttttggttgatgcgaaggttaggactgataagacctaccctgctggcttcatggatgttgtatcaattcccaaaacaaatgagaacttccgtctcctttatgataccaagggtcggttccgtctccactcaattagggatgaagaggctaagttcaagctctgcaaggtccggtctgtgcagtttgggcagaagggaatcccctatctcaacacctatgacgggcgaactatccgctaccctgacccaattattaaggctaatgacaccatcaagctggacttggagactggcaagatcaccgacttcattaaatttgatgttggtaatgttgtcatggtgactggtggaaggaacagaggccgtgttggagtcattaagaacagggagaagcataagggaacctttgagactgttcacatccaggatgccacaggtcatgagtttgccacccgtcttggaaatgtgtacaccattggcaagggcacaaagccatgggtctctctccccaagggcaagggtataaagttgtcaatcattgaagaagcaaagaagaggcttcaaggccaacagactactgctgcttaaatactgttgtggttccattatagttttagaagattacttaggtgaagtttactcttgcaatttgacccctctagcttggggtgtgttttatttgaattttgcagtacttgattttggacagtcctatgagttgcaatatttatgcctaattttgttttgcactacaatgggaagtatcaagactattttgatcagcttactgtgtgtttgaaaattttaacaaaaa

SEQ ID NO: 4217 - DNA, 1284 bp, Gossypium hirsutum
cgtctctctcttattcgcaccttccctggaaaggtaaaggctttcagtggaaacagcttcattccaccaaaatggctagagggttgaagaaacatttgaagaggctcaatgctcctaggcattggatgctcgacaaacttggcggtgcatttgcaccaaagccgtcatctggacctcacaaatccagggaatgcttgccactagttctcattctgcgaaacagattaaagtatgctctgacatatagagaagtgattgctattcttatgcagaggcatgttatggtagatgggaaggttagaactgataagacttatccagctggtttcatggatgttgtgtcaattccaaagacaaatgaggacttccgtctcctctacgatacaaaaggtcgattccgccttcatgccatcactggtgatgagtccaagtttaagctctgtaaagttcggtctgtccagtttggccagaagggtattccatacctcaatacttatgatggccgaacaatccgctacccagatccgttgatcaaggctaatgacaccatcaagtttgacttagagagcaacaaaattgtcgatttcatcaagttcgatgtcgggaatgttgtcatggtcactggaggaaggaacaggggacgtgttggagtgattaagaacagagagaagcataagggtagcttcgagacaatccatgttcaagatgctgctggccacgagtttgcaacccgtcttggcaatgtgtttacaattggtaaggggacaaagccgtgggttttgcttcctaagggcaagggtatcaagttgtcgatcattgaggaagcccggaagaggcttgcagcccaatccgccgcgtaaatttgataatatttggagcagttcaaagaattaatgagttggatgcttgctggctggtactttgtgttggttcttctttaagttgtatcctctgcttttcaactcatgagcggcagttttggaccaatcgtcttcttgaaatttagttgcagtagtttagtttaagttacatttgttttatcgaaggaagttgttacatttttaataaaccattatatagcatggtaaaattcttgtttgctaaaatctgctttacatcttggctcacctttatttcgtatataggtcaagccaggtcgatgtatggtttcaataaattacatatttgtctagatccaatatgtgataatgggttttgaattttgtaactctggaagaaactaactgaaatcaccaattaaatatagcattagcttcctatgtt

SEQ ID NO: 4218 - DNA, 1213 bp, Solanum melongena
atcttcttcagtgcagcagcaaaaatacagagaaaatggctagaggtttgaagaaacatttgaagaggctcaatgccccaaagcattggatgcttgataagcttggtggagcatttgcccccaagccatcctctggtccacacaaatcaagggagtgcttgccgttggtcattatcttgcgaaacaggttgaaatatgctctcacgtaccgagaagtgatttcaattttgatgcaacgacaagttctggtcgatgggaaagttaggacagacaagacatatcctgctggtttcatggatgttgtttcaattccgaagactaatgagaacttccgtcttctttatgacaccaagggccgcttccgtcttcactcagtcagggacgaggaaagcaagtttaagctttgcaaggtccgctctgtgcagtttggtcagaagggaatcccatacttgaacacctacgacggaagaacaatccgctatcctgatcctctcatcaaggccaacgacagcataaagctggacttggaatctaataagattgttgatttcatcaagtttgacgttgggaatgttgtgatggtgactggaggtagaaacaggggacgtgttggtattatcaagaacagggagaagcataagggtagctttgagaccctccacattcaggatgcaacaggtcatgaatttgctacacgtttgggaaatgtgttcactcttggcaagggtactaagccatgggtttcactacctaaaggtaaaggaattaagttgtccatcatcgaagaggcacgtaagaggctggctgctcaatccgccaccactgcttaaactgtttcagttgcatcatcaactggtcaagtcaatttccaaacagcggataaagttaagttttgtagtttggagtcttaaatatttcagtttgtttagtaatgcatatctgcgaatagccttttgaatattcgtttgtttggtcttaccattcctagcgttttgatggtgagatgattagactcctttatggatcaaatctgtctgttccagttgctttaagccatcgactagtagtctaggtgctatgttactgccaaggattgtattctgagattctggtcatcttggtttatggactttattcccttcttaggagttgcggaaagaaatggtacctatcttgtagttgatcagtccgcacaaagctatcgtggttcgat

SEQ ID NO: 4219 - DNA, 1059 bp, Solanum melongena
tctctcgtcttcttcaacgaagcaacgaaaaaaacacagagaaattcgtaaactgcaaagatggctagaggtttgaagaagcatctaaagaggctcaatgcccctaagcattggatgcttgataagcttggtggagcgtttgctcccaagccgtcctctggtccacacaaatcaagggagtgcttgccattggtcattatcttgcgaaacaggttgaagtatgctctcacataccgagaagtgatctcaattttgatgcaacgacaagttctggttgatgggaaagttaggacagacaagacatatccctctggtttcatggatgtcgtttcaattccaaagactaatgagaacttccgtctcctttatgacaccaagggacgcttccgtcttcactcggtcagggatgaggaagccaagtttaagctttgcaaggtccgatctgtgcagtttggtcagaagggaatcccatacctgaacactaatgatggaagaacaatccgctatcctgatcctctcatcaaggccaacgataccataaagctggacttggaatctaataagattgttgatttcatcaagtttgacgttgggaatgttgtgatggtgactggaggtagaaacagaggacgtgttggtattattaagaacagggagaagcataagggtagctttgagaccctccacattcaggatgcaacgggtcatgaatttgctacacgtttgggaaacgtgttcactcttggcaagggtactaagccatgggtttcactaccaaaaggtaaaggaattaagttgtccattatcgaggaggcacggaagaggctggctgctcaatctgccagcgctgcttaaaactgtttcagttgcttcatccactgtccaatttaattttttgttgttgaaaagttaaagttttgtagtttggagtcttgaatggttttattttgtttagtaatacctaatatgttatgctcacagcgttttgaatatttgtgtacttggtattaatatgcccaacattttgatgagaaaatgatttaagactcctttttggat

SEQ ID NO: 4220 - DNA, 1102 bp, Eschscholzia californica
ggcagtactacagactacaggggactcacaggcgaaaggagaaggcggggagttttcaagcgaagaagaataactcaatatggcaagaggactgaagaagcatttgaagaggctcaatgccccaagccactggatgctcgacaagcttggtggtgcatttgctccaaaaccatcctctggaccccacaaatccagggaatgcctcccattgattcttatcctgcgaaataggttgaaatatgctcttacatatagggaggttgttgctattttaatgcaacgacatattttggttgatggaaaggtgcgaacagaccagagatatccatcaggcttcatggatgttgtgtcgatcccgaaaacaaatgagaacttccgtcttctctatgataccaaaggtcgtttccgtctccattcaatcaaggatgaagaggctaagttcaagctctgcaaggtccgtaatgtgcagtttggacagaagggtatcccttacattaacacctatgatggacgcacaatccggtaccctgacccacttatcaaggctaacgacaccatcaaacttgacctcgagaacaacaaaatcaccgatttcatcaaatttgacgtaggaaatgttgtcatggtgactggtggaagaaacaggggacgagttggtgttattaagaacagagaaaagcacaagggaagctttgagacaatccatgtccaggatgcaactggtcatgaatttgcaactcggttgggcaatgtgtttactatcggcaagggaaccaagccatggatttcacttcccaagggcaagggtatcaagttatcaatcatcgaagaagcgagaaagaggcttgctgctcaaggagctgccaccgcttagctttactgaaaggtaatagccatcaggtataagacttcaaagttttctagatgaatttactgttcaagattagctgaagaaaaacagttgtttttaattagtgtatgaacaaagttttgaagttggttcaagttttatgttggagaaacaatatggtggactagtatcaccgaatcagatgttcttatattgtctttacaactagtagcagtttatgttgctctttac

SEQ ID NO: 4221 - DNA, 1105 bp, Fagopyrum esculentum
aggaagaagagagcagccgaaggcctcgaatcgtctgcaaacctagacttcatcgagggaatccccggagttcatcatctccttccaccatggcgagaggtttgaagaagcatatgaagaggctcaacgcccccaagcactggatgcttgataaactcggtggtgcctttgcccccaagccatcatctggaccacacaagtcgagggaatgcttgcctttgatccttatcttgaggaacaggttgaagtatgcccttacataccgtgaagtcatttctattttgatgcaaaggcatgtgcttgttgacaacaaagttaggactgataagacttacccagctggtttcatggatgttgtttccattcccaagaccaacgagaactttcgcctgatgtatgacacaaagggcaggttccgtcttcactctgttagggatgatgaagctaagttcaagctatgcaaggtacgctctgtgcaatttggccagaagggtatcccttacatcaacacttatgatggacgcactatccgctacccagaccccctcatcaaagccaacgacaccatcaagcttgaccttgagaccagcaagattgttgatttcatcaagtttgatgttggtaatgttgtgatggtcaccggtggtagaaacagaggccgtgttggagtcatcaagaacagggagaagcataagggaagcttcgagaccatccacgtgacagattcccagggccacgagtttgccactcgtttggggaatgtgttcatcatcggcaagggtactaagccgtgggtgtctcttcccaagggcaagggtatcaagcttaccatcatcgaggaagccaagaagaggcaacaacaagctcaagctactactgcttaagtcaacttcagattatttaagaaatacattctactttattttctattcagtacaattttggttactagacccgtgttagttttgtttctatcagtgctttactcactgttgttttgtttgatgaattttcaatgcagtttcagaatctggaatagtttgtagcttaaaattgcgtgctcttttgatttgctgtcgttttatgaaaacaaaatttccatttt

SEQ ID NO: 4222 - DNA, 1120 bp, Ipomoea nil
gcatttgccttgtctgcggcgcgcgctctcacacacagggatagagagtggaagagagggagagcaaggaggagctaagcagcactttgatatagcaacacaatggctcggggtttgaagaaacacatgaagaggctcaatgccccaaaacattggatgttggacaagctaggtggtgcttttgcaccaaagccatcatcaggtccccacaaatcaagggagtgtttacccttggttttgattatacgtaatagattgaaatatgctctcacatatcgtgaagtcatttctatcctgatgcaacgccatgttcttgttgatggaaaggtgcggactgacaagacgtaccctgctggttttatggatgtcgtgtcaatgcccaagacgaatgagaatttccgtctgctctatgacaccaagggcagatttcggcttcactcaatcagggacgaggagtctaagttcaagctatgtaaagttcgatcagttcagtttgggaagaaagggatcccttacatcaacacctatgatgggagaactattcgctatcctgatccgctcattaaggctaatgacacgatcaagcttgacttggaatcaaacaagatagttgattttatcaagtttgatgtaggcaacgtcgtcatggtcactggtggaaggaacagagggcgtgtcggtgtgatcaagaacagggagaagcataagggaagcttcgagaccgttcatatccaggatgctcttggtcacgagtttgcaactcgtttgggtaatgtgtacacaatcgggaaaggtactaagccatgggtgtcactaccaaagggcaaaggtattaagctgaccatcattgaggaggccaagaagagacttgctgctcaatccgctactactgcctaaaagaataataaatttcctcgctccaaactgccccaagtggatgtaccctctaaattttcattcactgagttgctatcattttgttgcattagaatttttgctggatatttgttttcaatagacattttatacagttttgaactacaacttattggctgtgtatgcctggacttatcgaatgtcggctgttaattttggtgttgaatgcaagtgaatcaacaaa

SEQ ID NO: 4223 - DNA, 1152 bp, Ipomoea nil
gcacttaggagcagcggagtaggcaccaccggcgacggccgaacactcagctttccaccaccatggctcgagggttgaagaagcatatgaagaggctaaatgccccaaaacattggatgctggacaagttgggtggggcctttgctcctaaaccttcatctgggccgcacaaatccagggagtgcttgccattagtacttatcattcgaaacaggttgaagtatgcccttacctatcgtgaagtcatttcaattttgatgcagcgacatgttttggttgatggtaaggtcaggactgacaagacttaccctgctggtttcatggatgttgtttcaattccaaagacaaatgagaacttccgcctcttctatgataccaaagggcgattccgacttcactcaatcagggatgaggaggctaagtttaagctttgcaaagtccgctctgttcagtttggaaagaagggaattccattcatcaacacctatgatggtagaaccatccgctaccctgatcctctcatcaaggctaatgacacagtaaagctggacctagagagcaacaaggttgttgacttcatcaagtttgacgtggggaatgttgttatggtcactggtggaagaaacaggggacgtgttggcgtcatcaagaatagggagaagcataagggaagcttcgagactgtccacatccaggatgccactgggcatgagtttgctactcgtttggggaatgtgttcactattggaaaaggcactaagccttgggtttctctgcccaagggtaagggtatcaagctgtccatcattgaagaggcaaagaagaggcttgctgcccagtctgcaaccactgcctaaatgcactgtaggctttcctccaataccccatatctgctttgaagtaatttacaagtttgatagaattttgttctgcaggttgaactaatgtagatttcttatttaaatgtgtaatgcatgctcttcgattttcagaattactgttactcagttgcatactttttttcctgagatggaaattgactgttgaagaactcttctcctttatcttaattctttattttgggtttgcatctatttctttaaggtaaccaatgcaatcatttgctatatgcaggcctttaataaaattttg

SEQ ID NO: 4224 - DNA, 977 bp, Medicago truncatula
ctcacacaactctcgcacgcaagcaagaaccaaaaggcgcggcaacctcgccaccgcgccgttcctttctgttctcaacataccaacatggcaagaggtttgaagaaacatttgaagcggctcaatgctccaaaacattggatgcttgataagcttggtggtgcctttgccccaaagccgtcatctggaccacacaaatctagggagtgccttcctttgatccttatcttgaggaacagactaaaatatgctctcacatatagagaagtaattgccatcttgatgcagcgccatgttctagttgatggcaaagttaggacagacaagacatatcctgctggttttatggatgtcgtatctattcccaagaccaatgaaaacttccgtcttctctatgacacaaaaggtcgattccgtctccactctgtaagggatgatgaagcaaagtttaagctttgcaaggtacgatctgttcagtttggtcagaaagggataccctatctgaacacctatgatgggcgtacaatccgctatcctgatccccttattaaggccaatgacacaatcaaactagacttggaacagaacaagataaccgatttcatcaaatttgatgtggggaatgttgttatggtgactggaggaaggaacagaggtcgtgttggtttcatcaagaacagaaagaaacacatgggcacttttgagacgattcatgtccaggatgctgctggtcatgagtttgcaacccgattgggtaatgtcttcaccattggcagagggccgaaaccttgggtgtctcttcccaaaggcagaggtatcaaattgaccgtcattgaggaggctaggaagcggatggctgcttctcaacaggctgcagctgcttaaatttgattgcattatattgctggacaatttagccatttagattgtttgcgacctttttgcggctaatatgacatgacaattttatttttaat

SEQ ID NO: 4225 - DNA, 1102 bp, Medicago truncatula
ggttctctctttcaccacctcacacaactctcgcacgcaagcaagaaccaaaaggcgcggcaacctcgccaccgcgccgttcctttctgttctcaacataccaacatggcaagaggtttgaagaaacatttgaagcggctcaatgctccaaaacattggatgcttgataagcttggtggtgcctttgccccaaagccgtcatctggaccacacaaatctagggagtgccttcctttgatccttatcttgaggaacagactaaaatatgctctcacatatagagaagtaattgccatcttgatgcagcgccatgttctagttgatggcaaagttaggacagacaagacatatcctgctggttttatggatgtcgtatctattcccaagaccaatgaaaacttccgtcttctctatgacacaaaaggtcgattccgtctccactctgtaagggatgatgaagcaaagtttaagctttgcaaggtacgatctgttcagtttggtcagaaagggataccctatctgaacacctatgatgggcgtacaatccgctatcctgatccccttattaaggccaatgacacaatcaaactagacttggaacagaacaagataaccgatttcatcaaatttgatgtggggaatgttgttatggtgactggaggaaggaacagaggtcgtgttggtttcatcaagaacagaaagaaacacatgggcacttttgagacgattcatgtccaggatgctgctggtcatgagtttgcaacccgattgggtaatgtcttcaccattggcagagggccgaaaccttgggtgtctcttcccaaaggcagaggtatcaaattgaccgtcattgaggaggctaggaagcggatggctgcttctcaacaggctgcagctgcttaaatttgattgcattatattgctggacaatttagccatttagattgtttgcgacctttttgcggctaatatgacatgacaattttatttttaatacatcacaattatgaactaggcttgatgtgagtttaattttgtttggatggcatttcttgtgctcaatgtagcttcaggttgcaattttatgctctcccattttgct

SEQ ID NO: 4226 - DNA, 1009 bp, Medicago truncatula
ctcttttctttgataacagccgcaccatcactctctccactccgtagctgctgcgaagaaggagaaatttgaaaatggcgagaggtttgaagaagcatttgaagaggctcaatgcccccaagcattggatgcttgacaaattgggtggtgcttttgctcctaaaccctcatctggaccacacaagtccagggaatgtctcccactcattctgatcttgcgaaacagattgaagtatgctctaacataccgtgaagtcattgctattctgatgcaacgacatgtccttgttgatggcaaagtcaggactgacaagacttatccagctggattcatggatgttgtttcaatccccaagacaaatgagagctttcgtctgctgtatgacaccaagggccgtttccgtctccattcagtcagagatgatgaggcaaagtttaagctgtgcaaggtgcgttcagtgcaatttgggcagaaaggtatcccatacctgaacacctatgatggtcgcactatccgctaccctgacccagtcatcagggctaatgacacaatcaagctggaccttgaggaaaacaagattgtcgatttcatcaaattcgatgttgggaatgtagtgatggttactggtggtaagaatagggggcgtgttggagtgatcaagaacagagaaaagcataagggaacctttgagacaatccacgttcaggatgccactggtcatgagtttgcaactcgtctggtcaatgtgttcactattggcaaggggacaaagccatgggtatctcttcccaagggtaagggtattaaattaactgtcattgaggaagctaggaagagggctgctgcagctcagcaagcagttgctgcttaaacatctatgcaatgaatttataatagactcgagtgttttgtagtagtttttattcaactttgttgctttgaatttcttctatcaattttggttttgaatgacttttaaaatatgagcaactttagttcacatcctct

SEQ ID NO: 4227 - DNA, 1155 bp, Medicago truncatula
gattatttagggtttgttcctctcctcttttctttgataacagccgcaccatcactctctccactccgtagctgctgcgaagaaggagaaatttgaaaatggcgagaggtttgaagaagcatttgaagaggctcaatgcccccaagcattggatgcttgacaaattgggtggtgcttttgctcctaaaccctcatctggaccacacaagtccagggaatgtctcccactcattctgatcttgcgaaacagattgaagtatgctctaacataccgtgaagtcattgctattctgatgcaacgacatgtccttgttgatggcaaagtcaggactgacaagacttatccagctggattcatggatgttgtttcaatccccaagacaaatgagagctttcgtctgctgtatgacaccaagggccgtttccgtctccattcagtcagagatgatgaggcaaagtttaagctgtgcaaggtgcgttcagtgcaatttgggcagaaaggtatcccatacctgaacacctatgatggtcgcactatccgctaccctgacccagtcatcagggctaatgacacaatcaagctggaccttgaggaaaacaagattgtcgatttcatcaaattcgatgttgggaatgtagtgatggttactggtggtaagaatagggggcgtgttggagtgatcaagaacagagaaaagcataagggaacctttgagacaatccacgttcaggatgccactggtcatgagtttgcaactcgtctggtcaatgtgttcactattggcaaggggacaaagccatgggtatctcttcccaagggtaagggtattaaattaactgtcattgaggaagctaggaagagggctgctgcagctcagcaagcagttgctgcttaaacatctatgcaatgaatttataatagactcgagtgttttgtagtagtttttattcaactttgttgctttgaatttcttctatcaattttggttttgaatgacttttaaaatatgagcaactttagttcacatcctctacttatagtcctttttctggttattattattcaagcttaatattggtaatggaatgtgattttagactattttcttatatttccaccttaccataataccagttgatcacataaccagatcg

SEQ ID NO: 4228 - DNA, 1103 bp, Medicago truncatula
acttgagtttttctttttctctctaactttggaacttttggctgctctgttaatctcacaatatggctagaggattgaagaagcatttgaagaggctcaatgcccccaagcattggatgcttgacaaattgggtggtgcttttgctccaaaaccctcgtcaggaccacacaaatctagggaatgtcttcccctcattctgattttgcgaaacagattgaagtatgctttgacgtaccgtgaagttatcgctattctcatgcaacgacatgtccttgttgacggcaaagtcaggactgacaagacatatccagctggattcatggatgttgtctcaattcctaaaacaaatgagagcttccgtctgctttatgacaccaaaggccgcttccgtctccactcagtcagagatgatgaggcaaagttcaagctctgcaaggttcgttcagtgcaatttgggcagaaaggtatcccataccttaacacctatgatggtcgcactatccgttacccagaccccgtcatcagggctaatgacaccatcaagctggatctggaggaaaacaagattgttgatttcatcaaatttgatgttgggaacgtcgttatggttactggtggtaagaataggggacgtgttggagtgattaagaacagagagaagcataagggaacattcgagacaatccacgttcaggatgccactggtcatgagttcgcaactcgtttggtcaatgtgtttactattggcaagggcacaaagccatgggtatctcttcccaagggtaagggtattaagcttacagtcatcgaggaagctaggaagagggctgctgcggctcaacaagcagttgctgcttaaatatctatggactgagtgttttgtagtttttattcgactcttgtgttttgaatatctttatcaattttggtgttatatgtcttttataatctgcgcaacttcggttcatccctagctggatattgtcatggaaatgttattttagactatttttcttttattttcatcttatcaaaaagccagtttatcacataaccaaagctgaaattttgattttagattatgatttgattgtttttgttt

SEQ ID NO: 4229 - DNA, 1116 bp, Medicago truncatula
cggcagcctcctcacttgagtttttctttttctctctaactttggaacttttggctgctctgttaatctcacaatatggctagaggattgaagaagcatttgaagaggctcaatgcccccaagcattggatgcttgacaaattgggtggtgcttttgctccaaaaccctcgtcaggaccacacaaatctagggaatgtcttcccctcattctgattttgcgaaacagattgaagtatgctttgacgtaccgtgaagttatcgctattctcatgcaacgacatgtccttgttgacggcaaagtcaggactgacaagacatatccagctggattcatggatgttgtctcaattcctaaaacaaatgagagcttccgtctgctttatgacaccaaaggccgcttccgtctccactcagtcagagatgatgaggcaaagttcaagctctgcaaggttcgttcagtgcaatttgggcagaaaggtatcccataccttaacacctatgatggtcgcactatccgttacccagaccccgtcatcagggctaatgacaccatcaagctggatctggaggaaaacaagattgttgatttcatcaaatttgatgttgggaacgtcgttatggttactggtggtaagaataggggacgtgttggagtgattaagaacagagagaagcataagggaacattcgagacaatccacgttcaggatgccactggtcatgagttcgcaactcgtttggtcaatgtgtttactattggcaagggcacaaagccatgggtatctcttcccaagggtaagggtattaagcttacagtcatcgaggaagctaggaagagggctgctgcggctcaacaagcagttgctgcttaaatatctatggactgagtgttttgtagtttttattcgactcttgtgttttgaatatctttatcaattttggtgttatatgtcttttataatctgcgcaacttcggttcatccctagctggatattgtcatggaaatgttattttagactatttttcttttattttcatcttatcaaaaagccagtttatcacataaccaaagctgaaattttgattttagattatgatttgattgtttttgttt

SEQ ID NO: 4230 - DNA, 1074 bp, Medicago truncatula
tttaacttttgctgctctgttaatctcacaatatggctagaggattgaagaagcatttgaagaggctcaatgcccccaagcattggatgcttgacaaattgggtggtgcttttgctccaaaaccctcgtcaggaccacacaaatctagggaatgtcttcccctaattctgattttgcgaaacagattgaagtatgctttgacgtaccgtgaagttatcgctattctcatgcaacgacatgtccttgttgacggcaaagtcaggactgacaagacatatccagctggattcatggatgttgtctcaatccctaaaacaaatgagagcttccgtctgctttatgacaccaaaggccgcttccgtctccactcagtcagagatgacgaggcaaagttcaagctctgcaaggttcgttcagtgcaatttgggcagaaaggtatcccataccttaacacctatgatggtcgcacaatccgctacccagaccccgtcatcagggctaatgacaccatcaagctggatctggaggaaaacaagatcgttgatttcatcaaatttgatgttgggaacgttgttatggttactggtggtaagaataggggacgtgttggagtgattaagaacagagagaagcataagggaacattcgagacaatccacgttcaggatgccactggtcatgagtttgcaactcgtttggtcaatgtgttcactattggcaagggcacaaagccatgggtatctcttcccaagggtaagggtattaagcttacagtcatcgaggaagctaggaagagggctgctgcggctcaacaagcagttgctgcttaaatatctatggaccgagtgtttagtagtttttattcaactcttgtgttttgaatatctttatcaatttttggtgttaaatgtcttttataatctgcgcaactttggttcatccctcaacttttagtcctgtttgtattattctagctggatattgaatggaaatgttattttagactattttctttattttcatctatcataaaatcagttaatcacatgatgagttgaatcgtgtcaaaaaaaa

SEQ ID NO: 4231 - DNA, 1161 bp, Quercus alba
cgtgtctctacggaattcccgggatcgcaggtgcagctgagtgagaagaccagctccaacgtcggcgccgagatctacgataccacaactccaacatggctagaggtttgaagaaacatttgaagaggcttaatgcgccaaagcattggatgcttgacaaacttgggggtgcatttgctcccaagccatcgtctgggccccacaaatcgagggagtgcttgcccttgattctcatcctgaggaacaggttgaagtatgcgctcacataccgtgaggtcattgccattctgatgcaacgacatgttttggttgatgcgaaggttaggactgataagacctaccctgctggcttcatggatgttgtatcaattcccaaaacaaacgagaacttccgtctcctttatgataccaagggtcggttccgtctgcactcaattagggatgaagaggcaaagttcaagctctgcaaggtccggtctgtgcagtttgggcagaagggaatcccctatctcaacacccttgatgggcgaactatccgctatcctgacccaattattaaggctaatgacaccatcaagctggacttggagactggcaagatcaccgatttcattaaatttgatgttggaaatgttgtcatggtgactggtggaaggaacagaggccgtgttggagtcattaagaacagggagaagcataagggaacctttgagactgttcacatccaggattccacaggtcatgagtttgccacccgtcttggaaatgtgtacaccattggcaagggcacaaagccatgggtctctctccccaagggcaagggtataaagttgtcaatcattgaagaggcaaagaagaggcttcaaggccaacagactactgctgcttaaatattgttgtggttccattatagttttagaagattacttaggtgaagtttactcttgcaatttgacccctctagcttggggtgtgttttatttgaattttgcgctacttgtttttggacagtcctatgagttgcaatatttatgcctaattttgttttgcactacaatgggaagtatcagactattttgatcagtttactgtgtgttggaaaattttatctacaggtcttgttaatttaaaaaaaaaaagttaattaatcggacacgcgag

SEQ ID NO: 4232 - DNA, 1073 bp, Solanum tuberosum
tcttcatcgaagctgcaaaaaatacagagaaattcttagaccaacaaaatggctagaggtttgaagaagcatctgaagaggctcaatgccccaaagcattggatgcttgataaacttggtggagcatttgctcccaagccatcctctgggccacacaagtcaagggagtgcttgccattggtcattatcatgcgaaacaggttgaagtatgctctcacatacagagaggtgatctcaattctgatgcaacgacaagttatggttgatgggaaagttaggacagataagacatatcctgctggtttcatggatgtcgtttcaattccgaagactaatgagaacttccgtctcctttatgacactaagggccgattccgtcttcactcgctcagggacgaggagtccaagtttaagctttgcaaggtccgctctgtgcagtttggtcagaaggggatcccatacctgaacacttacgatggaagaacaatccgctatcctgatcctctcatcaaggccaacgataccataaagctggacttggaatccaataagattgttgatttcatcaagtttgacgttgggaatgttgtgatggtgactggaggtagaaacaggggacgagttggtgttattaagaacagggagaagcataagggtagctttgagaccctccacattcaagattcacagggtcatgaatttgctacacgtttgggaaatgtgttcactcttggtaagggtactaagccgtgggtttcactacccaaaggtaaaggaattaagttgaccatcatcgaggacgcaaggaagaggctggctgctcaatctgccacccctgcttaaactgtccaggttgcttcatccactgttcaagtcaatttcacgctttacagcatgataaagttaagttttgtagtttggactctaaatgttttgctttgtttagtaatacatattttattctgcagccttttgaatatttgtattcatggttttagcatgcctagctttttaatgagaagatgattagactcctttatggatcaatccttgttgattttgttccagatttg

SEQ ID NO: 4233 - DNA, 1066 bp, Raphanus sativus
ggagggtttcagttttcttcttcttttgatatataacccactgctgaactgccgccgcagaggaatcagaagtagtcgtcgtcgtcagctccgaaacatctgcaaacatggcgaggggattgaagaagcatttgaagaggctcaatgcccccaagcattggatgcttgacaaactcggtggtgctttcgctcccaagccgtcttctggacctcacaagtcgagagagtgtcttcctcttgttttgatcatcaggaacaggttgaagtatgctttgacgtaccgtgaagtcatctccatcctgatgcaaaggcatatccaagttgatggaaaagtgaggactgacaagacataccctgctggtttcatggatgttgtatcaatccccaagaccaatgagaacttccgtcttctgtatgacaccaagggacgtttccgcctccactccatcagggatgaggaagcaaagttcaagctttgcaaggttaggactatccagttggggcagaaggggatcccttacctcaacacttacgatggtcgcaccatccgttaccccgacccgctcatcaaaccaaacgacaccatcaagctagaccttgaggagaacaaggttgtggacttcatcaagttcgacgtgggcaacgttgtgatggtgactgggggtagaaacagagggcgtgtgggtgtgatcaagaaccgtgagaagcataagggaagctttgagacgatccacattcaagactcgacggggcatgagtttgccacgaggttgggtaatgtgtttactctcgggaaagggacaaagccgtgggtgtctcttcccaagggtaaaggtatcaagctgaccatcattgaggaagcaaggaagaggctttctgcccagcaagctgcttaaaagatgaatcatcatcaaatggccgtttcgtttctattgctatgaactctagtttcttacctcagtttgagcttgtgttcttcatgttgctttttgcaaaaccgcttttgaaaaaaaaacagcttaaaattcttgtaatgtttgtgttgacaattttagtaatttactcg

SEQ ID NO: 4234 - DNA, 1115 bp, Solanum phureja
ctagggttttagtatttctctcgtcttcttcatcgaagctgcaaaaaatacagagaaattcatagaccaacaaaatggctagaggtttgaagaagcatctgaagaggctcaatgccccaaagcattggatgcttgataaacttggtggagcatttgctcccaagccatcctctgggccacacaagtcaagggagtgcttgccattggtcattatcatgcgaaacaggttgaagtatgctctcacatacagagaggtgatctcaattctgatgcaacgacaagttatggttgatgggaaagttaggacagataagacatatcctgctggtttcatggatgtcgtttcaattccgaagactaatgagaacttccgtctcctttatgacactaagggccgattccgtcttcactcgctcagggacgaggagtccaagtttaagctttgcaaggtccgctctgtgcagtttggtcagaaggggatcccatacctgaacacttacgatggaagaacaatccgctatcctgatcctctcatcaaggccaacgataccataaagctggacttggaatccaataagattgttgatttcatcaagtttgacgttgggaatgttgtgatggtgactggaggtagaaacaggggacgagttggtgttattaagaacagggagaagcataagggtagctttgagaccctccacattcaagattcacagggtcatgaatttgctacacgtttgggaaatgtgttcactcttggcaagggtactaagccatgggtttcactacccaaaggtaaaggaattaagttgaccatcatcgaggaggcaaggaagaagctggctgctcaatctgccacccctgcttaaaccgtccaggttgcatcatccactgttcaagtcaatttcacgctttacagcgtgataaagttaagttttgtagtttggactctaaatgttttgctttgtttagtaatacatattttattctgcgagcagccttttgaatatttgtattcttggttttagcatgccaagctttttaatgagaagatgattagactcctttatggatcaatccttgttcattttgttccagatttgaaatagtttctc

SEQ ID NO: 4235 - DNA, 968 bp, Solanum phureja
ttcttcatcgaagctgcaaaaaatacagagaaattcttagaccaacaaaatggctagaggtttgaagaagcatctgaagaggctcaatgcccctaagcattggatgcttgataaacttggtggagcatttgctcccaagccatcctctgggccacacaaatcaagggagtgcttgccattggtcattatcatgcgaaacaggttgaagtatgctctcacatacagagaggtgatctcaattctgatgcaacgacaagttatggttgatgggaaagttaggacagataagacatatccggctggtttcatggatgtcgtttcaattccgaagactaatgagaacttccgtctcctttatgacactaagggccgattccgtcttcactcgctcagggacgaggagtccaagtttaagctttgcaaggtccgctctgtgcagtttggtcagaaggggatcccatacctgaacacttacgatggaagaacaatccgctatcctgatcctctcatcaaggccaacgataccataaagctggacttggaatccaataagattgttgatttcatcaagtttgacgttgggaatgttgtgatggtgactggaggtagaaacaggggacgagttggtgttattaagaacagggagaagcataagggtagctttgagaccctccacattcaagattcacagggtcatgaatttgctacacgtttgggaaatgtgttcactcttggtaagggtactaagccgtgggtttcactacccaaaggtaaaggaattaagttgaccatcatcgaggacgcaaggaagaggctggctgctcaatctgccacccctgcttaaactgtccaggttgcttcatccactgttcaagtcaatttcacgctttacagcatgataaagttaagttttgtagtttgaactctatgttttgctttgtttagtaatacatattttattctgcagc

SEQ ID NO: 4236 - DNA, 1087 bp, Nicotiana tabacum
ccgggggcgttttcatcaggtaagatacttaagccggcgctggccgagagctctcagggaggtggttcaaactctaagagaccaaaatggctagagggttgaagaaacatttgaagaggctcaatgcgcctaaacattggatgctcgacaaacttggtggagcctttgctcccaagccttcctctggtccacacaaatcaagggagtgtttgccgctgatcattatcttgcgaaacaggttgaagtatgctctcacataccgtgaggtaattgcaattctgatgcaacgacaggttatggttgatgcaaaagtgaggacagataagacttacccagctggtttcatggatgttgtctcaattccaaagactaatgagaactttcgtctcctttatgacacaaaggggcgattccgtcttcactctatcagggatgaggaagccaagtttaagctttgcaaggtccgatccattcagtttggtagtaaggggattccttatcttaatacttatgatggtagaacaattcgctaccctgatcctctcatcaaggccaatgataccatcaagctggacttggaatccaataagattgttgacttcatcaagtttgatgttggaaatgttgtgatggtaactggtggtagaaacaggggacgtgttggtgttattaagaacagggagaagcacaagggtagctttgagaccgttcacattcaggatgccctaggccatgaatttgctactcgcttgggaaatgttttcacccttggcaaaggtacaaagccatgggtgtctctacctaaaggaaaaggtatcaagttgtccatcattgaggaggcacggaagaggcttgctgctcaatcagctaccactgcctgaataccctggttgctcgtttcttcatttccttgctcttcaagtatggaaaacttatgttttacagttttggactcgatgtttctatttgcttagtgatgccatttttattacgcaatgccttttatattgtacttgtttgcttggcatattttaaatagattaaaactgtgctttatgatagtttaattagtttctacagtttaatt

SEQ ID NO: 4237 - DNA, 1049 bp, Nicotiana tabacum
  misc_feature (927)..(927): n is a, c, g, or t
  misc_feature (1002)..(1002): n is a, c, g, or t
ggggttttaaggtagctttcacatcagcgaagcagaaagtggcggagctgtgaggctgctgattcaaatcgaaaggccaccaaaatggctagaggtttgaagaaacatttgaagaggctcaatgccccaaagcattggatgcttgacaagcttggaggagcttttgctcccaagccttcgtctggtccgcacaaatcaagggagtgtttgccgttgatcattatcatgagaaacaggctgaagtatgctctgacatacggtgaggtcatttcaattttaatgcaacgacttgttatggttgatgggaaagttaggacagataagacttaccccgctggctttatggatgttgtttcaattcctaagacaaatgagaacttccgcctcatgtatgacacaaagggccgatttcgtcttcactcagttagggatgaggaagccaagtttaagctgtgcaaggtccgatctgtgcagtttggacagaagggtattccatacctcaacacttatgatggaagaacaatccgctaccccgatcctctcattaaggccaatgataccatcaagctggacttagagaacaataagattgttgacttcatcaagtttgatgtcggaaatgttgtcatggtgactggtggtagaaacagggggcgtgttggtgttattaagaacagggaaaagcataagggtagtttcgagacagttcacattcaagatgcccaaggtcatgagtttgctacccgcttgggtaacgtggtcactctcggaaaaggtactaagccatgggtatccctccctaaaggaaaaggtatcaagttgtccatcattgaagaggcacggaagagacttgctgctcaatcagctaccactgcttaaaatgcgtggtcgagctttagactgatcaaacttgtttgctggttgganctaatgtttatttttattttagcaataccaattttatttgtactgccctacaaacatttgtgttctaggttcttntgaacctatagctttttgttaggataaaaacgttgaagacttttaaa

SEQ ID NO: 4238 - DNA, 1094 bp, Nicotiana tabacum
ggccattacggccgggggcgttttcatcaggtaagatacttaagccgagagctctcagggaggtgattcgagaccaaaatggctagagggttgaagaaacatttgaagaggctcaatgcgcctaagcattggatgctcgacaagcttggtggagcctttgctcccaagccttcctctggtccacacaaatcaagggagtgtttgccgctcatcattatcttgcgaaacaggttgaagtatgctctcacataccgtgaggtgattgcaattctgatgcaacgacaggttatggttgatgcaaaagtgaggacagataagacttacccagctggtttcatggatgttgtctcaattccaaagactaatgagaactttcgtctcctttatgacacaaagggacgattccgtcttcacgctatcagggatgaggaagccaagtttaagctttgcaaggtccgatctattcagtttggtactaaggggattccttaccttaatacttatgatggtagaacaattcgctaccccgatcctctcatcaaggccaatgataccatcaagctggacttggagtccaataagattgttgacttcatcaagtttgatgttggaaatgttgtgatggtaactggtggtagaaacaggggacgtgttggtgttattaagaacagggagaagcataagggtagctttgagaccgttcacattcaggatgccctaggccatgaatttgctactcgtttgggaaatgttttcacccttggcaaaggtacaaagccatgggtgtctctacctaaaggaaaaggtatcaagttgtccatcattgaggaggcacggaagaggcttgctgctcaatcagctaccactgcctgaataccctcgttgctcatttcttcatttccttactcttcaagtatggaaaacttatgttttacagttttggactcgatgtttctatttgcttagtgatgccatttttattatgcgccttttatattgtacttgttctcttggcatattttaaatagattaaaactgtgtctttatgataatttaattagtttctacagtttaattttagtgctaatgctttt

SEQ ID NO: 4239 - DNA, 1068 bp, Trigonella foenum-graecum
ctcataataatacagagccgcagtttcactctttctctagcttcggaggttttgcttgttctgtaaatccaaaatggcgagaggattgaagaagcatttgaagaggctcaatgctcccaagcattggatgcttgacaaattgggtggtgcttttgctcctaaaccctcatccgggccacataagtcgagggaatgtctgccactcattttgattttgcgaaacagattgaagtatgctttgacataccgtgaagttattgctattctgatgcaacggcatgtccttgttgacggcaaagtcaggactgacaagacttatccagccgggttcatggatattgtgtcaatccccaagacaaatgagaacttccgcctgctttatgacaccaaaggtcgattccgtctccactcagtgagagatgacgaggcaaagttcaagctctgcaaggttcgttcagtgcagtttgggcagaaaggtatcccataccttaacacctatgacggtcgcactatccgctaccctgatcctgtcatcagggctaatgacaccatcaagctggatctggaggaaaacaagatcgtcgacttcatcaaatttgatgttgggaatgtagtcatggttactggtggaaagaatagaggacgagttggagtgatcaagaacagggagaagcataagggaaccttcgagacaatccacgttcaggatgccactggtcacgagtttgcaactcgtttggtcaatgtgttcactattggcaagggcacaaagccatgggtatctcttcccaagggtaagggtattaagctcacagtcattgaggaagccaggaaaagggctgctgcagcccaacaagcagttgctgcttaaatctctggaattaatttatgatagacttgtgtgtttttgtagttttattcaacaattttgctttttaatgtatttgtcaaacttgtcagtgaatctcctttaattaactaatgcctgtttattttattttgaaacaaaataaagggctaatgtataacgctctccaaatgacttgtttgtaatgaaagtgggaaact

SEQ ID NO: 4240 - DNA, 989 bp, Trigonella foenum-graecum
tctcttagctttggaacttttggctgctctgttaatctcacaatatggctagaggattgaagaagcatttgaagaggctcaatgcccccaagcattggatgcttgacaaattgggtggtgcttttgctcctaaaccctcatccgggccacacaagtccagggaatgtctgccactcattctgattttgcgaaacagattgaagtatgctctgacataccgtgaagtcatcgctattctgatgcaacgacatgtccttgttgacggcaaagtcaggactgataagacttatccagctggattcatggatattgtgtccatccccaagacaaatgagaacttccgcctgctttatgacaccaaaggccgattccgtctgcactcagtcagagatgatgaggcaaagttcaagctgtgcaaggttcgttccgtacaatttgggcagaaaggtatcccatacctgaacacctatgacggtcgcactatccgctacccagaccctgtcatcagggctaatgacaccatcaagttggatctggaggaaaacaagatcgttgacttcatcaaatttgatgttgggaatgtagtcatggttactggtggtaagaatagggggcgtgttggagtgatcaagaacagggagaagcataagggcacatttgagacaatccatgttcaagatgccactggccacgaatttgcaactcgattggtcaacgtgttcacaatcggcaagggtacaaagccatgggtatctcttcccaagggtaagggtattaagctcactgtcattgaggaagctagaaagagggctgctgcagctcaacaagcagttgctgcttaaatatctttggcatgaacttatgatagactcgagtgttttgtagtttttatttaactctgttgttttgaatgtctttttatcaattttggttttaaatgtcttttataatctgagcaacttttttattattcaagttgaatctggtaa

SEQ ID NO: 4241 - DNA, 1067 bp, Zostera marina
gaattttcttcttcgacgatcgtgaaaagaaccggagcggagcggcaaagagagaagcaggcgacgttcattcattatggctagaggtttaaagaagcatctgaagaggctcaacgcacccaagcattggagtctagacaaacttggtggtgcttttgcacccaaaccctcttcaggaccacacaaagcgagggaatgtttgcctttgatccttattttgaggaacaagctgaaatacgctctaacataccgtgaagtcattgccatcttgatgcagcgtcatgttatggttgatggcaaggtcaggacagacaagacctatcctgctggttttatggatgttgtttcaattcccaaaacaaatgaaaacttcagactcctttatgataccaagggacgattccgtcttcactctgtgagagatgaagaggctaagttcaaactctgcaaggttcgttctgtgcagattggacagaagggtatcccctacttgaacacctatgatggccgcaccatccgttaccctgatcctctcatcaaacccaatgataccatcaagtttgatctcgaggagaacaagattgtagacttcatcaggtttgatgttggaaatgtggtgatggtcactggtggaagaaacactgggcgtgtcggtatcattaaaaatagggagaagcataagggaacattcgaaaccatccatgttcaggattctactggtcatgaatttgccactcgtttgggcaatgttttcaccattggtaagggtgcaaaaccatgggtgtctctacctaagggtaagggtatcaaacttaccattattgaagaggcaaggaagcgtgaggctgtcgctttagctgctgcaacatagacagtagtaaatcgtaatgggtaatcaatcaattaatcccctcctagtggtgaaaactattggacacaatcaatatttcgttagacattttgttgtgttttgagttatttattttactatgttttgagttgttctttttcattatctacctaagatgttaaaccatgttatttttcttcaattttgaaacataaat

SEQ ID NO: 4242 - DNA, 1069 bp, Zostera marina
ggcgtgtcgatctgccatattcttacgccgtcgacagacagggcttttagcatggcgagaggtttgaagaagcatttgaagaggctcaatgctccaaaacactggagtcttgacaagcttggtggtgccttcgcacctaaaccatcatctggtcctcacaaagcaagagagtgcttgcctttgattcttattttgaggaacaaactaaagtatgctcttacttaccgtgaggttattgcaattctcatgcaacgacatgttatggttgatggcaaagttaggactgataagacatatccggctggattcatggatgtcgtgtcaattccaaaaacaaatgagaatttccgacttctctatgacaccaagggtcgattccgtctacattctgttagggatgaggagtctaagtttaagctttgcaaggttagatctgttcaaattggacagaaaggcattccatatcttaacacctatgacggacgtaccatccgttaccctgaccctcttatcaagcctaacgacactatcaagcttgaccttgaggaaaataagattgtcgactttattaagtttgatgtgggcaatgttgtgatggtcactggtggaagaaatacaggtcgtgttggtgttatcaagaacagggaaaaacataagggaacctttgaaaccatccacgttcaggattctactggtcatgaatttgctactcgtttgggcaatgtgtttactattggaaagggcttaaagccttgggtgtctcttcccaagggcaagggcatcaaactcacaatcattgaagaggcaaggaaacgagaagctgctgcagcagccactatttaatcttttctttataattcaggtaatgtggtgtttcttgacgagttgcagcagactgtttattttttgttgtgttttatttatctatgcatgtatgtccttaggtttttgacgtttttattgttaaattcgaaattatttttaaatgttgaatttataaaacctcaaatttttaaatgttgaacttgtttataaaggtttttttctttcttaattaatgttcttttgg

SEQ ID NO: 4243 - DNA, 1026 bp, Brassica rapa
ggagagccgggaactgccgccactgagaggaagaagtcgtcgtcgtccgctccgaagcaactgcaaacatggcaaggggattgaagaagcatttgaagaggctcaatgctcccaagcattgggatcttgacaaacttggtggtgccttcgctcccaagccctcttctggacctcacaagtctagggagtgcctccctctcgtcctgatcatcaggaacaagttgaagtacgctttgacataccgtgaggtcatctccatcctcatgcaaaggcatatccaagtcgatggaaaagtcaggactgacaagacttaccctgctggcttcatggatgttgtttccatccccaagactaatgagaacttccgtcttctgtatgacaccaagggacgtttccgtctccactccatcagggacgaggaagcaaagttcaagctttgcaaggttaggacaatccagttcggacaaaagggaatcccttacctcaacacatacgatggccgcaccatccgttaccctgacccgctcatcaaaccaaacgacaccatcaagctcgacctcgaggagaacaagattgttgagttcatcaagtttgacgtcggtaacgttgtgatggtgactggtggcaggaacagagggcgtgttggtgtgattaagaaccgtgagaagcataagggaagctttgagacgattcatatttaagactctacgggacatgagtttgccacgaggttgggcaatgtgtttactctggggaaaggaacaaagccgtgggtgtctcttccaaagggtaaaggtattaagctgactatcattgaggaagctaggaagaggctttctgcccaacaagctgcttaaatgttgaatcatccaagaccgtttgttaccttcttgcttcagttttgagcttattcctaattcatgtttcttgcttgcaaaaccccataagaaaaaaaaacagctgagcattttagagcgttttgtattatttgtacggactttttaaagtaatttactcttcaaaatc

SEQ ID NO: 4244 - DNA, 1037 bp, Brassica juncea
cgggagacgagaactgccgccaccacagaggaagaagaagaggaagaagtcgtcgtcgtctgctccgagacagctgcaaacatggcgaggggattgaagaagcatttgaagaggctcaatgccccaagcattggatgcttgacaaacttggtggtgccttcgctcccaagccgtcttctggacctcacaagtcgagagagtgtcttcctctcgtcttgatcatcaggaacaggttgaagtatgctttgacgtaccgtgaagtcatctccatcctgatgcaaaggcatatccaagttgatggaaaagtgaggaccgacaagacataccctgctggtttcatggatgttgtatcgatcccaaagacgaatgagaactttcgtcttctgtatgacaccaagggacgtttccgcctccactccatcagggacgaggaagcaaagttcaagctttgcaaggtgaggactatccagcttgggcagaagggaattccttacctaaacacttacgatggtcgcaccatccgttaccctgaccccctcatcaagccaaacgacaccatcaagctggatcttgaggagaacaaggtcgttgagttcatcaagtttgatgttggtaacgttgtgatggtgacaggaggcagaaacagagggcgtgttggtgtgatcaagaaccgtgagaagcataagggaagctttgagacgatccacatccaagactcgacaggacacgagtttgccacaaggttgggcaacgtgttcaccctcggcaaaggtacaaagccatgggtgtctcttccgaagggcaaaggtattaagctgaccatcattgaggaagccaggaagaggctttctgcccagcaagctgcttaaaagttgaatcatcgaagactgtgtttcgtttctcttttgtcataaactctagcttcttacttcagttttgagcttttgttctttcatgttgctttctcgcaaaaccccattttgaaacatctgaagattccagtagaacgttttgtaatgtctgcgtcattgtcttgt

SEQ ID NO: 4245 - DNA, 842 bp, Brassica juncea
gctcacaaacttcaccgtctggatcagagagccacgcttgcaaactcctaacatggcgagaggtttaaagaagcatctgaagaggctcaatgcacctaagcattggatgcttgacaaacttggtggtgcttttgcccccaagccatcttctggaccacacaagtctagagagtgccttcctcttgttcttatcatcaggaacaggttgaagtacgctcttacctaccgtgaagtcatctccatcttgatgcaaaggcatatccaggttgatggcaaagtcagaaccgacaagacctaccctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgttggtgtgattaagaaccgtgagaagcataagggaagctttgagacaatccacatccaagactctacaggacatgagtttgcaacacgtttgggaaatgtcttcaccctcggcaaaggaactaagccctgggtttctcttcctaagggtaaaggtattaagctcaccatcatcgaggaagccaggaagaggctctctggccaacaagctgcttaaa

SEQ ID NO: 4246 - DNA, 1151 bp, Brassica rapa
tttttctcgttttctctctctcacaacttcactagtcgtctgaatcggagctacgcttgcaaactccaatcatggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaagtcatctccatcttgatgcaaaggcatatccaggttgatggcaaagtcaggactgacaagacctatcctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgtgggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaaggtattaagctcaccatcatcgaggaagccaggaagaggctctctgggcaacaagctgcttaagttttcgactttcagctcttttatcatgtcgttttagatgacttttgtttccttagactcactttgcatcttttggcttgctactcagttttggaacttatgtttttttatctatttcaagagttttaaaatatgatctagtacaacgcaagaaccacagagatgtggttattgtccaaatcctgacatgttaccaagtaccagcccatacaagttcactattggccatttgcatcttttggtttgctactcggtttagaaacttatgttattttatctgttttaagagtt

SEQ ID NO: 4247 - DNA, 1073 bp, Brassica rapa
ctctcacaaccttcaccactcgttcagagctaaacgagagaagccgtctggatcggcgctacgcttccgaactccaaacatggcgagaggtttaaagaagcatttgaagaggctcaatgcccctaagcattggatgcttgacaaacttggtggtgctttcgcccccaagccatcttctggaccacacaagtctagagagtgccttcctcttgttcttatcatcaggaacaggttgaagtatgctcttacttaccgtgaagtcatctccatcttgatgcaaaggcatatccaggttgatggcaaagtcaggactgacaagacctaccctgctggtttcatggatgttatctctatccccaagactaacgagaacttccgtcttctctatgacaccaagggtcgtttccgtcttcactccatcagagatgaggaagcaaagtttaagctttgcaaggttcgaactatccaggtcggacagaagggcattccttacctcaacacatacgatggtcgtaccatccgttaccctgacccgttcatcaagcctaacgacaccatcaagctcgatcttgaggagaacaagattgttgagttcatcaagtttgatgtcggcaatgttgtcatggttaccggaggaagaaacagggggcgtgttggtgtgattaagaaccgtgagaagcataagggaagctttgagacaatccacatccaagactctacaggacatgagtttgcgacaaggttgggtaatgtgttcacccttggcaaaggaacaaagccgtgggtgtctcttcccaagggtaaaggtattaagcttaccatcattgaggaggccaagaagaggcttgctggtcaacaagctgcttgattttgtgattctccagctcgttattaagtcttcttagacgtcatatgttttcgtagactcgctttgcttctttttgttttggaacttgtgttattttctctgtttcaaggattcaacaaaaacttcaacatcacttgcccttttcttttgatggtcgcatggtatcacataatcatgttgttaagtagaacaatgagaatgagat

SEQ ID NO: 4248 - DNA, 1113 bp, Brassica rapa
aatcgctgagagagccgggaactgccgccactgagaggaagaagaagtcgtcgtcgtcgtccgctccgaagcaactgcaaacatggcaaggggattgaagaagcatttgaagaggctcaatgctcccaagcattgggatcttgacaaacttggtggtgccttcgctcccaagccctcttctggacctcacaagtctagggagtgcctccctctcgtcctgatcatcaggaacaagttgaagtacgctttgacataccgtgaggtcatctccatcctcatgcaaaggcatatccaagtcgatggaaaagtcaggactgacaagacttaccctgctggcttcatggatgttgtttccatccccaagactaatgagaacttccgtcttctgtatgacaccaagggacgtttccgtctccactccatcagggacgaggaagcaaagttcaagctttgcaaggttaggacaatccagttcggacaaaagggaatcccttacctcaacacatacgatggccgcaccatccgttaccctgacccgctcatcaaaccaaacgacaccatcaagctcgacctcgaggagaacaagattgttgagttcatcaagtttgacgtcggtaacgttgtgatggtgactggtggcaggaacagagggcgtgttggtgtgattaagaaccgtgagaagcataagggaagctttgagacgattcacattcaagactctacggggcatgagtttgccacgaggttgggcaatgtgttcactctggggaaaggaacaaagccgtgggtgtctcttccaaagggtaaaggtattaagctgactattattgaggaagctaggaagaggctttctgctcaacaagctgcttaaaagttgaatcacccaaagaccggttgttaccttcttgcttcagttttgagcctttttctgttacatgtttcttgcttgcaaaaccccataagaaaaaaaaacagctgagcattttagagcgttttgtaatatttgtatggacttttaaagtaatttactcttcaaaatcatttacttgtgatatattacaagcaaaatgatgctgcaatgttaatgaatcttgtattatgtgtttaatctag

SEQ ID NO: 4249 - DNA, 1135 bp, Cicer arietinum
ctgtatcttctttctcacagcacacgcacacagcgatcaagactcaagaggcgcagcaactttgctcgtctctttttacaattcgcaaacatggcaagagggttgaagaaacatttgaagaggctcaatgctccaaaacattggatgcttgataagcttggcggtgcctttgcaccaaagccatcatctggaccacacaaatcaagggagtgcctgcctttgattcttatcctgcgaaacaaactaaaatatgctctcacatatagagaagtaattgccatcttaatgcagcgccatgttttagttgataacaaagttaggacagataagacatatcctgctggttttatggatgtcgtgtctatccccaagactaatgaaaatttccgtcttctctatgacacaaagggtcgattccgtctccactctgtaagggatgatgaggcaaagtttaagctttgcaaggtacgatctgttcagtttgggcagaaaggtataccatatctgaacacctacgatggacgcaccatccgctaccctgatcccctgattaaggccaatgacacaatcaaactagacctggaacaaaacaaaatagccgatttcatcaaatttgatgtcgggaatgttgttatggttactggtgggaggaacagaggccgtgttggtgtcattaagaacagggagaagcacaagggaacttttgagaccgttcacgtccaggatgccactggtaatgagtttgcaacccggttgagtaatgtcttcactattggcaaaggtacaaagccttgggtgtctcttcccaaaggccggggtatcaaattgactgtcattgaggaggctagaaagcggattgctgctcaacaggtggcagctgcttaaatctgattacatatatattgttggacaatttagccatttagattgtttgagactgattttttattttaatccgctggtttccaggggaatggttgtgagaccgatttgtggctaatatgagattagttttgtttttaatgcaacatcacaattttgaactagacatggtgagttcaatttggcaccctttccatgttggacaacatttcttgtactaaattccctcttcctaattgtattacaattatag

SEQ ID NO: 4250 - DNA, 2213 bp, Gossypium hirsutum
aaaggtctttaacagctacattccaccaaaatggctagagggttgaagaaacatttgaagaggctcaatgctcctaggcattggatgcttgacaaacttggcggtgcatttgcaccaaagccatcatctggacctcacaaatccagggaatgcttaccactagttctcattcttcgaaacagattaaaatatgctctgacatatagagaagtgattgctattcttatgcagaggcatgttatggtagatgggaaggttagaactgataagacttatccagctggtttcatggatgttgtgtcaattccaaagacaaatgaggacttccgtctcctttatgatacaaaaggacgattccgccttcatgccatcaccggtgatgagtccaagtttaagctctgtaaagttcggtctgtccagtttggccagaagggtattccatacctcaatacttatgatggccgaacaatccgctacccagatccattgatcaaggctaatgacaccatcaagcttgacttagagagcaacaaaattgtcgatttcatcaagtttgatgtcgggaatgttgtcatggtcactggaggaaggaacaggggacgtgttggagtgattaagaacagagagaagcataagggtagctttgagacaatccatgttcaagatgctgctggccacgagtttgcaacccgtcttggcaatgtgtttacaattggtaaggggacaaagctgtgggttttgcttcctaagggcaagggtatcaagttgtcgatcattgaggaagcccggaagaggcttgcagcccaatccgctgcgtaaatttgataatatttggagcagttcaaagaattaatgagttggatgcttgctggctggtactttgtgttggttcttctttaagttgtatcctctgcttttcaactcacgagcggcagttttggaccaatcgtcttcttgaaatttagttgcagtagtttagtttaagttacatttgtttttttgatggaagtttttacatttttaataaaccattatatagcatggtaaagttcttgtttgctaaaatctgttttacatcttggctcaccttccaaactctagaaaaatgtcatcaacccagcaatcctcttcaacaaaaaagcaaacccttttcatagcttcacttataatcctatggtactcctcaaacattggagttcttctcttaaataaattcttactttccaactatggtttcagattcccaatctttttaacaatgtgccacatgtcagcttgtgcttttctcagttacgtctctattgtgttcatgaaacttgtccctcttcaacctatcaaatccaggcctcagttcctaaagattgcaactttaagtgttgtcttttgtggttctgttgttggaggtaacatttccttaagatacctccctgtctcttttaaccaggctgttggtgctaccacaccctttttcactgccttatttgcttacttcatgactttcaagagagaagcttgggttacttatggtgctcttgttcctgttgttgctggggttgtcattgctagtgggggtgaaccaggttttcactggtttggattcattatgtgcttaagtgcaactgccgcaagggccttcaaatctgttcttcagggcattctgctttcttctgaaggagaaaagttgaactcgatgaatttgctactctatatgtccccaattgcagttctagttttagtgcctgcagtaattataatggagcccaatgtgttagaagtcatcttatcccttggaaaacaacacagatacatgtggctgcttcttttcattaattcaacaatggcatattcagccaacttgtcaaacttcttggtgactaaacatacaagtgcattaacactccaggtgttaggcaatgcaaaaggtgctgtggctgttgtcatctcaatacttctgttcagaaatcctgtaacagttgtgggcatcggtggttatacaatgactgtccttggtgttgttgcttatggagaagcaaagcgtaggtttagataaatgacatgtcacgtcacattttaccgatatgaattcaatttagtggacttggaaatgttgtgttttcatgaaagagtatagtgagatttaaagggcagattcctagtgaatatagtattttgtagagtgctttaattgcctacacatgcatgccttcccttgt

SEQ ID NO: 4251 - DNA, 906 bp, Eschscholzia californica
cagaggcggaagaggagggcgtctgattttcaggcgaagaagaatacatacaatatggcgaggggactcaagaagcatttgaaaaggctcaatgccccaagtcattggatgctcgataagcttggtggtgcatttgctcccaaaccatcgtctggaccccacaaatctagagaatgccttccattgattcttatcctgcgaaataggctgaaatatgctcttacatatcgtgaggttgttgctatattgatgcaacgacatattctggtcgatgggaaggttcggacagatcagagatacccatcaggtttcatggatgttgtgtcgatcccgaaaaccaatgagaacttccgccttctctatgacaccaagggtcgtttccgtcttcattcaatcaaggatgaagaggctaagttcaagctctgcaaggtccgaaatgtgcagttcggacaaaagggtatcccttacatcaacacatatgatggtcgaacaatccgctaccctgacccacttatcaaggctaacgacaccatcaagcttgaccttgaaaccaacaaaatcaccgacttcatcaagtttgatgtcggaaatgtcgtgatggtcactggtggaagaaacaggggacgtgttggagttatcaagaacagagagaagcataaaggaagtttcgagactatccatgtccaagatgcgactggtcacgaatttgccactcgtttaggaaatgttttcacaatcggaaagggaactaagccgtggctttcacttcccaagggcaagggtatcaagttgtcgatcattgaagaggccaggaagagacttgctgctacagaatctgctaaatgaggtcttaagttactgttagcttaacaacaattgtctttacttttgtaagttagtattcgg

SEQ ID NO: 4252 - DNA, 1217 bp, Carpinus betulus
tcggctcagagatctacgttccgacgactccaagatggctaggggcttgaagaaacatctgaagaggctcaatgctccaaaacattggatgcttgacaaacttgggggcgcatttgctcctaagccatcatctggcccccacaaatccagggagtgcttgccattaatccttattttgcggaacaggttgaagtatgccctcacataccgtgaggtcattgccattctgatgcagcgacatgttttggttgatgggaaggttaggactgacaagacctatccttcaggcttcatggatgtggtatcaattccaaaaacaaatgagaacttccgtctcctttatgataccaagggtcgtttccgtctccactcaattagggatgaagaggcaaagttcaagctttgcaaggtccggtctgtgcagtttgggcagaagggaattccatatctcaacacccacgatgggcgaactatccgctaccctgacccaattatcaaggctcatgacaccatcaagctggacctagagaccaacaagatcaccgatttcatcaagtttgatgttgggaatgttgtcatggtgactggtggtagaaacagaggtcgtgttggagtcattaagaacagggaaaagcataagggaacattcgagacagttcacatccaggatgccactggtcatgagtttgcaacccgtcttggaaatgtttacaccattggcaagggtactaagccatgggtctctctgcccaagggcaagggtatcaagctgaccatcattgaagaggcaaggaagcggaaccaaggccaaccactcacagctgcttaaaaccagtattgtgtattagttatggctttagaagattacctagatgaagtttattttttgccatttgaggattcatgttttggtttaaatatgtagtactggttttcgcgaatgagtttcactactgttgtttaattctgtttgcactagaatgagtaatatcaaaccagtttgatgagcttactctgtttatgtgaattttaaattttccctttagcagattttgttaaaggcaatctctatatatagaattttgctggcattcattctctttgatggagacatggacaggctgctgtcgtctgtgttttatgttgtcaacttgcttttatgtgataactcagcctgaaaaggcatggagatcgttgtattaattatggagtactag

SEQ ID NO: 4253 - DNA, 1249 bp, Papaver somniferum
ctgctctctcgtaatagtgtagtggatttagctccagaggcggaagaagaagaagaaggaatagaaaattagggcaaacctaatttacagtccaaaaactccatcatggcgaggggattgaagaaacatatgaagaggcttaatgcccctaagcattggatgcttgataaattgggtggtgcttttgcccctaagccatcatctggaccacacaagtctagggaatgtcttcccctgattcttatcctgcgaaacagattgaaatatgcccttacataccgtgaagttattgctattttgatgcaaaggcacattcttgttgacgggaaagtgcgaacagacaagacctatccatctggattcatggatgttgtgtcgattcccaagacgaacgagaacttccgtctcctatatgacaccaagggtcgcttccgtctccactccatcaaggatgaagaagctaagttcaagctatgcaaggttagaaatgtacactttggatctaagggtattccatacatcaacaccttcgatggtcgcaccatccgttaccctgaccctcttatcaaggctaatgacaccatcaagctagatcttgagagcaataagattgttgattttatcaagtttgatattggtaatgtcgtcatggttactggaggtagaaacagaggccgtgttggtgttatcaagaacagagagaagcataagggaagtttcgatacccttcatatccaggattctactggccatgagttcgccacccgtttggccaatgtgttcaccattgggaaaggtaccaagccatgggtttcactccccaagggcaagggtatcaagttgtctattattgaagaggctaggaaaaggttggcggcccaaggagctgccacagcttaggtgcggccatcatgaccaggtgttcggcttggaaattaatcttagcttaaaagaacaattgctgttttagttactttctgaacaaaattttgaaactgttttttgtttagcttttccaacattacttggatattataagcctgatctgtctgagtttctttggtattgattctttcccactttccctgcgttatgttcattttgtcaggtctacctgaattcaaattggctctgttaatttaagatcagtaaatccctgtatccataagaaatccccatgggcaacactggaatttgttatattcatactcttgcaagtcccccagcaaagctgaattggactcatttc

SEQ ID NO: 4254 - DNA, 1280 bp, Gossypium hirsutum
tctctctcttattcgcaccttccctggaaaggtaaaggctttcagtggaaacagcttcattccaccaaaatggctagagggttgaagaaacatttgaagaggctcaatgctcctaggcattggatgctcgacaaacttggcggtgcatttgcaccaaagccgtcatctggacctcacaaatccagggaatgcttgccactagttctcattctgcgaaacagattaaagtatgctctgacatatagagaagtgattgctattcttatgcagaggcatgttatggtagatgggaaggttagaactgataagacttatccagctggtttcatggatgttgtgtcaattccaaagacaaatgaggacttccgtctcctctacgatacaaaaggtcgattccgccttcatgccatcactggtgatgagtccaagtttaagctctgtaaagttcggtctgtccagtttggccagaagggtattccatacctcaatacttatgatggccgaacaatccgctacccagatccgttgatcaaggctaatgacaccatcaagtttgacttagagagcaacaaaattgtcgatttcatcaagttcgatgtcgggaatgttgtcatggtcactggaggaaggaacaggggacgtgttggagtgattaagaacagagagaagcataagggtagcttcgagacaatccatgttcaagatgctgctggccacgagtttgcaacccgtcttggcaatgtgtttacaattggtaaggggacaaagccgtgggttttgcttcctaagggcaagggtatcaagttgtcgatcattgaggaagcccggaagaggcttgcagcccaatccgccacgtaagtttgataatatttggagctgtttaaagaattgatgagttggatgcttgctggctggtactttgtgttggttcttctgtaagttctatcctctgcttttcaactcatgagcggcagttttagaccaatcgtcttcttgaaatttagttgcagtagtttagtttgttacatttgttttatcgaaggaagttgttacatttttagtaaatcattatatagcatagtaaaattcttgtttgctaaaatctgctttgcatcttggctcacttttatttcctatataggtcaagccaggtcgatgtatggtttcaataaattacatatttgtctagatccaatatgtgataatgggttttgaattttgtaactctggaagaaactaactgaaatcaccaattaaatatagcattagcttcctatgtt

SEQ ID NO: 4255 - DNA, 832 bp, Antirrhinum majus
tatgtctagggtttaactgagtacagaacataacagagacccagccgccggcgtcgatttgcacatcctctaccgaaaatggctaggggtttgaagaaacacttgaagaggctcaatgcccccaaacattggatgttggacaagcttggtggtgcttttgcgcccaagccatcgtccggaccccacaaatcgagggagtgcttgcccttgattcttattattcgtaataggctcaagtatgctctgacttaccgtgaagtcatttcaattttgatgcaacgccatatccttgttgatggcaaagtcaggacggataagacgtatcccgctggtttcatggatgtcgtctctattcccaagaccaatgagaacttccgtctgctgtatgacaccaagggacgattccgtctgcactccgtcagggatgaggaagccaagtttaagctgtgcaaagtccgttctgttcagtttggaaagaagggtattccttacatcaatacctttgatggaaggactatccgctatcctgatccattgatcaaggcaaacgacaccattaaacttgacctggaggaaaacaagatcgttgactttatcaagtttgatgttgggaatgtcgtgatggttactggtggtaggaacaggggacgtgttggagtaatcaagaaccgtgaaaagcataagggaagctttgagactatccacatccaggattctactggccacgagtttgctactcgattgggcaatgtgtttacaattggtaaggggacaaagccttgggtttctcttccaaagggcaaaggtattaagttgtccattattgaggagg

SEQ ID NO: 4256 - DNA, 1092 bp, Arnica chamissonis
cagatcaactagggttatccgaggagttgaacgagagggtgttgcaggcgagaggaccgccgcagcttcgccgtacaattctaccgatctcttacacaccacgccgcagctatggctcgtggtttgaagaaacatctaaagaggcttaatgctcctaagcattggatgcttgataaacttggtggtgcttttgctccaaagccatcatctggaccacataaatctagggaatgcttgcctttgatccttatactaaggaataggttgaagtatgctttgacataccgtgaggttcaatctattttgatgcaacgtcatgtgcttgttgacaataaggtcaggacagacaagacttaccctgccggtttcatggatgttgtctcaattcccaagactaatgaaagcttccgacttctatacgatacaaagggcaggtttaggctacactccatcagggatgaggaatcgaagttcaagttgtgcaaggttcgttcggtccaatttggtcaaaaagggattccttacataaacacctatgatggtcgaaccattcgttacccagatcctctcatcaaagctaatgacacaatcaaacttgatctagactcgaacaagattgttgatttcatcaagtttgatgttgggaatgtagtcatggtgacaggtggacgaaacacaggccgtgttggaatcctcaagaacagggaaaaacataagggaagctttgagacggttcacattcaggatgctaccgggcatgagtttgctactcgattgggaaatgtcttcactcttggaaagggttcaaagccgtgggtgtctcttcccaagggcaagggtatcaagttgaccatcatcgaggaggctaggaagaggcaagctgctgctgctgcatcggttgcttgatttgcatgcacgctctagcggaggcatgttttaattttggacctgcatgttaaggttagtttgataaagaattggtgagtctttgctgatttatcattgtttttattttagacttttgcttcttgaatttgttttatgaaattgagatgattatgtatgcctttgaccacttgatttgattgttat

SEQ ID NO: 4257 - DNA, 982 bp, Arnica chamissonis
acgccgcagttctatcgtatatttctaccggagactctcatctcctacaccccgcgctgcaaccatggctagaggtttgaagaaacatatgaagaggctcaatgctcctaagcattggatgcttgataaacttggtggtgcttttgctcctaagccatcatctggacctcataaatcaagagaatgccttcccttgatcctcattttaaggaacaggttgaagtatgctttgacctaccgtgaggttcaatctattttgatgcaacgtcatgtccttgtcgataacaaggtcaggactgacaagacttaccctgctggtttcatggatgtggtctcaattcccaagaccaatgaaagcttccgacttttgtatgacacaaagggcaggttcaggctccactccatcagggatgaggaatcaaagtttaagttgtgcaaggttcgttcggtccagtttggtcaaaaggggattccttacatcaacacctatgatggccgaacaattcgctaccccgatccactcatcaaagctaatgacacaatcaaacttgacttggaatcaaacaagattgttgatttcatcaagtttgatgttgggaatgttgtcatggtgacaggaggacgaaacacaggccgtgttggaatccttaaaaacagggaaaaacacaagggcagctttgagactgtccacattcaagatgccactgggcacgagtttgctacccgtttgggaaatgttttcactctgggaaaaggttcaaagccttgggtatcactcccgaagggtaagggtattaagttgaccatcattgaggaagctaggaaaaggcaggctgcacaagctgccaccgcataggttgcttaattttgtattccttgttctggaggagttgtgttttaatttgggtaacaattttgagactttagatttgtgtgctaagtttagtttgattacaaattgtagtaccttttttatttgtca

SEQ ID NO: 4258 - DNA, 1045 bp, Brassica juncea
aataatcacaagtcctcctgctcgcaacacctgcaaacatggcgagaggattgaagaagcatctgaagaggctcaatgctcccaagcattggatgcttgacaaacttggtggtgccttcgctcccaagccgtcttctggacctcacaagtctagggagtgtcttcctctcgtcctgatcatcaggaacaggttgaagtacgctttgacataccgtgaggtcatctccatcctgatgcagaggcatatccaagtcgatggaaaagtcaggactgacaagacataccctgctggtttcatggatgttgtgtctatccccaagacgaatgagaacttccgtcttctgtatgacaccaagggacgtttccgtctccactccatcagggacgaggaagctaagttcaagctctgcaaggttaggaccatccagctcggacagaagggtatcccttacctcaacacttacgacggtcgcaccatccgttaccccgacccactcatcaaaccaaacgacaccatcaagctagacctcgaggagaacaaggtcgtggagttcatcaagttcgacgttggcaacgttgtgatggtgactgggggtagaaacagagggcgtgttggtgtgatcaagaaccgtgagaagcataagggaagcttcgagacgatccacatccaagactcgactgggcatgagtttgcaacgaggttgggcaatgtgttcactctcgggaaaggaacgaagccgtgggtgtctcttccaaagggtaaaggtattaagcttaccatcattgaggaagccaggaagaggctttctgctcaacaagctgcttaaaatgttttatcgttgaaggctgcttttgtgtcacagactcgctacttgtctcagttttgaggctttttttgctcttttatgttgcttgctttcaaaacctattacaagacagtttatgattccagtagagcgttttgtatggatgattttagtaatttttactctttgcaaaaaaaaataaagaaattatcagttctataatccccgcgtaatctgcg

SEQ ID NO: 4259 - DNA, 961 bp, Brassica juncea
tgctcgcaacacctgcaaacatggcgagaggattgaagaagcatctgaagaggctcaatgctcccaagcattggatgcttgacaaacttggtggtgccttcgctcccaagccgtcttctggacctcacaagtctagggagtgtcttcctctcgtcctgatcatcaggaacaggttgaagtacgctttgacataccgtgaggtcatctccatcctgatgcagaggcatatccaagtcgatggaaaagtcaggactgacaagacataccctgctggtttcatggatgttgtgtctatccccaagacgaatgagaacttccgtcttctgtatgacaccaagggacgtttccgtctccactccatcagggacgaggaagctaagttcaagctctgcaaggttaggaccatccagctcggacagaagggtatcccttacctcaacacttacgacggtcgcaccatccgttaccccgacccactcatcaaaccaaacgacaccatcaagctagacctcgaggagaacaaggtcgtggagttcatcaagttcgacgttggcaacgttgtgatggtgactgggggtagaaacagagggcgtgttggtgtgatcaagaaccgtgagaagcataagggaagcttcgagacgatccacatccaagactcgactgggcatgagtttgcaacgaggttgggcaatgtgttcactctcgggaaaggaacgaagccgtgggtgtctcttccaaagggtaaaggtattaagcttaccatcattgaggaagccaggaagaggctttctgctcaacaagctgcttaaaatgttttatcgttgaaggctgcttttgtgtcacagactcgctacttgtctcagttttgaggctttttttgctcttttatgttgcttgctttcaaaacctattacaagacagtttatgattccagtagagcgttttgtatggatgattttag

SEQ ID NO: 4260 - DNA, 941 bp, Brassica juncea
caaactccaaacatggcgagaggtttgaagaagcatttgaagaggctcaatgcccctaagcattggatgcttgacaaacttggtggtgcttttgcccccaagccatcttctggaccccacaagtctagggagtgccttcccctcgttcttatcatcaggaacaggttgaagtatgctcttacctaccgtgaagtcatctccatcttgatgcaaaggcatatccaggttgatggcaaagtcaggaccgacaagacctaccctgctggtttcatggatgttgtctctatccccaagactaacgagaacttccgtcttctctacgataccaagggacgtttccgtcttcactccatcagggacgaggaagccaagtttaagctgtgcaaagtccgaactatccagctcggacagaagggcattccttacctgaacacgtacgatggtcgcaccatccgttaccctgacccactcatcaagcctaacgacaccatcaagctcgacctggaggagaacaaagttgtggaattcatcaagtttgatgtcggcaatgttgtgatggtgactggaggaagaaacagagggcgtgttggtgtgattaagaaccgtgagaagcataagggaagctttgagacaatccacatccaagactcaactggacacgagtttgcaactaggttgggaaacgtcttcaccctcggcaaaggaacaaagccatgggtttctcttcccaagggtaaaggtattaagttgaccatcatcgaagaagccaggaagaggctcgctggccaacaggctgcttaagtttgtgtgactttcagctctttattatgtcgttttagatgacttttgtttccttagactcgctttgcatcttttggttcgctactcagttttgaaacttattctatctatttcaagagtttccttagactcgctttgca

SEQ ID NO: 4261 - DNA, 915 bp, Brassica juncea
acaagtcctcctgctcgcaacacctgcaaacatggcgagaggattgaagaagcatctgaagaggctcaatgcacccaagcattggatgcttgacaaacttggtggtgccttcgctcccaagccgtcttctggacctcacaagtcgagggagtgtcttcctcttgtcctgatcatcaggaacaggttgaagtacgctttgacgtaccgtgaagtcatatccatccttatgcaaaggcatatccaagttgatggaaaagtgaggaccgacaagacataccctgctggtttcatggatgttgtgtcgatccccaagacgaatgagaacttccgtcttctgtatgacaccaagggacgtttccgcctccactccatcagggacgaggaagcaaagttcaagctttgcaaggtgaggactatccagcttgggcagaagggaattccttacctaaacacttacgatggtcgcaccatccgttaccctgaccccctcatcaagccaaacgacaccatcaagctggatcttgaggagaacaaggtcgttgagttcatcaagtttgatgttggtaacgttgtcatggtgacaggaggtagaaacagagggcgtgttggtgtgatcaagaaccgtgagaagcataagggaagctttgagacgatccacatccaagactcgacaggacacgagtttgccacaaggttgggcaacgtgttcaccctcggcaaaggtacaaagccatgggtgtctcttccgaagggcaaaggtattaagctgaccatcattgaggaagctaggaagaggctttctgcccaacaagctgcttaaagttgattcatcaaaggccgtttggttttactcttagtatcgtagactctcgcttctcacctcagttttcagcttttgtcctttcatgttttttt

SEQ ID NO: 4262 - DNA, 1051 bp, Brassica rapa
gctctcacaaccttcaccactcgttcagagctaaacgagagaagccgtctggatcggcgctacgcttccgaactccaaacatggcgagaggtttaaagaagcatttgaagaggctcaatgcccctaagcattggatgcttgacaaacttggtggtgctttcgcccccaagccatcttctggaccacacaagtctagagagtgccttcctcttgttcttatcatcaggaacaggttgaagtatgctcttacttaccgtgaagtcatctccatcttgatgcaaaggcatatccaggttgatggcaaagtcaggactgacaagacctaccctgctggtttcatggatgttatctctatccccaagactaacgagaacttccgtcttctctatgacaccaagggtcgtttccgtcttcactccatcagagatgaggaagcaaagtttaagctttgcaaggttcgaactatccaggtcggacagaagggcattccttacctcaacacatacgatggtcgtaccatccgttaccctgacccgttcatcaagcctaacgacaccatcaagctcgatcttgaggagaacaagattgttgagttcatcaagtttgatgtcggcaatgttgtcatggttaccggaggaagaaacagggggcgtgttggtgtgattaagaaccgtgagaagcataagggaagctttgagacaatccacatccaagactctacaggacatgagtttgcgacaaggttgggtaatgtgttcacccttggcaaaggaacaaagccgtgggtgtctcttcccaagggtaaaggtattaagcttaccatcattgaggaggccaagaagaggcttgctggtcaacaagctgcttgattttgtgattctccagctcgttattaagtcttcttagacgtcatatgttttcgtagactcgctttgcttctttttgttttggaacttgtgttattttctctgtttcaaggattcaacaaaaacttcaacatcacttgcccttttcttttgatggtcgcatggtatcacataatcatgttgtt

SEQ ID NO: 4263 - DNA, 974 bp, Brassica rapa
gctctctctcacaacttcactagtcgtctgaatcggagctacgcttgcaaactccaatcatggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaagtcatctccatcttgatgcaaaggcatatccaggttgatggcaaagtcaggactgacaagacctaccctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgttggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaaggtattaagctcaccatcatcgaggaagccaggaagaggctctctgggcaacaagctgcttaagttttcgactttcagctcttttatcatgtcgttttagatgacttttgtttccttagactcactttgcatcttttggcttgctactcagttttggaacttatgtttttttatctatttcaagagttt

SEQ ID NO: 4264 - DNA, 980 bp, Brassica napus
tggacgcctgcggaccggtccggaattctcggtcgacccacgcgtccggtcgtctgaatcggagctacgcttgcaaactccaatcatggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaagtcatctccatcttgatgcaaaggcacatccaggttgatggcaaagtcaggactgacaagacctaccctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgttggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaaggtattaagctcaccatcatcgaggaagccaggaagaggctctctggccaacaagctgcttaagttttcgactttcagctcttttatcatgtcgttttagatgacttttgtttccttagactcactttgcatcttttggcttgctactcagttttggaacttatgtttt

SEQ ID NO: 4265 - DNA, 1018 bp, Brassica napus
ttaacaatttacttcgaatatgattaaatgtactaccacaaacgaagcaaaccttcaccacacgttcagaagctaaacgagagaagccgtctggatcggcgttacgcttccgaactccaaacatggcgagaggtttaaagaagcatttgaagaggctcaatgcccctaagcattggatgcttgacaaacttggtggtgcttttgcccccaagccatcttctggaccacacaagtcgagggagtgccttcctcttgttcttatcatcaggaacaggttgaagtatgctcttacctaccgtgaagtcatctccatcttgatgcaaaggcatatccaggttgatggcaaagtcaggactgacaagacctaccctgctggtttcatggatgttatctctatccccaagactaacgagaacttccgtcttctctatgacaccaagggtcgtttccgtcttcactccatcagagatgaggaagcaaagtttaagctttgcaaggttcgaactatccaggtcggacagaagggcattccttacctcaacacatacgatggtcgtaccatccgttaccctgacccgttcatcaagcctaacgacaccatcaagctcgatcttgaggagaacaagattgttgagttcatcaagtttgatgttggcaatgttgtcatggttaccggaggaagaaacagggggcgtgttggtgtgattaagaaccgtgagaagcataagggaagctttgagacaatccacatccaagactctacaggacatgagtttgcgacaaggttgggtaatgtgttcacccttggcaaaggaacaaagccgtgggtgtctcttcccaagggtaaaggtattaagcttaccatcattgaggaggccaagaagaggcttgctggtcaacaagctgcttgattttgtgattctccagctcgttattatgtcttcttagacgtcatatgttttcgtagactcgctttgcttctttttgttttggaacttgtgttattttctctgtttca

SEQ ID NO: 4266 - DNA, 900 bp, Taraxacum officinale
ggagagagcgctgcagaggaccgccgcagtttcgccgtacaattatcccggagattattatctcctactacacacgccgcagccatggctcgaggtttgaagaagcacatgaagaggctcaatgcccccaagcattggatgctcgataaactcggtggcgcttttgcacccaagccgtcatcaggcccacacaaatcacgcgaatgcctacccttgatcctcattctccgtaacaggctcaagtacgccttaacctaccgtgaggtccaatccatcctaatgcaacgccatgttcttgttgacaacaaggtcagaaccgacaagacctacccagctggtttcatggatgttgtctccatccccaaaaccaatgaatacttccgtcttctatacgacaccaaaggtagattcagattgcactcagtcagagatgaagagtcaaagtttaagttatgcaaggttcgatcagtccaatttggacaaaaggggattccatacatcaacacatatgatgggcgaacaatccgttatccggacccactaatcaaagccaatgacacgatcaagcttgatttggacacgaacaagatcgtggatttcatcaagtttgatgttgggaatgtggtgatggtgacaggtggcaggaacacggggcgtgttgggatccttaagaaccgtgaaaaacataaggggagttttgagacggttcatattcaggattcaacgggtcatgagtttgcgacccggttggggaacgtgtttacggttgggaaggggagtaagccgtgggtgtcgctgcccaaggggaaggggattaagttgactattattgaggaggctaggaagaggcaggctgccctagctgcccaagttgcttgattttgtatggtggttggtttt

SEQ ID NO: 4267 - DNA, 915 bp, Taraxacum officinale
ttcgggcggcggaaggagagagcgttgtagaggaccgccgcagtttcgccgtacaagtatcccggagattattatctcccactacacacgccgcagccatggctcgaggtttgaagaagcacatgaagaggctcaatgcccccaagcattggatgctcgataaactcggtggcgcttttgcacccaagccgtcatcaggcccacacaaatcacgcgaatgcctacccttgatcctcattctccgtaacaggctcaagtacgccttaacttaccgtgaggtccaatccatcctaatgcaacgccatgttcttgttgacaacaaggtcagaaccgacaagacctaccctgcaggtttcatggatgttgtctccatcccaaaaaccaatgaaaacttccgtcttctatacgacaccaaaggtagattcagattgcactcagtcagagatgaagagtcaaagtttaagttgtgtaaggttcgatcagtccaatttggacaaaaggggattccatacatcaacacttatgatgggcgaacaatccgttatccggacccactaatcaaaaccaatgacacgatcaagcttgatttggacacgaacaagatcgtggatttcatcaagtttgatgttgggaatgtggtgatggtgacaggtggcaggaacacggggcgtgttgggatccttaagaaccgtgaaaaacataaggggagttttgagacggttcatattcaggattcaacgggtcatgagtttgcgacccggttggggaacgtgtttacggttggaaaggggagtaagccgtgggtgtcgctgcccaaggggaaggggattaagttgactattattgaggaggcgaggaagaggcaggctgccctagctgcccaagttgcttgattttgtattgctggttggtttt

SEQ ID NO: 4268 - DNA, 1015 bp, Flaveria ramosissima
gcgggggtgtcgccataccagagacctccgccgcagctctgccgtataactccaccggagacaccgatctctaaccccactctgcagccatggctagaggcttgaagaaacatttgaagaggcttaatgcccctaagcattggatgcttgataaacttggcggtgcttttgctcctaagccatcatctggacctcacaagtctagggaatgtttgcctttgatcctcattttgaggaataggttgaagtatgctttgacataccgtgaggttcagtccattttgatgcaacgtcatgtgcttgttgacaacaaggtcaggactgacaagacctaccctgctggtttcatggatgttgtctcaattcccaaaaccaatgaaaacttccgacttctatatgataccaagggcaggttcaggctccactcaatcagagatgaggaagcaaagttcaagttgtgcaaagtccgctctgtccaatttggttcaaaagggattccttacatcaacacttatgatggtcgaaccattcgctaccctgatcctctcatcaaagctaatgacactatcaaacttgacttggactcaaacaagattgttgatttcatcaagtttgatgttggtaatgttgtcatggtgactggtggacgcaacaggggccgtgttggaatccttaagaacagggaaaagcataagggaagctttgagacagttcacattcaggatgctactgggcatgaatttgctactcgtttgggaaatgtttttactcttggtaagggttcaaagccttgggtgtctctccctaagggcaagggtatcaagttgagcatcatcgaagaggctaggaagaggcaagctgctgccgcagcagttgcttagttatgccttgcaagcatgatcgttgcttgattgctggttggtcatgttaaatttatattatgagactttgtttaagaggagattaatttttatttttggtactaattttgcatctgcattgttaaggttagtat

SEQ ID NO: 4269 - DNA, 1081 bp, Flaveria ramosissima
agctccgccgcagctccgccgtacaacgccaccggagacaccgatctctaactccacactgcagccatggctcgaggcttgaagaaacatttgaagaggcttaatgcacctaagcattggatgcttgataaacttggtggtgcttttgctcctaagccatcatctggacctcacaagtctagggaatgtttgcctttgatcctcattttgaggaataggttgaagtatgctttgacataccgtgaggttcagtcgattttgatgcaacgtcatgtgcttgttgacaacaaggtcaggactgacaagacttatcctgctggtttcatggatgtcgtctcaattcccaagaccaatgaaaacttccgacttctatatgatacaaagggcaggttcaggctccactccatcagagatgaggaagcaaagttcaaattgtgcaaagttcgctccgtccaatttggttctaaagggattccttacatcaacacctatgatggtcgtaccattcgttaccctgatcccctcatcaaagctaatgacactatcaaacttgacttggactcaaacaagattgttgatttcatcaagtttgatgttggtaatgttgtcatggtgactggtggacgaaacaggggccgtgttggaatccttaagaacagggaaaagcataagggaagctttgagacggttcacattcaggatgctactgggcatgagtttgctactcgcttgggaaatgtcttcactcttggaaagggctcaaagccttgggtgtctctccccaagggtaagggtatcaagttgagcatcatcgaggaggctaggaagaggcaagctgctgctgcagcggttgcttaattatagcatgatctttgcttgctggctgggtggtcatgttaaatttatattatggcacttgttttagaggagatatgttttatttttggtacaattttgcatctgcatgttaaggttagtatgatttaaaattttcagactgtttgtctgatttatcctggtttctaatgttgactttctaattcatgaatttgctgaaggctatttggaatcttgttatacg

SEQ ID NO: 4270 - DNA, 844 bp, Heritiera littoralis
atggctagagggttgaagaaacatttgaagaggctcaatgcccctagacattggatgctcgacaagcttggcggtgcatttgcacccaagccatcatctggacctcacaagtccagggaatgcttgccactgatcctcattctgcgaaacaggttgaagtatgctctaacctgtcgagaagtcattgctattctcatgcagaggcatgttatggtagatgggaaggttaggacagataagacttatcctgctggtttcatggatgttgtgtccattcctaaaacaaatgaggactttcgtctactttatgacaccaaagggcgttttcggctccatgccatcactggtgatgaaaccaagttcaagctttgcaaggttcgatctgtccagtttggccagaaaggtattccatacctcaatacatatgatgggcgtactattcgctacccagatcctttgatcaaggctaatgacaccatcaagctggatcttgagagcaacaaaattgttgatttcatcaagtttgatgttgggaatgttgtcatggtcactggaggaaggaacagaggtcgtgttggagtaattaagaacagggagaaacataagggtagctttgagacgatccatgttcaagatgctgctgggcatgagtttgctactcgtctaggtaatgtcttcacaattggaaaaggaacaaagccatgggtttcccttcctaagggcaagggtatcaagttatccatcattgaggaagctaggaagaggcttgcaacccaaaatgctgtttaatctttagcataagatatccagatatgttttgctgcggtagtttattctgcagatg

SEQ ID NO: 4271 - DNA, 1002 bp, Lactuca sativa
aaggagagagtggcgcagtaagtgcagaggaccgccgcagtttcgccgtacatctataccggagattcctatctcctacaccacacgccgcagccatggctcgaggattgaagaaacacatgaagaggctcaatgccccaaagcattggatgcttgataaacttggtggcgcttttgctcctaagccatcatcaggacctcacaaatcaagggaatgtctccccttgatcctcatcctgaggaacaggttgaagtatgctttgacatatcgtgaggtccaatccattctcatgcaacgccatgttcttgttgacaacaaggtcagaactgacaagacttaccctgctggtttcatggatgtcgtctcaattcccaagaccaatgaaaacttccgtcttctatatgacaccaagggtagattcagactccactcagtcagagatgaggaatcaaagttcaaattgtgcaaggttagatcagttcaatttgggtcaaaaggcattccatacatcaacacatatgatgggcgaacaattcgctacccggacccactcatcaaagccaatgacacaatcaagcttgacttggacaccaacaagattgtggatttcatcaaatttgatgttggcaatgttgtcatggtgacaggtggcaggaacacagggcgagttggaattttgaagaacagggaaaaacataagggaagttttgagactgttcatatccaggattccacgggtcatgagtttgcgacccgtttggggaatgtgtttactcttggaaaggggacaaagccgtgggtgtcgctgcccaagggcaaggggattaagctgactattattgaggaggctagaaagaggcaggctgccccagctgcccaagttgcttgatttttgtgttgttgattgttggttttgttgagacttatatggtagttgttggattttagaggtggttatgtttttgattttggtacaattttgaatgtttgggttttgtttg

SEQ ID NO: 4272 - DNA, 1046 bp, Nuphar advena
gaggagttgcagaatcgttgctgagccaaaatggcacgaggtttgaagaaacatttgaagaggctcaatgctcccaaacattggatgcttgacaaattgggaggagcatttgcacccaaaccatcttctgggccgcacaagagtcgcgaatgtttgccattgatactgatcataaggaacaagctaaaatatgctttgacatatcgtgatgttgtctcaatcctgatgcagcgtcttgtgactgtggatggaaaagtacgaactgatcaaaagtatccttgtggatttatggacgttgtatccattccaaaagtaaatgagaactaccgactcctttatgatacaaagggtcgttttcgcttacaatctataaaggatgaagaggcaaagttcaagctttgcaaagtcagatctgtgcagtttggacaaaagggcatcccgtatctgaacacctacgatggccgaactattcgatatcccgatccacttattaaggctaatgacaccattaaactggacattgaaacaaacaaaatagttgactttattaagtttgatgttggaaatgttgtgatggtgacgggtggtagaaatcgtggtcggattggtgtaatcaagaaccgtgaaaaacataaggggagctttgaaattatccacgttcaagatgcagcaggacatgaatttgccacaagacttggcaacgttttcacaatagggaagggaaccaaaccctgggtgtctttgcccaaaggaaagggtatcaagctctcaatcattgaggaagccagaaaaaggaatgccgctgcagtggctgcagcttaagtgtcctcaggtaagcgcatcaagtactcttgacagttttgttatccatttgccttctttgaagagcggtgttttgtaagacgttttttagtttttgtttttttttgaagatttgtcattgaggattttgatttttgtaattagggacatgattcgagttcgaaagtgtttaaatctttaatgacttttatgttgattagtccaacttgattctgtttcatgcc

SEQ ID NO: 4273 - DNA, 1063 bp, Nuphar advena
accaggagcagcagcaggaggaggtggaggagttgcagagtcatccacttcattgagccaaaatggcgcgagggttgaagaagcatttgaagaggctcaatgctcccaaacattggatgcttgacaaattgggtggagcgtttgcacccaaaccatcttctgggccacacaagagtcgtgaatgcttacctttgatactcattatacgaaacaaactaaaatatgccttaacatatcgtgatgttgtttcaatcctaatgcagcggcttgtgactgtagatggaaaagtacgaactgatcaaaagtatccttgtggatttatggatgttgtatccattccaaaagtaaatgagaattatcgacttctctatgatacgaagggtcgcttccgcttgcaatctataaaagatgaagaggcaaagttcaagctttgcaaagtcagatcagttcagtttggacaaaagggtattccatacctgaacacctatgatggccgaactattcggtatccagatcctcttatcaaagctaatgacaccattaaactggatattgaaacaaacaaaatagttgactttatcaagtttgatgttggaaatgttgtgatggtgaccggtggtagaaatcgtggtcggatcggggtgattaagaaccgtgaaaagcataagggaagcttcgaaattatccatgttcaagatgctgcaggacatgaatttgcaacacggcttggtaatgtgttcaccatagggaagggaaataaaccctgggtgtccttgcccaaaggtaagggtatcaaactttcaatcattgaggaagccagaaaaaggaaagcgtccgcagtggctgcagcgtaagtattttgaaacaggcgattgaagtatggtgaattaaatcaagaaggccgttttgtgacatttttttagtttttatttttttttaagaatagtggttgaggattttcccttagtgagattaaatatgttggtgttaattttggatgattttttgtagtgagtgttgcatgaatattttggttttatttcattccttgcaaacttttgtg

SEQ ID NO: 4274 - DNA, 1104 bp, Populus trichocarpa
gcgtcgctttaaaccagtccagaccagagtgttggaagccgcggcagagctcagcgaagcaaaatggctagaggattgaagaagcacttgaagaggctcaatgcccctaaacattggatgcttgacaaacttggtggtgcatttgcacccaagccatcttctggaccccataagtctagagaatgcttgcctctcattcttattctgcgaaacaggctaaagtatgctctcacataccgtgaagtaattgccattttgatgcagagacatgtctttgttgatggcaaggtcaggacagataaaacttacccgtctggtttcatggatgttgtatcaatcccaaagacaaatgagagcttccgactcctctatgacaccaaaggccgcttccgtctccactccctcagagaagatgaggccaagtttaagctttgcaaagttcggtctgttcagtttgggcagaaaggcatcccttacctgaacacctatgatgggcgcactatccgctacccagacccactcatcaaggccaatgacaccatcaagctcgacctagagaattacaagatagtagactacatcaagtttgatgtgggaaatgttgtaatggtcactggaggaaggaacagaggccgagttggagtaatcaagaacagggagaagcataagggaagctttgagacaattcatgttcaagatgccactggccatgagttcgccacccgcctgggcaatgtgttcaccattggaaagggcaccaaaccatgggtttctcttcccaagggcaagggtattaagttgtctatcattgaggaggctaaaaagaggcttgcagcatcccaaaatgctgcatgaagttcatgattttacttggattatgctcccggggttagttatgttattgttttgtttgcacaatttagtgcaaaattttgaagcatatttatttttaacattcatttgaaacttctgggatgtatgtgacagattaggcatgaagttttctgtaccattaaaaatattcattccgaggaatcttactctgcctgtttatgcaaggattttttcctttccctttcctttaattttgtcatgcttcgcgaa

SEQ ID NO: 4275 - DNA, 1146 bp, Papaver somniferum
  misc_feature (239)..(239): n is a, c, g, or t
  misc_feature (322)..(322): n is a, c, g, or t
  misc_feature (449)..(449): n is a, c, g, or t
  misc_feature (1026)..(1026): n is a, c, g, or t
  misc_feature (1029)..(1029): n is a, c, g, or t
  misc_feature (1070)..(1070): n is a, c, g, or t
  misc_feature (1075)..(1075): n is a, c, g, or t
  misc_feature (1077)..(1077): n is a, c, g, or t
  misc_feature (1083)..(1083): n is a, c, g, or t
  misc_feature (1090)..(1090): n is a, c, g, or t
  misc_feature (1092)..(1092): n is a, c, g, or t
  misc_feature (1095)..(1095): n is a, c, g, or t
cagaggcggaagaagaagaagaaaattagggtaaacctaatttacagtcgaagaaatcaatcatggcgaggggattgaagaagcatttgaagaggcttaatgcccccaagcattggatgctcgataaacttggaggcgcatttgctcccaagccatcatcaggtccacacaaatctagggaatgtctacccttgattcttatcctgcgaaacagattgaagtacgctcttacataccgngaggttattgctattttgatgcaaaggcacattcttgttgatgggaaagtccgaacagacaagacctatccatctggattcanggatgttgtatcgattcccaagacgaatgagaacttccgtctcctgtatgacaccaagggtcgcttccgtctccactcaatcaaggatgaagaagctaagttcaagctctgcaaggttagaaatgtncacttcggatctaaaggtatcccatacattaacaccttcgatggtcgcaccatccgttaccctgaccctcttatcaaggctaatgacactatcaagctagatctcgagagtaataagattgttgattttatcaagtttgatattggtaatgtcgtcatggtcactggaggtagaaacagaggccgtgttggtgttatcaagaacagagaaaagcataagggaagtttcgatacccttcacatccaggactctacaggccatgagttcgccacccgtttggccaatgtgttcaccattgggaaaggtaccaagccatgggtttcactccccaagggcaagggtatcaagttgtctatcatcgaagaagcaaggaaaagacttgcagcacaaggagctgcaacagcataagctcattgaaggtttcatgaggatttttggcggcttgtttagttaattgtagcttaagataacaattcctgttttagttcatctctactttgtgaacaaaatttttaagttgactctgtttttgtgtttcagaccaggagaatattttattttgatcttctgagttagnaanaaaactcgaggggggccgtaccatcgcctaagtgagcgatnacatncngccgtntttacangncgngactggggaaacctgcgggttacacaacatatattgcgctgtgagaacaaa

SEQ ID NO: 4276 - DNA, 1038 bp, Raphanus sativus
ggctctcacaaacttcaccgtctctcctggatcagagctacaacactcgcaaactccaaacatggcgagaggtttaaagaagcatctgaagaggctcaatgcccctaagcattggatgcttgacaaacttggcggtgcttttgcccccaagccatcttctggaccacacaagtctagagagtgccttcccctcgttcttatcatcaggaacaggttgaagtatgctcttacctaccgtgaagtcatctccatcttgatgcagaggcatatccaggttgacggcaaagtcaggaccgacaagacctaccccgctggtttcatggatgttgtctctatccccaagactaacgagaacttccgtcttctctatgacaccaagggtcgtttccgtcttcactccatcagggatgaggaagctaagtttaagctttgcaaggtccgaactatccagttgggacaaaagggcattccttacctcaacacatacgacggtcgcaccatccgttaccctgacccgctcatcaagcccaacgacaccatcaagctcgatcttgaggagaacaagattgttgagttcatcaagttcgatgtcggcaacgttgtgatggttaccggaggaaggaacagagggcgtgttggtgtgattaagaaccgtgagaagcataagggaagctttgagacgatccacatccaggactcgactgggcatgagtttgcgacgagattgggtaatgtgttcacccttggcaaaggaacaaagccgtgggtgtctcttcccaagggtaaaggtattaagcttaccatcattgaggaagccaagaagaggcttgctggtcaacaggctgcttgattttgtgatttttccagctcttttattatgtccttttagacgtttttacgttttcgtagactcgctttgcttctttttgttttggaacttgtgttattttctctgtttcaagaattcaacaaaaacttcaaacatcacatgttctttagttttgttttgttttcattgaagttttagtttcttgccga

SEQ ID NO: 4277 - DNA, 973 bp, Raphanus sativus
ggacaaacttcaccgtctggatcagagcttcacttgcaaactccaaacatggcgagaggtttaaagaagcatctgaagaggctcaatgcccctaagcattggatgctcgacaaacttggtggtgcttttgcccccaagccatcttctggaccacacaagtctagagagtgccttcctcttgttcttatcatcaggaacaggttgaagtatgctctaacctaccgtgaagtcatctccatcttgatgcagaggcatatccaggttgacggcaaagtcaggaccgacaagacctaccctgctggtttcatggatgttgtctctatccccaagactaacgagaacttccgtcttctctatgacaccaagggtcgtttccgtcttcactccatcagagatgaggaagctaagtttaagctttgcaaggtccgaactatccagttgggacaaaagggcattccttacctcaacacatacgacggtcgcaccatccgttaccctgacccgctcatcaagcccaacgacaccatcaagctcgatcttgaggagaacaagattgttgagttcatcaagttcgatgtcggcaacgttgtgatggttaccggagggagaaacagagggcgtgttggtgtgatcaagaaccgtgagaagcataagggaagcttcgagacgatccacatccaggactcgacgggacatgagtttgcgacgaggttgggcaatgtgttcacccttggcaaaggaacaaagccgtgggtgtctcttcccaagggtaaaggtattaagcttaccatcattgaggaagccaagaagaggcttgctggtcaacaagctgcttgattttgtgatttttccagctctttgttatgtctttgtagacgtctttatgttttcgtagactcgctttgcttcttttttgttttggaacttgattttgttattttctctgtttcaagaattcaacaaaaacttcaaa

SEQ ID NO: 4278 - DNA, 980 bp, Tripterygium wilfordii
ggtcgcattctagcattgtccttcctaacaaaagctagggttttggcttcctcatcccgcccactcacagccgcagaggcagatacgcgcagtgctgtaggaggtcctcggggagtgatctctgagtgttcaaaatggctagagggttgaagaaacacatgaagaggctcaatgcccctaagcattggatgcttgataaacttggtggcgcttttgcccctaaaccatcatctggaccacataagtcaagggaatgtatgccaatgatccttattctgcgaaacaggctgaagtatgctctcacctatcgtgaagtcattgcgattctgatgcagaggcatgtacttgttgatggaaaggttaggacggacaagacgtaccctactggctttatggatgttgtttcaattcctaaaacaaatgagaatttccgcctcctctatgacacaaagggccgtttccgtcttcactctatcagggacgacgaggcaaagttcaagctttgcaaagttcgttcagtccagtttgggcagaaaggtatcccttatctgaatacctatgatgggcgcactatccgttatccagacccactgatcaaggctaacgatacaatcaaacttgaccttgagagtagcaagattgttgacttcatcaagtttgatgttgggaatgtcgtcatggtcactggaggaaggaacaggggacgtgtgggtgtcatcaaaaacagggaaaagcataaaggtagctttgagaccatccatattcaagatgccaccggtcatgagtttgcaactcgcctgagtaatgtgtttactattggaaaaggaaccaagccatgggtatctcttcctaagggcaagggtatcaagttgactatcattgaggaggcgaagaaaaggcttgcagccgaagctgcagcgtaaatttattgacatgattctggtcatgatctgctcctagaactactgttttttaagctt

SEQ ID NO: 4279 - DNA, 1103 bp, Brassica juncea
cactcgttcagagctaaacgagagaagccgtctggatcggcgctacgcttccgaacttcaaacatggcgagaggtttaaagaagcatctgaagaggctcaatgcccctaagcattggatgcttgacaaacttggcggtgcttttgcccccaagccatcttctggaccacacaagtctagagagtgccttcctcttgttcttatcatcaggaacaggttgaagtacgctcttacctaccgtgaagtcatctccatcttgatgcaaaggcatatccaggttgatggcaaagtcagaaccgacaagacctaccctgctggtttcatggatgttgtctctatccccaagactaatgagaacttccgtcttctctacgacaccaagggtcgtttccgtcttcactccatcagagatgaggaagcaaagtttaagctttgcaaggttcgaactatccagctcggacagaagggcattccttacctgaacacgtacgatggtcgcaccatccgttaccctgacccgctcatcaagcccaacgacaccatcaagctcgacctggaagagaacaaggttgtagaattcatcaagttcgatgtcggcaatgttgtgatggtgactggaggaagaaacagagggcgtgttggtgtgatcaagaaccgtgagaagcataagggaagctttgagaccatccacatccaagactcgacagggcatgagtttgcaacgaggttgggcaatgtgttcacccttggcaaaggaacaaagccgtgggtgtctcttcctaagggtaaaggtattaagctgacaatcattgaggaggccaggaagaggcttgctggtcaacaagctgcttgatttttgtgattttccggctcttttattatgtctttgtagacgtcgtcatgttttcgtagactcgcgactcgctttgcttctttttgttttggaacttggtgttattttctctgtttcaagaattcaacaaaaacttcaaacatcacatgtcctctagttttgttctttcttcattgcagttttgatttattgtcgagtaaacctgtttgaattctattgtcctatatggaattaacggtttcattaccgac

SEQ ID NO: 4280 - DNA, 1159 bp, Secale cereale
cctcattctttgtcatcccggcggcggcgcgtagcacaggagaaggagcaggcggcggcggtacccgaagaggagaagcacggcgacctagcccgagctcgcaaccatggctaggggtttgaagaagcatctgaagaggctcaatgccccgtctcattggatgcttgacaagcttggtggagcttttgcccccaacgacactcatctggtccgtccacaaggaccgacgggaggtgcctcgcctcctgatcctccatcctcgaggaacagactgaaataatgctctcacctaccgtgaagtgcaatctatccttatgcagcgtcatatcatggttgatggaaaggtccgcactgacaagacctaccctgctgggttcatggacatcatttccattcccaagactggtgagaactacaggcttctgtatgacaccaagggccgcttccgccttcactctgtcaaggatgaggatgctaagttcaagctctgcaaggtcaggtctgtccagtttggccagaagggtatcccctacctcaacacctatgatggccgcaccatccgctacccagacccactcatcaaggccaatgacaccatcaagcttgacctggagaccaacaagattgttgacttcatcaagtttgacgtcggcaacgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggcaccaagccgtgggtgagcctccccaagggcaagggtatcaagctcaccatcattgaggagcagaggaagcgcgatgccgctgcccaggctgctgccaaggcctgattctgatgcgttgagtcgttttgctcgtttttaagttttgttggatgtctgttgatttgcgaactcgtggttgctgctagatgtactgtggatgtttaccttattaagtgctatttcgagacctcatctggttatcttaaatgtttgagatccaagtttaggcattatctgataaaatgttatctgttcaaagttgcaagatagaaagttcgacaaaccaaaaaaaaaaaactagaagacta

SEQ ID NO: 4281 - DNA, 1474 bp, Brassica rapa
cttcttttgatatataatcaaagctgagctgccgccgcataggaatcagaagtcgtcgtcgttgtcagctccgaaacacctgcaaacatggcgaggggattgaagaagcatttgaagaggctcaatgcccccaagcactgggatcttgacaaacttggtggtgccttcgctcccaagccgtcttcgggacctcacaagtcgagggagtgtcttcctctcgtcttgatcatcaggaacaagttgaagtacgctttgacgtaccgtgaagtcatctccatcctcatgcaaaggcatatccaagttgatggtaaagtcaggactgacaagacataccctgctggtttcatggatgttgtatcaatccccaagacgaatgagaacttccgtcttctgtatgacaccaagggacgtttccgcctccactccatcagggacgaggaagcaaagttcaagctttgcaaagttaggactatccaggtggggcagaaggggatcccttacctcaacacttacgacggtcgcaccatccgttaccctgacccgctcatcaagccaaacgacaccatcaagctcgaccttgaggagaacaagatcgttgactccatcaagtttgatgtcggtaacgttgtgatggtgacgggagggagaaacagagggcgtgtgggtgtgatcaagaaccgtgagaagcataagggaagctttgagacgatccacatccaagactcgacgggacacgagtttgctacgaggttgggcaatgtgttcaccctcgggaaaggtacaaagccatgggtgtctcttccaaagggtaaaggtattaagctgaccatcattgaggaagccaggaagaggctttctgcccagcaagctgcttaaaagttgaatcatcgaagactgtgtttcgtttctcttttgtcataaactctagcttcttacttcagttttgagcttttgttctttcatgttgctttctcgcaaaaccccattttgaaacatctgaaaattccagtagaacgttttgtaatgtctgcgtctttgtcttgaaatttttaataatttactcgttaaaatcaactaggcgttaaagacatattatgtgctcagacatatataagcaaagcatcacagtttagcttctatggttccttatcagattatttctcatatatcagcaaagcagaacagtttagcttctatgcttccttatcagattatttgttttatttgttctttgctcgatttttttaaacacccaattcagataaacatatacacaatcgaaacgacaagtgtaactctacgaaaaagcaaagtaaaaattggtcttaaagctcaaaaccatgaatgaagaataaggcgtgttaagagctctctctatcgtattgactagtctcctccgcagcctttgtccacacactggcaatcttctctgcatatccaacctgcaccatccaaaataccaacaactctgttt

SEQ ID NO: 4282 - DNA, 1101 bp, Fagus grandifolia
ctggaccttggctgtcactcagttagctcttttttgcaggtgtagccgagtgaagaccagctccaacgtcggcgctgagatctacgataccacaactccaaaatggctaggggtttgaagaaacatttgaagaggcttaatgcgccgaagcattggatgcttgacaaacttgggggtgcatttgctcccaagccgtcatctgggccacacaaatcaagggagtgcttgcccttgatccttatcctgcggaacaggttgaagtatgcactcacttaccaagaggtcgtttccattctaatgcagcgacatgttttggttgatgggaaggttaggactgataagacctacccttcaggtttcatggatgttgtgtcaattcccaaaacaaccgagaacttccgtctcctttatgataccaagggtcggttccgtctccactcaattagggacgaagaggcaaagttcaagctctgcaaggtccggtctgtgcagtttgggcagaaaggaatcccctatctcaacacctatgacgggcgaactatccgctaccctgacccaattatcaaagctaatgacacgatcaagctggacttagagatcaacaagatcactgatttcattaaatttgatgttgggaatgttgtcatggtgactggtggaaggaatagaggtcgtgttggaatcattaagagcagggagaagcataagggaagctttgagactgttcacatccaggatgcccttggtcatgagtttgcgacccgtcttggaaatgttttcactgttggcaagggctcaaagccatgggtctctctccccaagggcaagggtataaagttgtcaatcattgaagaggcaaggaagaggcttcaaggccaacagattaatgctgcttaaatatagttttagaagattacttaggtgaaatttagttttgcaactttgacccttctgtgaggtcatgcttcgtatttgtgttttattatgatttgcggtacttgtttttggataagagtttttggacaatcttatgagttgcaatctttgtgtttaattctgttttgcactacaatgagaaatatcagactagtttgaataaac

SEQ ID NO: 4283 - DNA, 1105 bp, Allium cepa
ttcctattcgttggtgccgccattctagtcagtccctcagcagacgcaagaagaggagactctccaactcaggacagaacaagatggctagaggattgaagaagcatatgaagaggctaaatgccccaaggcattggatgcttaacaagcttggtggtgctttcgctcccaaaccatcatctggaccgcataaatcaagagagtgcctgccattgatcctcattttgaggaacaagttgaagtatgctcttacctaccgtgaagttattgctattttgatgcaaaggcatgtaatggtcgataacaaggtcaggacagacaaaacctatcctgctggtttcatggatgttgtgtccattcccaagacaaatgagaacttccgtctgttgtatgataccaaaggtcgcttccgtttgcacaccattagagatgatgaggcaaagtttaagctgtgcaaggttcgctcagtccaatttgggaagaaggccataccgttcctaaacacatacgatggtcgaaccatcaggtacccagacccactaatccgtgcaaacgacaccatcaagctcgaccttgaaaccaacaaaatcgtggacttcatcaagtttgatgtcgggaatgtcgtcatggtcactggtggcaggaacacaggccgtgttgggatcatcaagaacagagaaaagcataagggaacgtttgagaccatccacgttcaagatgctactggtcacgagtttgcaacacgtcttggaaatgtgtttacgatcggtaaaggaaccaagccatgggtgaccttgcctaagggtaagggtatcaagctcagtattattgaggaggcaaggaagcgcactgccgccgccgccgctaaagctactgcttagtaagttggtgtttttatttttatgtttagtggggaagtgctttgaattttgcgttctgttatgacattaccaagtagcttctgttttctgtttgtctccgttatctttgattttgtagtgagacaataatgttgcttgactgtttatttgctaagtttatgtgttactgaaaattttatgacatttgtccatctgtacgaattacatttccctctttctccttg

SEQ ID NO: 4284 - DNA, 1326 bp, Papaver somniferum
aaactgaagaagaaaagcagcgtttagcctttgatcagtccgaggcgaattaactcaaaatggcaagagggttgaagaagcatttgaagaggctcaatgcgcctaagcattggatgcttgacaagcttggtggtgcctttgctccaaaaccatcatctggtccacacaaatctagggagtgtttaccattgatccttattttgcgtaataggttgaagtatgctctcacataccgtgaggttattgctatcttgatgcaaaggcatattcttgttgatggaaaggtcaggactgacaagacatacccttctgggttcatggatgtcgtgtcaattcccaagacaaatgagaacttccgtctcctttatgacaccaagggtcgtttcagactccactcaatcaaggatgaagaggccaagttcaagctttgcaaggtccgtaatgtgcattttggatcaaagggtatcccatacatcaacacatttgatggtcgcactatccgctacccagatcccctgatcaaggctaacgacaccatcaagcttgatcttgagagcaacaagattgtcgatttcatcaaatttgacattggtaacgttgtcatggttactggaggaagaaacagaggccgtgttggtgtcattaagaacagagaaaagcataagggaagttttgatacccttcacatccaggatagcaccggtcatgaatttgccacccgtttggcaaatgtcttcaccattggtaaggggacaaagccttgggtgactctccccaagggcaagggtatcaagttaaccatcatcgaagaggcaaggaagcgtcttgcagcacaaggagccgctactgcttgagttttactatgatgataaaattctgataggtttcagagatagtttgttaaagaatttctttggattgctctcttttctcattttgaagtatttctccaatgttagcttaagaacttgtgttttgttttcattagttggcactgtatagaactagattttgtacctctgctatattcagtttagacctttactgtcaccttacccaattgttgcaataactggttcagtgagatgccagatattcatatggtcaactgttagctagatctagtttgatggtccactggaatatcgcagaatttgaaaattctgtgtacttccagttgtgcatttgcattatgcttccagttggtgtatacagttgatggcctgatggcctaacagtatagcgagaagctgggtattgatatgaatggtagcttgaaccagttgttggtctctggaataggtgcagaattagtctacattcttt

SEQ ID NO: 4285 - DNA, 943 bp, Helianthus annuus
tccatcgtatatttccaccggagactccgatctcctactgcagccatggctagaggtttgaagaaacatatgaagaggctcaatgctcctaagcattggatgcttgataaacttggtggcgcttttgctcctaagccatcatctggacctcataaatcaagggaatgcttgcccttgatcctcatcttgaggaacaggttgaagtatgctttgacttaccgtgaggttcaatctattttgatgcaacgacatgtgcttgttgataacaaggtcaggactgacaagacttaccctgcgggtttcatggatgtcgtctcaattccgaagaccaatgaaagtttccgacttctatatgatacaaagggcaggttcaggcttcactccatcagggacgaggaatcaaagttcaagttgtgcaaagttaggtctgttcaatttggttcaaaggggattccatacatcaacacttatgacggccggacaattcgctacccagatccactcatcaaagctaacgacaccatcaaactcgacttggagtcgaacaagatcgttgatttcatcaagtttgatgtcgggaatgttgtcatggtgacaggtggacgcaacactggtcgtgttggaatccttaaaaacagagaaaaacataagggcagctttgagacggtacacattcaagatgccactgggcacgagtttgccacccgtttgggaaatgtgttcactcttggaaaaggttcaaagccttgggtatcactccccaagggtaagggtatcaagttgacaatcattgaggaggctaggaaaaggcaggctgcacaagctgccactgcataggtggtttgattttgtattgattgtgttctacgagagttatgtgttaatttgcgtacaattttcaattttgagaccttggatatgcattttaaagttggtttgatta

SEQ ID NO: 4286 - DNA, 1160 bp, Brassica juncea
gctctcgcaaacttcaccactcgttcagagctaaaacgagagaagccgtctggatcggcgctacgcttccgaacttcaaacatggcgagaggtttaaagaagcatctgaagaggctcaatgcccctaagcattggatgcttgacaaacttggcggtgcttttgcccccaagccatcttctggaccacacaagtctagagagtgccttcccctcgttcttatcatcaggaacaggttgaagtatgctcttacctaccgtgaagtcatctccatcttgatgcaaaggcatatccaggttgatggcaaagtcaggaccgacaagacctaccctgctggtttcatggatgttgtctctatccccaagactaacgagaacttccgtcttctctacgataccaagggacgtttccgtcttcactccatcagggacgaggaagccaagtttaagctgtgcaaagtccgaactatccagctcggacagaagggcattccttacctgaacacgtacgatggtcgcaccatccgttaccctgacccactcatcaagcctaacgacaccatcaagctcgacctggaggagaacaaagttgtggaattcatcaagtttgatgtcggcaatgttgtgatggtgactggaggaagaaacagagggcgtgttggtgttatcaagaaccgtgagaagcataagggaagctttgagacaatccacatccaagactctacaggacatgagtttgcaacacgtttgggaaatgtcttcaccctcggcaaaggaactaagccctgggtttctcttcctaagggtaaaggtattaagctcaccatcatcgaggaagccaggaagaggctctctggccaacaagctgcttaagttttcgactttcagctctctatcatgtcgttttagatgacttttgtttccttagactcactttgcatcttttggcttgctactcagttttggaacttatgtttttttatctatttcaagagttttaaaatatgatctagtacaacgcaagaaccacagagatgtggttactgtccaaatcctgacatgttacgaagtaccagcccatacaagttcactattggccatttgcatcttttggtttgctactcggtttagaaacttatgttattttatctgttttaagagtt

SEQ ID NO: 4287 - DNA, 885 bp, Ambrosia trifida
ttctaccggagactctgatctcctacaaccagctctgcaaccatggctagaggtttgaagaagcatatgaagaggctcaatgctcctaagcattggatgcttgataaacttggtggtgcctttgctcctaagccgtcatctggaccacataaatcaagggaatgcttgcccctgatcctcattttgaggaacaggttgaagtatgctttgacttaccgtgaggttcagtctattttgatgcaacgtcatgtacttgttgataacaaggtcaggactgacaagacttaccctgctggtttcatggatgtggtctcaatcccaaagactaatgaaagcttccgacttttgtatgatacaaagggcaggttcaggctacactccattagggatgaggagtcaaagttcaagttgtgcaaggttcgttcagtccaatttggttcaaaggggattccatacatcaacacttatgatggccgtaccatccgttacccagacccgctcatcaaagccaacgacaccatcaaactcgacttggagtctaacaagatcgttgatttcatcaagtttgatgttgggaatgtggtcatggtgacaggtggacgtaacacaggccgtgttgggattcttaaaaacagggaaaaacataagggcagctttgagactgttcacattcaagatgcgactgggcatgagtttgctacccgtttgggaaacgtgttcactctcggaaaaggttcaaagccgtgggtatcccttcctaagggtaagggtatcaagttgaccatcattgaggaggctaggaaaaggcaggctgcacaagctgctactgcataggtttgattttgtattgcagcttttctacaatcatgttttaggggagttatg

SEQ ID NO: 4288 - DNA, 1097 bp, Arabidopsis lyrata
agccgcagtggaatcagagcagctgcaaacatggcaagaggattgaagaagcatctaaagaggatcaatgctcctaagcattggatgcttgacaaacttggtggtgccttcgctcccaaaccatcttctggacctcacaagtcgagggagtgtcttcctcttgtcctgatcatcaggaacaggttgaagtatgctttgacttaccgtgaagttatctctatcttgatgcaaaggcatatccaagttgatggcaaagttaggactgacaagacttaccctgctggcttcatggatgttgtatcgatccccaagaccaatgagaacttccgtcttctctacgacaccaagggacgtttccgtctccactccatcaaggatgaggaagcaaagttcaagctttgcaaagttagatctatccagtttggtcagaagggaattcctttcttgaacacttatgatggtcgcaccatccgttaccctgacccgctcatcaagccaaacgacaccgtcaagctggaccttgaggagaacaagattgttgagttcatcaagtttgacgtgggtaatgttgtgatggtgactggaggccgaaacagagggcgtgtgggtgtgatcaagaaccgggaaaagcataagggaagctttgagacgatacacattcaagactcaacaggacatgagtttgccacaaggttgggtaatgtgttcaccatcgggaaaggaacaaagccatggatgtctcttccaaagggcaaaggtattaagctgaccatcattgaggaagccaggaagagacttgcttcccaacaagctgcttaaaactccaactgctttgaatcatcaaaaccgtttcgattttactctgtaatagactcgctgcttgtctcagtttgtgagcctatttcttttcttatgttgttggcttccaaaacccatcaaaaaaatagctgagtagagcgttttgtaatgtttgtatggtggatttttttggtgatttaccgtttaaatcagatgacagttgcttagtccactcctttgcttagtctcctcctttgctttgcgcttttagttgttgagagatgagaaatagatattat

SEQ ID NO: 4289 - DNA, 933 bp, Brassica juncea
tggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaagtcatctccatcttgatgcaaaggcacatccaggttgatggcaaagtcaggactgacaagacctaccctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgttggtgtgattaagaaccgtgagaagcataagggaagctttgagacaatccacatccaagactctacaggacatgagtttgcgacaaggttgggtaatgtgttcacccttggcaaaggaacaaagccgtgggtgtctcttcccaagggtaaaggtattaagcttaccatcattgaggaggccaagaagaggcttgctggtcaacaagctgcttgattttgtgattctccagctcgttactatgtcttcttagacgtcatatgttttcgtagactcgctttgcttctttttgttttggaacttgtgttattttctctgtttcaaggattcaacaaaaacttcaacatcacttgcccttttc

SEQ ID NO: 4290 - DNA, 815 bp, Brassica juncea
agtcgtcgtgctcgcaacaaaaatggcaagaggattgaagaagcatctgaagaggctcaatgcccccaagcattgggatcttgacaaacttggtggtgccttcgctcccaagccctcttccggaccccacaagtctagagaatgccttcctctcgtcctgatcatcaggaacaagttgaagtacgctttgacataccgtgaagtcatctccatcctcatgcaaaggcatatccaagtcgatggaaaggtcaggactgacaagacttaccctgctggcttcatggatgttgtctccatccccaagacgaatgagaacttccgtcttctgtatgacaccaagggacgtttccgtctccactccatcagggatgaggaagcaaagttcaagctttgcaaggttaggactattcagttagggcaaaagggaatcccttacctcaacacttacgatggtcgcaccatccgttaccccgacccgctcatcaaaccaaacgacaccatcaagcttgaccttgaggagaacaagatcgtggagttcatcaagttcgacgttggtaacgttgtgatggtgacaggaggtagaaacagaggtcgtgttggtgtgattaagaaccgtgagaagcataagggaagctttgagacgatccacatccaagactcaacgggacacgagtttgcaacgaggttgggcaatgtgtttactctcgggaaaggaacaaagccgtgggtgtctcttcctaagggtaaaggtattaagctcaccatcattgaggaagctaggaagaggctttctgctcaacaagctgcttaaaagt

SEQ ID NO: 4291 - DNA, 850 bp, Brassica juncea
ctgccgccgcataggaatcagaagtcgtcgtcgttgtcagctccgaaacacctgcaaacatggcgaggggattgaagaagcatttgaagaggctcaatgcccccaagcattgggatcttgacaaacttggtggtgccttcgctcccaagccctcttccggaccccacaagtctagagaatgccttcctctcgtcctgatcatcaggaacaagttgaagtacgctttgacataccgtgaagtcatctccatcctcatgcaaaggcatatccaagtcgatggaaaggtcaggactgacaagacttaccctgctggcttcatggatgttgtctccatccccaagacgaatgagaacttccgtcttctgtatgacaccaagggacgtttccgtctccactccatcagggatgaggaagcaaagttcaagctttgcaaggttaggactattcagttagggcaaaagggaatcccttacctcaacacttacgatggtcgcaccatccgttaccccgacccgctcatcaaaccaaacgacaccatcaagcttgaccttgaggagaacaagatcgtggagttcatcaagttcgacgttggtaacgttgtgatggtgacaggaggtagaaacagaggtcgtgttggtgtgattaagaaccgtgagaagcataagggaagctttgagacgatccacatccaagactcaacgggacacgagtttgcaacgaggttgggcaatgtgtttactctcgggaaaggaacaaagccgtgggtgtctcttccaaagggtaaaggtattaagcttaccatcattgaggaagctaggaagaggctttctgctcaacaagctgcttaaaa

SEQ ID NO: 4292 - DNA, 1055 bp, Brassica rapa
gataatcaaagctgagctgccgccgcataggaatcagaagtcgtcgtcgttgtcagctccgaaacacctgcaaacatggcgaggggattgaagaagcatttgaagaggctcaatgcccccaagcactgggatcttgacaaacttggtggtgccttcgctcccaagccgtcttcgggacctcacaagtcgagggagtgtcttcctctcgtcttgatcatcaggaacaagttgaagtacgctttgacgtaccgtgaagtcatctccatcctcatgcaaaggcatatccaagttgatggtaaagtcaggactgacaagacataccctgctggtttcatggatgttgtatcgatcccaaagacgaatgagaacttccgtcttctgtatgacaccaagggacgtttccgcctccactccatcagggacgaggaagcaaagttcaagctttgcaaagttaggactatccaggtggggcagaaggggatcccttacctcaacacttacgacggtcgcaccatccgttaccctgacccactcatcaagccaaacgacaccatcaagctcgaccttgaggagaacaagatcgttgactccatcaagtttgatgtcggtaacgttgtgatggtgacgggagggagaaacagagggcgtgtgggtgtgatcaagaaccgtgagaagcataagggaagctttgagacgatccacatccaagactcgacgggacacgagtttgctacgaggttgggcaatgtgttcaccctcgggaaaggtacaaagccatgggtgtctcttccaaagggtaaaggtattaagctgaccatcattgaggaagccaggaagaggctttctgcccagcaagctgcttaaaagttgaatcatcgaagactgtgtttcgtttctcttttgtcataaactctagcttcttacttcagttttgagcttttgttctttcatgttgctttctcgcaaaaccccattttgaaacatctgaaaattccagtagaacgttttgtaatgtctgcgtctttgtcttaattttttaaaataatttactcgtg

SEQ ID NO: 4293 - DNA, 985 bp, Brassica napus
gtcgtcgtcagctccgaaacacctgcaaacatggcgaggggattgaagaagcatttgaagaggctcaatgcccccaagcactgggatcttgacaaacttggtggtgccttcgctcccaagccgtcttctggacctcacaagtcgagggagtgtcttcctctcgtcttgatcataaggaacaagttgaagtacgctttgacgtaccgtgaagtcatctccatccttatgcaaaggcatatccaagttgatggtaaagtcaggactgacaagacataccctgctggtttcatggatgttgtatcgattcccaagacgaatgagaacttccgtcttctgtatgacaccaagggacgtttccgcctccactccatcagggacgaggaagcaaagttcaagctttgcaaggttaggactatccaggtggggcagaagggaatcccttacctcaacacttacgacggtcgcaccatccgttaccctgacccactcatcaagccaaacgacaccatcaagctcgaccttgaggagaacaagatcgttgactccatcaagtttgatgtcggtaacgttgtgatggtgacgggagggagaaacagagggcgtgtgggtgtgatcaagaaccgtgagaagcataagggaagctttgagacgatccacatccaagactcgacgggacacgagtttgccactaggttgggcaatgtgttcaccctcggcaaaggtacaaagccatgggtgtctcttccaaagggcaaaggtattaagctgaccatcattgaggaagccaggaagaggctttctgcccagcaagctgcttaaaagttgaatcttcatccaagactgtttcgtttctcttgtcataaactctagcttctcatctcagttttgagcttttgttcctttcatgttgctttctcgcaaatccccattttgaaacatctgaaaattccagtagaacgttttgtaatgtctgcgtctttgtctt

SEQ ID NO: 4294 - DNA, 1073 bp, Brassica napus
cgtcgtcgtccgctccgaaacaactgcgaacatggcaaggggattgaagaagcatttgaagaggctcaatgctcccaagcattgggatcttgacaaacttggtggtgccttcgctcccaagccctcttctggacctcacaagtctagagagtgccttcctctcgtcctgatcatcaggaacaagttgaagtacgctttgacataccgtgaggtcatctccatccttatgcaaaggcatatccaagtcgatggaaaagtcaggactgacaagacttaccctgctggcttcatggatgttgtttccatccccaagacgaatgagaacttccgtcttctgtatgacaccaaaggacgtttccgtctccactccctcagagatgaggaagcaaagttcaagctatgcaaggttaggaccatccagtttggacaaaagggaatcccttacctcaacacatacgacggtcgcaccatccgttaccccgacccgctcatcaaacccaacgacaccatcaagctagacctcgaggagaacaagattgtggagttcatcaagtttgacgttggtaacgttgtgatggtgactggtggcaggaacagagggcgtgttggtgtgattaagaaccgtgagaagcataagggaagctttgagacgattcacattcaagactctacggggcatgagtttgccacgaggttgggcaatgtgttcactctggggaaaggaacaaagccgtgggtgtctcttccaaagggtaaaggtattaagctgactattattgaggaagctaggaagaggctttctgctcaacaagctgcttaaaagttgaatcatccaagaccgtttgctaccttcttgcttcagttttgagcttttttctgttgcatgtttcttgcttgcaaaaccccataagaaagaaaaaacagctgagcattttagagcgttttgtaatatttgtattgattttaaaaaagtaatttactcttcaaaatcattcacttgtgatgtactcgcaaaatgatgctgcaatgtcaatggatctggggaaaataattctcagttttcaaatttaagc

SEQ ID NO: 4295 - DNA, 1080 bp, Brassica napus
gagaggaagaagtcgtcgtcgtccgctccgaaacaactgcgaacatggcaaggggattgaagaagcatttgaagaggctcaatgctcccaagcattgggatcttgacaaacttggtggtgccttcgctcccaagccctcttctggacctcacaagtctagggagtgcctccctctcgtcctgatcatcaggaacaagttgaagtacgctttgacataccgtgaggtcatctccatcctcatgcaaaggcatatccaagtcgatggaaaagtcaggactgacaagacttaccctgctggcttcatggatgttgtttccatcccaaagacgaatgagaacttccgtcttctgtatgacaccaagggacgtttccgtctccactccattagggacgaggaagccaagttcaagctatgcaaggttaggaccatccagttcggacaaaagggaatcccttacctcaacacatacgacggtcgcaccatccgttaccccgacccgctcatcaaacccaatgacaccatcaagctcgacctcgaggagaacaagattgttgagttcatcaagtttgacgtcggtaacgttgtgatggtgactggtggcaggaacagagggcgtgttggtgtgattaagaaccgtgagaagcataagggaagctttgagacgattcatattcaagactctacgggacatgagtttgccacgaggttgggcaatgtgtttactctggggaaaggaacaaagccgtgggtgtctcttccaaagggtaaaggtattaagctgactatcattgaggaagcctggaagaggctttctgcccaacaagctgcttaaatgttgaatcatccaagaccgtttgttaccttcttgcttcagttttgagcttattcctaattcatgtttcttgcttgcaaaaccccataagaaaaaaaaacagctgagcattttagagcgttttgtattatttgtacggactttttaaagtaatttactcttcaaaatcatttacttgtgatatactattacaagtaaaatgctgctgcaatgttaataatcatttacttgtgatatactattacaa

SEQ ID NO: 4296 - DNA, 1019 bp, Taraxacum officinale
cttcggcgggggatcatcaaggagggtgtgcggctgcgagtgaggaggagaggcgcagtttaaccggacgagacaaccggagatctcaaagtcatcacaacaacgtaaccatggctaggggtttgaagaagcatatgaagaggctcaatgccccaaaacattggatgcttgataaactcggcggtgcttttgctcccaaaccttcatcaggaccacacaaatcaagggaatgcctgcccttgatcctcatcctccgtaacaggttgaaatatgctttgacctaccgtgaggtccaatctatcctgatgcaaaggcatgtcctcgtggacaacaaagtcaggactgacaaaacctaccccgctggtttcatggatgttgtttccatccccaaaaccaatgagaacttccgtcttctttatgacaccaaaggtagattcaggctacactctgtcagggatgaagaatcaaagttcaagctttgcaaggttaggtcagtccaatttgggcaaaagggaatcccatacatcaacacctatgatggaaggacaatccgttaccctgaccctctaatcaaagccaatgacaccatcaagctcgatttggaatccaacaagattgttgatttcatcaagtttgatgtgggaaatgttgtgatggtgacaggaggaaggaacacagggcgagttgggatcttgaagaacagggaaaagcataagggaagctttgagactgttcacattcaggactcaacaggtcatgagtttgctacccgtttgggaaatgtgtttacagttggaaagggttcaaagccatgggtgtctttgcctaaaggaaagggtattaagttgactatcattgaagaggctaggaagaggcaggctgctttagctgctactgcttaggtccttatttgggtttcatagtttgttatgttataattcatgaaaaatgttttttttttattatatgcatttggtacaatttttgatggataattttgttggattttgctaaatgtt

SEQ ID NO: 4297 - DNA, 909 bp, Flaveria ramosissima
agctccgccgcagctccgccgtacaacgccaccggagacaccgatctctaactccacactgcagccatggctcgaggcttgaagaaacatttgaagaggcttaatgcacctaagcattggatgcttgataaacttggtggtgcttttgctcctaagccatcatctggacctcacaagtctagggaatgtttgcctttgatcctcattttgaggaataggttgaagtatgctttgacataccgtgaggttcagtcgattttgatgcaacgtcatgtgcttgttgacaacaaggtcaggactgacaagacttatcctgctggtttcatggatgtcgtctcaattcccaagaccaatgaaaacttccgacttctatatgatacaaagggcaggttcaggctccactccatcagagatgaggaagcaaagttcaagttgtgcaaagtccgctctgtccaatttggctcaaaagggattccttacatcaacacctatgatggccgaaccattcgttaccctgatcccctcatcaaagctaatgacactatcaaacttgacttggactcaaacaagattgttgatttcatcaagtttgatgttggtaatgttgtcatggtgactggtggacgaaacaggggccgtgttggaatccttaagaacagggaaaagcataagggaagctttgagacagttcacattcaggatgctactgggcatgaatttgctactcgtttgggaaatgtctttactcttggtaagggttcaaagccttgggtgtctctccccaagggcaagggtatcaagttgagcatcatcgaagaggctaggaagaggcaagctgctgctgcaacagttgcttagttatgccttgcaagcatgatcgttgcttgattgctggttggtcatgttaaa

SEQ ID NO: 4298 - DNA, 1210 bp, Flaveria ramosissima
gtcgccataacagagacctccgccgcagctctgccgtacaacgccaccggagacaccgatctctaactccacactgcagccatggctagaggattgaagaaacatttgaagaggcttaatgcccctaagcattggatgcttgataaacttggtggtgcttttgctcctaagccatcatctggacctcacaagtctagggaatgtttgcctttgatcctcattttgaggaataggttgaagtatgctttgacataccgtgaggttcagtccattttgatgcaacgtcatgtgcttgttgacaacaaggtcaggacagacaagacctaccctgctggttttatggatgtcgtctcaattcccaaaaccaatgaaaacttccgacttctatatgataccaagggcaggtttaggctccactccatcagagatgaggaatcaaagttcaagttgtgcaaagtccgctcagtccaatttggttcaaaagggattccttacatcaacacctatgatggtcgaaccattcgctaccctgatcccctcatcaaagctaatgacaccatcaaacttgacttggactcaaacaagattgttgatttcatcaagtttgatgttgggaatgttgtcatggtgactggtggacgcaacaggggccgtgttggaatccttaagaacagggaaaagcataagggaagctttgagacagttcacattcaggatgctactgggcatgaatttgctactcgtttgggaaatgtctttactcttggtaagggttcaaagccttgggtgtctctccccaagggcaagggtatcaagttgagcatcattgaagaggctaggaagaggcaagctgctgctgcagcggttgcttagttatgccttacaagcatgatcgttgcttgattgctggttggtcatgttaaatttatattatgagacttgttttagaggagataagttttatttttggtacaattttgcatctgcatgttaaggttagtatgatttaatatttgcagactgtttgctgatttatcctggtttctaatgttgacttttgattcgtgaatttgctgaaggctatttgaaactttattaataaccaaaaaaaaaaaaaacaaaaaaaaagtaaactactagtacttgtaatacctactagtcttacttcgagactacgacgaacggacacgacaaggggagagggaccccc

SEQ ID NO: 4299 - DNA, 1052 bp, Flaveria ramosissima
cgcagctctgccgtacaactccaccggagataccgatctctaactccacactgcagccatggctagaggcttgaagaaacatctgaagaggcttaatgctcctaagcattggatgcttgataaacttggtggtgcttttgctcctaagccattatctggacctcacaagtctagggaatgtttgcctttgatcctcattttgaggaataggttgaagtatgctttgacataccgtgaggttcaatcgattttgatgcaacgtcatgtgcttgttgacaacaaggtcaggactgacaagacctaccctgctggttttatggatgtcgtctcaattcccaagaccaatgaaaacttccgactgctatatgatacaaagggcaggttcaggctgcactcaatcagagacgaggaagcaaagttcaagttatgcaaagttcgctcggtccaatttggttcaaaagggatcccttacatcaacacctatgatggtcgaaccattcgctaccctgatcccctcatcaaagctaatgacaccatcaaacttgacttggactcaaacaagattgttgatttcatcaagtttgatgttgggaatgttgtcatggtgactggtggacgcaacaggggccgtgttggaatccttaagaacagggaaaaacataagggaagctttgagacggttcacattcaggatgctactgggcatgagtttgctactcgcttgggaaatgtcttcactctcggaaagggctcaaagccttgggtgtctctccccaagggtaagggtatcaagttgagcatcatcgaggaggcgaggaagaggcaagctgctgctgcagcggttgcttaattatgtcttacaagcatgatctttgcttgcttgctggttggttttgttaaatttatattatggcacttgttttagaggagatatgttttatttttggtacaattttgcatctgcatgttaaggttagtatgatttaaaaaattgcagactgtttgctgcaaaaaatacttaacatctagatatcgtcttaaatacactcgtt

SEQ ID NO: 4300 - DNA, 1034 bp, Gerbera hybrid cultivar
gccagaggtttcgaacaacgcaaccatggctagaggtttgaagaaacatttgaagaggctcaatgcgcctaaacattggatgcttgataaacttgggggtgctttcgctcctaagccttcatcgggaccccacaaatccagggaatgcttgcccttgatcctgattctgcgaaataggttgaaatatgctttgacgtaccgtgaggtcatatctattttgatgcaaaggcatgttcttgttgacaacaaggtcaggaccgacaagacataccctgctggttttatggatgttgtttctattcccaagaccaatgaaaactttcgtctactttatgatacaaaaggtagattcaggctgcactccatcagggatgaggagtcaaagttcaagttgtgcaaggttcgatccgtccagtttggtcaaaagggcattccttacataaacacatacgacggtaggaccatccgctacccagaccctctaatcaaggctaacgacaccattaaacttcatttagattctaacaagattgttgatttcatcaagttcgacgtgggaaacgttgtgatggtgaccggtggaagaaacaggggccgtgtcggagtccttaagaacagggaaaaacataagggcagctttgaaacggtacacattcaggatgcaaccggtcacgagtttgctactcgtttgggtaatgtttttaccctaggaaaaggtaccaagccttgggtgtccctccccaagggaaagggtattaagttgactataatcgaggaggctagaaagaggcaagctgccctaacggctactgcttagtatcgttaattgtagggtttgttcttgagaggatatgtttgtgttttgaacggttaattaggctctgaaatggtaaacttttgttaaattgatttgtttgtgttttgaatggttaattaggctctgaaatggtgaacttttgttaaattgattgataatactttgtttgttatatgccatttacgatcctggttttagaacaaaaaaaaaaaaaaaa

SEQ ID NO: 4301 - DNA, 1148 bp, Mesembryanthemum crystallinum
  misc_feature (11)..(11): n is a, c, g, or t
  misc_feature (19)..(19): n is a, c, g, or t
  misc_feature (23)..(23): n is a, c, g, or t
tcgttctctcnaagtagtncacntcgagtcccttgaccccgctgagacgcaatcgtcacgcgctgagcctctctagcattcttctaccaacgaaggagcagaaactcatctcctcctttctctctctcatccaaccttccaaccatggctagaggtttgaagaagcacttgaagaggctcaatgctcccaagcattggatgcttgacaagcttggtggtgcatttgcccccaagccatcatctgggccacacaaatcgagggagtgcttgccccttattctgattctgcgtaacaggttgaagtatgctttggtttaccgtgaagtcattgccattctgatgcaacgtcatgttttggttgatggcaaggtcaggactgacaagacataccctactggtttcatggatgtcatatcaatccccaaaaccaacgaaagctttcgtcttctttatgatgtgaagggccgattcaggctgcattcactcagggatgaggaggcaaagtttaaattgtgcaaggttcgtaacgttcagtttggtagcaagggaattccatacatcaacacctatgatggaaggaccattcgttacccagaccctcttatcaaggccaatgacactatcaagctagacttagaggagaacaagattgttgacttcatcaagtttgatgtcgggaatgtcgtcatggttactggtgggagaaacaggggacgtgttggagtcctcaagaacagggaaaaacataagggaagctttgagaccattcacattcaggattcacaaggtcacgagtttgctacccgtatggcaaatgtgttcatcatcggtaagggtacaaaaccgtgggtgtctcttcccaagggcaagggtatcaagttgactgtgatcgaggaggcacgcaagagacaggcagagaaagctgctactgcttgatcacttgctgttttgaaatggcatcccctggtgtggggttttaattagggctgtagtttggtgctgttgagattttgaagtttaaaagttgtcacccccttcgatttttgtagcttataattaaggaacggttgaaccatagaagctgctggtaagcttttgtttgttggatttctttgcttggaacatgcatgatgaattgctgttttaat

SEQ ID NO: 4302 - DNA, 1142 bp, Lotus japonicus
gaactgcaaccctaacagccgtaagcgtttctctgtttctgaactccaaaatggcgagagggttgaagaagcatttgaagaggctcaatgcgccgaagcattggatgcttgacaaactgggtggtgcttttgctcctaaaccctcatctggaccacataagtcgagggagtgtctcccactcatcctgatcttgcgaaacaggctgaagtatgctctgacttaccgtgaggttatcgctattctgatgcagcgtcatatccttgttgatggcaaagtcaggactgacaagacttacccctctggtttcatggatgttgtctcaatcccaaaaaccaatgagaacttccgcctgctttatgacactaagggccgattccgtctccactcagtcagggatgatgaggctaagtttaagctatgcaaggtgaggtctgtgcagtttggacaaaagggtatcccatacctgaacacctatgatggccgcaccatccgctacccggacccagtcatcagggcaaatgacaccatcaagctggatcttcaggagaacaagattgttgatttcatcaagtttgacgttgggaatgttgtcatggtcactggtggaaggaacagaggcagagttggagtgatcaagagcagggacaggcagaagggaagctttgacacaatccatgttcaggatgcaaccggtcatgagtttgctacccgtctgggcaatgtgttcaccattggcaaggggagcaaaccatggatatctcttcccaagggtaagggtattaagctatcaatcattgaggaagctaggaagaggattgctgcccaacaagcaactgctgcttgaatctttgtttaatggggtattcaatagacttgagtgcttggtagttatattcagttttttggattgtcctttgttttgtctcaagattttctgttaaattttgacttttgaaccatacaacttttattctcatgccatgaaggaatctttccattatctagtttatatttcgtttctagtctgcttggtagcaagttccacccttgctcgtgaaatgggattgttctgcaaatgagtaatggttgtttagtacctagtattttctatcaaaaaggtatagtctgaatgatcttttgc

SEQ ID NO: 4303 - DNA, 1168 bp, Mimulus guttatus
tcgtttctagggttttatatttcctccgcagctcgaacacactagtgagagagagagaggtgagggagagagagagagtgagaggcgccgcccgtagatctgcacatcatttaacaacatggcgagaggtttgaagaagcacttgaagaggctcaatgcacccaagcattggatgttggacaagcttggtggtgcttttgcccccaaaccatcgtccgggcctcacaaatccagggagtgcttgccattgattctgattctccgaaacagactcaagtatgccctaacttaccgtgaggtcattgctatccttatgcaacgccacattctcgttgatggcaaagtcaggaccgacaagacctatccttctggtttcatggatgttgtctctattccaaaaaccaacgagaacttccgtcttctgtacgataccaagggcagatttaggctgcactccatcagggatgaggaagctaagttcaagctgtgcaaagtccgttcgattcagttcggaaagaagggcattccgtacctgaacacctacgatggaaggaccatccgctacccagacccactcatcaaggcaaacgacaccatcaagctcgatctggagaccaacaaaattgcagacttcatcaagttcgacgtgggcaatgttgtgatggtgacaggtggcaggaacaggggccgtgttgggattctcaagaaccgtgagaagcataagggaagcttcgagactgtccacatccaggattccacaggccacgagtttgctactcgattgggcaatgtctacactatcggtaagggctccaagccgtgggtttctcttcccaagggtaagggtattaagttgacgatcatcgaggaagctaggaagaggattacttcccaatccgcaactgcttaagtagatataattacccgagtttttcgttcgtgaatgtgttggctgaagtagtagtaccatgagatgatgtcgttttggatatttatagtatcctttttgagggaacttgtgatgctatcttctgttaagtttttttgacgatttatatttgttttgttttgtcggttggattatttaattttggataattttactgcaatttcataagcttgttttgttcatcttatttaattttatttggttacttcgaatggtttg

SEQ ID NO: 4304 - DNA, 1207 bp, Petunia hybrida
ggtccggaattcctcgagacactgttggcctactggaaaggtggtagcgaagcaggtaagctaaagttactacactcagtggcggaggagcagctctaattcaaacactaccaacatggcgagaggattgaagaaacatatgaagaggctcaatgcgccaaagcattggatgcttgacaagcttggaggagcctttgctcccaagccttcttctggtccacataaatcaagggagtgtttaccattgaccttaatcctgaggaacaggttgaagtatgctctgacgtaccgtgaagtcattgcaattttgatgcaacggcaggttatggtcgacgggaaagttaggacagacaaaacttatcctgctggctttatggatgttgtttcaattcctaagacaaatgagaacttccgcctcctctatgacacaaagggcagattccgtcttcactcagttagggatgaggaatccaagtttaagctttgcaaggtccgatctattcagttcggacagaagggtatcccattcctgaacacatatgatggaagaacaatccgctaccctgatcctctcattaaggccaatgataccatcaagctagacttagagaccaataagattgttgacttcatcaagtttgatgtcgggaatgtcgtcatggtgactggtggaagaaacaggggacgtgttggtgttattaagaacagggagaagcataagggcagtttcgagacagttcacattcaagatgccctaggacatgagtttgctacccgcttgggaaatgtgttcactcttggcaagggtactaagccatgggtgtccttacctaagggaaaaggtatcaagttgaccatcatcgaggaggcacgcaagaggcttgctgctcaatcagctactactgcttgaaaggcaaggttgagcttagattaagttttcgctggttggacctaatgtttctttcatttagcaataccaatcttattctgtaattaccttgagacatttgtgttttaggtgctggtgcacctatgttaggtacaagcgtttagactttaaagtgctctggtttttgctttctatgattattgaaatagatttaatagcttttttatgcttataatacaaggattaccaattcttgtattatcttatgctatgctatgtgtttacattttcgggggtgtatgggtacctcggccgcga

SEQ ID NO: 4305 - DNA, 1230 bp, Papaver somniferum
  misc_feature (269)..(269): n is a, c, g, or t
ctcaaactgaagaagaagaaaagcagcgtttagccttcgatcagtccgaggcgaattaactcaaaatggcaagagggttgaagaagcatttgaagaggctcaatgcgcctaagcattggatgcttgacaaacttggtggtgcctttgctccaaaaccatcatctggtccacacaagtctagggagtgtttaccattgatccttattttgcgtaataggttgaagtatgctctcacataccgtgaggttattgctatcttgatgcaaagncatattcttgttgatggaaaggtcaggactgacaagacatacccttctgggttcatggatgtcgtgtcaattcccaagacaaatgagaacttccgtctcctttatgacaccaagggtcgtttcagactccactcaatcaaggatgaagaggccaagttcaagctttgcaaggtccgtaatgtgcattttggatcaaagggtatcccatacatcaacacatttgatggtcgcactatccgctacccagatcccctgatcaaggctaacgacaccatcaagcttgatcttgagagcaacaagattgtcgatttcatcaaatttgacattggtaacgttgtcatggttactggaggaagaaacagaggccgtgttggtgtcattaagaacagagaaaagcataagggaagttttgatacccttcacatccaggatagcaccggtcatgaatttgccacccgtttggcaaatgtcttcaccattggtaaggggacaaagccttgggtgactctccccaagggcaagggtatcaagttaaccatcatcgaagaggcaaggaagcgtcttgcagcacaaggagccgctactgcttgagttttactatgatgataaaattctgataggtttcagagatagtttgttaaagatttctttggattgctctctttttctcattttgaagtattctccatgttagcttaaaacttgttgtttttgttttttcattagttggcactgtatagaactagattttgtacctctgctatattcagtttagacctttactgtcaccttacccattgttgcaatactggtcagtgagatgccagaaattcatatgtcactgttagctagatctagtgatgtccctggaaagtcgcagaatttgattctgtttacttcaggtcgcattgcatattgtcttccagtgtgggtttataaaagggtggtgagtgcccccgag

SEQ ID NO: 4306 - DNA, 1034 bp, Helianthus annuus
gttgcggcagtgagtctgcgtagaagggtagaataatttcaccggagatttagatctcccgccggcgattctcaaacatggctagaggactaaagaagcatatgaagaggctcaatgctcccaagcattggatgcttgacaaacttggtggcgctttcgctcctaagccatcgtctgggcctcataaatctagggaatgcttgccgttgatcctcatactgaggaaccggttgaagtatgccttgacttaccgtgaggttcaatctattttgatgcaacgacatgttcttgttgacaacaaggtcaggactgacaagacgtaccctgctggtttcatggatgttgtttctattcccaagaccaatgaaagcttccgtcttctttatgacacaaagggtagatttagactgcactcaatcagagacgaggagtcaaagtttaaattgtgcaaggttcgttcagttcagtttggttcaaagggaattccatacatcaacacctatgatggtcgaaccattcgttaccccgacccactcatcaaagctaatgacaccatcaagcttgatctagaatcaaacaagattgttgatttcatcaaatttgatgttggtaatgttgttatggtaactggtggaagaaacactggccgggttggaatccttaagaaccgggaaaaacataagggcagcttcgaaactgttcacattcaagatgcaaccggccatgagtttgcgacccgtttgggtaatgtttttacccttggaaagggttcaaaaccgtgggtttccttacctaagggtaagggtatcaagctaaccatcatcgaagaggctagaaagaggcaggctgctcaagaagccgcttagatcgtgtttggttatagggattatggtgtcttgttttttatttcaagtttgttggaatgttatttatttcttgctttatgtttattagacgattatcagttatgttatactattgaattttgttggttaagttttgttataaaatggagaacatcattgatgtttttt

SEQ ID NO: 4307 - DNA, 989 bp, Helianthus annuus
ttgcggcagtgagtctgcgtagaagggtagaataatttcaccggagatttagatctcccgccggcgattctcaaacatggctagaggactaaagaagcatatgaagaggctcaatgctcccaagcattggatgcttgacaaacttggtggcgctttcgctcctaagccatcgtctgggcctcataaatctagggaatgcttgccgttgatcctcatactgaggaaccggttgaagtatgccttgacttaccgtgaggttcaatctattttgatgcaacgacatgttcttgttgacaacaaggtcaggactgacaagacgtaccctgctggtttcatggatgttgtttctattcccaagaccaatgaaagcttccgtcttctttatgacacaaagggtagatttagactgcactcaatcagagacgaggagtcaaagtttaaattgtgcaaggttcgttcagttcagtttggttcaaagggaattccatacatcaacacctatgatggtcgaaccattcgttaccccgacccactcatcaaagctaatgacaccatcaagcttgatctagaatcaaacaagattgttgatttcatcaaatttgatgttggtaatgttgttatggtaactggtggaagaaacactggccgagttggaatccttaagaaccgggaaaaacataagggcagcttcgaaactgttcacattcaagatgcaaccggccatgagtttgcgacccgtttgggtaatgtttttacccttggaaagggttcaaaaccgtgggtttccttacctaagggtaagggtatcaagctaaccatcatcgaagaggctagaaagaggcaggctgctcaagaagccgcttagatcgtgtttggttataggggttatggtgtcttgttttttatttcaagtttgttggaatgttatttatttcttgctttatgtttattagacgattatcagttatgttatactattgaattttgtt

SEQ ID NO: 4308 - DNA, 1118 bp, Solanum lycopersicum
atcttcatctcgttagggtttaagacacacacctctcgccggtagccgttactcgccgcagctaatcagtcggaaaaccgccaaaatggcaagagggttgaagaaacatttgaagaggctcaatgcgcctaagcattggatgcttgataaacttggaggtgcttttgctcccaagccttcttctggtccacataaatcaagggaatgtttgccattggttattatcctgaggaacaggttgaaatatgcgttgacgtaccgtgaggtcatttctatcttgatgcaacgccaagttatggttgatgggaaagttaggacagataagacttaccctgctggtttcatggatgttgttactattccaaagacgaatgagagcttccgacttctttatgacactaagggtcggttccgtctccactcactcagagatgaggaagccaagttcaaactttgtaaggttcgatcagtgcagtttggacagaaggggatcccatatctcaacacttatgatggaagaacaatccgctaccctgatcccctcatcaaggccaatgacactatcaagcttgacttagattcgaacaagattgttgacttcatcaaatttgatgttggaaatgtggtcatggttactggtggtagaaacaggggacgtgttggaattcttaagaacagggagaagcacaagggtagctttgagacagttcacattcaggactccctggggcacgagtttgctactcgtctgggcaatgtgttcactcttggcaagggtagtaagccatgggtgtctctacctaagggtaaaggtatcaagttatctatcattgaagaggctcgcaagaggatggctgctcagtcagctacagctgcttaaaatgtctaggttggacttatgatgaatttaacaggttgggccatgattctcactgtttagagataccaatctcattttgtatgttgaattttaacaattttgtattcggtaccgtttaactttgttttgttgggaaaataggtttgactgagtttaagatcattcatttgctttttatgtgatagtgtttttttggtcgcttagtttaattgccttggccatgagatcattcatttat

SEQ ID NO: 4309 - DNA, 1136 bp, Lactuca sativa
ataggatttagggtttaccagagcttcgatttaagaaaatcgcttcggttgcggcatctagttgcagagaagtggcgaggagagtagcaggctagccgaaaattcaaccggagatttagatctcccgccggacaccgcaaccatggctcgaggattaaagaaacacatgaagaggctcaatgcccctaagcattggatgctcgacaaacttggtggtgcttttgctcctaaaccatcatctggaccccacaaatcccgtgaatgtttgcccttgatccttatccttcgtaacaggttgaaatatgcattgacatatcgtgaggttcaatctattttaatgcaacgacatgttcttgttgacaacaaagttagaactgacaaaacatatccagctggattcatggatgttgtttctatccccaaaaccaatgaaaacttccgtcttctttatgacacaaaaggtcgattcagactgcattcagttagagatgaagaagctaagtttaaattgtgcaaggtaagatcagtccaatttgggtcaaaggggattccctacatcaacacatatgatggaagaacaatccgatacccggacccactaatcaaagccaatgacacaatcaagctcgacctcgacacaaacaaaatcgtcgatttcatcaaatttgatgttgggaatgttgtcatggtgacaggtggcagaaacacagggcgtgttgggattcttaagaacagggagaaacataaggggagtttcgaaactgttcatattcaagattcaactggacatgagtttgcaactcgtttggggaatgtgtttactcttggaaaagggtcaaagccctgggtgtctttgcctaagggaaagggtattaagttgaccatcattgaggaggctaggaaaagaagagctgctcaagatgctgttgcttaattttgggtttggtttttatgtttttgttttcttgaaagaggtttgaagtgttatgtttttgtgttacaagttatggtttagggctatatgagatcggaatgcacaataatttttgtagcaagttggtaaaaacttctgttaaatgtttatttattattatgttaaccttttgatgttcaactatatgtttataaaatctctc

SEQ ID NO: 4310 - DNA, 2027 bp, Brassica napus
actcgagtcgaggttcttaattcgtcaaaagtgtgcaaaatccaaaatgcatagtctcaattcaacaacaaagaagcaaactaagtgtatgacaccaagcatttgtagttacgtagtaggttgtagaaagtcaaatatctgaaaacataatcaagaacgacaataaaatataaaaaaaattacacattttttccgagcaacgacacctgctgtcttcggatgcaatgcatcaagggtcgtttctcttcacacacaggattcagttctcttctttaggctcatcacctttggatttctcttctccttcctcggggaggtcagaagtccacaaggtgaggttgtctctgagtagctgcatgataagagtgctgtccttgtatgactcctcgttgaggctgtcaagttcagcgattgcatcgtcgaatgcttgcttagccaattggcatgcgctttcaggagagtttaagatctcataatagaaaaccgaaaagttcaaagccaagccaagtctaactggatgtgttggtgccaatccagtctctgcagcagcaacagcagccttgtaggcttcaagagactgatctgcagcttccttgcgctcagcaccagagctgaactctgccagatagcgatagtaatctcctttcattttgtagaaaaagacagtggactccacagcggtagaggaaggaatgagatgcttatcaatgacggacaagatgtcattgcaaactttggcaagctcctcttcaaccctctttcggtaagtctgaatcctcttgacattctcctcgttccccttggactcttccttctgctcaatggaggacagtatcctccacgatgctctcctcgcgccgatgacgttcttgtaaccaacagatacaaggttcctctcctctacggtgagctccacatccatctgagcaactttcttcatcgcctcaaccatttcatcgtaacgttcggtttgctcagagagcttcgccgagtaaacctgcttttccctctcactctccatgtctttcttctctgaaacaaacaatggatgctctcgattttctcgttcagagctaaacgagagaagccgtctggatcggcgctacgcttccgaactccaaacatggcgagaggtttaaagaagcatttgaagaggctcaatgcccctaagcattggatgcttgacaaacttggtggtgctttcgcccccaagccatcttctggaccacacaagtcgagggagtgccttcctcttgttcttatcatcaggaacaggttgaagtatgctcttacctaccgtgaagtcatctccatcttgatgcaaaggcatatccaggttgatggcaaagtcaggactgataagacctaccctgctggtttcatggatgttatctctatccccaagactaacgagaacttccgtcttctctatgataccaagggtcgtttccgtcttcactccatcagagatgaggaagccaagtttaagctttgcaaggttcgaactatccaggtcggacagaagggcattccttacctcaacacatacgatggtcgcaccatccgttaccctgacccgttcatcaagcctaacgacaccatcaagctcgatcttgaggagaacaagattgttgagttcatcaagtttgatgtcggcaatgttgtcatggttaccggaggaagaacagggggcgtgttggtgtgattaagaaccgtgagaagcataagggaagctttgagactatccacatccaagactcgacaggacatgagtttgcaacaaggttgggtaatgtgttcacccttggcaaaggaacaaagccctgggtgtctcttcccaagggtaaaggtattaagcttaccatcattgaggaggccaagaagaggcttgctggtcaacaggctgcttgattttgttattttccagctcttttattatgtcttcttagacgtcatatgttttcgtagactcgctttgcttctgtttgttttggaacttgtgttattttctctgtttcaaggattca

SEQ ID NO: 4311 - DNA, 825 bp, Brassica napus
gtctgtatcggcgctacccttccgaactccaaacatggcgagaggtttaaagaagcatttgaagaggctcaatgcccctaagcattggatgcttgacaaacttggtggtgcttttgcccccaagccatcttctggaccccacaagtctagagagtgccttcctctcgttcttatcatcaggaacaggttgaagtatgctcttacttaccgtgaagtcatctccatcttgatgcaaaggcatattcaggttgacggcaaagtcagaccgacaagacctaccctgctggtttcatggatgttatctctatccccaagactaacgagaacttccgtcttctctatgacaccaagggtcgtttccgtcttcactccatcagggatgaggaagccaagtttaagctttgcaaggttcgaactatccagtcggacagaagggaatcccttacctcaacacatacgatggtcgcaccatccgttaccctgacccgctcatcaagcctaacgacaccatcaagctcgacctggaggagaacaagattgttgactccatcaagtttgatgtcggcaatgttgtgatggtgactggaggaagaaacaagagggcgtgttggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaagtattaagctcaccatcatcgaggaagccaggaagaggctctctgggcaacaagctgcttaagttt

SEQ ID NO: 4312 - DNA, 1010 bp, Flaveria ramosissima
ctccgccgcagctctgccgtacaacgccaccggagacaccgatctctaactccacactgcagccatggctagaggattgaagaaacatttgaagaggcttaatgcccctaagcattggatgcttgataaacttggtggtgcttttgctcctaagccatcatctggacctcacaagtctagggaatgtttgcctttgatcctcattttgaggaataggttgaagtatgctttgacataccgtgaggttcagtccattttgatgcaacgtcatgtgcttgttgacaacaaggtcaggacagacaagactaccctgctggttttatggatgtcgtctcaattcccaaaaccaatgaaaacttccgacttctatatgataccaagggcaggtttaggctccactccatcagagatgaggaatcaaagttcaagttgtgcaaagtccgctcagtccaatttggttcaaaagggattccttacatcaacacctatgatggtcgaaccattcgctaccctgatcccctcatcaaagctaatgacaccatcaaacttgacttggactcaaacaagattgttgatttcatcaagtttgatgttgggaatgttgtcatggtgactggtggacgcaacaggggccgtgttggaatccttaagaacagggaaaaacataagggcagctttgagacggttcacattcaggatgctactgggcatgaatttgctactcgcttgggaaatgtcttcactctcggaaagggttcaaagccttgggtgtctctccccaagggtaagggtatcaagttgagcatcatcgaggaggctaggaagaggcaagctgctgctgcagcggttgcttaattatgtcttacaagcatgatctttgcttgcttgctggttggtcatgttaaatttatattatgggatttgttttagaggagataagttttatttttggtacaaccttgcatctgcatgttaagattagtatgatttaaaaattgcagactgtttgc

SEQ ID NO: 4313 - DNA, 810 bp, Panicum virgatum
gcactcttgtcatcccggcggcggcggcgcggaaggaggaggaggagcaacagcagcagcaggcggcgccgaagagcagctacccacccccaaccggcaaccatggctaggggattgaagaagcatctcaagaggctcaatgcgccgaagcattggatgttggacaaacttggcggagcttttgcccccaagccatcttctggcccccacaagtctagggagtgccttccccttatcctcatcatcaggaacaggctcaagtatgctttgacttaccgcgaggttatttctatcctgatgcaacgccatgtcttggttgatggcaaggtcaggactgacaagacctaccctgctgggttcatggatgtcatttccattcccaagaccaatgagaactacaggcttctgtacgacaccaagggtcgcttccgtcttcacccgatcagggatgaggatgccaagttcaagctctgcaaggttaggtctgttcagtttggccagaagggcatcccctacctgaacacttatgatggtcgcaccatccgctaccctgacccgctcatcaaggctaacgacaccatcaagatcgaccttgagaccaacaagattgttgacttcatcaagtttgatgttggcaacgttgtcatggtgactggtggaaggaacactgggcgtgttggtgtgatcaagaacagggagaagcataaagggcagcttcgagaccatccatgttgaggatgcccttggccaccagttcgccacccgtctgggcaatgtgttcaccatcggcaagggcaacaagccgtgggt

SEQ ID NO: 4314 - DNA, 985 bp, Eutrema parvulum
ttcatcctttttctgcaggcgagaggtttaaagaagcatctgaagaggcttaatgcccctaagcattggatgcttgacaaacttggtggtgcatttgcccccaagccgtcttctgggccacacaagtctagggagtgcctaccccttgtccttatcatcagaaacaggttgaagtatgctctgacatacagagaggtgatttcgatcttgatgcaaaggcatattcaagttgatgggaaagtgaggactgacaagacctaccctgctggtttcatggatgttgtgtctatcccaaaaacaaatgaaaatttccgtcttctgtatgacaccaagggacgtttccgtctccactccatcagggacgaggaagcaaagttcaagctttgcaaggtgagatctatccagtttggtcagaagggcattccctacctgaacacatatgatggtcgcaccatccgttaccccgacccgctcatcaagcctaatgacacaatcaagctcgacctcgaggagaacaagattgtggagtttatcaagtttgacgtgggcaatgtagtgatggtgactggaggaagaaacagagggcgtgtcggtgtgatcaagaaccgtgagaaacacaagggaagctttgaaaccatccacattcaagactcaacaggacacgagtttgctacaaggttggggaatgtgttcacaataggtaaaggaacaaagccatgggtgtctcttccaaagggaaaaggtattaagttgaccatcattgaggaagccaggaagagactttctgctcaacaagctgcttaaaaccatactcttgttccccagatttcagaacaaactatgctttagtttgcagcttttctttttatgcctttatcaagagtttacttgtgttttcagacttgtctttttggggtaacgatgagctattttgtggaccttttgtgctatcaatcatgacttggaacttcttcaacttggtttt

SEQ ID NO: 4315 - DNA, 940 bp, Eutrema parvulum
ttaaacgtttctctgcaggcaaggggattgaagaaacatctgaagaggcttaatgcccccaagcattggatgcttgacaaacttggtggtgcttttgcccccaagccatcttctggaccacacaagtcgagggagtgccttccccttgttcttatcatccgtaatagattgaagtatgctctcacataccgtgaggtgatttcaatcttgatgcaaaggcatattcaagttgacgggaaagtcaggactgacaagacataccctgctggtttcatggatgttgtgtctatcccaaaaacaaatgaaaacttccgtcttctgtatgacaccaagggacgcttccgtcttcactccatcagggacgaggaagccaagttcaagctgtgcaaagtgagatcgatccagtttggtcagaaggggattccttacctgaacacatacgatggtcgcaccatccgttaccccgacccgctcatcaagcctaacgacaccatcaagctcgacctcgaggaaaacaagattgtggaatttatcaagtttgatgttggaaatgttgtgatggtgaccggaggtagaaacagagggcgtgttggtgtgatcaagaaccgtgagaaacacaagggaagcttcgagaccatccacattcaagactcgacaggacatgaattcgccacaaggttagggaatgtgttcacaattggtaaaggaacaaagccgtgggtgtctcttccaaagggtaaaggtattaagcttaccatcattgaggaagctaggaagaggctttctgctcaacaagcagcttaaactgtttttatctcagtttcagaaaactatgttatgttttttatattttgctattgagttcctttctctcagacttttatgcctttgttttgccgactttgtaatcttgtgggaatatgttaaaaaaattagaaaa

SEQ ID NO: 4316 - DNA, 1075 bp, Brassica rapa
tttccttttcatatataaacgtagagtaagtgccgccgcaaaaataatcacaagtcgtcgtgctcgcaacaaaaatggcaagaggattgaagaagcatctgaagaggctcaatgcacccaagcattgggatcttgacaaacttggtggtgccttcgctcccaagccctcttccggacctcacaagtctagagaatgccttcctctcgtcctgatcatcaggaacaagttgaagtacgctttgacataccgtgaagtcatctccatcctcatgcaaaggcatatccaagtcgatggtaaagtcaggactgacaaaacttaccctgctggcttcatggatgttgtctctatccctaagacgaatgagaacttccgtcttctctacgacaccaagggacgtttccgtctccactccgtcagggatgaggaagctaagttcaagctttgcaaggttaggacgatccagttagggcaaaagggaatcccctacctcaacacttacgacggtcgcacaatccgttaccccgacccactcatcaaacccaacgacaccatcaagctcgacctcgaggagaacaaggttgtggacttcatcaagttcgacgtcggcaacgttgtgatggtgactggagggagaaacagagggcgtgttggtgtgattaagaaccgtgagaagcataagggaagctttgagacgatccacattcaagattcaaccggacatgagtttgccacgaggttgggcaatgtgtttaccttggggaaaggaactaagccgtgggtgtctctacctaaggggaaaggtattaagcttaccatcattgaggaagctaggaagaggctctctgctcaacaagctgcttaaaaaaatttattaccaaaggctgtttggttttttactcttgtgtcttagactcgctacttgtctgtgttttgagatttttttcctctttcatgttgcttgcaaaactctattacaagacagtttaagtttccagtagagtgttttgtattgaaattttagtaattttactctttaaatctgttgacttaatattaaaaccataacgagattgc

SEQ ID NO: 4317 - DNA, 993 bp, Centaurea maculosa
agaggcggagttcttccgaagaaaatcacacaacgcaaccatggctagaggtttgaagaagcatctgaagaggctcaatgcccctaaacattggaatcttgataaactcggtggtgcttttgctcccaagccttcatccggaccccacaagtccagagagtgcttgcccttgattctcattctccgaaataggttgaaatatgctttgacataccgtgaagtcatatctattttgatgcaacgtcatgtacttgttgacaacaaggtcaggaccgacaagacttaccctgctggtttcatggatgttgtttcaattcccaaaaccaatgaaaactttcgccttgtttacgatacgaaaggtagattcaggctgcactcgatcagggatgaggagtcaaagttcaagctgtgcaaggttcgttccgttcagtttggctcaaagggtattccgtacattaacacctacgatggccgcacaatccgctaccccgaccccctcatcaaggccaacgacaccataaaactcgacttggactccaacaagatcgtcgatttcatcaagttcgatgttggaaacgttgtgatggttaccggcggaagaaacacgggccgtgtcggaatccttaagaacagagaaaaacataagggaagtttcgagaccgtgcacatccaggatgccactggtcacgagtttgctactcgtttgggcaacgtttttacgatcggaaagggttcgaagccgtgggtgtctcttcccaagggcaagggtatcaagttgacaattattgaagaggctagaaagaggcaggctgccttaactgctattgcttagatttggaattttatgggaattatttgagatagtttgtgatgatgttataggtaatatgacaagatcatttgaggaacttgttctgtttttgctatttttggtacattttgaaggttaaattggttttgtaaacaatggatttttgcttaaatgtaggcaag

SEQ ID NO: 4318 - DNA, 1207 bp, Centaurea maculosa
ttttggacagatagttcgaattggactggttttattcacccctactaactcataaggctgcttgtaccaaacataatttgttattttgttcataacctagactagattatcaactatagcttagattatctttgccaaacagagcctaagaagattgtagtgagttgcagagagaaggagcagtccagccggagatttagaagacaccgtagccatggctagaggtttgaagaaacatatgaagaggctcaatgcgcctaagcattggatgcttgacaaacttggtggtgcttttgctcccaagccatcatcaggaccacacaaatctagggaatgcttgcctttgattctcatcctccgaaataggttgaagtatgcccttacataccgtgaggtgatttctattttgatgcaaagacatgttcttgtcgacaacaaagtcaggaccgacaagacctacccagctggtttcatggatgttgtttctattccaaagactaatgagaacttccgtctcctatacgataccaaaggtagattcaggctacactcaatcagggacgaggaagcaaagttcaagctatgcaaggttcgttccgtccagtttggttcaaagggcattccttacatcaacacatatgatggtcgaaccatccgttacccagacccactcattaaggccaacgacaccattaagcttgatttggaatcaaacaagattgttgatttcatcaagtttgacgtgggaaatgtcgttatggttactggtggacgaaacactggccgtgttggaattctaaagaacagggaaaagcataagggcagcttcgagactgttcacattcaggacgctaccggccatgagttcgccacacgtttggggaacgtgtttacggtcggaaagggtacaaagccgtgggtgtctcttcccaagggtaagggtatcaagttaaccatcatcgaggaggctaggaagaggcgggctggccaagaccctgttgcctagatcgcatgattttggtgttctgttcttgcaggtttgtgggaagttttcttctttacttggttattgttatggtacagttttgaacctatggttttgattctacaagttatgctagactcttgttggttaatttgattacagaatggttatagcttttgtttaaatgcattacgaatccctcgttattttctagaaaaagaa

SEQ ID NO: 4319 - DNA, 973 bp, Centaurea maculosa
atcagccggaaagcttaagaagaagaagaccagcggcagagagaagtagcagtccagccggagaattccaccggagattaagatctcctctaacacaccgcagccatggctagaggtttgaagaaacatttgaagaggctcaatgcccctaagcattggcagcttgacaaacttggtggtgcttttgctcccaagccatcttcaggcccccacaaatctagagaatgcttgcctttgattctcatcctccgaaataggttgaagtatgcacttacataccgtgaggtgatctctatcttgatgcaaaggcatgtgcttgtcgacaacaaagtcaggaccgacaagacctacccagctggttttatggatgttgtttctattccaaagaccaacgagaacttccgtctcctatacgataccaaaggtagattcaggctacactcaatcagggacgaggaagcaaagttcaagctatgcaaggttcgttccgttcagtttggttcaaagggcattccgtacatcaacacatacgatggtcgaaccatccgttacccagacccactcattaaggccaacgacaccattaagctcgatttggaatcaaacaagattgtcgatttcatcaagtttgatgtgggaaatgttgttatggttactggtggacgaaacactggccgtgttggtatcctaaagaacagggaaaaacataagggcagcttcgagaccgttcacattcaggacgctactggccatgagtttgccacacgtttggggaacgtgttcacggtgggaaagggtacaaagccgtgggtgtctcttcccaagggtaagggtatcaagttaaccatcatcgaggaggctaggaagaggcgggctggccaagaccctgttgcctagatcgcgtgattttagtgttttgttcttgcaggtttgtgggaagtgttcttttttacttggttatcgttatggtaca

SEQ ID NO: 4320 - DNA, 1190 bp, Gossypium hirsutum
tctttaatttcctttcatttttgtattgtcaattaatttcttttgctgtttaaagatgtcgtttatccgaagatctttgccaattatcagttgttcacaagagctctcctccaatcattcgagtttcaagtgaatacttttcattcttcctttaattttgcctaacaataagctcatcactccctcaattttgtctaatcgtatgagggctagagagttgaagaaacacttgaagaggctcaatgccctcaggcattggatgctcgaaaagcttggtggtgcattcgcgccaaagccatcatctggaccccacaagtcgagggaatggttgccacttattctcattctgcgaaacagactgaagtatgctttgacatacagagaagtgattgctattcttatgcaaaggcatgttatggtagatgggaaggttaggactgataagacctaccctgcaggttttatggatgttgtgtcaattcccaagacaaatgaggacttccgtctcctttatgacactaaaggtcgtttccgccttcatgccatcactggtgatgagactaagtttaagctctgcaaagttaggtctgtccaatttggccagaagggtattccatacctgaatacctacgatggacgcacaatacgctacccagaccctttgatcaaagccaacgacaccatcaagcttgacttagagagcaacaaaattgttgatttcattaagtttgatgttgggaatgttgtcatggtcactggtggaaggaacaggggacgtgttggagtgattaagaacagggagaagcacaagggtagcttcgagacaatccatgtacaagatgctgctggacacgagtttgcaactcgtctaggcaatgtcttcacaattggtaaaggaacaaagccatgggtttcgcttcccaagggcaagggtatcaagttgtcgatcattgaggaagcgaggaagaggcttgctgctcaggctgctgcttaaacctatcatatctggtagttttttttttgtcgaaagacttgttggatgaatgctggctggtcctgtcctagcttttgtagggtttatggatttgctttttattaatgttttttttttctatgaatttagtttagttactcatttggtttatgttatattttgactatcatttatcacattacagttctttctgaaa

SEQ ID NO: 4321 - DNA, 1269 bp, Gossypium raimondii
gctcaattcatctctaaaaccctaaattaccgcaataaataggtaaaacaaaattagggttttgatttcctcccgctggcatcttcctaaagaacgctgaaggctctcagcggaaacagctgcttccagaccaaccgaaatggctagagggttaaagaaacatctgaagaggctcaatgctccaaggcattggatgcttgacaagcttggcggtgcatttgcacccaagccctcatctggaccacacaaatccagagaatgcttgccgctcattctcattctgcaaaacagattaaagtacgctctaacatatagagaagtgattgccattcttatgcaaaggcatgttatggtagatgggaaggttaggacggataaaacataccctactggtttcatggatgttgtatcaattccaaagacgaatgaggacttccgcctcctttatgacacaaaaggtcgttttcgccttcatgccatcaccggtgatgagaccaagtttaagctctgtaaagttcggtctgtccaatttggtcaaaagagtatcccctaccttaatacgtatgatggacgcaccatccgctacccagatccactgatcaaggctaacgataccatcaagcttgacctagagagcaacaaaattgtagatttcattaagtttgatgttgggaatgttgtcatggtcactggaggaagaaacagagggcgtgttggagtgattaagaaacgtgagaagcataagggtagcttcgagacaatccacgtccaagatgctgctggacacgaatttgctactcgtttaggcaatgtcttcacaattggtaaaggaacgaagccatgggtgtcacttccaaagggcaagggtatcaagttgtccatcattgaggaagccaggaagaggcttgcagcccaagctactgtctaaattttatgattaaagatataatatctggaattgttttttgtcaaatgaattaatctgtttggtggtcctttgtgtttgcttttgtaggatttatgttttgtttttactcatgacacagttttggaccaatcgttatattatttttttaaattaaatttcattttgaaatgcagaaataggttggatttgaaatttctggttctaagtatatcgaaaatgcaattatgtatttagtgattcaatttggtttaagtcagcttagattgtttcataaataatagtttaattgtcaatatataaataaaagattaaataataaaatggatttttgagacgtacgt

SEQ ID NO: 4322 - DNA, 1224 bp, Papaver somniferum
aaacttcattagggttttggtttctttctcgtaatagtgtggtggattaagctccagaggcggaagaagaagaaggaatagaaaattagggcaaacctaattttcagtccaaaaactcaatcatggcgaggggattgaagaaacatatgaagaggcttaatgcccctaagcattggatgcttgataaattgggtggtgcttttgcccctaagccatcatctggaccacacaagtctagggaatgccttcctttgattcttatcctgcgaaacagattgaagtatgcccttacataccgtgaggttattgctattttgatgcaaagacacattcttgttgatgggaaagtgcgaactgaccagacctatccatctggatttatggatgttgtatcaatccccaagacgaacgagaacttccgtcttttgtatgacaccaagggtcgtttccgtctccactcaatcaaggatgaagaagctaagttcaagctctgcaaggtcagaaatgtacactttggatctaagggtatcccatacattaacacctttgatggtcgcaccatccgttaccctgaccctcttatcaaggctaatgacaccatcaagttagatctcgagagcaacaagattgtggattttatcaagtttgatatcggtaacgttgtcatggttactggaggtagaaacagaggccgtgttggtgttatcaagaacagagaaaagcataagggaagtttcgatacccttcacatccaggactctacaggccatgaattcgccacccgtttggctaatgtgttcaccattggcaagggtaccaagccatgggttaccctccccaagggcaagggtatcaagttgtctatcattgaagaggctaggaaaaggttggcggctcaaggagctgccacagcttaggtgcttccatcatgacctggtgttctgttttgcagtttggaaattactcttagcttaaaggaacaagtgctgttttagtttactttcggaacaaaattttgaagctgctttttgtgtagcttttcctacattactaggatattataaacttaatctattggctcttcccatgcgttatgttcattttgtcaggtttaccttattgctttcaactttgcacgaatatttctgtttgttttagatcagtaaatccctgtatccaaaagaaatctggaagatgttattttattctctttttcgttagcgt

SEQ ID NO: 4323 - DNA, 1164 bp, Helianthus annuus
ccgatctcgtccctgatagagtacgcgggaacgagagggtgccgcacttactcagaccaccgccgcacttttccaccggagacaccgatctcttacataccccgtcgcagccatggctcgtggattgaagaaacatatgaagaggcttaatgcgcctaagcattggatgcttgataaacttggtggtgcttttgctcctaaaccatcatctggacctcataaatcaagggagtgcttgcccttgattcttatattgaggaataggttgaagtatgctttgacataccgtgaggttcagtctattttgatgcagcgtcatgttcttgttgataacaaggtcaggactgataagacttaccctgctggtttcatggatgttgtctcaattcccaagaccaatgaaagcttccggcttttatacgacaccaagggcaggttcagacttcactctatcagggacgaggaatcgaagttcaagctgtgcaaggttcgctcggttcagtttggttcaaaagggattccttacatcaacacctacgatggtcgaaccattcgttaccctgatcctctcatcaaagctaacgacacaatcaaactcgacttggaatcaaacaagattgttgatttcatcaagtttgatgttgggaatgtcgtgatggttactggtggacgcaacactgggcgtgttggaatcctcaagaacagggaaaaacataagggaagttttgagaccgttcacattcaggatgctaccgggcatgagtttgctactcgtttgggaaatgtgttcactctcggaaagggttcaaagccgtgggtgtctctccctaagggcaagggtatcaagttgaccatcattgaagaggctaggaagaggcaagctgctgctgccgctgttgcttgattatgtattacaggcatcgtctttgcttgctttctgttttgtcgtgttaaatttatatgttagcacctgttttaattttggtacaattttgcaactttggatctgcatgttaaggttagtatgattaagaattcgagacttttcattgatttctcgtggtttttaagatttaactttgcttgaatttgtttgaaggctatgtggaatgttgttactttcaaaacaatttatgatattcaatatggttatgtttgaaggct

SEQ ID NO: 4324 - DNA, 1010 bp, Helianthus annuus
gattttggggctgcggctgtcaattgtagaagaatttcaccggagatttacatctcccaccgcaaaccgcaaccatggcaagaggtctcaagaagcacatgaagaggctcaatgccccgaagcattggatgcttgacaaacttggtggtgcttttgctcctaagccatcatctgggccacacaagtctagggaatgcctgcccttgatcctcattttgaggaacaggttgaagtatgcattgacataccgtgaggtacaatctattttgatgcagcgtcatgttcttgtcgacaacaaggtcaggaccgacaagacttaccctgcaggcttcatggatgttgtttctattcctaagaccaatgaaagcttccgtcttctttatgacaccaaaggtagattcaggttgcactctatcagagacgaggagtcaaagtttaagttgtgcaaggttcgttcagttcaatttggttcaaaaggtattccatacatcaacacctatgatggtcgaaccatccgctacccggacccacttattaaagccaacgacaccattaagctcgatctagaatcaaacaagatcgttgattttatcaagtttgatgttggaaatgtcgtcatggtaactggtggaagaaacacaggccgtgtcggaatcctcaagaacagagaaaaacataagggcagcttcgaaaccgttcacattcaagatgctaccggtcacgagtttgctactcgtttgggtaacgtgttcactctcggaaagggttcgaaaccgtgggtctctctacccaagggtaagggtatcaagttaaccatcattgaagaggctagaaagaggcaggctgcccaagaggctgctgcttagattgtgtctggcttcaaagattatggtggtatgtttttgatttcgggttgttgggaagtttttaactgctttcgttatggtacaattttgaacctatgttttgatgttggattattttggttataaatcggtaaacttttgctc

SEQ ID NO: 4325 - DNA, 1059 bp, Helianthus annuus
cacttttcaccggagacaccaccgatctcttacaccccccgccgcagccatggctcgtggattgaagaaacatatgaagaggcttaatgctcctaagcattggatgcttgataaacttggtggtgcttttgctcctaaaccatcatctggacctcataaatcaagggagtgcttgcccttgattcttatattgaggaataggttgaagtatgctttgacataccgtgaggttcagtctattttgatgcagcgtcatgtgcttgttgataacaaggtcaggactgataagacttaccctgctggtttcatggatgttgtctcaattcccaagaccaatgaaagcttccggcttctatacgacaccaagggcaggttcagacttcactctatcagggacgaggaatcgaagttcaagctgtgcaaggttcgctcggtccagtttggttcaaaagggattccttacatcaacacctacgatggtcgaaccattcgttacccagatcctctcatcaaagctaacgacacaatcaaactagacttggaatcaaacaagattgttgatttcatcaagttcgatgttgggaatgtcgtgatggttaccggtggacgcaacactggtcgtgttggaatcctcaagaacagggaaaagcataagggaagcttcgagactgttcacattcaggatgctaccgggcatgagtttgctactcgtttgggaaatgtgttcaccctcggaaagggttcaaagccatgggtgtctctccctaagggcaagggtatcaagttgaccatcattgaagaggctaggaagagacaagctgctgcttctgctgttgcttgattatgtattacaggcatcgtctttgcttgctttctgttttgtcgtgttaaatttatatgttagcacctgttttaagtttggtacaattttgcaactttggatctgcatgttaaggttagtatgattaagaattcgagacttttcattgatttctcgtggtttttaagatttaactttgcttgaatttgttgaaggttatgtggaatattgttactttc

SEQ ID NO: 4326 - DNA, 879 bp, Helianthus annuus
gatttcggggctgcggctgtcaattgtagaagaatttcaccggagatttacatctcccaccggaaaccgcaaccatggctagaggtctcaagaagcacatgaagaggctcaatgccccaaagcattggatgcttgacaaactcggtggtgcttttgctcctaagccatcatccgggccacacaagtctagggaatgcctgcccttgatcctcattctgaggaacaggttgaagtatgctttgacataccgtgaggtacaatctattttgatgcagcgtcatgttcttgttgacaacaaggtcaggaccgacaagacttaccctgctggtttcatggatgttgtttctattcctaagaccaatgaaagcttccgtcttctttatgacaccaaaggtagattcaggttgcactcaatcagagacgaggagtcaaagtttaagttatgcaaggttcgttcagtccagttcggttcaaagggcattccgtacatcaacacttatgacggtcgaaccatccgctacccagatccccttatcaaagccaacgacaccattaagctcgatctagaatcaaacaagatcgttgattttatcaagttcgacgttggaaatgtcgtcatggtaactggcggaagaaacacaggccgtgtcggaatcctcaagaacagagaaaaacacaagggcagctttgaaaccgttcacattcaagatgctaccggtcacgagtttgctactcgtttgggtaatgtgttcaccctgggaaagggttcgaaaccatgggtctctctacccaagggtaagggtatcaagttaaccatcattgaagaggctagaaagaggcaggctgcccaagaggctgctgcttagattgtgtttggtt

SEQ ID NO: 4327 - DNA, 1143 bp, Ambrosia trifida
cagatcacctagggtttactccaataccttctcaaccaaccaccagagggtgtcactaacaccaccgccgcacacttctctcacacaacacacagcagccatggctcgtggtttgaagaaacatatgaagaggcttaatgcgcctaagcattggatgcttgataaacttggtggtgcttttgctcctaagccatcatctggaccgcacaaatctagggagtgtttgcctttgatattgatactgaggaataggttgaagtatgctttgacataccgtgaggttcagtctattttgatgcagcgccatgtccttgttgataacaaggtcaggactgacaagacttaccctgctggtttcatggatgttgtctcaattcccaaaaccaatgaaagcttccggcttttatatgacaccaagggcaggttcaggcttcactctatcagggatgaggaatcaaagttcaagttgtgcaaggttcgttcagtccagtttggttcaaaaggtattccttacatcaacacctatgatggccggaccatccgttacccagaccctctcatcaaagccaatgacacaatcaaacttgacttggaatcaaacaagattgttgacttcatcaagttcgatgtcgggaatgttgtgatggttactggtggacgcaacacaggccgtgttggaatcctcaagaacagggaaaaacataagggaagctttgagactgttcacattcaggatgctaccggtcatgagtttgctactcgtttgggaaatgtcttcactcttggtaagggttcaaagccgtgggtgtctctccctaagggcaagggtatcaagttaacaatcattgaggaggctaggaagagacaagctgctgccgctgccgttgcttgattatgtgttacaggcatcatctttgcttgctttatgtttggctatgttaaatttatatgttagcacttgttttgtttttggcacaattttgcaactttgaatctgcatgttaaggttagtatgattatgaattggagacttttcagcgactgtttgtggttttaaacctgacctttgcttattggtatctttctaaggctatatagaatcttgttatctaaaaaagaaaaaagtaaccgaactgcgactct

SEQ ID NO: 4328 - DNA, 1846 bp, Ambrosia trifida
ggtgtcactaacacctcctccgccgccgtacacttccaccggacgacaccgatcccttccaccccacactgcagccatggctcgtggattgaagaaacatatgaagaggcttaatgcccctaagcattggatgcttgataaacttggtggtgcttttgctcctaagccatcgtctggaccgcataaatcaagggagtgcttgcctttgatattgatactgaggaataggttgaagtatgctttgacataccgtgaggttcagtctattttgatgcagcgtcatgtgcttgttgataacaaggtcaggactgacaagacttaccctgctggtttcatggatgttgtctcaatccctaagaccaatgaaagcttcaggcttttatatgacaccaagggcaggttcagactgcactctattagggatgaagaatcaaagttcaagctgtgcaaggttcgctctgtccagtttggttcaaaggggattccttacatcaacacctatgatggacgaaccatccgctacccagatcctctcatcaaagctaatgacacaatcaagctcgacttggaatcaaacaagattgttgacttcatcaagtttgatgtcgggaatgttgtgatggttactggtgggcgcaacacaggccgtgttggaatcctcaagaacagggaaaaacataagggaagctttgagacggttcacattcaggatgctaccggccatgagtttgctactcgtttgggaaatgtgttcactcttggaaagggttctaagccgtgggtgtctctccccaagggcaagggtatcaagttgaccatcattgaggaggctaggaagagacaagctgctgccgctgctgttgcttgattatgtattacaggcatcgtctttgcttgctttatgtttggttatgttaaatttatatcttagcacttgtttgaatttcggtacaattttgcaactttggatctgcatgttaaggttagtatgattatgaatttgagacttttcaaaaaatagcgcttgaaagaatgacaatgtatgagaattacacatgaaataaaactccgtttggtttttctaaaacaaggtagtcactgtaattatatgaattcacacagtgatttttaagtgaattgtcatcaacaaaaaacaaacactaataaaaagatggcacaaaatacatggatatgttttttgatcagagagaattggggcagggtaagcacacgattatttggttgcctgcgcaatgatattgcttatagaatttgcttcttctttggctgcctccaccaaagaatcctgtgtagctactagacgggccactgtcttcttgcttgattcctgaagttcccccgctatcagtacctcatccagtatataataagccttgtgaaaattgaagatcaggtccagctcacaaacacttccaaagtaacgatctagaatttcaacataatgatgaataatttcaaggacttccaattcattgtcttcctggttaatgcacatacagaagtagaggctggcatatcttttataaacaactttaaatcccctccattcgacaaaattgcaaagcttggggccacgtgaaagaatcatcccactgagttcccggattaccttacttctttctttctgagtgtaaggtgaataccactttgttaacctaacttttccttgtcggcttattaagagaacaaaatgaatcatggctcaaacttgaacaaattcacgtctatcttcctccgatctgattgatagctcttagatttgctctgatcgtcgccggtgaaacagagtaaaatctctggtgactattttattgtttctatttga

SEQ ID NO: 4329 - DNA, 1067 bp, Aquilegia formosa
gtaatcttccagcaccacacctcgccttctctctcattcatttcagtgaagatcgatcgaagaagaacttgaatcatggcgagaggattgaagaagcatttgaagaggctcaatgcccccaagcattggatgcttgacaaacttggtggtgcttttgctcccaaaccatcatctggacctcacaaagccagggaatgtctgccattagctctgatccttaggaacagattgaaatatgctctcacctatagggaggtcattgctatactgatgcaacgacatgtccttgttgatgctaaagtcagaactgacaagacttatcctgctggatttatggatgttatttcaatccccaagacaaatgagaacttccgtcttctatatgataccaaaggtcgcttcaaaattcatgcgattaaggatgaagaagctaagttcaagctttgcaaggttcggtctgtgcaatttgggcagaagggaatcccatacctgaacacctatgatggtcgcacaattcgatatcctgatcccctcatcagggcccatgacaccatcaaaattgaccttgagaccaacaagatcattgatttcatcaagttcaatgttggtaatgttgtcatggtgactggtggtagcaacagaggacgtgttggaattattaagagcagggaaaagcataagggtacctttgaaactatccatctccaggatgctactggtcatgagtatgctactcgtctaggcaatgtctttaccattggcaagggtacaaagccatgggtctctcttcccaagggcaagggtatcaagctcactattattgaagaggctaagaagagagcagctgctcaaggagctgctactgcttaaattttaagaatgagtcaggtttatcttaaacagtaccgtagattgattttgttatctgcttggatgttcagactattttgcctgcatttttgttattggtactattttagttaactttatagttaattttggtttaaactttgttccttaaaatgtaagactttctatttcatgcatagatttttgtttgaatgcct

SEQ ID NO: 4330 - DNA, 1322 bp, Aquilegia formosa
gaagaagtagaagaaagagagcatttgctccactggccgagtaagaagaagaagaagacgacggaaacttcttagtaggagagaaacacaatggcaagaggtctaaagaagcatttgaagagggtgaatgccccgaagcattggatgcttgacaaacttggtggtgcatttgctccaaaaccctcatctggtcctcacaaatcaagagagtgcttgcctttggtaatcatcctgcgagagaggttgaaatatggtcttacaggtcatgaggtcgtttctattttgatgcaacgacatgttatggttgatgggaaggttaggactgataagacctatcctgcgggtttcatggatgttgtttcgattcccaaaacaaatgagaatttccgtcttctctatgacaccaagggtcgtttccgcatgcacgctattaaggatgaagaagctaaggttaaactatgcaaggttcgatctgtacagtttggccaaaaggggatcccatatctcaatacctatgacggccgcacaatccggtaccctgatccactcatcaaagccaatgatactatcaagatagatcttgaaagcaacaagatcctcgatttcataaagtttgatgttggcaatgttgtcatggtgactggtggaagtaataggggccgtgttggagttatcaagaacagggagaagcacaaaggaacctttgaaaccatccatctccaggattccactggtcatccttttgccactcgtttgggcaatgtcttcaccattggcaagggtacaaagccttgggtatctctccccaagggcaagggtattaagcttaccatcattgaagaggccaagaagagacaggctgctcaaggagctgccactgcttaaatttttcctgtggcagtttgggcatatgattttcaatttcactgtagtataggaattttgatatttaatcttctggtactgtttaagcaaagtgttgtagaaaaaacgtggtacaagtttttttataccgaatagtgaatagcagtgatcagattttgagtggtaacggcggtttgcacacattgtcccaacctaaggattctttaattttatgtccaggctgtcaggttagcaggtatcctcctaaaagtactgagtaatagtggaaactggaaaatacagtcccagtttttctgtgtagatcgtttggagtttgaactgtacgtctgtatcattagcaatcactaattcactgctactctatgaagcttctgttgtttcttccctaaataaaccaaagtgccacacattattcagtatgtgtggcaccatttctc

SEQ ID NO: 4331 - DNA, 1010 bp, Brassica oleracea
  misc_feature (1010)..(1010): n is a, c, g, or t
ggaatcagaagtcgtcctgctcgcaacaaaaaaaatggcaagaggattgaagaagcatctgaagaggctcaatgcccccaagcattgggatcttgacaaacttggtggtgccttcgctcccaagccctcttctggaccccacaagtctagagaatgccttcctctcgtcctgatcatcaggaacaagttgaagtacgctttgacataccgtgaagtcatctccatcttgatgcaaaggcatatccaagtcgatggtaaagtcaggactgacaagacttaccctgccggcttcatggatgttgtctccatccccaagacgaatgagaacttccgtcttctctatgacaccaagggacgtttccgtctccactccatcagggatgaggaagctaagttcaagctttgcaaggttaggacgatccagctagggcaaaagggaatccctttcctcaacacatacgacggtcgcaccatccgttaccccgacccactcatcaaaccgaacgacacaatcaagctcgacctcgaggagaacaaggtcgtggacttcatcaagttcgacgtcggcaacgttgtgatggtgactggagggagaaacagagggcgtgtgggtgtgattaagaaccgtgagaagcataagggaagctttgagacgatccacattcaagattcaaccggacatgagtttgccacgaggttgggcaatgtgtttaccttggggaaagggacgaagccgtgggtgtctcttccgaaggggaaaggtattaagcttaccatcattgaggaagctaggaagaggctctctgctcaacaagctgcttaaaaaaaaattattaccaaaggatgtttcgttttactactcgctacttgtctgtgttttgaggtttttttcccctttcatgttgcttgcaaaactctattacaagacagtttaagtttccagtagtgtgttttgtattgaaattttagtaattttactctttaaatctgttgacttgatattaaaaccn

SEQ ID NO: 4332 - DNA, 1044 bp, Brassica rapa
tttccttttcatatataaacgtagagtaagtgccgccgcaaaaataatcacaagtcgtcctgctcgcaacaaaaatggcaagaggattgaagaagcatctgaagaggctcaatgcacccaagcattgggatcttgacaaacttggtggtgccttcgctcccaagccctcttccggacctcacaagtctagagaatgccttcctctcgtcctgatcatcaggaacaagttgaagtacgctttgacataccgtgaagtcatctccatcctcatgcaaaggcatatccaagtcgatggtaaagtcaggactgacaaaacttaccctgctggcttcatggatgttgtctctatccctaagacgaatgagaacttccgtcttctctacgacaccaagggacgtttccgtctccactccgtcagggatgaggaagctaagttcaagctttgcaaggttaggacgatccagttagggcaaaagggaatcccctacctcaacacttacgacggtcgcacaatccgttaccccgacccactcatcaaacccaacgacaccatcaagctcgacctcgaggagaacaaggttgtggacttcatcaagttcgacgtcggcaacgttgtgatggtgactggagggagaaacagagggcgtgttggtgtgattaagaaccgtgagaagcataagggaagctttgagacgatccacattcaagattcaaccggacatgagtttgccacgaggttgggcaatgtgtttaccttggggaaaggaactaagccgtgggtgtctctacctaaggggaaaggtattaagcttaccatcattgaggaagctaggaagaggctctctgctcaacaagctgcttaaaaaaatttattaccaaaggctgtttggttttttactcttgtgtcttagactcgctacttgtctgtgttttgagatttttttcctctttcatgttgcttgcaaaactctattacaagacagtttaagtttccagtagagtgttttgtattgaaattttagtaattttactcttaatcgccgc

SEQ ID NO: 4333 - DNA, 1032 bp, Brassica napus
gtcctgctcgcaacaaaaatggcaagaggattgaagaagcatctgaagaggctcaatgcccccaagcattgggatcttgacaaacttggtggtgccttcgctcccaagccctcttccggacctcacaagtctagagaatgccttcctctcgtcctgatcatcaggaacaagttgaagtacgctttgacataccgtgaagtcatctccatcctcatgcaaaggcatatccaagtcgatggtaaagtcaggactgacaagacttaccctgctggcttcatggatgttgtctccatccccaagacgaatgagaacttccgtcttctctacgacaccaagggacgtttccgtctccactccgtcagggatgaggaagctaagttcaagctttgcaaggttaggacgatccagttagggcaaaagggaatcccctacctcaacacttacgacggtcgcacaatccgttaccccgacccactcatcaaacccaacgacaccatcaagctcgacctcgaggagaacaaggttgtggacttcatcaagttcgacgtcggcaacgttgtgatggtgactggagggagaaacagagggcgtgttggtgtgattaagaaccgtgagaagcataagggaagctttgagacgatccacattcaagattcaaccggacatgagtttgccacgaggttgggcaatgtgtttaccttggggaaaggaactaagccgtgggtgtctctacctaaggggaaaggtattaagcttaccatcattgaggaagctaggaagaggctctctgctcaacaagctgcttaaaaaatttattaccaaaggctgtttggtttttactcttgtgtcttagactcgctacttgtctgtgttttgagatttttttcctctttcatgttgcttgcaaaactctattacaagacagtttaagtttccagtagagtgttttgtattgaaattttagtaattttactctacgaaaaaaaaaaaactagtagactacgcgaacggacgacacacgggaggtaggag

SEQ ID NO: 4334 - DNA, 1099 bp, Centaurea maculosa
cgcgggggttatcgccggaagcttagaagaagaagaccagcggcagagagaaggagagcagtccagccggagaattccaccggagattaacatctcctctaacacacagcagccatggctagaggtttgaagaaacatatgaagaggctcaatgcccctaagcattggatgcttgacaaacttggtggtgcttttgctcccaagccatcctctggaccacacaaatctagagaatgcttgcctttgattctcatcctccgaaataggttgaagtatgcccttacataccgtgaggttatctctatcttgatgcaaaggcatgtgcttgtcgacaacaaagttaggaccgacaagacctacccagctggttttatggatgttgtttctattccaaagactaatgagaacttccgtctcctatacgataccaaaggtagattcaggctacactcaatcagggacgaggaagcaaagttcaagctatgcaaggttcgttctgtccagtttggttcaaagggcattccttacataaacacatacgatggtcgaaccatccgttacccagacccactcattaaggctaacgacaccattaagctcgatttggaatcaaacaagattgtcgatttcatcaagtttgatgtgggaaatgtcgttatggttaccggtggacgaaacactggccgtgttggtatcctaaagaacagggaaaagcataagggcagcttcgagaccgttcacattcaggacgctaccgggcatgagtttgccacacgtttggggaacgtgttcacggtggggaagggtacaaagccgtgggtgtctcttcccaagggtaagggtatcaagttaaccatcatcgaggaggctaggaagaggcgggccggccaagaccctgttgcctagatcgcgtgattttagtgttcttttcttgcaggtttgttggaagtgttcttttttacttggttatcattatggtacaattttgaacctatatggttttgactctatgagttatgctagactcttgttggttaaatttgattacagaatggttataacttttgtttaaatgcattatgaacccctcgttatctcc

SEQ ID NO: 4335 - DNA, 1170 bp, Cirsium arvense
gttcagccggagaattccaccggagatttagatctcctctaagacaccgtagccatggcgagaggtttgaagaaacatatgaagaggctcaatgcgcctaagcattggatgcttgacaaacttggtggtgcttttgctcccaaaccatcctcaggaccacacaaatctagagaatgcttgcctttgattctcattctccgaaataggttgaagtatgcccttacgtaccgtgaggtcatctctatcttgatgcaaaggcatgtgcttgtcgacaacaaagtcaggaccgacaagacctacccagctggttttatggatgttgtttctatcccaaagactaatgagaacttccgtctcctatacgataccaaaggtagattcaggctacactcaatcagggacgaggaagcaaagttcaagctatgcaaggttcgttctgtccagtttggttcaaagggcattccgtacatcaacacatacgatggtcgaaccatccgttacccagacccactcattaaggccaacgacaccattaagcttgatttggaatcaaacaagattgttgatttcatcaagtttgatgtgggaaatgtcgttatggttactggtggacgaaacactggccgtgttggaattctaaagaacagggaaaagcacaagggcagcttcgagaccgttcacattcaggacgctaccggccatgagtttgccacacgtttagggaacgtgttcacggtgggaaagggtacaaagccgtgggtgtctcttcccaagggtaagggtatcaaattaaccatcatcgaggaggctaggaagaggcgggctggccaagaccctgttgcctagatcgcatgattttagtgttctgttcttgcaggttcgtgggaagtgttcttttttacttgcttatcgttatggtacaattttgaacctatatggttttgattctacaacttatgctagactcttgttggttactttgattacagaatggttataacttttgtttaaatgcattatgaaccccttgttattttctgatgcttagataattagtctacactatagcattaggatttttttagttccatcaaagtaggttcagtatgcaacatattatattaagtgttaattggttaagagccgatattatcacttatctgtaaaact

SEQ ID NO: 4336 - DNA, 985 bp, Cirsium arvense
atcagcccgaaggaagattgcagtttgcaggtagcgccgtagcggtgagaagaaggagcagtggtccagccggagatttagattacctcccgtagcagcagccatggctagaggtttgaagaaacatatgaagaggctcaatgcgcctaagcattggatgcttgacaaacttggtggtgcttttgctcccaaaccatcctcaggaccacacaaatcgagagaatgcttgcctttgattctcatcctccgaaataggttgaagtatgcccttacgtaccgtgaggtcatttctatcttgatgcaaaggcatgtgcttgtcgacaacaaggtcaggaccgacaagacctacccagctggttttatggatgttgtttctattccaaagacgaatgagaacttccgtctcctctacgataccaaaggtagattcaggctacactcaatcagggacgaggaagcaaagttcaagctatgcaaggttcgttccgtccagtttggttcgaagggcattccttacatcaacacatacgatggtcgaaccatccgttacccagacccacttattaaggctaacgacaccattaagcttgatctggaatcaaacaagattgttgatttcatcaagtttgatgtgggaaatgtcgttatggttactggtggacgaaacactggccgtgttggaattctaaagaacagggaaaagcataagggcagcttcgagaccgttcacattcaggacgctaccggccatgaatttgccacacgtttagggaacgtgttcacggtgggaaagggtacaaagccatgggtatctcttcctaagggtaagggtatcaagttgaccatcatcgaggaggctaggaagaggcgggctggccaagaccctgttgcgtagatcgtgtgattttagtgttctgttctacttgcttattgttatggtacaattttgaatctatggttttgattctacaagttatgttagact

SEQ ID NO: 4337 - DNA, 2629 bp, Cirsium arvense
ggggtgcggcagtaagaagaaggagcagtcggtagtccagccggagatttggatttcctcccgtagcagcagccatggcgagaggtttgaagaaacatatgaagaggctcaatgcgcctaagcattggatgcttgacaaacttggtggtgcttttgctcccaaaccatcctcaggaccacacaaatccagagaatgcttgcctttgattctcatcctccgaaatcggttgaagtatgcccttacgtaccgtgaggtcatttctatcttgatgcaaaggcatgtgcttgtcgacaacaaggtcaggaccgacaagacctacccagctggttttatggatgttgtttctattccaaagactaatgagaacttccgtctcctctacgataccaaaggtagattcaggctacactcaatcagggatgaggaagcaaagttcaagctatgcaaggttcgttccgtccagtttggttcaaagggcattccttatatcaacacatacgatggtcgaaccatccgttacccagacccactcattaaggccaacgacaccattaagcttgatttggaatcaaacaagattgttgatttcatcaagtttgatgtgggaaatgtcgttatggttactggtggacgaaacactggccgtgttggaattctaaagaacagggaaaagcataagggcagcttcgagaccgttcacattcaggacgctaccggccatgagttcgccacacgtttggggaacgtgttcacggtgggaaagggtacaaagccgtgggtgtctcttcccaagggtaagggtatcaagttaaccatcatcgaggaggctaggaagaggcgggctggccaagatcctgttgcctagatcgtgtgattttagtgttttgttctacttgcttattgttatggtacaattttgaatctatggttttgattctacaagttatgttagactcttgttggttaatttgattacaaaatggttataacttttgtttgaatgcattatgaacccctcggtacttttttcttttttcttttctatgtgaagcagacgttgaagatgtctgtctgcaaacatccgctcttgaaaaccacactccacaacagctgcagagggtgaactctaaaatttcatgtaaaatgagggtgtcaactacttgtctgaatgtcctcttttagccttgcggcgtgaatggctgtgcggcttgccatttctatggggcttcttagcctttccaaaaaagatcaccgataaggttctgaacaaaatgatgaaaggcagtacaaacaccgcagaggcggcaaaccatataagctccttggtggcaagagatctcgtaaattcatgccttttcagtgattcttcaacgctgccttgaacctgattatggtatttcgttgcagattcaagaaacttcccatacactatgactgcctcttttgtgtagggttccaaacactctcgtcccttatcaaggtgcggctttgttgcaacagcaatctgatcaatgtatggctcgcagaacttctttgcaacctgaaaatgagggtgtacaacttcctttattttaaccacatggggagttagaacctcctttgattgaacataaacctttgtggtcctttcggtcagtaatttcacatgtggctcaacattagttatgactaccgcccattgttcctttgcagcagggacccacttagttttgatcgtctccatatgaggttcagcccacttttcggcttgtgccttcttctccaaagccttcaatgtgaaagcatcaagagcaggtttcccatgaactttccaacgagtttccacaaaagactgacaacaagacacgtggcctgcaacccatggtggtaaccatgcagaatgaacctttgtgagttcttgaattctgagtgaagcttcatccttggtcttcataagttcctcctcagcaactttaagagcacgctcggttttaagaagttttgacttctgttcttcaattgtttgttgaagattctgaagctttggatttatatcgagcatctgcttctccaactcttgtgatcgagtttctaacgcttcccttaacttagtcttttggtccacttccaattgaagtttcgccacctgcttttccaactcctgagttcgtgcattagccttctcgatctcctccttagcatcggatgaccctttaaccttaagagaagctatctcactttgcaataaagcaacactatccaacttctctttaatcaaaccctccttctctgcaatcaccttctctttcccagctattatctcatctctgcttctcaattcctcactcttcttctcaacaagtgattcaagtgattggatcttagatgtgagcttatccaattcggattgatccgatccgactgcaactccatctagggaatcatccgatctaatctgagtcgaaattagggcaaaaaagagggaaagcaagaggagacgatgaagaaggtttgagaccgccatggaatggatttgattactactacagaatgaatggaacagatgatttagggttgttgttaatgggttgtggaatccgtcggacaataaatgggtagttgggagtagggtaaagggagagagaagaa

SEQ ID NO: 4338 - DNA, 1195 bp, Cirsium arvense
aatttgttattttgttcataacctagactagattatcaactatagcttagattatctttgccaaacaaaggctaagaagattgtagggagttgcagagagaaggagcagtccagccggagatttagaagacaccgtagccatggctagaggtttgaagaaacatatgaagaggctcaatgcgcctaagcattggatgcttgacaaacttggtggtgcttttgctcccaagccatcatcaggaccacacaaatctagggaatgcttgcctttgattctcatcctccgaaataggttgaagtatgcccttacataccgtgaggtgatttctattttgatgcaaaggcatgtgcttgtcgacaacaaagtcaggactgacaagacctacccagctggtttcatggatgttgtttctattccaaagactaatgagaacttccgtctcctatacgataccaaaggtagattcaggctacactcaatcagggacgaggaagcaaagttcaagctatgcaaggttcgttccgtccagtttggttcaaagggcattccttacatcaacacatatgatggtcgaaccatccgttacccagacccactcattaaggccaacgacaccattaagcttgatttggaatcaaacaagattgttgatttcatcaagtttgacgtgggaaatgtcgttatggttactggtggacgaaacactggccgtgttggaattctaaagaacagggaaaagcataagggcagcttcgagaccgttcacattcaggacgctaccggccatgagttcgccacacgtttggggaacgtgttcacggtgggaaagggtacaaagccgtgggtgtctcttcccaagggtaagggtatcaaattaaccatcatcgaggaggctaggaagaggcgggctggccaagaccctgttgcctagatcgcatgattttagtgttctgttcttgcaggttcgtgggaagtgttcttctttacttggttatcgttatggtacaattttgaacctatggttttgattctacaagttatgctagactcttgttggttaatttgataacagaatggttataacttttgtttaaatgcattatgaaccccttgttattttctgatgcttagataattagtctacactatagcattaggatttttttagtcaaaaagaaaaaagtaccgactgcg

SEQ ID NO: 4339 - DNA, 963 bp, Euphorbia peplus
tgcggaggctgagagcagctagggtttgagaggaatttcaggcgagtgaatccggagctactgcaacaggatggcgagaggattgaagaagcatcagaagaggctcaatgccccaaagcattggatgcttggcaaacttggtggtgcttttgctcccaagccatcatctggacctcacaagtctcgtgagtgcttgccattgatcctgattctgcgagacagattgaagtatgccctcacatatcgtgaagttgtttctattctgatgcagcgacacattcttgttgatgggaaggttaggacggataaaacatatccgtctggtttcatggatgttttgtcaattccaaagacaaacgaaaacttccgccttctttatgataccaaaggtcggtttcgcctacacgcaatcagagatgatgaggctaagtttaagctctgcaaagtccgatctattcaatttggtcagaagggtatcccatacctgaacacatatgatggtcgtactatccgctacccagatcccctcatcaaggctaatgacaccatcaagcttgacttggagacaaacaagatcactgaatttatcaagtttgatgttggtaatgttgtcatggtcactggaggcaggaacagaggaagagtcggagtgcttaagaacagggaaaagcataagggaagttttgaaactgttcacatccaagatgcaactggccatgagtttgctacccgtttggctaatgtcttcaccatcggtaaaggtaccaagccatgggtttctcttcctaagggcaagggtattaagctgactatcatcgaggaggctaggaaaaagcaagctgcagctcaggcagctgcttaagcagttgaattttaatattggaagttttgttgaacacatgtgatgagagatagttggtttgtttttaggtgcatggatttctgaaatgtttgtttttattc

SEQ ID NO: 4340 - DNA, 1078 bp, Flaveria ramosissima
gtggtgcggctgtgaatcgtagaggaagccaaagactttcgccggagatttagatctcccaccggacacagcaaccatggctagaggtttgaagaaacatctgaagaggctcaatgcccccaagcattggatgcttgacaaacttggtggtgcttttgctcctaaaccatcatctggcccacacaaatctagggaatgtttgcctttgatcctcatattgaggaacaggttgaagtatgcattgacataccgtgaggtacaatctatcttgatgcagcgtcatgtccttgttgacaacaaggtcaggactgacaagacctaccccgctggtttcatggatgttgtttctatccctaagaccaatgaaaacttccgtcttctttatgatacaaaaggaagattcagattgcactcgatcagagatgaggagtcaaagtttaagttgtgcaaggttcgttcagttcagtttggttcaaagggcattccatacatcaacacctatgatggtcgaaccatccgctacccggacccactcatcaaagccaatgacaccattaagcttgatctagactcaaacaagatcgttgatttcatcaaatttgatgttggaaatgttgttatggtaactggtggaagaaacaggggccgtgttggaatccttaagaacagggaaaagcataagggcagctttgaaacagttcacattcaagatgctttgggccatgagtttgccacccgtttgggtaatgtttttaccatcggaaagggttcaaaaccatgggtttctttacccaagggcaagggtatcaagctaaccatcattgaagaggctaggaagaggcaggctgctcaagaatctgctgcttagattgtgtttggttatagagactctggtgttctgtttttgatttcaggttggtgggaagtttcttcctgcttttattttggtacaattttgaacttatgttttgatgctggttaatttgttataaattgtgaacttctgtttcaaaaaaaaaaaaaaaaagaaaatctggtgtgacacggtataggggtacgtagaggggcgtgggagagg

SEQ ID NO: 4341 - DNA, 962 bp, Flaveria ramosissima
catggctagaggtttgaagaaacatttgaagaggctcaatgcccccaagcattggatgcttgacaaacttggtggtgcttttgctcctaaaccatcatctgggccacacaaatctagggaatgcttgcctttgatcctcatactgaggaataggttgaagtatgctttgacataccgtgaggtacaatctattttgatgcagcgtcatgtacttgttgacaacaaggtcaggactgacaagacctaccctgctggattcatggatgttgtttctatccccaagaccaatgaaaatttccgtcttctttatgatactaaaggaagattcagattgcactcaatcagagatgaggagtcaaagtttaagctgtgcaaggttcgttctgttcagtttggttcaaagggcattccatacatcaacacctatgatggtcgaaccatccgctacccggacccactcatcaaagccaatgacaccattaagcttgatctagactcaaacaagattgttgatttcatcaaatttgatgttggaaatgttgttatggtaactggtggaagaaacaggggtcgggttggtatccttaaaaacagggaaaagcataagggcagctttgaaacagttcacattcaagatgctttgggccatgagtttgccacccgtttgggtaatgtttttaccattggaaagggttcaaagccatgggtttctttacccaagggtaagggtatcaagttaaccatcattgaagaggctaggaagaggcaggctgcccaagaatctgctgcttagattgtgtttggttatagagactctggtttttttgtttttgatttcaggttggtgggaagtttcttcctgcttttcttttggtacaattttgaacctatgttttgatgctggttaatttgttataaatttgtgtaacttttgtacttactaaaagttctttaatacgtta

SEQ ID NO: 4342 - DNA, 975 bp, Flaveria ramosissima
gtacgcgggggacggacagctgaagaagattgtgggggtgcggctgtgaatcgtagaggaagccgaagactttcgccggagatttagatctcccaccggacaccgcaaccatggctagaggtttgaagaaacatctgaagaggctcaatgcccccaagcattggatgcttgacaaacttggtggtgcttttgctcctaaaccatcatctgggccacacaaatctagggaatgcttgcctttgatcctcatattgaggaacaggttgaagtatgctttgacataccgtgaggtacaatctattttgatgcagcgtcatgttcttgttgacaacaaggtcaggaccgacaagacctatcctgctggattcatggatgttgtttctatccctaagaccaatgaaaacttccgtcttctttatgatacaaaaggaagatttagattgcactcgatcagagatgaggagtcaaagtttaagctgtgcaaggttcgttctgtccaatttggttcaaagggcattccatacatcaacacctatgatggtcgaaccatccgctacccagacccactcatcaaagccaatgacaccattaagcttgatctagactcaaacaagatcgttgatttcatcaaatttgatgttggaaatgttgttatggtgactggtggaagaaacaggggtcgggttggaatccttaaaaacagggaaaagcataagggcagctttgaaacagttcacattcaagatgctttgggccatgagtttgccacccgtttgggtaatgtttttacaattggaaagggttcaaagccatgggtttctttacccaagggtaagggtatcaagttaaccatcattgaagaggctaggaagaggcaggctgcccaagaatctgctgcttagattatgtttggttatagagactctggtgttttgtttttgatttcaggttggtgggaagtttcttcctgctttt

SEQ ID NO: 4343 - DNA, 981 bp, Flaveria ramosissima
agattgtggtggtgcggctgtgaatcgtagaggaagccgaagactttcgccggagatttagatctcccaccgacaccgcaaccatggctagaggtttgaagaaacatctgaagaggctcaatgcccccaagcattggatgcttgacaaacttggtggtgcttttgctcctaaaccatcatctgggccacacaaatctagggaatgcttgcctttgatcctcatattgaggaacaggttgaagtatgctttgacataccgtgaggtacaatctattttgatgcagcgtcatgttcttgttgacaacaaggtcaggaccgacaagacctatcctgctggattcatggatgttgtttctatcccaaagaccaatgaaaacttccgtcttctttatgatacaaaaggaagatttagattgcactcaatcagagatgaggagtcaaagtttaagctgtgcaaggttcgttctgtccaatttggttcaaagggcattccatacatcaacacctatgatggtcgaaccatccgctacccagacccactcatcaaagccaatgacaccattaagcttgatctagactcaaacaagatcgttgatttcatcaaatttgatgttggaaatgttgttatggtgactggtggaagaaacaggggtcgggttggaatccttaaaaacagggaaaagcataagggcagctttgaaacagttcacattcaagatgctttgggccatgagtttgccacccgtttgggtaatgtttttaccattggaaagggttcaaagccatgggtttctttacccaagggtaagggtatcaagctaactatcatcgaagaggctaggaagaggcaggctgcccaagaatctgctgcttagattgtgtttggttatagagacactggtgttttgtttttgatttcaggttggtgggaagtttcttcctgctttttctttgttacaattttgaacctatgttttgatg

SEQ ID NO: 4344 - DNA, 945 bp, Flaveria ramosissima
ggggtgcggctgtgaagtgtagaggaagccgaagactttcgccggacaccgcaaccatggctagaggtttgaagaaacatttgaagaggctcaatgcccccaagcactggatgcttgacaaacttggtggcgcttttgctccgaaaccatcatctgggccacacaaatctagggaatgcttgcctttgatcctcatcctgaggaataggttgaagtatgctttgacataccgtgaggtacaatctattttgatgcagcgtcatgttcttgttgacaacaaggtcaggactgacaagacctacccagctggattcatggatgttgtttctatccctaagaccaatgaaaactttcgtcttctttatgatacaaaaggaagattcagattgcactcaatcagagatgaggagtcaaagtttaagctgtgcaaggttcgatctgttcaatttggttcaaagggcattccatacatcaacacctatgatggtcgaaccatccgctacccagacccacttatcaaagccaatgacaccattaagcttgatttagactcaaacaagattgttgatttcatcaaatttgatgttggaaatgttgttatggtgactggtggaagaaacaggggtcgggttggtatccttaaaaacagggaaaagcataagggcagctttgaaacagttcacattcaagatgctttgggccatgagtttgccacccgtttgggtaatgtttttactattggaaagggttctaaaccatgggtttctctacccaagggtaagggtatcaagttaaccatcattgaagaggctaggaagaggcaggctgctcaagaatctgctgcttagattgtgtttggttatagagactatggtgttttgttttgtatttcaggttggggggaagtttcttcctgcttttattttggtacaattttgtaacctt

SEQ ID NO: 4345 - DNA, 1017 bp, Lactuca sativa
cggcggggcttgatttagaaatcgcttcgggtgcggcatcgagttgcagagaagtggcgaggagagtagcaggctagccgaaaattcaaccggagatttagatctcccgccggacaccgcaaccatggctcgaggattaaagaaacacatgaagaggctcaatgcccctaagcattggatgcttgacaaacttggtggtgcttttgctcctaaaccatcgtctggaccccacaaatcccgtgaatgtttgcccttgatccttatccttcgtaacaggttgaaatatgcattgacatatcgtgaggttcaatctattttaatgcaacgacatgttcttgttgacaacaaagttagaactgacaaaacatatccagctggattcatggatgttgtttctatccctaaaaccaatgaaaacttccgtcttctttatgacacaaaaggtcgattcagactgcattcagttagagatgaagaagctaagtttaaattgtgcaaggtaagatcagtccaatttgggtcaaaggggattccctacatcaacacatatgatggaagaacaattcgttacccggacccactaatcaaagccaacgacacaatcaaactcgacctcgactcaaacaaaatcgtggatttcatcaaattcgatgttggaaatgttgtcatggtgacaggtggcagaaacacagggcgtgttgggattcttaagaacagggagaaacataaggggagttttgaaactgttcatattcaagattcaactggacatgaatttgctactcgtttggggaatgtgtttactcttggaaaagggtcaaagccttgggtgtctttgcctaagggaaagggtattaagttgactatcattgaggaggctaggaaaagaagagctgctcaagatgctgttgcttaagttttggtttggtttttatgtttttgttttcttgaaagaggttttgaaagtatgtttttgtgttacaagttaatgaaagtatggtttagggctatatgaga

SEQ ID NO: 4346 - DNA, 1169 bp, Solanum tuberosum
acacacgcctatcgccggtagccgtcactcgtggcagctaatcagtcggaaaaccgccaaaatggcaagagggttgaagaaacatttgaagaggctcaatgcgcctaagcattggatgcttgataaacttggaggtgcttttgctcccaagccttcttctggtccacataaatcaagggaatgtttgccattggttattatcctcaggaacaggttgaaatatgctttgacataccgtgaggtcatttctatcttgatgcaacgccaagttatggttgatgggaaagttaggacagataagacttaccctgccggtttcatggatgttgttactattccaaagacaaatgagagtttccgacttctttatgacactaagggtcggttccgtctccactcactcagagatgaggaggccaagttcaaactttgtaaggttcgatcagtgcagtttggacagaaggggatcccatatctcaacacttatgatggaagaacaatccgctaccctgatcccctcatcaaggccaatgacaccatcaagcttgacttagattccaataagattgttgacttcatcaaatttgatgttggaaatgtggtcatggttactggtggtagaaacagggggcgtgttggaattcttaagaacagagagaagcacaagggtagctttgagacagttcacattcaggattccctggggcatgagtttgctacccgtttgggaaatgtgttcactcttggtaaaggtagtaagccatgggtgtctctacctaagggtaaaggtatcaagttatctatcattgaagaggctcgcaagaggatggctactcaatcagctacaactgcttaaaaatgatagcttgaacttgtgataaatttaacaggttgggccatgtttctctttgtttagagagataccaatcttattctgtatgttggattttaacatttttgtactcggtaccgtttaactttgttttgttgggaaaagaggttgactgagtttaagatcattcatttgctttttatgtgatagtgttttgttggtcgcttagtttaattgccttggccatgagattattcatttatttcaaaatgagattttggttataaaattttcaaatccaacctggagttggatttcaagttttgtttagtactct

SEQ ID NO: 4347 - DNA, 1065 bp, Raphanus sativus
ttttttctttgggtatatataaaacgtaaaggaagtgccgccgcagaagaatcacaaatcctccggctcccatcacctgcaaacatggcgagaggattgaagaagcatctgaagaggctcaatgctcccaagcattggatgcttgacaaacttggtggcgccttcgcccccaagccgtcttctggaccacacaagtcgagggagtgccttcctcttgtcctgatcatcaggaacaggttgaagtacgctttgacataccgtgaagtcatctccatcctcatgcaaaggcatatccaagttgatggaaaagtcaggactgacaagacttaccctgctggtttcatggatgttgtctctatccccaagacgaatgagaacttccgtcttctgtatgacaccaagggacgtttccgtctccactccatcagggacgaggaagctaagttcaagctttgcaaggttaggactatcagtttggggcagaaggggatcccttacctcaacacttacgatggccgcaccatccgttaccccgacccgctcatcaagccgaacgacaccatcaagctagacctcgaggagaacaaggttgtggagttcatcaagttcgacgttggcaacgttgtgatggtgactgggggtagaaacagagggcgtgtgggtgtgatcaagaaccgtgagaagcacaagggaagctttgagacgatccacattcaagactcgactgggcatgagtttgcaacgaggttggggaatgtgtttactctcgggaaagggacgaagccgtgggtgtctcttcccaagggtaaaggtatcaagcttaccatcattgaggaagctagaaagaggctttctggtcaacaagctgcttaaaaatataattatcgttgaaggatatgtttcgttttactcttgtgttgtagactcgctacttgtctcggtttgtaggttttttcctctttttatgttgcttgtttgcaaaacctattacaagacagttttaagactccagtagagcgtttttgtatggaaatttttagtaattttactctttaaatctgttga

SEQ ID NO: 4348 - DNA, 1084 bp, Raphanus sativus
ggcctctcacaacttcaccagtcgttcggagctaaacgaaagaagtggtcttcatcggagttacgctcgcaaactccaaacatggcgagaggtttgaagaagcatttgaagaggctcaatgcccctcaccattggagccttgacaaacttggtggtgcttttgcccccaagccatcttctggaccccacaagtcgagggagtgccttcccctcgttcttatcatcaggaacaggttgaagtatgctcttacctaccgtgaagtcatctccatcttgatgcaaaggcatatccaagttgatggcaaagtcaggactgacaagacctaccctgctggtttcatggatgttgtctctatccccaagactaacgagaacttccgtctcctctatgataccaagggacgtttccgtctccactccctcagggacgaggaagccaagtttaagctgtgcaaagtccgaactatccagttaggacagaagggcattccttacctgaacacatacgatggtcgcaccatccgttaccctgacccactcatcaagcctaatgacaccatcaagctcgacctggaggagaacaaggttgtggacttcatcaagtttgatgtcggcaatgttgtgatggtgactggaggaagaaacagagggcgtgttggtgtgattaagaaccgtgagaagcataagggaagctttgagactatccacatccaagactctacaggacatgagtttgcaactaggttgggaaacgtcttcaccctcggcaaaggaactaagccatgggtttctcttcctaagggtaaaggtattaagttgaccatcatcgaggaagccaggaagaggctcgctggccaacaggctgcttaattttgttgtgttttcagtgcttttgttgtgtcgttttagatgacttttgtttctttagactcactttgcatcttttggtttcgttactcggttttgaaacttgtgttattttatattcaagagttttaaaatacatgatctagcaaaacatgttggatcaataatagccatgggcttttattaataatgtgaataaaaatggcattgggcttca

SEQ ID NO: 4349 - DNA, 1088 bp, Raphanus sativus
ggatctttctttctttgggtatatatataaaacgtagaggaagtgccgccgcagaagaatcacaagtcctccggctcgcaacacctgcaaacatggcaagaggattgaagaagcatctgaagaggctcaatgctcccaagcattggatgcttgacaaacttggtggcgccttcgcccccaagccgtcttctggacctcacaagtcgagggagtgtcttccacttgtcctgatcatcaggaacaggctgaagtatgctttgacataccgtgaagtcatctccatcctgatgcaaaggcatatccaagtcgatggaaaagtcaggactgacaagacttaccctgctggtttcatggatgttgtctctatccccaagacgaatgagaacttccgtcttctgtatgacaccaagggacgtttccgtctccactccgtcagggacgaggaagctaagttcaagctttgcaaggtcaggactatcagtttggggaagaagggaatcccttacctcaacacatacgatggccgcaccatccgttaccccgacccgctcatcaagccaaacgacaccatcaagctagacctggaggagaacaaggttgtggacttcatcaagttcgacgttggcaacgttgtgatggtgactgggggtagaaacagagggcgtgtgggtgtgatcaagaaccgtgagaagcacaagggaagctttgagacgattcacattcaagactcgactgggcatgagtttgcaacgaggttgggcaatgtgtttactctcgggaaagggacgaagccgtgggtgtctcttcccaagggtaaaggtatcaagcttaccatcattgaggaagctagaaagaggctttctgctcaacaagctgcttaaaaaattaattatcgttgaaggatatgtttcgttttactcttgtgttgtagactcgctacttgtctcggtttggaggttttttcctctttttatgttgcttgtttgcagaacctattacaagacagttttaagactccagtagagtgttttgtatggaaatttttagtaattttactctttagatctgttaactttattttaaaacca

SEQ ID NO: 4350 - DNA, 1084 bp, Silene vulgaris
gcagccgaatgaattgtagcagctccaaacctcgccctcctccactctgatcttatttctcctttgattccaacttcatcttcaacctcaacatcatggcgagaggcttgaagaagcatttgaagaggctcaatgcgcccaagcattggatgcttgacaaacttggtggtgcttttgctcccaagccatcatccggaccacacaaagccagggagtgtttgccccttatccttatcttgcgtaacaggttgaagtatgctcttgtttaccgtgaagtcattgccattctcatgcaacgccaaatcatggttgatggaaaggtcaggactgacaagacttacccagctggcttcatggatgttatttccattcctaaaacaaacgagagcttccgcctgctgtatgatgttaagggtcgcttcagacttcactcaatcagagacgatgaggctaagttcaagctctgcaaggtccgcaacgtgcaatttggcaacaagggtatcccatacctcaacacttatgatggaaggaccatccgctacccagacccacttatcaaggcaaatgataccatcaagcttgaccttgaagagaacaagattgttgagtttgtcaagtttgatgtaggtaatgtggtcatggtaactggaggtagaaacagaggtcgtgttggagtgatcaagaacagggagaagcacaagggaagctttgagacaatccacattcaggattcccagggtcacgagtttgccacgcgtatgggcaatgtgttcatcattggtaaaggtacaaagccatgggtttctcttcccaagggtaagggtattaagctgaccatcatcgaggaagcacgcaaaaggcaggcagagaagtcagcagctactgcttgattagttcagttcctatcatgttatttagaagtttggaagctctttttctttcaattagtaatcgcaacagagacccatgaagagttttatggattttggctagaaccttggaagctgtgtttgtttgaactcttttgttttatgatgaaaaccggtttgaatacatgtattcctttaatttgttttcggagcag

SEQ ID NO: 4351 - DNA, 974 bp, Helianthus annuus
cgcacttactcagaccaccgccgcacttttccaccggagacaccaccgatctcttacataccccgtcgcagccatggctcgtggattgaagaaacatatgaagaggcttaatgcgcctaagcattggatgcttgataaacttggtggtgcttttgctcctaaaccatcatctggacctcataaatcaagggagtgcttgcccttgattcttatattgaggaataggttgaagtatgctttgacataccgtgaggttcagtctattttgatgcagcgtcatgttcttgttgataacaaggtcaggactgataagacttaccctgctggtttcatggatgttgtctcaattcccaagaccaatgaaagcttccggcttttatacgacactaagggcaggttcagacttcactctatcagggacgaggaatcgaagttcaagctgtgcaaggttcgctcggtccagtttggttcaaaagggattccttacatcaacacctacgatggtcgaaccattcgttacccagatcctctcatcaaagctaacgacacaatcaaactagacttggaatcaaacaagattgttgatttcatcaagtttgatgttgggaatgtcgtgatggttaccggtggacgcaacactggtcgtgttggtatcctcaagaacagggaaaaacataagggaagcttcgagaccgttcacattcaggatgcaaccgggcatgagtttgctactcgtttgggaaatgtgttcactctcggaaagggttcaaagccgtgggtgtctctccctaagggcaagggtatcaagttgaccatcattgaagaggctaggaagaggcaagctgctgctgccgctgttgcttgattatgtattacaggcatcgtctttgcttgctttctgttttgtcgtgttaaatttatatgttagcacctgttttaattttggtacaattttgcaactttggatctgcatg

SEQ ID NO: 4352 - DNA, 1019 bp, Helianthus annuus
cagagggtgtcgcacttactcagaccaccgccgcacttttccaccggagacaccaccgatctcttacagaccccgtcgcagccatggctcgtggattgaagaaacatatgaagaggcttaatgcgcctaagcattggatgcttgataaacttggtggtgcttttgctcctaaaccatcatctggacctcataaatcaagggagtgcttgcccttgattcttatattgaggaataggttgaagtatgctttgacataccgtgaggttcagtctattttgatgcagcgtcatgttcttgttgataacaaggtcaggactgataagacttaccctgctggtttcatggatgttgtctcaattcccaagaccaatgaaagcttccggcttttatacgacaccaagggcaggttcagacttcactctatcagggacgaggaatcgaagttcaagctgtgcaaggttcgctcggtccagtttggttcaaaagggattccttacatcaacacctacgatggtcgaaccattcgttacccagatcctctcatcaaagctaacgacacaatcaaactagacttggaatcaaacaagattgttgatttcatcaagttcgatgttgggaatgtcgtgatggttaccggtggacgcaacactggtcgtgttggtatcctcaagaacagggaaaaacataagggaagcttcgagaccgttcacattcaggatgctaccgggcatgagtttgctactcgtttgggaaatgtgttcactctcggaaagggttcaaagccgtgggtgtctctccctaagggcaagggtatcaagttgaccatcattgaagaggccaggaagaggcaagctgctgctgccgctgttgcttgattatgtattacaggcatcgtctttgcttgctttctgttttgtcgtgttaaatttatatgttagcacctgttttaattttggtacaattttgcaactttggatctgcatgttaaggttagtatgattaagaattcgagacttttc

SEQ ID NO: 4353 - DNA, 996 bp, Helianthus annuus
ggctgtcaattgtagaagaatttcaccggagatttacatctcccgccggaaaccgcaaccatggctagaggtctcaagaagcacatgaagaggctcaatgccccaaagcattggatgcttgacaaactcggtggtgcttttgctcctaagccatcatccgggccacacaagtctagggaatgcctgcccttgatcctcattctgaggaacaggttgaagtatgctttgacataccgtgaggtacaatctattttgatgcagcgtcatgttcttgttgacaacaaggtcaggaccgacaagacttaccctgccggtttcatggatgttgtttctatccctaagaccaatgaaagcttccgtcttctttatgacaccaaaggtagattcaggttgcactcaatcagagacgaggagtcaaagtttaagttgtgcaaggttcgttcagtccagttcggttcaaagggcattccgtacatcaacacttatgacggtcgaaccatccgctacccagacccacttatcaaagccaacgacaccattaagctcgatctagaatcaaacaagatcgttgattttatcaagttcgacgttggaaatgtcgtcatggtaactggcggaagaaacacaggccgtgtcggaatcctcaagaacagagaaaaacataagggcagcttcgaaaccgttcacattcaagatgctaccggtcacgagtttgctactcgtttgggtaacgtgttcaccctcggaaagggttcgaaaccatgggtctctctacccaagggtaagggtatcaagttaaccatcattgaagaggctagaaagaggcaggctgcccaagaggctgctgcttagattgtgtttggtttcaaagattatggtggtatgtttttgatttcggtttgttgggaagtttttaactgcttttgttatggtacaattttgaacctatgttttgatgttgaattgttttggttataaatcggtaaacttttgctc

SEQ ID NO: 4354 - DNA, 968 bp, Thalictrum flavum
tcgaagaatcaaatcatggcgagaggattgaagaagcatttgaagaggctcaatgcccccaagcattggatgcttgataaacttggtggtgcttttgctcccaaaccctcatctggacctcacaaagccagggaatgtctgccattagcactgatccttaggaacagattgaaatatgcgcttacctatcgtgaggtcgttgctatcttgatgcaacgacatgtccttgttgatgcgaaagtcagaacagacaagacttaccctgctggatttatggatgttatttcaatccccaagacaaatgagaacttccgtcttctatatgatgccaaaggccgtttcaaaattcatgcaattaaggatgaagaagccaagttcaagctctgcaaggttcgctctgtgcagtttgggcagaagggaatcccatacctgaacacctatgatggtcgcacaatccgttatcctgatcctctcatccgggccaatgacaccatcaaaattgaccttgagaccaacaagatcattgatttcatcaagttcaatgttggtaatgttgtcatggtaactggtggtagtaacagagggcgtgttggagttatcaagagcagggaaaagcataagggtacttttgaaactattcatctccaggatgctactggtcatgagtatgctactcgtctaggcaatgtctttaccattggcaagggtacaaaaccatgggtctctcttcccaagggcaagggtatcaagctcactatcattgaagaggctaagaagagagcagctgctcaaggtgctgctacagcatagatttaaattgagtaaaggcatcagttttatttaaatgagtaccttaccttaggttgatttgtttatctgcttggcccaactgatgttcagactattttgcctgcatttttttatttggtactattttagtaaacatttatagttaattttggtttagg

SEQ ID NO: 4355 - DNA, 1074 bp, Triphysaria pusilla
cgagcagaaaacacaaagaggcgccgtcagcgtttcattccttcacttcttctacagccgagctagagagacccatcagcaaatatggcaagaggattgaagaagcacttgaagaggctcaatgcccccagccactggatgttggacaagcttggtggtgcctttgcacccaagccgtcatctggaccccacaaatccagggagtgcttgcccttgattcttattctgcgaaacaggctgaaatatgctctgacttaccgtgaggtcattgctattctgatgcaacgccacattcttgttgatggcaaggtcaggactgacaagacctatcctgctggatttatggatgttgtctctatcccaaagaccaatgagaatttccgtctcctttacgacaccaagggtcgtttccgtctccactctgtcagggatgaggaagccaagttcaagctgtgcaaggtacgaaatgtccagtttgggaagaagggtatcccctacatcaacacctatgatggaaggactatccgttacccagacccacttatcaaggccaacgacaccatcaagcttgaccttgagaccaacaaggttgttgacttcatcaagtttgatgtcggcaatgttgtcatggtgactggaggtagaaacaggggacgtgtcggtgtgatcaagaacagggagaagcagaagggaagctttgagaccatccatgtccaggatgccactggccatgagtttgctacccggttgagcaatgtgtacacaattggaaagggtacaaagccgtgggtatctcttccaaagggtaagggtattaagctgtctatcctcgaggaggctaagaagaggattgctgctcaatctgctactgcttaaaaaagtttgaaatgcttttcgagctatcatcttgaatgacttttgttagggtttttgtttgcatctgttataagcaatatttcttgaggaactatgtttgttcttatttggagttttgaatattattatcttgtttttgctaaattttattaagattcaagacttggaaatgttacttttggtggattttgctgcaag

SEQ ID NO: 4356 - DNA, 1070 bp, Triphysaria pusilla
aataccgccattagtgacggagacttcacagtccagcaagaaagagagagcgagcgccggcgtgtattcgatccaccagcaaaaatggcaagaggattgaagaaacacttgaagaggctcaatgcccccagtcactggatgttggacaagcttggcggtgcctttgcacccaagccatcatctggaccccacaaatccagggagtgcttgcccttgattcttattctgcgaaacaggctgaaatatgctcttacttaccgcgaggtcattgctattctgatgcaacgccacatccttgttgatggcaaggtcaggactgacaagacatatcctgctgggtttatggatgtggtctctatcccaaagaccaatgagaatttccgcctcctttatgacaccaagggccgattccgtctccactctgtcagggatgaggaagccaagtttaagctgtgcaaggttcgtaatgtccagttcgggaagaaaggtatcccgtacatcaacacctacgatggaaggactatccgctacccggacccactgatcaaggccaatgacaccatcaagcttgacctggagacaaacaaggtagttgacttcatcaagtttgatgtaggcaatgttgtaatggtgactggaggtaggaacaggggacgtgttggtgtgatcaagaaccgtgagaagcagaagggaagttttgagactatccatgtccaggacgctactgggcatgagtttgctacccgtttgagcaatgtgtacacaattggaaagggtaccaagccgtgggtatctcttcccaagggtaagggtattaagttgtctatcctcgaggaggctaagaagaggattgctgctcaatctgctacagcttagaaaagcatgcttttcggaattttgagccatcaccttcaattactttaggtgtttttacattgcatctgttttaagtatcgtggctactagaattcttctgttataggatgttttgagaaactatgtttgttttatttggatttttgaatattttatcttatttatgctaaaatacatttgagtaattgaattct

SEQ ID NO: 4357 - DNA, 1058 bp, Valeriana officinalis
aagagaggcgcagctttggagatactctgatctccttctaatcaacacaatatggctaggggtttgaagaagcatttgaagaggctcaatgccccaaagcattggatgcttgacaagcttggtggtgcttttgctcccaaaccatcgtctggtccccacaaggcaagggagtgccttccccttgttcttattcttcgaaacaggttgaagtatgcgctcacttaccgtgaggtccaatctatccttatgcagcgtcatgttcttgttgatggaaaagttaggactgataagacttatccttctggattcatggatgttgtgtcaatccccaagaccaatgaaaacttccgtctcctttatgataccaagggacgtttccgccttcactccatcagggacgaagagtccaagttcaagctatgcaaggtgaggtcagtacagttcggtagcaagggaatcccctacatcaacacctatgatggtcgcacgatccgttaccctgaccctctaattaaggcaaatgacaccatcaagtttgatctggaaacccagaaaatcactgatttcatcaaattcgatgttggcaatgttgtgatggttactggaggaagaaacagaggccgtgttggaattctcaagaacagagagaagcataagggaagtttcgagactgttcacattcaagatagtcttggccatgaatttgctactcgtttatccaatgtttacacgatcggcaaaggatctaaaccctgggtttcacttcctaagggcaagggtattaagttgaccatcattgaggaggccaagaagagacttgctgcccagtctgctgctactgcttaagggtaatattgtctttttatgaatgaaatgttgggttttgttcaacctttattatagattgttttggttttaaggttgtttgtttcaagtagttggatttatgttctttgtttcagtacaattttgaattttgaggtatttggaacctgttttcttttaattcatacattctgttattttaaatgatcattaaatctacatgttttgttatc

SEQ ID NO: 4358 - DNA, 1014 bp, Helianthus annuus
agtagattttggggctgcggctgtcaattgtagaagaatttcaccggagatttacatctcccaccggaaaccgcaaccatggctagaggtctcaagaagcacatgaagaggctcaatgctccaaagcattggatgcttgacaaactcggtggtgcttttgctcctaagccatcatccgggccacacaagtctagggaatgcctgcccttgatcctcattctgaggaacaggttgaagtatgctttgacataccgtgaggtacaatctattttgatgcagcgtcatgttcttgttgacaacaaggtcaggaccgacaagacttaccctgccggtttcatggatgttgtttctattcctaagaccaatgaaagcttccgtcttctttatgacaccaaaggtagattcaggttgcactcaatcagagacgaggagtcaaagtttaagttgtgcaaggttcgttcagtccagttcggttcaaagggcattccgtacatcaacacttatgacggtcgaaccatccgctacccagacccacttatcaaagccaacgacaccattaagctcgatctagaatcaaacaagatcgttgattttatcaagttcgacgttggaaatgtcgtcatggtaactggcggaagaaacacaggccgtgtcggaatcctcaagaacagagaaaaacataagggcagcttcgaaaccgttcacattcaagatgctaccggtcacgagtttgctactcgtttgggtaacgtgttcaccctcggaaagggttcgaaaccatgggtctctctacccaagggtaagggtatcaagttaaccatcattgaagaggctagaaagaggcaggctgcccaagaggctgctgcttagattgtgtttggtttcaaagattatggtggtatgtttttgatttcggtttgttgggaagtttttaactgcttttgttatggtacaattttgaacctatgttttgatgttgaattgttttggttataaatcggtaaacttttgctc

SEQ ID NO: 4359 - DNA, 1004 bp, Brassica rapa
ctctcacaaccttcaccactcgttcagagctaaacgagagaagccgtctggatcggcgctacgcacaggcgagaggtttaaagaagcatttgaagaggctcaatgcccctaagcattggatgcttgacaaacttggtggtgctttcgcccccaagccatcttctggaccacacaagtctagagagtgccttcctcttgttcttatcatcaggaacaggttgaagtatgctcttacttaccgtgaagtcatctccatcttgatgcaaaggcatatccaggttgatggcaaagtcaggactgacaagacctatcctgctggtttcatggatgttgtctctatccccaagactaacgagaacttccgtcttctctatgacaccaagggtcgtttccgtcttcactccatcagagatgaggaagcaaagtttaagctttgcaaggttcgaactatccaggtcggacagaagggcattccttacctcaacacatacgatggtcgtaccatccgttaccctgacccgttcatcaagcctaacgacaccatcaagctcgatcttgaggagaacaagattgttgagttcatcaagtttgatgtcggcaatgttgtcatggttaccggaggaagaaacagggggcgtgttggtgtgattaagaaccgtgagaagcataagggaagctttgagacaatccacatccaagactctacaggacatgagtttgcgacaaggttgggtaatgtgttcacccttggcaaaggaacaaagccgtgggtgtctcttcccaagggtaaaggtattaagcttaccatcattgaggaggccaagaagaggcttgctggtcaacaagctgcttgattttgtgattctccagctcgttattaagtcttcttagacgtcatatgttttcgtagactcgctttgcttctttttgttttggaacttgtgttattttctctgtttcaaggattcaacaaaaacttcaacatcacttgcccttttcttttg

SEQ ID NO: 4360 - DNA, 1044 bp, Eutrema parvulum
ttttttgtgaatttgcaggcaaggggattgaagaagcatctaaagaggctcaatgcccccaagcattggatgcttgacaaacttggtggtgccttcgcccccaagccgtcttctggacctcacaagtcgagggagtgtcttcctcttgtcctgatcatcaggaacaggttgaagtatgctttgacataccgtgaagtcatctccatccttatgcaaaggcatatccaagttgatggaaaagttaggactgacaagacataccctgctggctttatggatgttgtatcgatccccaagacgaatgagaacttccgtcttctgtacgacaccaagggacgtttccgtctccactccatcaaggatgaggaagcaaagttcaagctttgcaaggttaggtctattcagtttgggcagaagggaattccttacctaaacacttatgatggtcgcaccatccgttaccctgacccgctcatcaagccgaacgacactatcaaacttgaccttgaggagaacaagattgtggagttcatcaagtttgacgtgggtaacgttgtgatggtgacaggaggcagaaacagaggtcgtgtgggtgtgattaagaaccgtgagaagcataagggaagctttgagacaatacatatccaagattcaacaggacatgagtttgccacaaggttgggtaatgtgttcaccattggcaaaggaacaaagccatgggtgtctcttccaaagggcaagggtattaagctgaccatcattgaggaagcgaggaagaggctttctgcgcaacaagctgcttaaagttgaatcatcccaggccgttttgttttactcttgtgttatagactcgcgcttcttgcctcagttttgagctttttccttttatatgttgcttgcttgcaaaaccccattaaaaaacagctgaaaattccagtagagcgttttgtaatgtttgtatggaaacttttagtaatttactctttaaattggttggttgttagtagatttattgcaaatcgatgctgcaaagtcaaccaatca

SEQ ID NO: 4361 - DNA, 961 bp, Ocimum basilicum
ggcagcaacattcgtttacagcatggcgagaggtttgaagaagcacttgaagcggctcaatgccccaaagcattggatgctggacaaattgggtggtgctttcgccccaaaaccgtcatctggtccacacaaatccagggaatgcctgccactgattctgattatccgaaatcggctcaagtatgctcttagttaccgtgaggtcatttctatcttgatgcaacgtcatgtccaggttgatggtaaggtcaggactgacaagacctaccctgctggtttcatggatgttgtgtctatcccgaagaccaatgagaatttccgccttctctatgatactaagggccggttcaggttgcactctatccgagatgaagaggctaagtttaagttgtgcaaggttcgttcagttcagtttgggaagaagggcattccgtaccttaacacatacgatggaaggaccattcgctacccagaccctcttatcaaggctaatgataccatcaagcttgatcttgagagcaacaaaattgttgatttcataaaatttgatgtgggcaatgttgtaatggtgactggcggtaggaacaggggccgtgttggggtaatcaagaaccgagagaagcataagggaagctttgagacgcttcacattcaggatgcaactgggcatgagtttgcaacgaggctcagcaatgtattcacaatcggacagggcactaagccctgggtatctcttctcaagggcaaaggtatcaagttgtccatcatcgaggaggcgaggaagggcttcaggcccaatctgctgcaactgcttagatcactctgcctatgatggttgtagtactctgagatactaccataggatcttttgttgcaatttgatgttttcccaacctaagttttgtcttcaatatttccttgcatgtcttgaatgttcgcttacatatttgaagattttgat

SEQ ID NO: 4362 - DNA, 974 bp, Allium cepa
attcaagtgtctgcaaaacaaatggctagggtcttaagaaacatatgaagcggcttaatgcccaagacactggatgctcaacaaattggcggtgcatttgccccaaaccttcatctggaccccacaaatcaagagagtgtttgccattgatcctcattttgaggaataagttgaaatatgcccttacataccgtgaggttatcgccattctcatgcagaggcatgtgatggtggatggaaaggtcaggaccgacaagacctatcctgctggcttcatggatgtcgtttcaattccaaaaacaaacgagaatttcagactgttgtatgatacaaaaggtcgtttccgtcttcataccatcagggatgatgaggcaaagttcaagctatgcaaggttcgatcataccaattggggcataaaggaatcccatatctgaacacatacgatggtcgcaccatccgctacccagacccactcatccgtgcaaacgacaccattaaaatcgaccttgaaacaaacaagatcgtcgacttcatcaaatttgacgtgggcaatgtgattatggtgaccggtgggcgtaacacgggtcgggttggaatcatcaagaaccgtgagaagcataagggaacctttgaaaccattcacgtggtcgatgctacaggacatgagtttgctaccaggcttagcaatgtgtttaccattggcaaaggtaccaagccatgggttactttgcccaagggcaagggtatcaagttgagcattattgaggaggccaggaagcggaatgctgccgctgccgctgctgctaaagcaactgcttgatattcatgttttatttggatgctcttctggtaggctgttttgatgattgttattatcgagtattatgtgacattttttgttgtatgttgaattaattggtacaatttgctgaatttttgtagttttataccggttaaaatgcttactttgtcc

SEQ ID NO: 4363 - DNA, 878 bp, Helianthus annuus
gatttcggggctgcggctgtcaattgtagaagaatttcaccgggagatttacatctcccaccggaaaccccaaccatggctagaggtctcaagaagcacatgaagaggctcaatgccccaaagcattggatgcttgacaaactcggtggtgcttttgctcctaagccatcatccgggccacacaagtctagggaatgcctgcccctgatcctcattctgaggaacaggttgaagtatgctttgacataccgtgaggtacaatctattttgatgcagcgtcatgttcttgttgacaacaaggtcaggaccgacaagacttaccctgccggtttcatggatgttgtttctattcctaagaccaatgaaagcttccgtcttctttatgacaccaaaggtagattcaggttgcactcgatcagagacgaggagtcaaagtttaagttgtgcaaggttcgttcagtccagttcggttcaaagggcattccgtacatcaacacttacgacggtcgaaccatccgctacccagacccacttatcaaagccaacgacaccattaagctcgatctagaatcaaacaagattgttgattttatcaagttcgacgttggaaatgtcgtcatggtaactggtggaagaaacacaggccgtgtcggaatcctcaagaacagagaaaaacataagggcagcttcgaaacagttcacattcaagatgctaccggtcacgagtttgctactcgtttgggtaacgtgtttactctcggaaagggttcgaaaccgtgggtttctctacccaagggtagggtatcaagttaaccatcattgaagaggctagaaagaggcaggctgcccaagaggctgctgcttggattgtgtttggt

SEQ ID NO: 4364 - DNA, 928 bp, Ambrosia trifida
cgaggccacgtaatcaacgacgagaggtacgacgggggagggaaggtagacggctagtgaattttataaaaattaaaccggaagatttacatctccgaccgtacacagcaaccatggcaagaggtttaaagaaacatatgaagaggctcaatgcccctaagcattggatgcttgacaaacttggtggtgcttttgctcctaagccgtcatccgggccacacaagtccagggaatgcctgcccttgatcctcattcttaggaacaggttgaagtatgctttgacataccgtgaggtacaatctattttgatgcagcgtcatgttcttgttgacaacaaggtcaggaccgacaagacttaccccgcgggtttcatggatgttgtttctattcctaagaccaatgaaagcttccgtcttctttatgacacaaaaggtagattcaggctgcactcaattagagacgaggagtcaaagttcaagttgtgcaaggttcgttcagttcagtttggttcaaagggcattccatacatcaacacctatgatggtcgaaccattcgctacccagacccactcatcaaagccaatgacaccattaagcttgatctagaatcaaacaagatcgttgactttatcaagtttgacgtgggaaatgttgttatggtgactggtggaagaaacacaggccgggttggaatcctcaagaacagggaaaagcataagggcagctttgaaaccgttcacattcaagatgctactggccacgagtttgctactcgtttgggtaatgtgtttacccttggaaagggttcaaaccatgggtttctctacccaagggtaagggtatcaagttaaccatcattgaagaggctagaaagaggcaggctgcccaagaatctgctgcctagattgtgtttggttatcttgttttg

SEQ ID NO: 4365 - DNA, 915 bp, Helianthus annuus
tctagagtacgcgggggcataagtagattttggggctgcggctgtcaattgtagaagaatttcaccggagatttacatctcccaccggaaaccgcaaccatggctagaggtctcaagaagcacatgaagaggctcaatgccccaaagcattggatgcttgacaaactcggtggtgcttttgctcctaagccatcatccgggccacacaagtctagggaatgcctgcccttgatcctcattctgaggaacaggttgaagtatgctttgacataccgtgaggtacaatctattttgatgcagcgtcatgttcttgttgacaacaaggtcaggaccgacaagacttaccctgctggtttcatggatgttgtttctattcctaagaccaatgaaagcttccgtcttctttatgacaccaaaggtagattcaggttgcactcaatcagagacgaggagtcaaagtttaagttatgcaaggttcgttcagtccagttcggttcaaagggcattccgtacatcaacacttatgacggtcgaaccatccgctacccagacccccttatcaaagccaacgacaccattaagctcgatctagaatcaaacaagatcgttgattttatcaagttcgacgttggaaatgtcgtcatggtaactggcggaagaaacacaggccgtgtcggaatcctctagaacagagaaaaacataagggcagctttgaaaccgttcacattcaagatgctaccggtcacgagtttgctactcgtttgggtaacgtgttcaccctcggaaagggttcgaaaccatgggtctctctacccaagggtaagggtatcaagttaaccatcattgaagaggctagaaagaggcaggctgcccaagaggctgctgcttagattgtgtttggtttcaaagattat

SEQ ID NO: 4366 - DNA, 903 bp, Phaseolus coccineus
aaattagggttttatgcacaaccctcttcataagtgccgcagctactctttcagtttttcagtttagtgccgtagcagtggagcactagtgtttcttttgcaattctaaaatggctaggggattgaagaaacatttgaagaggctcaatgctcctaagcattggatgcttgacaaattgggtggtgcatttgctcccaaaccctcatctggaccccacaaatcgagggagtgccttcctctcatactcatcctccgaaatcggttgaagtatgctcttacctaccgtgaagtcattgctattctgatgcagcgacatgtgcttgttgatggcaaagtcaggacagacaagacatacccttctggtttcatggatgttgtatctatacctaaaacaaacgagaacttccgcctgctctatgacaccaaaggtcgtttccgtcttcattctgtcagggatgatgaggcaaagtttaagctgtgcaaggtaaagtctgtgcagtttggtcagaaaggtattccatacctgaacacctttgatggtcgtaccatccgttacccagaccctgtcatcagagccaatgacaccattaagctggatctggaggaaaacaagatcgttgattttatcaaatttgatgttggtaacgttgttatggttactggaggaagaaacagggggcgtgttggagttattaagagcagggagaggcaaaagggcagctttgacacaattcacgttcaggatgccactggacatgaatttgctactcgtttggcaaacgtgttcactattgggaaggggacaaagcctttgatatcacttcccaagggtaagggtattaagctatccatcattgaggaagctagaaaaaggactgccgctcagcaagcaactgctgctt

SEQ ID NO: 4367 - DNA, 867 bp, Phaseolus coccineus
agtgcagtagaggtggggcactagtttcctttgcaaatccaaagatggctaggggattgaagaaacatttgaagaggctcaatgctcctaagcattggatgcttgacaaattgggtggtgcatttgctcccaaaccctcatctggaccccacaaatcaagggagtgccttcccctcatactcatcctgcggaaccggttgaagtatgctctgacctaccgtgaagtcattgctattctgatgcagcgacatgtgcttgttgatggcaaagtcaggacagacaagacatacccttctggtttcatggatgttgtatctatacctaaaacaaacgagaacttccgcctgctctatgacaccaaaggtcgtttccgtcttcattctgtcagggatgatgaggcaaagtttaagctgtgcaaggtaaagtctgtgcagtttggtcagaaaggtattccatacctgaacacctttgatggtcgtaccatccgttacccagaccctgtcatcagagccaatgacaccattaagctggatctggaggaaaacaagatcgttgattttatcaaatttgatgttggtaacgttgttatggttactggaggaagaaacagggggcgtgttggagttattaagagcagggagaggcaaaagggcagctttgacacaattcacgttcaggatgccactggacatgaatttgctactcgtttggcaaacgtgttcactattgggaaggggacaaagcctttgatatcacttcccaagggtaagggtattaagctatccatcattgaggaagctagaaaaaggactgccgctcagcaagcaactgctgcttaattcccccttctgaattaatagacttgag

SEQ ID NO: 4368 - DNA, 1060 bp, Centaurea maculosa
cagcggcagagagaaggagagcagtccagccggagaattccaccggagattaacatctcctctaacacaccgcagccatggctagaggtttgaagaaacatatgaagaggctcaatgcccctaagcattggatgcttgacaaacttggtggtgcttttgctcccaagccatcctctggaccacacaaatctagagaatgcttgcctttgattctcatcctccgaaataggttgaagtatgcccttacataccgtgaggttatctctatcttgatgcaaaggcatgtgcttgtcgacaacaaagttaggaccgacaagatctacccagctggttttatggatgttgtttctattccaaagactaatgagaacttccgtctcctatacgataccaaaggtagattcaggctacactcaatcagggacgaggaagcaaagttcaagctatgcaaggttcgttccgtccagtttggttcaaagggcattccttacataaacacatacgatggtcgaaccatccgttacccagacccactcattaaggctaacgacaccattaagctcgatttggaatcaaacaagattgtcgatttcatcaagtttgatgtgggaaatgtcgttatggttaccggtggacgaaacactggccgtgttggaatcctaaagaacagagaaaagcataagggcagctttgagaccgttcacattcaggacgctaccggccacgagtttgccacacgtttggggaacgtgttcacggttggaaaaggtacgaagccgtgggtgtctcttcccaagggtaagggtatcaagttaaccatcattgaggaggctaggaagaggcgggctggccaagaccctgttgcctagatcgcgtgattttagtgttctgttcttgcaggtttgttggaagtgttcttttttacttggttatcgttatggtacaattttgaacctatatggttttgactctatgagttatgctagactcttgttggttaaatttgattacagaatggttataacttttgtttaaatgcattatgaacccctcgttatct

SEQ ID NO: 4369 - DNA, 1072 bp, Centaurea maculosa
gcggcagtgagttgcagagagaaggcgcagtccagccggagaattccaccggagatttacatctcctttaacacacagcagccatggctagaggtttgaagaaacatatgaagaggctcaatgcgcctaagcattggatgcttgacaaacttggtggtgcttttgctcccaaaccatcctctggacctcacaagtctagggaatgcttgcctttgattcttatcctccgaaataggttgaagtatgcccttacataccgtgaggtgatctctatcttgatgcaaaggcatgttcttgtcgacaacaaggtcaggactgacaagacctacccagctggtttcatggatgttgtttctattccaaagaccaatgagaacttccgtctcctatacgataccaaaggtagattcaggctacattctatcagggatgaggaggcaaagttcaagctatgcaaggttcgttcagtccagtttggttcaaagggcattccttacatcaacacatacgatggccgaaccatccgttacccagacccactcattaaggccaacgataccattaagcttgatttggattcaaacaagattgttgatttcatcaagtttgacgtgggaaatgtcgttatggttactggtggacgtaacactggccgtgttggaattctaaagaacagggaaaagcataagggcagttttgagactgttcacattcaggatgctaccggccatgaatttgccacacgtttggggaacgtgttcacggtcggaaagggtacaaagccgtgggtgtctctacccaagggtaagggtatcaagttaaccatcatcgaggaggctaggaagagacgggctggccaagaccctgttgcctagatcctctgattttggtgttttgttcttgcaggttcgtgggaagttttctttctcttgctttttgttatggtacaattttaaatctatgttttgatgctgcaagttatgttaaactattgtttagtaatttgattacaaaatggttaagcttttgttttaatgcattaagcatccttcctttgtgtggtctgctgctt

SEQ ID NO: 4370 - DNA, 985 bp, Centaurea maculosa
attgcagccgtgagaaagagcagtttcagccggagaattccaccggagatctagatctcctctaagacaccgcagccatggcgagaggtttgaagaaacatatgaagaggctcaatgcccctaagcattggatgcttgacaaacttggtggtgcttttgctcccaaaccatcctcaggaccacacaaatctagagaatgcttgcctttgattctcattctccgaaataggttgaagtatgcccttacgtaccgtgaggtcatttctatcttgatgcaaaggcatgtgcttgtcgacaacaaagtcaggaccgacaagacctacccagctggttttatggatgttgtttctattccaaagactaatgagaacttccgtctcctatacgacaccaaaggtagattcaggctacactcagtcagggacgaggaagcaaagttcaagctatgcaaggttcgttccgtccagtttggttcaaagggcattccttacatcaacacatacgatggtcgaaccatccgttacccagacccactcattaaggccaacgacaccattaagcttgatttggaatcaaacaagattgttgatttcatcaagtttgatgtgggaaatgtcgttatggttactggtggacgaaacactggccgtgttggaattttaaagaacagagaaaagcataagggaagcttcgagaccgttcacattcaggacgctaccggccatgagttcgccacacgtttggggaacgtgttcacggtgggaaagggtacaaagccgtgggtgtctcttcccaagggtaagggtatcaagttaaccatcatcgaggaggctaggaagaggcgggctggccaagaccctgttgcctagatcgtgtgattttagtgttctgttctacttgcttattgttatggtacaattttgaatctatggttttgattctacaagttatgttagactcttgttggttaatttgattacaaaat

SEQ ID NO: 4371 - DNA, 1011 bp, Centaurea maculosa
tgcggcagtgagttgcagatagaaggcgaagtccagccggagaattccaccggagattcagatctcctccaagacctgcagccatggctagaggtttgaagaaacatatgaagaggctcaatgcgcctaagcattggatgcttgacaaacttggtggtgcttttgctcccaaaccatcctcaggacctcacaagtccagggaatgcttgcctttgattcttatcctccgaaataggttgaagtatgcacttacataccgtgaggtgatttctatcttgatgcaaaggcatgttcttgtcgacaacaaggtcaggactgacaagacctacccagctggtttcatggatgttgtttctattccaaagaccaatgagaacttccgtctcctatacgataccaaaggtagattcaggctacattcaatcagggatgaggaggcaaagttcaagctatgcaaggttcgttcagtccagtttggctcaaagggcattccttacatcaacacatacgatggccgaaccattcgctacccagacccactcatcaaggccaacgacaccattaagcttgatttggattcaaacaagattgttgatttcatcaagtttgacgtgggaaatgttgttatggttactggtggacgaaacactggccgtgttggaattctaaagaacagggaaaagcataagggaagtttcgagacagttcacattcaggatgctactggccatgagtttgccacacgtttggggaacgtgttcacggttggaaagggtacaaagccgtgggtgtctctacccaagggtaagggtatcaagttaaccatcatcgaggaggctaggaagagacgggctggccaagaccccgttgcctagatgctctgattttggtgttttgtttcttgcaaggttcgtgggaagttttctttctcttgctttttgttatggtacattttaacctatgttttgatgctgcaagttatgttaaactattgttagttaatttgattac

SEQ ID NO: 4372 - DNA, 1023 bp, Eschscholzia californica
taaggccttcagctccttctagggcaaaaacaaattcactatggcgagaggtttgaagaagcatcttaagaggctcaatgccccgagtcactggatgcttgacaaacttggcggtgcttttgcccctaaaccatcatcaggaccacacaagtccagggaatgcttgcctttgattcttattctccgaaacagactgaaatatgctctcacttaccgtgaggtcgtggctattttgatgcaacgacacattcttgttgacgggaaggtcaggactgaccagaggtacccatctggattcatggatgttatctcaatccccaaaacaaacgagaacttccgtttgctttatgacactaagggtcggttcagactccactcaatcaaggatgaagaggccaagttcaagctttgcaaggttcgaaatgttcaatttggacaaaagggaatcccatacatcaacacctatgatggtcgaactatccgttaccctgatcctcttatcaaagctaatgacaccgtcaaacttgaccttgagaccaacaaggtcattgacttcatcaagtttgatgttggcaatgttgtgatggttactggaggaaggaacaggggacgagttggagttatcaagaacagagaaaagcataagggtagtttcgaaaccatccacgttcaagatgcaactggccatgaatttgctactcgtttgggtaatgtgtttaccattggcaagggcaccaagccgtggttgtcccttcccaagggcaaaggtatcaagttgaccattatcgaagaggccaggaagcgacttgccgctaaaggagagactgttgcttaacttttcttaatgagaagacttctttaggtttttggaatagttctatggaaagatattgtcggagattaattttgttgatttatgatgtttttgcaatctaattttagatttgagacaatgtggtttgtttttatgacttgaaactggtttagaactaaattttgtattgcgatatttggtttagaatt

SEQ ID NO: 4373 - DNA, 1066 bp, Helianthus annuus
cgctgctgttcatcgtatacttcaaccggagactccgatctcctactgcagccatggctagaggtttgaagaaacatatgaagaggctcaatgctcctaagcattggatgcttgataaacttggtggtgcttttgctcctaagccatcatctggacctcataaatcaagggaatgcctgcccttgatcctcatcttgaggaacaggttgaagtatgctttgacgtaccgtgaggttcaatctattttgatgcaacgacatgtgcttgttgataacaaggtcaggactgacaagacttaccctgcgggtttcatggatgtcgtctcaattccgaagaccaatgaaagtttccgacttctatatgatacaaagggcaggttcaggcttcactccatcagggatgaggaatcaaagttcaagttgtgcaaagttaggtctgttcaatttggttcaaaggggattccatacatcaacacttatgacggccggacaattcgctacccagatccactcatcaaagctaacgacaccatcaaactcgatttggagtcgaacaagatcgttgatttcatcaagtttgatgttgggaatgttgtcatggtgacaggtggacgcaacactggtcgtgttggaatccttaaaaacagagaaaaacataagggcagctttgagacggttcacattcaagatgccactgggcacgagtttgccacccgtttgggaaatgtgttcactcttggaaaaggttcaaagccttgggtatcactccccaagggtaagggtatcaagttgacaatcattgaggaggctaggaaaaggcaggctgcacaatatgcaactgcataggtggtttgattttgtattgattgtgttctaggagagttatgctttaatttgggtacaattttcaattttgagaccttggatatgcattttaaagttggtttgattacaaattgaagacttacttttcttgatttttagaatttggttatgtagaaaacttcatacaattaagatggttatgtaaggcatatctagtgatctaaatggttgtatgatgcagt

SEQ ID NO: 4374 - DNA, 1008 bp, Ambrosia trifida
aataatattgtgaggagagtgggtgcggctgtgaattttataaaaatttaaccggagatttacatctccacaggacactgcaaccatggcaagaggtttaaagaaacatatgaagaggctcaatgcccctaagcattggatgcttgacaaacttggtggtgcttttgctcctaagccatcatcagggccacacaagtccagggaatgcctgccattgatccttattctgaggaacaggttgaagtatgctttgacataccgtgaggtacaatctattttgatgcagcgtcatgttcttgttgacaacaaggtcaggaccgacaagacttaccctgcgggtttcatggatgttgtttctatccctaagaccaatgaaagcttccgtcttctttatgacacaaaaggtagattcaggttgcactcaatcagagacgaggagtcaaagttcaagttgtgcaaggttcgttcagtccagtttggttcaaagggcattccatacatcaacacctatgatggtcgaaccatccgctacccagacccactcatcaaagccaatgacaccattaagcttgatctagaatcaaacaaaatcgttgactttatcaagtttgacgtgggaaatgttgttatggtaactggtggaagaaacacaggccgggttggaatcctcaagaacagggaaaagcataagggcagctttgaaaccgttcacattcaagatgctactggccacgagtttgctactcgtttgggtaatgtgttcaccctcggaaagggttcaaaaccatgggtttctctccccaagggtaagggtatcaagttaactatcatcgaagaggctagaaagaggcaggctgcccaagaatctgctgcctagattgtgtttggttatcttgtttttgatttaaggttgttgggcagttttactgcctttattatggtacaattttgaacctatgctttgatgttggataatttggttataaatcggttaacttgtgttcttaa

SEQ ID NO: 4375 - DNA, 1184 bp, Ambrosia trifida
gggaccgtaaggaaggttaaccggtaccggggggaccgtttaggcgttttaaactaaattaaagttaatttaggttagagggaaagggttagacgggctgttgaattttataaaaaattaaccggagatttacatctccgaccgaacacagcaaccatggcaagaggtttaaagaaacatatgaagaggctcaatgcccctaagcattggatgcttgacaaacttggtggtgcttttgctcctaagccgtcatccggcccacacaagtccagggaatgcctgcccttgatcctcattctgaggaacaggttgaagtatgctttgacataccgtgaggtacaatctatcctgatgcagcgtcatgttcttgttgacaacaaggtcaggaccgacaagacttaccctgcgggtttcatggacgttgtttctattcctaagaccaatgaaagcttccgtcttctttatgatacaaaaggtagattcaggctgcactcaattagagacgaggagtcaaagtttaagttgtgcaaggttcgttcagttcagtttggttcaaagggcattccatacatcaacacctacgatggtcgaaccattcgctacccagacccactcatcaaagccaatgacaccattaagcttgatctagaatcaaacaagatcgttgactttatcaagtttgacgtgggaaatgttgttatggtaactggcggaagaaacacaggccgtgttggaatcctcaagaacagggaaaagcataagggcagctttgaaaccgttcacattcaagatgctactggccacgagtttgctactcgtttgggtaatgtgtttacgcttggaaagggttcaaaaccatgggtttctctccccaagggtaagggtatcaagttaaccatcatcgaagaggctagaaagaggcaggctgcacaagaatctgctgcctagattgtgtttggttatcttgtttttgatttaaggttgttgggtagttttactgcctttattatggtacaatttttgaacctatgctttgatgttggataatttggttataaattggttaactttttcaccagtgataaccaatattgagacattaacaagaaacaaatagagaaaacgatagaagaaaatataacacccacacataccatacataatttgacaattaacaaataaat

SEQ ID NO: 4376 - DNA, 1340 bp, Ambrosia trifida
aaaaccccgtataactcggattcaaatcggcgacctccaaaggaggcctagatcttattcactagacttgttaagagttgttatcgtgttgagactagagtttcaaacaactatatcgggccaaatctaaaccacatatttgggccgggtcgtaaaagcactaaaaacctagcccaataacgtcagaccaagcccataaaataaaataggtttccaggtatataaacaaaccatatctagggtttataagacagactgctcaacaataatattgtgaagacggtgcggctgttgaatttttataaaaaattaaccggagatttacatctccgatcgaacacagcaaccatggcaagaggtttaaagaaacatatgaagaggctcaatgcccctaagcattggatgcttgacaaacttggtggtgcttttgctcctaagccgtcatccgggccacacaagtctagggaatgcctgcccttgatcctcattctgaggaacaggttgaagtatgctttgacttaccgtgaggtacaatctatcttgatgcagcgtcatgttcttgttgacaacaaggtcaggaccgacaagacttaccctgcgggtttcatggatgttgtttctattcctaagaccaatgaaagcttccgtcttctttatgatacaaaaggtagattcaggctgcactcaattagagacgaggagtcaaagtttaagttgtgcaaggttcgttcagttcagtttggttcaaagggcattccatacatcaacacctatgatggtcgaaccattcgctacccagacccactcatcaaagccaatgacaccattaagcttgatctagaatcaaacaagatcgttgactttatcaagtttgacgtgggaaatgttgttatggtaactggcggaagaaacacaggccgggttggaatcctcaagaacagggaaaagcataagggcagctttgaaaccgttcacattcaagatgctactggccacgagtttgctactcgtttgggtaacgtgtttacccttggaaagggttcaaaaccatgggtttctctccctaagggtaagggtatcaagttaaccatcattgaagaggctagaaagaggcaggctgcacaagaatccgctgcctagattgtgtttggttatcttgtttttgatttaaggttgtttggttgttttactttactgtcctttattatggtactaattttgaacctatgctttgatgttggataatttggttataaattggttaacttttgttctaaaggtaatgtttgattgttttatgtattcaactttccaaaaaagaaaaagtaaccgaactgacg

SEQ ID NO: 4377 - DNA, 1148 bp, Phaseolus coccineus
gaaattagggttttatgaacaaccctctccataagtgccgcagctactctttcagttctccagtttagtgccgtagcagtggaacactagtttcctttgcaactccaaaatggctaggggattgaagaaacatttgaagaggctcaatgctcctaagcattggatgcttgacaaattgggtggtgcatttgctcccaaaccctcttctggaccccacaaatcgagggagtgccttcccctcatactgatcctgcgaaatcggttgaagtatgctctgacctaccgtgaagtcattgctattctgatgcagcgacatgtgcttgttgatggcaaagtcaggacagacaagacatacccttctggtttcatggatgttgtatctatacctaaaacaaacgagaatttccgcctgctctatgacaccaaaggtcgtttccgtcttcactctgtcagggatgatgaggcaaagtttaagctgtgcaaggtaaagtctgtgcagtttggtcagaaaggtattccatacctgaacacatttgatggtcgtaccatccgttacccagaccctgtcatcagagccaatgacaccattaagctggatctggaggaaaacaagatcgttgattttatcaaatttgatgttgggaacgttgttatggttactggaggaagaaacagggggcgtgttggagttattaagaacagggagaggcagaagggcagctttgacacaattcacgttcaggatgccactggacatgaatttgctactcgtttggcaaacgtgttcactattggcaaggggacaaagcctttgatatcacttcccaagggtaagggtattaagctatccatcattgaggaagctagaaaaaggactgccactcagcaagcaactgctgcttaaatcccccttctgaattaatagacttgagcatttcgtagtttaattctatgtttttggtttttaattccttttgtccgagagatttttattgttgaattttgactcttgcactatacaactttattgtggctgttaaattcatgatgtaatcgtttctttctccagtatttacttggtttttggttgctcaaatcgcagaattcggtttttatataagtagaataatggcgtagttatagtggac

SEQ ID NO: 4378 - DNA, 1023 bp, Phaseolus coccineus
gtgccgcagctactctttcagtttttcagtttagtgccgtagcagtggagcactagtgtttcttttgcaattctaaaatggctaggggattgaagaaacatttgaagaggctcaatgctcctaagcattggatgcttgacaaattgggtggtgcatttgctcccaaaccctcatctggaccccacaaatcgagggagtgccttcctctcatactcatcctccgaaatcggttgaagtatgctcttacctaccgtgaagtcattgctattctgatgcagcgacatgtgcttgttgatggcaaagtcaggacagacaagacatacccttctggtttcatggatgttgtatctatacctaaaacaaacgagaacttccgcctgctctatgacaccaaaggtcgtttccgtcttcattctgtcagggatgatgaggcaaagtttaagctgtgcaaggtaaagtctgtgcagtttggtcagaaaggtattccatacctgaacacctttgatggtcgtaccatccgttacccagaccctgtcatcagagccaatgacaccattaagctggatctggaggaaaacaagatcgttgattttatcaaatttgatgttgggaacgttgttatggttactggaggaagaaacagggggcgtgttggagttattaagagcagggagaggcaaaagggcagctttgacacaattcacgttcaggatgccactggacatgaatttgctactcgtttggcaaacgtgttcactattggcaaggggacaaagcctttgatatcacttcccaagggtaagggtattaagctatccatcattgaggaagctagaaaaaggactgccgctcagcaagcaactgctgcttaattcccccttctgaattaatagacttgagcatttcgtagtttaattctatgtttttggtgtttaattccttttgtccgacagatttttgttgttgaattttgactcttgcactatacaacttcattgtggctgttaaattcatgatgtaatc

SEQ ID NO: 4379 - DNA, 1041 bp, Cichorium intybus
atcgaggagggggtgcggctgcgagtgaggaggagaggcgcaggttcatcggacaagacaaccggagatctcaaagtcatccctacgacgcaatcatggctaggggtttgaagaaacacatgaagaggctcaatgccccaaaacattggatgcttgataaactcggtggtgcttttgctcccaaaccttcgtctggaccacacaaatcaagggaatgcttgcccttgatcctcatcctccgtaacaggttgaaatatgctttaacctaccgtgaggtccaatctatcttaatgcaaaggcatgtacttgttgacaacaaggtcaggactgacaaaacctaccctgctggtttcatggatgttgtctccattcccaaaaccaatgaaaacttccgtcttctttatgacaccaaaggtagattcagactacactcagtcagagacgaagagtcaaagttcaagctatgcaaggttcggtcagtccagttcgggcagaagggcatcccatacatcaacacatacgatggaaggaccattcgttaccctgaccctctgatcaaagctaatgacaccattaaactcgatttggactcgaacaagattgttgatttcatcaaatttgatgttggaaatgttgtgatggtgactggtggaaggaacacgggacgtgttgggatcttgaagaacagggaaaagcataagggaagttttgagacagtgcatattcaggatgcaactggtcatgaatttgctacacgtttggggaatgtgtttactcttggaaaagggacaaagccgtgggtgtcattgccaaaggggaagggtattaagttgactattattgaggaggcgaggaagaggcaggctgcattggctgctactgcttaggttgtttggtgatttggggttttgatagtttgttatgttataagttatattattgaaggacttgtttttgttttttgcattttggtacaattttgaaggttaaatttgttttgaaacgctttaatgttggtaaatgtaggttaattgtcttttc

SEQ ID NO: 4380 - DNA, 1022 bp, Cichorium intybus
gggggcggcacgagttgcgagtggtgaggagaggagctagccgaagaattcaaccggagatttagatctctcgccggacaccgcaaccatggcaagaggattaaagaaacacatgaagaggctcaatgccccaaagcattggatgcttgacaaacttggcggtgcttttgcccctaaaccatcatctggaccccacaaatcccgtgaatgtttaccattgatcctcattctccgtaacagattgaagtatgcattaacataccgtgaggtccaatctattttgatgcaacgacatgttcttgttgacaacaaagtcaggaccgataaaacctatccagctggtttcatggacgttgtttcaatccccaaaaccaacgaaaacttccgtcttctttacgacacaaaaggtcgattcagactacactcacttagagacgaggagtctaagtttaagttatgcaaggttcgttcggtccaattcgggtcaaagggaattccgtacatcaacacatacgatggtcgcacaatccgttacccggacccgctaatcaaagccaacgacacaatcaaactcgatctcgattccaacaaaatcgtcgacttcataaaattcgatgttggaaacattgtgatggtgacaggtggcagaaacacagggcgagttggaatccttaaaaaccgggaaaaacataagggaagttttgaaacggttcacattcaagattcaactgggcatgaatttgctactcgtttgggtaatgtgtttactattggaaaaggttcaaagccgtgggtgtcgttgccaaagggtaagggtattaagttgacaattattgaagaggctagaaagagaaaggctgcccaagagagcgctgcttaaaggtttttgtttgattttgttttgctgattttgaacttgttttggtgttgggagttattgtaggattctgagaacgcgaaataattttgtagcaaaatggtaaaattttgttaaatgttatggtaaacgttcatctttgggt

SEQ ID NO: 4381 - DNA, 915 bp, Cirsium arvense
ggggggtgcggcagtgagttgcagagagaaggcgcagtctagccggaaaattccaccggagatttagatctcccccaacacacagctgccatggctaggggtttgaagaagcatatgaagaggctcaatgcgcctaagcattggatgcttgataaacttggtggtgcttttgcccctaaaccatcatcaggacctcacaaatctagagaatgcttgcccttgattctcattctccgtaataggttgaagtatgccttgacctaccgtgaggtgatttccatcctgatgcaaagacatgtgcttgtcgacaacaaagtcaggactgacaagacctacccagctggttttatggatgttgtatcaattcccaagaccaatgaaaacttccgtcttctttatgatactaaaggtagattcaggttgcactcgatcagggatgaggaggcaaagttcaagctatgcaaggttcgttcagtccaatttggctcaaagggtattccatacatcaacacctacgatggtcgaaccatccgctatccagaccctctcattaaggccaatgacaccattaagctcgatctggattcaaacaagatcgtcgatttcatcaagttcgatgtgggaaacgttgtgatggtgacaggtggcagaaacacaggccgtgttggaatcctaaagaacagagaaaaacataagggaagcttcgaaaccgttcacattcaggacgcaactggccacgaatttgctacccgtttagggaatgtgttcacggtcggaaagggtacaaagccatgggtttctcttccaaagggtaagggtatcaagttaaccatcattgaggaggctaggaagaggcgggctggccaagatactgtggcttagatcgtgttatttggtggtttggttcttcttgca

SEQ ID NO: 4382 - DNA, 935 bp, Cirsium arvense
ttgcgagtgcggaggagaataccaccggagtttttcgaagaaaatcatacaaaacaaacatggctagaggtttgaagaaacatatgaagaggctcaatgcccctaaacattggatgcttgataaactgggtggtgcttttgcacctaagccttcatccggcccccacaaatccagggaatgcttgcctttgattctcattcttcgaaataggttgaaatatgctttgacttaccgtgaggtcatatctattttgatgcaacgtcatgttcttgttgacaacaaggtcaggaccgacaagacttaccctgctggtttcatggatattgtttcaattcccaaaaccaatgaaaactttcgtattgtttacgatacaaaaggtagattcaggctacactctgtcagggatgaagagtcaaagttcaagctgtgcaaggttaggtctgtccaatttggacagaagggcattccttacataaacacctatgatggcagaactatccgctaccctgaccctctgatcaaagctaacgacaccataaaacttgatttggactctaacaagattgttgatttcatcaagtttgatgtcggaaatgttgttatggttactggtggaagaaacacgggccgtgtaggaatccttaaaaacagagaaaaacataagggtagtttcgagactgttcacattcaagattccactggtcatgagtttgctacccgtttggggaacgtttttactatcggaaagggttcaaagccatgggtgtcacttcccaaaggaaagggtattaagttgaccattattgaggaggctaggaagaggcaggctgctttaaatgctagtgcttagattggaaaatttatggggatttagttggtatttttatagcttaatatttacattaacttattttgttttgcatttttgggtaca

SEQ ID NO: 4383 - DNA, 893 bp, Cirsium arvense
aagattgcaggcagtgagagaagcagttcagccggagaatttcaccggagatttagatctcctctaagacaccgcagccatggcgagaggtttgaagaaacatatgaagaggctcaatgcccctaagcattggatgcttgacaaacttggtggtgcttttgctcccaagccatcctctggaccacacaaatccagagagtgcttgcctttgattctcatcctccgaaataggttgaagtatgccctaacgtaccgtgaggtcatctctatcttgatgcaaaggcatgtgcttgtcgacaacaaggtcaggaccgacaagacctacccagctggttttatggatgttgtttctattccaaagactaatgagaacttccgtctcctatacgataccaaaggtagattcaggctacactcaatcagagacgaagaagcaaagttcaagctatgcaaggttcgttccgtccagtttggttcaaagggcattccttacatcaacacatatgatggtcgtaccatccgttacccagacccactcattaaggccaacgacaccattaagcttgatttggattcaaacaagattgttgatttcatcaagtttgatgtgggaaatgtcgttatggttactggaggacgaaacactggtcgtgttggaatcttaaagaacagagaaaagcataagggcagctttgagactgttcacattcaggacgctaccggccatgagttcgccacacgtttaggaaacgtgttcacggtaggaaagggtacaaagccgtgggtgtctcttcccaagggtaagggtatcaagttaaccatcatcgaggaggctaggaagaggcgggctggccaagaccctgttgcctagattctgtgattttagtgttctg

SEQ ID NO: 4384 - DNA, 1021 bp, Gossypium hirsutum
gctggcatcttcctaaagaacgctgaaggctctcagcggaaacagcttcttccagaccaaccgaaatggctagagggttaaagaaacatctgaagaggctcaatgctccaaggcattggatgcttgacaagcttggcggtgcatttgcacccaagccctcatctggaccacacaaatccagagaatgcttgccgctcattctcattctgcaaaacagattaaagtacgctctaacatatagagaagtgattgccattcttatgcaaaggcatgttatggtagatgggaaggttaggacggataaaacataccctactggtttcatggatgttgtatcaattccaaagacgaatgaggacttccgcctcctttatgacacaaaaggtcgttttcgccttcatgccatcaccggtgatgagaccaagtttaagctctgtaaagttcggtctgtccaatttggtcaaaagagtatcccctaccttaatacgtatgatggacgcaccatccgctacccagatccactgatcaaggctaacgataccatcaagcttgacctagagagcaacaaaattgtagatttcattaagtttgatgttgggaatgttgtcatggtcactggaggaagaaacagagggcgtgttggagtgattaagaaacgtgagaagcataagggtagcttcgagacaatccacatccaagatgctgctggacacgaatttgctactcgtttaggcaatgtcttcacaattggtaaaggaacgaagccatgggtgtcacttccaaagggcaagggtatcaagttgtccatcattgaggaagccaggaagaggcttgcggcccaagctactgtctaaattttatgattaaagatataatatctggaattgttttttgtcaaatgaattaatctgtttggtggtcctttgtgtttgcttttgtaggatttatgttttgtttttactcatgactacagttttggaccaatcgttatattattttttaaattaaagttaatttcatt

SEQ ID NO: 4385 - DNA, 1064 bp, Gossypium hirsutum
caataaataggtaaaacaaaattagggtttttgatttcctcccgctggcatcttcctaaagaacgctgaaggctctcagcggaaacagcttcttccagaccaaccgaaatggctagagggttaaagaaacatctgaagaggctcaatgctccaaggcattggatgcttgacaagcttggcggtgcatttgcacccaagccctcatctggaccacacaaatccagagaatgcttgccgctcattctcattctgcaaaacagattaaagtacgctctaacatatagagaagtgattgccattcttatgcaaaggcatgttatggtagatgggaaggttaggacggataaaacataccctactggtttcatggatgttgtatcaattccaaagacgaatgaggacttccgcctcctttatgacacaaaaggtcgttttcgccttcatgccatcaccggtgatgagaccaagtttaagctctgtaaagttcggtctgtccaatttggtcaaaagagtatcccctaccttaatacgtatgatggacgcaccatccgctacccagatccactgatcaaggctaacgataccatcaagcttgacctagagagcaacaaaattgtagatttcattaagtttgatgttgggaatgttgtcatggtcactggaggaagaaacagagggcgtgttggagtgattaagaaacgtgagaagcataagggtagcttcgagacaatccacatccaagatgctgctggacacgaatttgctactcgtttaggcaatgtcttcacaattggtaaaggaacgaagccatgggtgtcacttccaaagggcaagggtatcaagttgtccatcattgaggaagccaggaagaggcttgcggcccaagctactgtctaaattttatgattaaagatataatatctggaattgttttttgtcaaatgaattaatctgtttggtggtcctttgtgtttgcttttgtaggatttatgttttgtttttactcatgactacagttttggaccaatcgttatattattttttaaattaaagttaatttcatt

SEQ ID NO: 4386 - DNA, 1000 bp, Cynara scolymus
ggcgcagtctagccggagaattccaccggagatttagatctccccaaagacaccgcagccatggctaggggtttgaagaaacatatgaagaggctcaatgcgccgaagcattggatgcttgataaacttggtggtgcttttgctcctaagccatcgtcaggacctcacaaatctagggagtgcttgcccttgattctcattctccgtaataggttgaagtatgccttgacataccgtgaggtgatttccatcttgatgcaaagacatgtgcttgttgacaacaaagtcaggactgacaagacctacccagctggtttcatggatgttgtttctattccgaagaccaatgaaaacttccgtcttctctatgacacaaaaggtagattcagactacactcaatcagggatgaggaggcaaagttcaagctatgcaaggttcgttcggtccagtttggctcaaagggcattccttacatcaacacatatgatggccgaaccatccgctacccagaccctctcatcaaggccaacgacaccattaaacttgatttagattcaaacaagattgttgatttcatcaagtttgatgtgggaaatgttgttatggtgactggtggacgaaacacaggccgtgttggaatccttaagaacagggaaaaacataagggcagcttcgagacagttcacattcaggacgctactggccatgagtttgccacccgtttgggaaatgtgttcacagtcggaaagggtacaaagccgtgggtgtctcttcccaagggtaagggtatcaagttaaccatcattgaggaggctaggaagaggcggggtggccaagatcctgttgcctagattgcgttatttggtgttctgttcttgcaggtttgtgggaagtccttttttctgctttaagtatggtacaaatttgaaccctatgtttgatgtacaagttatgtgagactcttcgtagttaattttattccaaatggttacttttctc

SEQ ID NO: 4387 - DNA, 1021 bp, Eschscholzia californica
atggcgagaggtttgaagaagcatcttaagaggctcaatgccccgagtcactggatgcttgacaaacttggcggtgcttttgcccctaaaccatcatcaggaccacacaagtccagggaatgcttgcctttgattcttattctccgaaacagactgaaatatgctctcacttaccgtgaggtcgtggctattttgatgcaacgacacattcttgttgacgggaaggtcaggactgaccagaggtacccatctggattcatggatgttatctcaatccccaaaacaaacgagaacttccgtttgctttatgacaccaagggtcggttcagactccactcaatcaaggatgaagaggccaagttcaagctttgcaaggttcgaaatgttcaatttggacaaaagggaatcccatacatcaacacctatgatggtcgaactatccgttaccctgatcctcttatcaaagctaatgacaccgtcaaacttgaccttgagaccaacaaggtcattgacttcatcaagtttgatgttggcaatgttgtgatggttactggaggaaggaacaggggacgagttggagttatcaagaacagagaaaagcataagggtagtttcgaaaccatccacgttcaagatgcaactggccatgaatttgctactcgtttgggtaatgtgtttaccattggcaagggcaccaagccgtggttgtcccttcccaagggcaaaggtatcaagttgaccattatcgaagaggccaggaagcgacttgccgctaaaggagagactgttgcttaacttttcttaatgagaagacttctttaggtttttggaatagttctatggaaagatattgtcggagattaattttgttgatttatgatgtttttgcaatctaattttagatttgagacaatgtggtttgtttttatgacttgaaactggtttagaactaaattttgtattgcgatatttggtttagaattatgttgttcagtactcttgttatatcatctctgtcagg

SEQ ID NO: 4388 - DNA, 1142 bp, Fagopyrum esculentum
ggggagactgtatttaacttctagggttctgttttgctgggttaaagcggccgaagaagcgagcttaaaaccctacgtagcaatcacattgaaggggaaccctttcatccagtccattcaccatggcgagaggattgaagaagcatatgaagaggcttaatgccccaaagcactggatgcttaataaacttggcggtgcttttgcgcctaagccatcatctgggccacacaaggcaagagagtgcttgccgttgatccttatcttgaggaacaggttgaagtatgctcttacatacgccgaagtcatttctattttgatgcaaagacatgtacttgttgacaacaaagttaggactgacaaaacttaccctgctggtttcatggatgttgtctcaattccaaaaacaaacgagagcttccgtcttctctacgacacgaaaggaaggttccgtctccactctattagagatgaggaggccaagttcaagctgtgcaaggttcgctctgtccaatttggtcagaagggaattccgtacattaacacctttgatggtcgcaccattcgttacccagaccctttgatcaaggccaatgacagcatcaagctagaccttgagaacaacaagattgttgacttcgtcaagtttgatgttggtaatgttgttatggtcactggcggtaggaacagaggccgtgttggagtgatcaagaacagggagaagcataagggaagctttgagaccatccacatccaggattcccaaggacatgagtttgctacccgtatgggcaacgttttcatcatcggcaaaggaactaagccatggctatctcttcccaagggtaaaggtatcaagcttaccattattgaggaagctaggaagaggctggcagcacaaacaacaactgcttagacacatcattccattgatgcagaggtttacatattgtctggtttttgggacctctatttatgaattttggttgctctgacttggagtggtttactttttcttcatggtttttgggatgtttacctttagaattaaatggggaaaatctaaaatagcttatagtgctttggctgggtcagaatacttcgttgccctttacttccgaagaatctcttcctttaataactt

SEQ ID NO: 4389 - DNA, 1202 bp, Fagopyrum esculentum
tgtagtacacgagagagggggggggagaaaaatgggagactgtatataactgctagggttcttgttttgcttgggttattgcggccgaagaagtgagctaaaaaccctgcgtagcaatctcattgaagggaaccctctcatccagtccattcaccatggcgagaggattgaagaagcatatgaagaggcttaatgccccaaagcactggatgcttaataaacttggcggtgcttttgcgcctaagccctcatctggaccacacaaggcaagagagtgcttgccgttgatcctcattctgaggaacaggttgaagtatgctcttacatacgccgaagtcatttctattttgatgcaaagacatgtactcgttgacaacaaagttaggaccgacaaaacttaccctgctggtttcatggatgttgtctcaatcccaaaaacaaacgagagcttccgtctcctctatgacacaaaaggaaggttccgtctccactctatcagagacgaggaggccaagttcaagctgtgcaaggttcgctctgtccaatttggtcagaagggaattccctacatcaacacctttgacggacgcaccattcgttatccagaccctttgatcaaggccaatgacagcatcaagctagaccttgaaaacaacaagattgtcgactttgtcaaatttgatgttggtaatgttgttatggtcactggcggtaggaacagaggtcgtgttggagtgatcaagaacagggagaagcataagggaagctttgagaccatccacatccaggactcccaaggacatgagtttgctactcgtatgggcaacgttttcatcatcggcaaaggaactaagccatggctatctcttcccaagggtaaaggtatcaagcttaccattattgaggaagctaggaagaggctggcagcacaaacaacaactgcttagatacatcattccattgatgcagaggtttacatattgtctggtttttgggacctctatttatgaattttggttgctctgacttggagtggtttactttttcttcatggtttttgggatgtttacctttagaattaaatggggaaaatctaaaatagcttatagtgctttggctgggtcagaatacttcgtcgccctttacttccgaagaaatctcttcctttatacttaaacgttataaaatctcaagtatagtag

SEQ ID NO: 4390 - DNA, 1111 bp, Lactuca sativa
cttcggcgggggatatcgaagagggtgtgcggctgcgagtgaggaggagaggcgcagttcaaccggacgagactaccggagatctccaagtcgtcactacaacgcaaccatggcgaggggtttgaagaagcacatgaagaggctcaatgcgcctaagcattggatgctcgataaacttggtggtgctttcgctcccaaaccttcatctggaccacacaaatcaagggaatgcttgcccttgatcctgatccttcgtaacaggttgaaatatgctttgacttatcgtgaggttcaatctattctgatgcaaaggcatgtgcttgttgacaacaaggtcaggactgacaaaacttaccctgctggtttcatggatgttgtctccattcccaaaacaaatgagaacttccgtcttctttatgacaccaaaggaagattcagactccactcagtcagggatgaagaatccaagtttaaattgtgcaaggtaagatcagtccaatttgggtcaaaggggattccatacatcaacacatacgatggaagaacaatccgttaccctgaccctttaatcaaagctaatgacaccattaaacttgatctggattccaacaagattgttgatttcatcaaatttgatgtgggaaatgttgtgatggtgactggaggaagaaacacagggcgtgttggaatcttgaagaacagggaaaaacataagggaagctttgaaactgttcacattcaagattcaacaggtcatgaatttgctactcgtttgggcaatgtgttcacccttggaaagggaacaaagccatgggtgtctctccccaagggcaagggtattaagttgaccatcattgaggaagctaggaagaggcaagctgctgttgctgcaactgcttagatcttttaatgattttcgagattttattgcttttcatagtttttgttatgttataattatcattgttaaacttttttcaattgcatttggtacaatttttgttatggaagtgttgaattttgctacctttgttttggtatgtttctaattccatgacataaatgaaatgaagtagattaattaattaatgattaatgatatacaatatac

SEQ ID NO: 4391 - DNA, 1252 bp, Lactuca sativa
attaaagtaaaatacatataaattttagtacccttattaaaccaggcccagtccgtatatgattcaagcccattcaaattccaccatctgaaataggttctgcaacttatataaacatatgttttagggttcaataaaaagagatcatcgaagagggtgtgcggctgcgagtgaggaggagaggcgcagttcaaccggacgagactaccggagatctccaagtcgtcactacaacgcaaccatggcgaggggtttgaagaagcacatgaagaggctcaatgcgcctaagcattggatgctcgataaacttggtggtgctttcgctcccaaaccttcatctggaccacacaaatcaagggaatgcttgcccttgatcctgatccttcgtaacaggttgaaatatgctttgacttatcgtgaggttcaatctattctgatgcaaaggcatgtgcttgttgacaacaaggtcaggactgacaaaacttaccctgctggtttcatggatgttgtctccattcccaaaacaaatgagaacttccgtcttctttatgacaccaaaggaagattcagactccactcagtcagggatgaagaatccaagtttaaattgtgcaaggtaagatcagtccaatttgggtcaaaggggattccatacatcaacacatacgatggaagaacaatccgttaccctgaccctttaatcaaagctaatgacaccattaaacttgatctggattccaacaagattgttgatttcatcaaatttgatgtgggaaatgttgtgatggtgactggaggaagaaacacagggcgtgttggaatcttgaagaacagggaaaaacataagggaagctttgaaactgttcacattcaagattcaacaggtcatgaatttgctactcgtttgggcaatgtgttcacccttggaaagggaacaaagccatgggtgtctctccccaagggcaagggtattaagttgaccatcattgaggaagctaggaagaggcaagctgctgttgctgcaactgcttagatcttttaatgattttcgagattttattgcttttcatagtttttgttatgttataattatcattgttaaacttttttcaattgcatttggtacaatttttgttatggaagtgttgaattttgctacctttgttttggtatgtttctaattccatgacataaatgaaatgaagtagattaattaattaatgattaatgatatacaatatacatatagtac

SEQ ID NO: 4392 - DNA, 1018 bp, Lactuca sativa
tcaagagggtgtgcggctgcgagtgaggaggagaggcgcagtttaaccggacgagactaccggagatctccaggtcttcactacaacgcaaccatggcgaggggtttgaagaagcacatgaagaggctcaatgcccctaaacattggatgcttgataaacttggtggtgcttttgctcctaaaccatcatctgggccacacaagtcaagggaatgtctgccattgatcttgatccttcgtaacaggttgaagtatgctttgacatatcgtgaggtccaatctattctgatgcaaaggcatattcttgttgacaacaaggtcaggactgacaagacttaccctgctggtttcatggatgttgtttccattcccaaaaccaatgagaactttcgtcttctttatgacaccaaaggtagattcagactccactcagtcagagatgaagagtccaagttcaagttgtgcaaagttaggtcagtccaattcgggcaaaagggcattccatacatcaacacatacgatggaagaacaatccgttacccagaccctctaatcaaagccaatgacacaatcaaactcgacttggactccaacaaaattgttgacttcatcaaattcgatgttggaaatgtcgtaatggtgactggaggaagaaacacaggtcgtgttggaatcttgaagaacagagaaaaacataagggaagctttgaaactgttcacattcaagattccacaggtcatgaatttgccacccgtttgggcaatgtgtttacccttggaaaaggtacaaagccatgggtgtctcttcccaagggtaaaggtatcaagttgacaatcattgaagaagctaggaaaagacaagctgctgttgctgctactgcttaaatgattctcaaagtttattgcttttcatagttttttgactttttgttatgttataattcatgtttaaacttttttttattgcatttggtacgattttttttatgggactgttgaattttgcaaactttggtat

SEQ ID NO: 4393 - DNA, 1135 bp, Mimulus guttatus
agggtttacattttccttcactttcaatccttcagctacacacacagggaggcgccgccgtcttcttcttcttcatccaccagcaaaatggctagaggtttgaagaaacacttgaagaggctcaatgccccaaagcattggatgttggacaagcttggtggtgcttttgcccccaaaccttcgtctggaccccacaaatcaagggaatgcttgcccttgattctcattttgcgaaataggctgaaatacgctcttacataccgtgaggtgattgccattctgatgcaacgtcacatccttgttgatgggaaagtcaggactgataagacttatccagctggttttatggatgttgtctctatcccaaagaccaacgagaacttccgtcttctgtatgacactaagggaaggttcaggctacactcaatcagggatgaggaagccaagtttaagctatgcaaagtccgctcagttcagttcggaaagaagggtattccgtacatcaacacatacgatggaaggaccattcgctacccggacccacttatcaaggcaaacgacaccatcaagctggatttggacagcaacaagattgtcgactttatcaaattcgatgtcggaaatgttgtgatggtgactggtggtaggaacagaggccgtgttggaatactcaagaatcgtgagaagcataagggtagctttgagactgttcacattcaggattcaactggcaatgaatttgctacacgattgagcaacgtgtacaccattggaaagggtacaaagccgtgggtttctcttccaaagggcaaaggtattaagtttactatcattgaggaggccaggaagaggctcgctgcccaatcggcaactgcttaatagtaatattatttttcttctttgcatgactagatgttagtttaaatttgtcggagcatgcatttttcaatcctatcgagactggaccattgctatattcttctatccgtcgtttttattattgtaggattttgactggagaaaatttgtggttttgtttttttcatttgcaaaatttaattgagcttctcattttggacactttagtttgggtgtttggttcgaattttagttgttgcctaataatgtgtgcctt

SEQ ID NO: 4394 - DNA, 1112 bp, Phalaenopsis aphrodite
gaaaagctagccgtcgtccggtgacgcgcagcttcttctccagtgggaaaatctgatcatacatggctagaggactgaagaaacatctcaagaggctcaatgcccccaagcactggatgcttgacaagcttggtggcgctttcgccccaaagccatcttctggacctcataaagctagggagtgtttgcctctgatccttatattgaggaaccggttgaaatatgctctcactaatcgtgaagtcattgctatattgatgcagcgacttgtgatggtggatggaaagattaggacggacaagacttatcccgctgggttcatggatgttgttcaaatcccaaaaacaaatgaaaattttaggcttctttatgacacaaagggacgttttcgtcttcattcaattagggatgaagaggcgaagttgaagctctgcaaggttcgttcggtccagtttggccagaaaggaattccatatctcaacacctacgacggacgaacgatccgctatcccgatcctctcattaaggcgaacgacaccattaaactcgacctcgacaccaacaagatagtagacttcataaaatttgatgttggcaacgtcgtgatggttaccggcggaaggaacaggggccgtgtcggagtgatcaagaaccgggagaagcacaagggtaccttcgagaccattcacgtccaggatgccgccgggcaagagttcgccacccgtctcggcaatgtttttactgtcggaaaggggaccaagccatggatttcgcttcctaaggggaagggtgttaagctgtccatcattgaggaggccagaaagcgccttgctgctgcttcaactgtcgctgcttgagcgtagtagggctactatgtttttgtaagagctaactaaaattacaaagcaagaagggagttttgattctgaaatgctttgtttttaagtcctaatcttctgtgttaattcttttttttgcctgttatggggggtatatgctacaaatctctgagctttgcacaatgcttatgttttcattacaacaatgatgagaaatcaaattcacaattctatatatgaatgatgattgtctattatttatttattcaaaaa

SEQ ID NO: 4395 - DNA, 969 bp, Lippia dulcis
ccaacatggctagaggattgaaaaaacacttgaagaggctcaatgctccaaagcactggatgttggataaactgggtggtgcctttgcccccaaaccatcatctggcccacacaaatcgagggagtgcttgcccttgattctcattctgcgaaacaggttgaagtatgcttttacttaccgtgaggtgattgctattctgatgcaacgtcacatccttgttgatgggaaagtaaggacagacaagacttacccaactggatttatggatgttgtttccattcccaagaccaatgaaaacttccgtctgctttatgacaccaagggacgcttcaggctccactctatcagggatgaggaagcaaagttcaagctttgcaaagtccgcaatatccagtttggcaagaaaggcattccttaccttaacacttatgacggaaggaccattcgttaccctgaccctctcatcaaggccaacgacacaattaaactcgaccttgagagcaacaagattactgatttcatcaagtttgatgtaggtaatgttgttatggtgactggtggtaggaatagaggacgtgttggtattctcaagaaccgtgagaagcataagggaagcttcgagactgtccacattcaggatgcaactggtcatgagtttgccactcgattagggaatgtctacaccattggaaaaggtaccaagccgtgggtatctctaccaaagggtaagggtattaagctatctatcattgaggaggccaagaagaggattagtgcccaagctgcgacagcttagagtatcacttcttgaagattgaagtaatgttttagctcattgtattttgttgttcggcactttttctatgaggtttagacattcctatcgagttgtctttgaaaaacatagctaaaagttattaagttggattctaaatttcggatcgattttatttatgaaaagcatcaaa

SEQ ID NO: 4396 - DNA, 1092 bp, Solanum tuberosum
aaatggcaagagggttgaagaaacatttgaagaggctcaatgcgcctaagcattggatgcttgataaacttggaggtgcttttgctcctaagccttcttctggtccacacaaatcaagggaatgtttgccattagttattatcctcaggaacaggttgaaatatgctttgacataccgtgaggtcatttcaatcttgatgcaacgacaagttatggttgatgggaaaattaggacagataagacctatcctgctggttttatggatgttgttacgattccgaagactaatgagagcttccgacttctttatgacactaagggtcggttccgtctccactcactaagagatgaggaagccaagttcaaactttgcaaggttcgatcagtgcagtttggacagaagggaatcccatatctcaacacttatgatggaagaacaatccgctaccctgatcccctcatcaaggccaatgacaccatcaagctggacttagattccaataagattgttgacttcatcaaatttgatgttggtaatgtggtcatggttactggtggtagaaacagggggcgtgttggaattcttaagaatagagagaagcacaagggtagctttgagacagttcacattcaggattccctggggcatgagtttgctacccgtttggggaatgtgttcactcttggtaaaggtagtaagccgtgggtgtctctacctaagggtaaaggtatcaagttatctatcattgaagaggctcgcaagaggatggctactcaatcagctacaactgcttaaaaatgataggttgaacttgagatgaatttaatagattgggccatgtttctctttgtttagagggatgccattcttattttgtgtgttgcatttcaacatctgtgtactcggtactgatttacttgcctttttttgtcgggaaaaaaggtagactgagttgagatcaatcagttgccttttatgtgatagtattttattgcgacagagtttaaggaccttgtccattagcctattcacttatttcaaaatgagttttggttgtaatattttcaaatctaacctggagttggattcc

SEQ ID NO: 4397 - DNA, 952 bp, Carthamus tinctorius
cgggggagcttaacagatgcagggatgcggcagtgagaaaacagtccaccggagaattccaccggagatttagatctcctctaagacaccgtagccatggcgagaggtttgaagaaacatatgaagaggctcaatgcgcctaagcattggatgcttgacaaacttggtggtgcttttgctcccaagccatcatcaggaccacacaaatctagggaatgcttgcctttgattctcatcctccgaaataggttgaagtatgcccttacataccgtgaggtcatttctattttgatgcaaaggcatgtgcttgtcgacaacaaagtcaggactgacaagacctacccagctggttttatggatgttgtttctattccaaagactaatgagaacttccgtctcctatacgataccaaaggtagattcaggctacactcaatcagggacgaggaagcaaagttcaagctatgcaaggttcgttccgtccagtttggttcaaagggcattccttacatcaatacatatgatggtcgaaccatccgataccctgacccgctcattaaggccaacgacaccattaagcttgatttggaatcaaacaaggttgttgatttcatcaagtttgatgtgggaaatgtcgttatggttactggtggacgtaacactggccgtgttggaattctaaagaacagggaaaagcataagggcagcttcgagaccgttcacattcaggacgctaccggccatgagtttgccacacgtttggggaacgtgttcacggtgggaaagggtacaaagccgtgggtgtctcttcccaagggtaagggtatcaagttaaccatcatcgaggaggctaggaagaggcgtgctggccaagaccctgttgcctagatcgcatgattctagtgttctgttcttgcaggttcgtgggaaagtgttcttttttacttgctta

SEQ ID NO: 4398 - DNA, 1069 bp, Carthamus tinctorius
  misc_feature (802)..(802): n is a, c, g, or t
ggttcattgcagctagttgcgattgtggaggagagaggcgcaaatagcacaagaccgccggagttcttccgaagaaaatcacacaacgcaaccatggctaggggtttgaagaaacatatgaagaggctcaatgcccctaaacattggatgcttgataaactgggtggtgcttttgctcctaagccttcatcaggaccccacaaatccagggagtgcttgcccttgattctcattctccgaaataggttgaaatatgctttgacttaccgtgaggtcgtatctattttgatgcaacgtcatgtacttgttgacaacaaggtcaggactgacaagacataccctgctggtttcatggatgtcgtttcaatccccaaaaccaatgaaaacttccgtcttgtttatgataccaaaggtagattcaggctgcactcgatcagagatgaggagtcaaagttcaagctgtgcaaggttcgttccgtccagtttggctcaaagggtattccgtacataaacacctacgatggccgcacaatccgctaccctgaccccctcatcaaggctaatgacaccataaaactcgatttggactccaacaagatcgtcgatttcatcaagtttgatgttggaaatgtcgtgatggttaccggcggaagaaacacaggccgtgtcggaatccttaagaacagagaaaaacataagggcagtttcgagactgtgcacatccaggattccaccggtcacgagtttgctacccgtttgggcaacgtttttacgatcggaaagggttcgaagccgtgggtgncccttcccaagggcaagggtattaagttgaccattattgaagaggctagaaagaggcaggctgccttaactgctagtgcttagattgggagatttatgggcttttattgagatagtttgtgatgttataggtaatattacaggattatttgaaggaacttgttttgtttttgcatttttgggtacattttgaaggttaatttggttttggaacaatgggttttgctaaatgtaggccattttatttatgttgctatttgttctctac

SEQ ID NO: 4399 - DNA, 1080 bp, Salvia sclarea
ctactagaccttggctgtcactcaggagcacagaagccagtgtaaagagaagaagaaacacaggccgccgccgccgtgttttccctccaccactaccaatatggcgagaggattgaagaaacacttgaagaggctcaatgccccgaaacattggatgttggataaattgggtggtgcttttgcccccaagccatcatctggtccccacaaatcgagggagtgcttgcccttgattctcattctgcgaaacaggctgaagtatgctttgacttaccgtgaagttattgccattctgatgcaacgccatatccaggttgatgggaaagtaaggactgataagacctaccctgctggatttatggatgtggtctccattcctaagaccaacgaaaacttccgtctgctttatgacaccaagggtcggttcaggctccactcgatcagggatgaggaagccaagttcaagctgtgcaaagtccgcaatatccattttggcaagaaaggcattccttacctcaacacttatgatggaaggaccatccgctaccctgaccctctcatcaaggccaacgacacaatcaagctggaccttgagagcaacaagatcactgacttcataaagtttgatgtaggtaatgttgttatggtgacaggtggtaggaacagaggtcgtgttggtattctcaagaaccgtgagaagcataagggaagctttgagaccgtccacattcaggacgccactggacacgagttcgccacccgtctcgggaacgtgtacaccatcggaaagggtaccaagccgtgggtatctctaccaaagggtaagggtattaagctgtctatcatcgaggaggccaagaagaggattagcgcccaagccgccactgcttagagatatctttaatttctggatggttgaagtagttttagctccttgtatcttgatgtttggcgcttcttctatgaggttttgacgttcttattgtttctgcttttaaaacatagttgcgcttcctaagttggattttttaatttcggatctgttttatttgtgataattatcaagttttggttgctcaa

SEQ ID NO: 4400 - DNA, 1212 bp, Silene vulgaris
catattcgcaaattctcctgcagttcggccgccgctctgatcgttcgcttttcattccaacttgatcttcaacctcaacatggcgagaggcttgaagaagcatttgaagaggctcaatgcgcccaagcattggatgcttgacaaacttggcggtgcttttgctcccaagccatcatccggaccacacaaagccagggagtgtttgccccttatccttatcttgcgtaacaggttgaagtatgctcttgtttaccgtgaagtcattgccattctcatgcaacgccaaatcatggttgatggaaaggtcagaactgacaagacttaccctgctggtttcatggatgttatttccattcccaaaacaaacgagaacttccgcctattgtatgatgttaagggtcgcttcagacttcactctgtcagagatgatgaggctaagttcaagctctgcaaggtccgcaacgtgcagtttggcaacaagggtatcccatacctcaacacttatgatggaaggactatccgctacccagacccccttatcaaggcaaatgataccatcaaacttgaccttgaagagaacaagattgtggagtttgtcaagtttgatgtaggtaatgtggtcatggtaacaggaggtagaaacagaggtcgtgttggagtgatcaagaacagggagaagcacaagggaagcttcgagacaatccacattcaggattcccagggtcatgagtttgcaacgcgtatgggcaatgtgttcatcattggcaaaggcacaaaaccatgggtttctcttcccaagggtaagggtattaagctgaccatcatcgaggaagcacgcaaaaggcaggcagagaagtcagcagttactgcttgattagttcagttcctatcgtgttatttagaagtttggaagttctttttttttacaatatgctttagtaatctcaagtgagacccatgaagagtattatggattttggatagaacctttgaagccatgtttttttgaacttcttttgttttatgataaaaaccggtttgaatacatgtgttcctttgaatttgtttttgaagcagtaactgattatgaagagttccctcacctccttgtcatcggtgtaggaaggtgagtattgaggcgtgtggtttagagcctacaatgaaggcgtgagtgaagccggttaacttttttatccatggtgaattggtaat

SEQ ID NO: 4401 - DNA, 1093 bp, Solanum phureja
gtatcttcatctcgttagggtttaagacacacacctctcgccggtagccgtcactcgtgccagctaatcagtcggaaaaccgccaaaatggcaagagggttgaagaaacatttgaagaggctcaatgcgcctaagcattggatgcttgataaacttggaggtgcttttgctcccaagccttcttctggtccacataaatcaagggaatgtttgccattggttattatcctcaggaacaggttgaaatatgctttgacataccgtgaggtcatttctatcttgatgcaacgccaagttatggttgatgggaaagttaggacagataagacttaccctgctggtttcatggatgttgttactattccaaagacaaatgagagtttccgacttctttatgacactaagggtcggttccgtctccactcactcagagatgaggaggccaagttgaaactttgtaaggttcgatcagtgcagtttggacagaaagggatcccatatctcaacacttatgatggaagaacaatccgctaccctgatcccctcatcaaggccaatgacaccatcaagcttgacttagattccaataagattgttgacttcatcaaatttgatgttggaaatgtggtcatggttactggtggtagaaacagggggcgtgttggaattcttaagaacagagagaagcacaagggtagctttgagacagttcacattcaggattccctggggcatgagtttgctacccgtttgggaaatgtgttcactcttggtaaaggtagtaagccatgggtgtctctacctaagggtaaaggtatcaagttatctatcattgaagaggctcgcaagaggatggctactcaatcagctacaactgcttaaaaatgatgggttgaacttgtgataaatttaacaggttgggccatgtttctctttgtttagagataccaatcttattctgtatgttggattttaacatttttgtactcggtaccgtttaactttgttttgttgggaaaagaggttgactgagtttaagatcattcatttgctttttatatgatagttttttgttggtcgcttagtttaattg

SEQ ID NO: 4402 - DNA, 954 bp, Euphorbia esula
gctgggcaatttgtgctgattccagagccgttactacgcctctttcaaaatggcgagaggattgaaaaagcatttgaagaggctcaatgccccaaagcattggatgcttggcaaacttggtggtgcttttgctcccaagccatcatctgggcctcacaagtctcgtgagtgcttgccattgatcctaattctgagggacagattgaagtatgccctcacataccgtgaagttgtttccattctgatgcagcgacacatacttgttgatgggaaagttaggactgataaaacttatccttctggtttcatggatgttttgtcgatccccaagacaaatgagaacttccgtctcctttatgacaccaagggccgcttccgcctccacgctatcagagatgatgaggcaaagtttaagctgtgcaaagtccgatctatccaatttgggcagaagggtatcccttacctgaacacatatgatgggcgtactattcgctacccagatcccctcatcaaggcaaatgataccatcaagcttgacttggaaaccaacaagatcacagagtttatcaagtttgatgttggaaatgttgtcatggtcaccggaggaaggaacagaggaagagttggagtgcttaagaatagggaaaagcataagggatcttttgagactgtccacatccaagatgctactggtcatgagtttgctactcgtttggccaatgtgttcaccattggtaaaggtactaagccatgggtttctcttcctaagggtaagggtattaagctgactatcattgaggaggctaggaaaaagcaagctgcacttcaggcagccacctgaagagttgaattttaatgttgttgaagttttgttattagacttctcatgagatagttgcgttgttttttaggttcatgaaaggctgaatgtttgtttgtttgtttttatttttt

SEQ ID NO: 4403 - DNA, 969 bp, Helianthus annuus
aggagaaggtgccgctgctgttccatcgtatatttccaccggaggctccgatctcctactgcagccatggctagaggtttgaagaaacatatgaagaggctcaatgctcctaagcattggatgcttgataaacttggtggtgcttttgctcctaagccatcatctggacctcataaatcaagggaatgcttgcccttgatcctcatcttgaggaacaggttgaagtatgctttgacttaccgtgaggttcaatctattttgatgcaacgacatgtgcttgttgataacaaggtcaggactgacaagacttaccctgcgggtttcatggatgtcgtctcaattccgaagaccaatgaaagtttccgacttctatatgatacaaagggcaggttcaggcttcactccatcagggatgaggaatcaaagttcaagttgtgcaaagttaggtctgttcaatttggttcaaaggggattccatacatcaacacttatgacggccggacaattcgctacccagatccactcatcaaagctaacgacaccatcaaactcgatttggagtcgaacaagatcgttgatttcatcaagtttgatgtcgggaatgttgtcatggtgacaggtggacgcaacactggtcgtgttggaatccttaaaaacagagaaaaacataagggcagctttgagacggttcacattcaagatgccactgggcacgagtttgccacccgtttgggaaatgtgttcactcttggaaaaggttcaaagccttgggtatcacttcccaagggtaagggtatcaagttgacaatcattgaggaggctaggaaaaggcaggctgcacaagatgcaactgcataggtggtttgattttgtattgattgtgttctaggagagttatgttttaatttgggtacaattttcaattttgagaccttggatatgcattttaaagttggtttgattacaaat

SEQ ID NO: 4404 - DNA, 1167 bp, Helianthus annuus
cccaaatattggaagaaggcccaaaaaagcccacgaaatagtgatataaaccgatctcctagggtttatcagaaggagaaggtgccgctgctgttccatcgtatatttccaccggagactccgatctcctactgcagccatggctagaggtttgaagaaacatatgaagaggctcaatgctcctaagcattggatgcttgataaacttggtggtgcttttgctcccaagccatcatctggacctcataaatcaagggaatgcttgcccttgatcctcatcttgaggaacaggttgaagtatgctttgacttaccgtgaggttcaatctattttgatgcaacgacatgtgcttgttgataacaaggtcaggactgacaagacttaccctgcgggtttcatggatgtcgtctcaattccgaagaccaatgaaagtttccgacttctatatgatacaaagggcaggttcaggcttcactccatcagggacgaggaatcaaagttcaagttgtgcaaagttaggtctgttcaatttggttcaaaggggattccatacatcaacacttatgacggccggacaattcgctacccagatccactcatcaaagctaacgacaccatcaaactcgatttggagtcgaacaagatcgttgattttatcaagtttgatgtcgggaatgttgtcatggtgacaggtggacgcaacactggtcgtgttggaatccttaaaaacagagaaaaacataagggcagctttgagacggttcacattcaagatgccactgggcacgagtttgccacccgtttgggaaatgtgtttactcttggaaaaggttcaaagccttgggtatcactccccaagggtaagggtatcaagttgacaatcattgaggaggctaggaaaaggcaggctgcacaagatgcaactgcataggtggtttgattttgtattgattgtgttctaggagagttatgctttaatttgggtacaattttcaattttgagaccttggatatgcattttaaagttggtttgattacaaattataaaccttaaaaaataattaaaacttgggggccggcttgggccaagtcaactttttaactcgaacaagcttttgcatgcgggccgcaattctggcctcttttggccaaattcccccttaaagg

SEQ ID NO: 4405 - DNA, 807 bp, Triphysaria pusilla
aaaatggcgagaggtttgaagaaacacttaaagaggctcaatgccccgaaaaattggaatctggacaaacttggtggtgcttttgcgcccaaaccatcgtccgggccccacaagtcccgggaatgtttgccgcttattctgattctacgaaacaggctcaagtatgctctaacataccgtgaggtgattgctatcctgatgcaacgacacattcaggttgatggcaaagtcaggacagacaagacatatccttctggtttcatggatgttgtctctattccaaagacaaatgagaatttccgtcttctgtatgacaccaagggccgtttcaggctgcactctgtccgtgatgaggaggccaagttcaagctatgcaaagtccgttcagttcagttcggcaagaaaggcatcccgtacattaacacttacgacggcaggacaatccgctaccctgacccactgatcaaagccaacgataccatcaagttcgacctcgagagcagtaagatcgtcgatttcatcaagttcgacgtcgggaatgttgtgatggtgacaggtggcaggaacaggggacgtgttggtgtgatcaagaaccgtgagaagcaaaagggcagttttgagactattcacgtccaggatgcttctgggcacgagtttgcaacgaggctgagcaatgttttcacgatcgggaaagggacaaagccgtgggtatcacttccaaagggtaagggtattaaactgactatcattgaggaggctaagaagaggcttgctgcccaaactgctgcagcttaatgaatatttttg

SEQ ID NO: 4406 - DNA, 902 bp, Helianthus annuus
ttgctgattgtgtttgtggagaagaggcggagttcttccgaagaaaatcacacaacgcaaccatggctagaggtttgaagaagcatctgaagaggctcaatgcccctaaacattggaatcttgataaactcggtggtgcttttgctcccaagccttcatccggaccccacaagtccagagagtgcttgcccttgattctcattctccgaaataggttgaaatatgctttggcataccgtgaagtcatatctattttgatgcaacgtcatgtacttgttgacaacaaggtcaggaccgacaagacttaccctgctggtttcatggatgttgtttcaattcctaaaaccaatgaaaactttcgccttgtttacgatacaaaaggtagattcaggctgcactcgataagggatgaggagtcaaagttcaagctgtgcaaggttcgttctgttcagtttggttcaaagggtattccgtacattaacacctacgatggccgcacaatccgctaccccgaccccctcatcaaggccaacgacaccataaaactcgacttggactccaacaagatcgtcgatttcatcaagttcgatgttggaaacgttgtgatggttaccggcggaagaaacacgggctgtgtcggaatccttaagaacagagaaaaacataagggaagtttcgagaccgtgcacatccaggatgccactggtcacgagtttgctactcgtttgggcaacgtttttacgatcggaaagggttcgaagccgtgggtgtctcttcccaagggcaagggtatcaagttgacaattattgaagaggctagaaagaggcaggctgccttaactgctagtgcttagatttggaattttatgggaattatttgagatagtttgtgatgatgtgat

SEQ ID NO: 4407 - DNA, 987 bp, Gossypium hirsutum
cttctttcaggctagagggttgaagaaatacttgaagaggctcagtgcccccaggcattggatgctcgacaagcttggtggcgccaaagccatcgtctggaccccacaagtcgagggaatgtttgccacttattctcattctgcgaaacaaactgaagtatgctttgacatacagagaagtgattgctattcttatgcaaaggcatgttatggtagatgggaaggttaggactgataagacctaccctgcaggttttatggatgttgtgtcaattcccaagacaaatgaggacttccgtctcctttatgacactaaaggtcgtttccgccttcatgccatcactggtgatgagactaagtttaagctctgcaagttaggtctgtccaatttggccaagaagggtattccatacctaaatacctacgatggacgcacaatacgctacccagaccctttgatcaaagccaacgacaccatcaagcttgacttagagagcaacaaaattgttgatttcattaagtttgatgttgggaatgttgtcatggtcactggtggaaggaacaggggacgtgttggagtgattaagaacagggagaagcataagggtagcttcgagacaatccatgtacaagatgctgctggacacgagttttgcaactcgtctaggcaatgtcttcacaatcggtaaaggaacaaagccatgggtttcgcttcccaagggcaagggtatcaagttgtcgatcattgaggaagcgaggaagaggcttgctgctcaggctgctgcttaaacctatcatatctagagttttttttttgcgcaaaagacttgttggattgaatgctggctggtcctgtcctagcttttgtagggtttatggactttgctttttattaatgtcttttttttctatgtaatttagtttagttactcatttggtttatgcttatattttgactatcatttatcacattacagttctttctag

SEQ ID NO: 4408 - DNA, 795 bp, Brassica napus
acaaaaaaaatggcaagaggattgaagaagcatctgaagaggctcaatgcccccaagcattgggatcttgacaaacttggtggtgccttcgctcccaagccctcttctggaccccacaagtctagagaatgccttcctctcgtcctgatcatcaggaacaagttgaagtacgctttgacataccgtgaagtcatctccatcttgatgcaaaggcatatccaagtcgatggtaaagtcaggactgacaagacttaccctgccggcttcatggatgttgtctccatccccaagacgaatgagaacttccgtcttctctatgacaccaagggacgtttccgtctccactccatcagggatgaggaagctaagttcaagctttgcaaggttaggacgatccagctagggcaaaagggaatccctttcctcaacacatacgacggtcgcaccatccgttaccccgacccactcatcaaaccgaacgacaccatcaagctcgacctcgaggagaacaagggtcgtggacttcatcaagttcgacgtcggcaacgttgtgatggtgactggagggagaaacagagggcgtgtgggtgtgattaagaaccgtgagaagcataagggaagctttgagacgattcacatccaagactcgacggggcatgagtttgccacgaggttggggaatgtgtttaccttggggaaagggacgaagccgtgggtgtctctacccaagggaaaaggtattaagcttaccatcattgaggaagctaggaagaggctctctgctcaacaagctgc

SEQ ID NO: 4409 - DNA, 912 bp, Centaurea maculosa
accggagatttacatctcctccaatacctgcagccatggctagaggtttgaagaaacatatgaagaggctcaatgcgcctaagcattggatgcttgacaaacttggtggtgcttttgctcccaaaccatcctctggacctcacaagtctagggaatgcttgcctttgattcttatcctccgaaataggttgaagtatgcccttacataccgtgaggtgatttctatcttgatgcaaaggcatgttcttgtcgacaacaaggtcaggactgacaagacctacccagctggtttcatggatgttgtttctattccaaagaccaatgagaacttccgtctcctatacgataccaaaggtagattcaggctacattctatcagggatgaggaggcaaagttcaagctatgcaaggttcgttcagtccagtttggttcaaagggcattccttacatcaacacatacgatggccgaaccatccgttacccagacccactcattaaggccaacgataccattaagcttgatttggattcaaacaagattgttgatttcatcaagtttgacgtgggaaatgtcgtcatggttactggtggatgaaacactggacgtgtaggaattctaaagaacagggaaaagcataagggcagtttcgagaccgttcacattcaggatgctaccggccacgagtttgccacgcgtttggggaatgtgttcacggttggaaagggtacaaagccgtgggtgtctcttcccaagggtaagggtatcaagttaaccatcatcgaggaggctaggaagagacgggctggccaagaccctgttgcctagatgctctgattttggtgttttgtttcttgcaaggttcgtgagaagttttctttctcttgcttttttgtatggtacaattttaaac

SEQ ID NO: 4410 - DNA, 863 bp, Cynara scolymus
gccgcagacgacagccgtagaagaatcttaccggagattttcatctcctacatccccacgccgcaaccatggctagaggtttgaagaaacatatgaagaggctcaatgcccccaagcattggatgcttgataaacttggtggtgcttttgctcctaagccatcctcaggaccccataaatccagggagtgcttgcccttgatcctcatactgaggaataggttgaagtatgccttgacataccgtgaggttatttctattttgatgcaacgccatgtacttgtggacaacaaggtcaggactgacaagacttaccctgctggtttcatggatgttgtctcaattcccaagaccaatgaaaacttccgtcttctatatgatacaaagggtcggttcagactgcactcaatcagggatgaggaatcaaagttcaagctgtgcaaggttcgttctgtccaatttggtcagaaaggcattccttacattaacacctatgatggaagaaccattcgctacccagatcctctcatcaaagctaatgacaccatcaagcttgacttggacacaaacaagattgttgatttcatcaagtttgatgttgggaatgtggtgatggtgactggtggaagaaacacaggccgtgttggaatccttaagaacagagaaaagcataagggcagttttgagacggttcacatccaagatgcaactgggcatgagtttgcaactcgtttaggcaacgtcttcactcttggaaagggttaaagccatgggtatctcttcccaagggtaaggtatcaagctgaccatcattgaagagctagaaagagcaggctgctctagctgcactgcctaatctgtatc

SEQ ID NO: 4411 - DNA, 996 bp, Flaveria ramosissima
cggctgtgaatcgtagaggaagccgaagactttcgccggagatttagatctcccacccgacacaacaaccatggctagaggtttgaagaaacatctgaagaggctcaatgcccccaagcattggatgcttgacaaacttggtggtgcttttgctcctaaccatcatctgggccacacaaatctagggaatgcttgcctttgatcctcatattgaggaacaggttgaagtatgcattgacataccgtgaggtacaatctattttgatgcagcgtcatgtccttgttgacaacaaggtcaggactgacaagacctaccccgctggtttcatggatgttgtttctatccctaagaccaatgaaaacttccgtcttctttatgatacaaaaggaagattcagattgcactcaatcagagatgaggagtcaaagtttaagttgtgcaaggttcgttcagtccagttcggttcaaagggcattccatacatcaatacctatgatggtcgaactattcgctacccggacccactcatcaaagccaatgacaccattaagcttgatctagactcaaacaagatagttgattttatcaaatttgatgttggaaatgttgttatggtaactggtggaagaaacaggggccgggttggaatccttaagaacagggaaaagcataagggcagctttgaaacagttcacattcaagatgctttgggccatgagtttgccacccgtttgggtaatgtttttactattggaaagggttcaaaaccatgggttctttacccaagggtaagggtatcaagctaactatcatcgaagaggctaggaagaggcaggctgcccaagaatctgctgcttagattgtgtttggttatagagacactggtgttttgtttttgatttcaggttggtgggaagtttcttcctgctttttctttgttacaattttgaacctatgtttgatgctggttaatttgttataaattgtgaacttct

SEQ ID NO: 4412 - DNA, 906 bp, Centaurea maculosa
tggctagaggtttgaagaaacatatgaagaggctcaatgcgcctaagcattggatgcttgacaaacttggtggtgcttttgctcccaaaccatcctctggacctcacaagtctagggaatgcttgcctttgattcttatcctccgaaataggttgaagtatgcccttacataccgtgaggtgatttctatcttgatgcaaaggcatgttcttgtcgacaacaaggtcaggactgacaagacctacccagctggtttcatggatgttgtttctattccaaagaccaatgagaacttccgtctcctatacgataccaaaggtagattcaggctacattcaatcagggatgaggaggcaaagttcaagctatgcaaggttcgttcagtccagtttggttcaaagggcattccttacatcaacacatacgatggccgaaccatccgttacccagacccactcattaaggccaacgataccattaagcttgatttggattcaaacaagattgttgatttcatcaagtttgacgtgggaaatgtcgtcatggttactggtggacgaaacactggacgtgtaggaattctaaagaacagggaaaagcataagggcagtttcgagaccgttcacattcaggatgctaccggccacgagtttgccacgcgtttggggaacgtgttcacggttggaaagggtacaaagccgtgggtgtctcttcccaagggtaagggtatcaagttaaccatcatcgaggaggctaggaagagacgggctggccaagaccctgttgcctagatgctctgattttggtgttttgttcctgcaggttcgtgagaagttttctttctcttgctttttgtatgggacaattttaaacctatgttttgatgctgcaagttatgttaaacta

SEQ ID NO: 4413 - DNA, 1033 bp, Cichorium intybus
gagaagtgccgctgtaagtgcagaggaccgtcgcagtttcgccgtacaacaataccggagattcctatctcctacaccacacgccgcagccatggctcgaggtttgaagaaacacatgaagaggctcaatgcccccaagcattggatacttgataaacttggtggcgcttttgctcctaaaccatcatcaggacctcacaaatccagggaatgcttgccctcgatcctcatactcaggaacaggttgaagtatgctttaacataccgtgaggtccaatctattttgatgcaacgccatgtacttgttgacaacaaggtcagaactgacaaaacctaccctgctggtttcatggatgctgtctcaattcccaaaaccaatgaaaacttccgtcttctatatgacaccaagggcaggttcaggctccactcaatcagggatgaagaatcaaagttcaagttatgcaaagttcggtcagttcaacttgggcagaagggcattccatacatcaacacttacgatgggcgtacaattcgctacccggacccactaatcaaagccaatgacacaatcaaactcgacttggactccaacaagattgttgatttcatcaaatttgatgttggcaatgttgtgatggcgacaggtggcagaaacacgggccgtgttgggatccttaagaaccgtgaaaaacataagggcagttttgaaactgttcatatccaagatgctactgggcatgagtttgctacccgtttgggcaatgtgtttactcttggaaaggggactaagccgtgggtgtcgctgcccaagggcaagggtattaagctgaccattattgaggaggctaggaagaggcaggctgcccaagctgcccaagttgcttgattttgtattggtggtttggtcttgttgagactatgtggtagtggttggtttttagaggagttttatgttatgattttggtacaattttggaaagtttggatttgcatgttggaagttgattttacaaattggactcattgccgaaaa

SEQ ID NO: 4414 - DNA, 990 bp, Flaveria ramosissima
acgcatacgcttgtggtagtgcggcactaggagttaccgtcggagaggagcagcgtagaagaagaagaagttcaccggagattcagatctcccgccggagaccgcaaccatggctagaggtttgaagaagcacatgaagaggctcaatgccccaaagcactggatgcttgacaaacttggtggtgcttttgctcctaaaccatcatctggacctcataaatctagggaatgcttgcctttacttctcattctgaggaataggttgaagtacgccttgacttaccgtgaggttcaatctattttgatgcaacgtcatgttcttgttgacaacaaggttcggactgacaagacataccctgctggtttcatggatgttgtttccatccccaagaccaatgaaaactttcgtcttctttatgacacgaaaggtagatttagactgcactcaatcagagatgaggagtcaaagtttaaactgtgcaaggttcgctcagtccagtttggttcaaagggcattccatacatcaacacttatgatggccgaaccattcgttaccctgacccacttatcaaagctaatgacaccatcaagcttgatctagatacatacaaaattgttgattttatcaagtttgatgttggcaatgttgttatggtaactggtggaagaaacactgggcgtgttggaatccttaagaacagggagaaacataagggcagctttgaaacagtccacattcaagatgctacaggccatgagtttgctacccgtttgagtaatgtttttactatcggaaagggttctaaaccgtgggtgtctttacccaagggtaagggtatcaagttaagcatcattgaggaggctagaaagaggcgtgctgcccaagatcctgttgcctaggcgataagattttgctgtcgtgtttatgatttcaggttgggattgtttttttgttgtctttatgttttgacagttatcagttatgttat

SEQ ID NO: 4415 - DNA, 1035 bp, Raphanus sativus
gggccgccactgaggaagaagaaggagagtcgtcgtctgctccgaaacaacagctgcaaacatggcaaggggattgaagaagcatctgaagaggctcaatgccccccatcattggggtcttgacaaacttggtggtgccttcgctcccaagccgtcttctggacctcacaagtctagggagtgtcttcctcttgtcctcatcatcaggaacaggttgaagtatgctttgacataccgtgaagtcatctccatcctcatgcagaggcatattcaagtcgatggtaaagtcaggactgacaaaacataccctgctggcttcatggatgttgtctccatccccaagaccaatgagagcttccgtcttctttacgacaccaagggacgtttccgtctccactccatcagagatgaggaagcaaagttcaagctttgcaaggtgagggctatcctgctcggacgaaagggaatcccttacctcaacacttacgacggtcgcaccatccgctaccccgacccgctcatcaaacccaacgacaccatcaagctcgacctcgaggagaacaagattgtcgagttcatcaagtttgacgtcggcaacgttgtgatggtgactggtggaaggaacagagggcgtgttggtgtgattaagaaccgtgagaagcataagggaagctttgagacgattcacatccaagactcgacggggcatgagttcgccacgaggttgggtaatgtgttcactctggggaaagggactaagccgtgggtgtctcttccaaagggtaaaggtattaagctgaccatcattgaggaagctaggaagaggctttctgctcagcaagctgcttaaatgttgaatcattcaagactgtttgttcgcttcttgcttcagttttgagtttgtttttttctttttattacatgtttcttgcttgcaaaaccccataaggaaaaaaaaaacagctgagcgttttagagagttttgtaatatttgtatggatatttttttatagtaacctactcttcaaaatcaca

SEQ ID NO: 4416 - DNA, 1079 bp, Raphanus sativus
gggcttctctttgatataaaaacgcatagtaagccgaaagttgccttgccgccactgaggaagaagaaggagagtcgtcgtctgctccgaaacaaacagctgcaaacatggcaaggggattgaagaagcatctgaagaggctcaatgcccccattcattgggatcttgacaaacttggtggtgccttcgctcccaagccgtcttctggacctcacaagtctagggagtgtcttcctcttgtcctgatcatcaggaacaggttgaagtatgctttgacataccgtgaagtcatctccatcctcatgcagaggcatatccaagtcgatggtaaagtcaggactgacaaaacttaccctgctggtttcatggatgttgtctccatccccaagaccaatgagagcttccgtcttctttacgacaccaagggacgtttccgtctccactgcatcagagatgaggaagcaaagttcaagctttgcaaggtgagggctatcctgctcggacgaaagggaatcccttacctcaacacttacgacggtcgcaccatccgctaccccgatccgctcatcaaaccgaacgacaccatcaagctcgacctcgaggagaacaagattgtcgagttcatcaagttcgacgtcggcaacgttgtgatggtgactggcggtagaaacagagggcgtgttggtgtcattaagaaccgtgagaagcataagggaagctttgagacgattcacatccaagactctacggggcatgagttcgccacgaggttgggtaatgtgttcactctggggaaagggactaagccgtgggtgtctcttccaaagggtaaaggtattaagctgaccatcattgaggaagctaggaagaggctttctgctcagcaagctgcttagatgtttgaatcattcaagaccgtttgttcgcttcttgcttcagttttgagtttgtttttttctttctattacatgtttcttgcttgcaaaaccgccataaggaaaaaaaaacagctgaacgttttagagagttttgtaatatttgtatggatatttttttatagtaacctactcttcaaaatc

SEQ ID NO: 4417 - DNA, 1122 bp, Silene vulgaris
atttctgggatcctacctcactttcaaccatggctagaggactgaagaagcacttgaagaggctcaatgccccaaagcattggatgcttgataagctcggtggtgcatttgctcctaagccatcatctggaccccacaaatccagggagtgcttgccgttgattctgatcttgcgtaacaggctcaagtatgcccttaactaccgtgaggttgtctcaatcttgatgcaaagacaaatccttgtcgatgggaaagttagaactgacaagacctatcctgctggtttcatggatgttgtctcaatccccaaaacaaatgagagcttccgtctgctttatgatacaaagggacgatttcgcttgcactctgttagagatgaagagtccaagtacaagctatgcaaagtccgatccgttcaatttggacagaagggtatcccatacctgaatacctatgatggccgcaccatccgttacccagatccccttatcaaggccaatgacacaatcaagctagatctggaatcccaaaagattgtcgaatttgtcaggtttgatgttggcaatgttgttatggtgacgggaggaaggaatagaggccgtgttggagtgatcaagaaccgagagaagcacaagggcagtttcgagactatccatattgaggattctgcagggcatgagtttgccactcgtcaagggaatgttttcgtagtgggcaagggaaccaaaccatgggtgtctcttccgaagggcaagggtatcaaattgaccatcatcgaagaggctaggaagagaatgcagaaggatgctgtagctgcataataatgtagtgaaacatcgaccttatttttcttagcattgtgttttaaatttggatgttttgtttgtctgggtacaattttgactctaaaactgagggacttttatgttagctagtagctagacttgcaacttttgtcgagactatctatatcttgtctttgctcgctttggtgatttcgatatggctaaatagatcaggacttttgtccattacacgaagaccttgagcaatacaaccttggctctttactcgtatacacgaggaaaatagagatactgttgtatcggtcagggtcaaacc

SEQ ID NO: 4418 - DNA, 1026 bp, Silene vulgaris
gagacacctccttatatctctcttttcttccctcactgccgccatttttctccttcgtcatcttcatcttcatattactgggaatatcctacctcactttcaaccatggctagaggattgaagaagcacttgaagaggctcaatgccccaaagcattggatgcttgataagctcggtggtgcatttgctcctaaaccatcatctggaccccacaaatccagggagtgcttgcctttgattctgatcttgcgaaacaggctgaagtatgctcttaactaccgtgaggttgtctcaatcttgatgcaaagacaaattcttgtcgatgggaaggttagaactgacaagacctatcctgctggtttcatggatgttgtttcaatccccaaaacaaatgagagcttccgtctgctttatgatacaaagggacgatttcgcttgcactctgttagggatgaagagtccaagtacaagctatgcaaggtccgatccgttcagtttggacagaagggtatcccgtacctgaacacctatgatggccgcaccatccgttacccagacccccttatcaaagccaatgacacaatcaagctagatctggaatcccaaaagattgtcgaattcgtcaggtttgatgttggcaatgttgttatggtgacgggaggaaggaatagaggccgtgttggagtgatcaagaaccgagaaaagcacaagggcagtttcgaaactatccacatagaagattctgcagggcatgagtttgccactcgtcaagggaatgttttcgtagtgggcaagggaaccaaaccatgggtttctcttccgaagggcaagggtatcaaattgaccatcatcgaggaggctaggaagagaatgcagaaggacgctgtaactgcataataatgtagtgaaacatcgactttatttttcttcacattgtgttttttaaatttggatgtctcgtttatctgggtacaattttgactcgaaaactgagacttcatcgtagctagacctgcgacttttgtt

SEQ ID NO: 4419 - DNA, 1084 bp, Tragopogon dubius
tcgggggtcgaagaggtgtgcggctgcgagtgaggagacccaggctaaccggagaagattaccggagatctcgaagtaatccctacaacgcaaccatggccaggggtttgaagaaacacatgaagaggctcaatgcccccaagcattggatgctcgataaacttggtggtgcttttgctcccaaaccttcatcaggaccccacaaatcaagggaatgcttgcctttgatcctcatcctccgaaacagattgaaatatgctttgacctaccgcgaggtccaatctatcttgatgcaaagacatgtccttgttgacaacaaggtcaggactgacaagacttaccctgctggtttcatggatgttgtctcaatccctaaaaccaatgaaagcttccgtcttctttacgacaccaaaggtagattcagacttcactcaatcagagatgaagagtcaaagttcaagctgtgcaaggttcgctcagttcaattcggatcgaagggcattccatacataaacacatacgatggacgaacaatccgctacccagacccgctcatcaaagccaacgacaccatcaaactagacctggaatccaacaagattgttgatttcatcaaattcgatgtgggaaatgttgtgatggtgactggtggaagaaacacagggcgtgttggaatcttgaagaacagggaaaaacataagggaagtttcgagaccgttcaccttcaggatgctgctggtaacgagtttgctacccgtttgggcaatgtgtttacccttggaaagggtacaaagccgtgggtgtctttgcctaagggtaagggtattaagttgactattattgaggaggcgaggaagaggcaggctgctttggctgctactgcttagatgaggtctggtgatttgaaagtttctttatgttataattatattcttgaagaactttttttctgcatgttggtacaattttgaaggttcaatttgtttttaaacggttgttatttgctgaatgtaggctgccttggttttaattagtacactccttttaaaaacttgatcattgaaatgaaaatgcttttcatgac

SEQ ID NO: 4420 - DNA, 1129 bp, Beta vulgaris
gcggctgaagagagaacactaatttctctctttcattcaaatctttaacaatggcgagagggttgaagaagcacatgaagaggctcaatgccccaaagcattggatgcttgataaacttggtggtgcatttgcacctaaaccctcatcaggtccccacaagtctagggaatgcttgcccttgatcctcatcctgcgtaacaggctaaagtatgctcttacttaccgggaggtcattgctatcttgatgcaacgtcatatccttgttgataacaaggtcaggactgataagacctaccctgctggtttcatggatgttgtctcgattcccaagacaaatgaaaatttccgtctgctttatgacacaaagggcagattccgcttgcactcagtcagagatgaagaggctaagtacaaactctgcaaggttcgatctattcagtttggccagaagggcattccctatctgaacacttatgatggccgaactatacgctatcctgacccactaatcaaagccaacgacacaatcaagcttgacttggaatcaaacaagattgttgactttatcaagtttgatgttggaaatgttgttatggtgactggagggagaaacagagggcgtgttggaatcctcaagaacagagaaaagcataagggaagttttgagaccattcacattgaagatgccgctggccatgagtttgctactcgtcagggcaatgtttttatcattggcaagggcaccaaaccatgggtgtctgttcccaagggtaagggtattaaattgactattattgaggaggctaggaagaggcagcaaaaggaagctacaactgcttagttggattggtaatagtcttctatacgatgtacgcgttattttttactcctatttcagtacaattttggcttttttgacttgcggtgatagatgtttatttgctatattggagatgaacatgattgtagctcgaccttattattcttcattgcaagattttgttccctttgcagaagtgtttttaatgttttgggatattgtggtatcaggatttgctgctttgcgaaaatcgtaaattcttttactcgtaggcgttgatctccttgttaagtttagttgttttatta

SEQ ID NO: 4421 - DNA, 1050 bp, Centaurea maculosa
gctagttgcagattgtggaggagagaggcgcaatttagcagcacaaaaccgccggagttcttccgacgaatatcacacaacgcaatcatggctagaggtttgaagaagcatcagaagaggctcaatgcccctaagaattggaatcttgataaactcggtggtgcttttgctcccaagccttcatcaggaccccacaagtccagggaatgcttgcccttgattctcattctccgaaatcggttgaagtatgctttgacataccgtgaggttatatctattttgatgcaacgtcatgtacttgttgacaacaaggtcaggaccgacaagacttatcctgctggtttcatggatgttgtttcaattcccaaaaccaatgaaaactttcgccttgtttatgatacaaaaggtagattcaggctgcactccatcagggatgaggagtcaaagttcaagctctgcaaggttcgttccgtccagtttggctcaaagggtattccatacattaacacttatgatggccgcacaatccgctaccccgaccccctcatcaaggccaacgacaccataaaactcgacttggactctaacaagatcgtcgatttcatcaagttcgatgttggaaatgttgtgatggttactggcggaagaaacacgggacgtgtcggaatccttaagaacagagaaaaacataagggcagtttcgagaccgtgcacatccaggatgccaccggtcacgagtttgctacccgtttgagcaatgttttcacaatcggaaagggttcgaagccgtgggtgtcccttcctaagggcaagggtattaagttgaccattattgaagaggctagaaagaggcaggctgccttgactgctagtgcttagattgggagatttatggggttttatgatagtttgtgatgtcataggtaatattacaagatcatttgagggaaacttttttcttttttgctgaatttgcaaatatcaaacatagagaacaaatggcaacatacccaacaaaataaaactgcctaaatttagcaaaatccattg

SEQ ID NO: 4422 - DNA, 775 bp, Brassica napus
ttaaagaagcatttgaagaggctcaatgcccctaagcattggatgcttgacaaacttggtggtgcttttgcccccaagccatcttctggaccccacaagtctagagagtgccttcctctcgttcttatcatcaggaacaggttgaagtatgctcttacttaccgtgaagtcatctccatcttgatgcaaaggcatattcaggttgacggcaaagtcaggactgacaagacctaccctgctggtttcatggatgttatctctatccccaagactaacgagaacttccgtcttcactatgacaccaagggtcgtttccgtcttcactccatcagggatgaggaagccaagtttaagctttgcaaggttcgaactatccaggtcggacagaagggaatcccttacctgaacacatacgatggtcgcaccatccgttaccctgacccgctcatcaagcctaacgacaccatcaagctcgatcttgaggagaacaagattgttgagtttatcaagtttgatgtcggcaatgttgtgatggttaccggaggaagaaacagggggcgtgttggtgtgattaagaaccgtgagaagcataagggaagctttgagactatccacatccaagactctacgggacatgagtttgcgacaaggttgggtaatgtgttcacccttggcaaaggaacaaagccgtgggtgtctcttcccaagggtaaaggtattaagcctaccatcattgaggaggccaagaagaggcttgctggtcaacaagctgctt

SEQ ID NO: 4423 - DNA, 891 bp, Centaurea maculosa
  misc_feature (793)..(793): n is a, c, g, or t
ggggcgattgtggaggagagaggcgcaatttagcagcacaaaaccgccggagttcttccgacgaataacacacaacgcaatcatggctagaggtttgaagaagcatcagaagaggctcaatgcccctaggcattggaatcttgataaactcggtggtgcttttgctcccaagccttcatcaggaccccacaagtccagggaatgcttgcccttgattctcattctccgaaatcggttgaagtatgctttgacataccgtgaggtcatatctattttgatgcaacgtcatgtacttgttgacaacaaggtcaggaccgacaagacttaccctgctggtttcatggatgttgtttcaattcccaaaaccaatgaaaactttcgccttgtttatgatacaaaaggtagattcaggctgcactctatcagggatgaggagtcaaagttcaagctctgcaaggttcgttccgtccagtttggctcaaagggtattccatacattaacacttacgatggccgcacaatccgctaccccgaccccctcatcaaggccaacgacaccataaaactcgacttggactctaacaagatcgtcgatttcatcaagttcgatgttggaaatgttgtgatggttactggcggaagaaacacgggacgtgtcggaatccttaagaacagagaaaaacataagggcagttttgagaccgtgcacatccaggatgccaccggtcacgagtttgctacccgtttgagcaatgttttcacaatcggaaagggttcgaagccgtgggtgtcncttcccaagggcaagggtattaagttgaccattattgaagaagctagaaagaggcaggctgccttaactgctagtgcttagatttgggattttatggg

SEQ ID NO: 4424 - DNA, 1008 bp, Cirsium arvense
gcagattgtggaggagagaggcgcaatttagcatcacaaaaccgccggagttcttccgacgataatcacacaacgcaaccatggctagaggtttgaagaagcatcagaagaggctcaatgcccctaggcattggaatcttgataaactcggtggtgcttttgctcccaagccttcatcaggaccccacaagtccagggaatgcttgcccttgattctcattctccgaaatcggttgaagtatgctttgacataccgtgaggttatatctattttgatgcaacgtcatgtacttgttgacaacaaggtcaggaccgacaagacttatcctgctggtttcatggatgttgtttcaattcccaaaaccaatgaaaactttcgccttgtttacgatacaaaaggtagattcaggctgcactctatcagggatgaggagtcaaagttcaagctctgcaaggttcgttccgtccagtttggctcaaagggtattccgtacattaatacttacgatggccgcacaatccgctaccccgacccccttatcaaggccaacgacaccataaaactcgacttggactctaacaagatcgtcgatttcatcaagttcgatgttggaaatgttgtgatggttactggcggaagaaacacgggacgtgtcggaatccttaagaacagagaaaaacataagggcagtttcgagaccgtgcacatccaggatgccaccggtcacgagtttgctacccgtttgagcaatgttttcacaatcggaaagggttcgaagccgtgggtgtcccttcctaaaggcaagggtattaagttgaccattattgaagaggctagaaagaggcaggctgccttgactgctagtgcttagattgggagatttatggggttttatgatagtttgtgatgtcataggtaatattacaagatcatttgagggaaacttagttttgtttttgtcattttttggttactattttgtaaggttaaattaggttttagtaaac

SEQ ID NO: 4425 - DNA, 1018 bp, Flaveria ramosissima
gacgggaagcatatgcttgcggaggtgcggcactaggagttagcgtcggagaggagcgtagcagaagttcaccggagatttacatctcccgccggagaccgcaaccatggctagaggtttgaagaagcacatgaagaggctcaatgccccgaagcactggatgcttgacaaacttggtggtgcttttgctcctaaaccatcatctggacctcataaatctagggaatgcttgcctttacttctcatactgaggaataggttgaagtacgccttgacttatcgtgaggttcaatctattttgatgcagcgtcatgttcttgttgacaacaaggttcggactgacaagacataccctgctggttttatggatgttgtttccatccccaagaccaatgaaaatttccgtcttctttacgacacaaaaggtagatttagactgcactcaatcagagatgaggagtcgaagtttaagctgtgcaaggttcgttcagtccagtttggttcaaagggcattccatatatcaacacttatgatggtcgaaccattcgttaccctgacccactcatcaaagctaatgacaccatcaagcttgatctagattcatacaaaattgttgattttatcaagtttgatgttggcaatgttgttatggtaactggtggaagaaacactgggcgggttggaatccttaagaatagggaaaaacataagggaagcttcgaaacggtccacattcaagatgctactggccatgagtttgctactcgtttgagtaatgtttttacaattggaaagggttctaaaccgtgggtgtctttacccaagggtaagggtatcaagttaagcatcattgaggaggctagaaagaggcgtgctgcccaagagcctgttgcctaggcgatgagattttagtgtcgtgttcttcttttcaggttggcgggatgttttctctttgctttatgttttgacagttatcagttatgttatacttttggatgttgttggttataagatgta

SEQ ID NO: 4426 - DNA, 776 bp, Helianthus annuus
ccatggctagaggtttgaagaagcatctgaagaggctcaatgcccctaaacattggaatcttgataaactcggtggtgcttttgctcccaagccttcatccggaccccacaagtccagagagtgcttgcccttgattctcattctccgaaataggttgaaatatgctttggcataccgtgaagtcatatctattttgatgcaacgtcatgtacttgttgacaacaaggtcaggaccgacaagacttaccctgctggtttcatggatgttgtttcaattcctaaaaccaatgaaaactttcgccttgtttacgatacaaaaggtagattcaggctgcactcgataagggatgaggagtcaaagttcaagctgtgcaaggttcgttctgttcagtttggttcaaagggtattccgtacattaacacctacgatggccgcacaatccgctaccccgaccccctcatcaaggccaacgacaccataaaactcgacttggactccaacaagatcgtcgatttcatcaagttcgatgttggaaacgttgtgatggttaccggcggaagaaacacgggctgtgtcggaatccttaagaacagagaaaaacataagggaagtttcgagaccgtgcacatccaggatgccactggtcacgagtttgctactcgtttgggcaacgtttttacgatcggaaagggttcgaagccgtgggtgtctcttcccaagggcaagggtatcaagttgacaattattgaagaggctagaaagaggcaggctgcc

SEQ ID NO: 4427 - DNA, 1013 bp, Papaver somniferum
gaaaattagggcaaacctaatttacagtcgaagaactcaatcatggcgaggggattgaagaagcattgagaggcttaatgcccaaaacattggatgcttgataaacttggaggcgcatttgctcccaagccatcatcaggtccacacaaatctagggaatgccttcctttgattcttatcctgcgaaacagattgaaatatgcccttacataccgtgaggttattgctattttgatgcaaaggcacattcttgttgatggaaaagtgcgaacagacaagacctatccatctggattcatggatgttgtgtcgattcccaagacgaacgagaacttccgtctcctgtacgacaccaagggtcgcttccgtctccactccatcaaggatgaagaagctaagttcaagctctgcaaggttagaaatgtacactttggatctaagggtatcccatacattaacaccttcgacggtcgcaccatccgttaccctgaccctcttatcaaggctaatgacaccatcaagctagatctcgagagcaataagattgttgattttatcaagtttgatattggtaatgtcgtcatggttactggaggtagaaacagaggccgtgttggtgtaatcaagaacagagaaagcataagggaagtttcgatacccttcacatccaggactctacaggccatgaatttgccacccgtctggccaatgtgttcaccattggtaagggtaccaagccatgggttcactcccaagggcaagggtatcaagttgtctatcatagaagaagcagaagagacttgctgctcaaggagctgcaaccgcataaagctcatggaaggtgtcagccatcatgaggtgtaatgttttgaggcttatttagtgaatcttagcttaaaaacaattgctgtttagtttatccctactttattgaacaaaattttgaagctaactctgctttgctgaggatgttatagtttgatctgctttctttagtgtcatttactcctttt

SEQ ID NO: 4428 - DNA, 918 bp, Brassica juncea
aagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtatgctcttacctaccgtgaagtcatctccatcttgatgcaaaggcatatccaggttgatggcaaagtcaggactgacaagacctaccctgctggtttcatggatgttatctctatccccaagactaacgagaacttccgtcttctctatgacaccaagggtcgtttccgtcttcactccatcagagatgaggaagcaaagtttaagctttgcaaggttcgaactatccaggtcggacagaagggcattccttacctcaacacatacgatggtcgtaccatccgttaccctgacccgttcatcaagcctaacgacaccatcaagctcgatcttgaggagaacaagattgttgagttcatcaagtttgatgtcggcaatgttgtcatggttaccggaggaagaaacagggggcgtgttggtgtgattaagaaccgtgagaagcataagggaagctttgagacaatccacatccaagactctacaggacatgagtttgcgacaaggttgggtaatgtgttcacccttggcaaaggaacaaagccgtgggtgtctcttcccaagggtaaaggtattaagcttaccatcattgaggaggccaagaagaggcttgctggtcaacaagctgcttgattttgtgattctccagctcgttactatgtcttcttagacgtcatatgttttcgtagactcgctttgcttctttttgttttggaacttgtgttattttctctgtttcaaggattcaacaaaaacttcaacatcacttgccctttt

SEQ ID NO: 4429 - DNA, 1015 bp, Tragopogon dubius
agagtgtgcagcggtaagcgaagagggcagccacagattcgccgtacaattccaccggagattcggatctcctacaccacacgccgcagccatggctcgaggtttgaagaaacacatgaagaggctcaatgcccctaagcattggatgcttgataaacttggtggtgcttttgcccctaagccatcttcaggaccacataaatcaagggaatgcttgcctttgatcctcatactcaggaacaggttgaagtatgctttgacataccgtgaggtccaatctattttgatgcaacgccatgtgcttgttgacaacaaggtcagaactgataagacttaccctgctggtttcatggatgttgtgtcaattcccaagaccaatgaaagcttccgtcttctatatgacacaaagggtaggttcagattgcactcaatcagggatgaggaatctaagttcaaattatgcaaggttagatcggttcaattcggttcaaaaggcattccatacatcaacacatacgatggacgcacaatccgctaccccgaccccctcatcaaagccaacgacaccatcaaactcgatttagagtccaacaaaatcgtcgatttcataaaattcgacgtcgggaacgttgtgatggtgacaggtggcagaaacacggggcgtgttggtatccttaaaagccgtgaaaacataagggaagtttcgagacggttcatctccaagatgctgcaggtaacgattatgctacgcggttggggaacgtgtttactcttggaaaggggacgaagccgtgggtgtctttgcccaaggggaaggggattaagcttactattattgaggaggctaggaaaaggcaggctgccctagctgcccaagttgcttgattttgtttttgtgttttttaatttgggtacaattttgagatttgaggttaagtttgattgcaaattgtagactgtttttatgatggaagtgttctagtttattgttataaacaatgttttgatagatatc

SEQ ID NO: 4430 - DNA, 1086 bp, Primula obconica
gcgccgctgccggagtgtcgaagctggctgatccgacaacatggcgagaggtttgaaaaagcacttgaagaggctcaatgctccgagtcattggatgcttgacaagcttggtggagcctttgcccccaagccatcatctggacctcacaagtcaagggaatgccttccattgattctgattctgcgaaacaggctgaagtatgctctgacataccgtgaagtgcaatctattgtgatgcagcgccatattcaggttgatggaaaagttaggactgataagacttaccccactggtttcatggatgttgtgtctattcccaaaacaaatgagaacttccgtctcctgtatgacaccaaagggcgctttagacttcactccctcagagatgaggaggctaagttcaagctttgcaaggttcgttcactccgatacgggtcgaaagccatcccttacgtcaacacctttgatgggagaacgatccgttacccagaccctctgataaaggccaacgacactatcaaacttgacttggagacaatgaagattgttgatttcatcaagtttgatgttgggaatgttgtgatggtgactggtggtagaaacagaggcagagttggtgtcattaagagcagagagaagcataagggtagctttgagaccattcacgttcaggattcaaagggtcacgagtttgccacacgtatgggaaacgtattcaccattggtaagggttcaaaaccatgggtctctcttccaaagggtaaaggtattaagctcaccatcatcgaggaggctaggaagaggcagaacccagaagcacctcaagttgctgcttaaatgttatattttattcatcaaaactaaaaatggtttctttctgctgttggtggttactgagcttgcaaggttggatttgtattggaaccttgatgttttgcctttattgttctagactatgttttggatcatctttagcatgggttttgaaagttttcaacagttttgctgaactgctggtatctggtatttttgtcacttttctcggtaatttcaactatctatttcttgtcgtaaatgtctcttga

SEQ ID NO: 4431 - DNA, 1107 bp, Flaveria ramosissima
gtggggaagcattcgcttgcgggagtgcggcactaggagttagcgtcggagaggaacagcgtagaagaagaagaagaagaagaagaagaagaagttcaccggagattcagatctcccaccggagaccgcaaccatggctagaggtttgaagaagcacatgaagaggctcaatgccccgaagcactggatgcttgacaaacttggtggtgcttttgctcctaaaccatcatctggacctcataaatctagggaatgcttgcctttacttctcatactgaggaataggttgaagtacgccttgacttaccgtgaggttcaatctattttgatgcaacgtcatgttcttgttgacaacaaggttcggactgataagacataccctgctggtttcatggatgttgtttccatccccaagaccaatgaaaactttcgtcttctttatgacacaaaaggtagatttagactgcactcaatcagagatgaggagtcgaagtttaaactgtgcaaggttcgttcagtccagtttggttcaaagggcattccatacatcaatacttatgatggtcgtaccattcgttaccctgatccactcatcaaagctaatgacaccatcaagcttgatctggattcatacaaaattgttgatttcattaagtttgatgttggcaatgttgttatggtaactggtggaagaaacactgggcgtgttggaatccttaagaacagggagaaacataagggcagctttgaaacggtccacattcaagatgctacaggccatgagtttgctacgcgtttgagtaatgtttttacaatcggaaagggttctaaaccatgggtgtctctacccaagggtaagggtatcaagttgagtatcattgaggaggctagaaagaggcgtgctggccaagatcctgttgcctaggtgataagattttggtgtcgtgttcttgatttcaggttggtgggatgttttttccttgctttatgttttgacagttatcagttatgttatacttttgaatgttgttggttataaaatggtaagtctttctttcattgttactttaatttgtcatcaattatagcatagaagtaatgtaatac

SEQ ID NO: 4432 - DNA, 1032 bp, Raphanus sativus
gggccgccactgaggaagaagaaggagagtcgtcgtctgctccgaaacaacagctgcaaacatggcaaggggatttaagaagcatctgaagaggctcaatgccccccatcattggggtcttgacaaacttggtggtgccttcgctcccaagccgtcttctggacctcacaagtctagggagtgtcttcctcttgtcctcatcatcaggaacaggttgaagtacgctttgacataccgtgaagtcatctccatcctcatgcagaggcatattcaagtcgatggtaaagtcaggactgacaaaacataccctgctggcttcatggatgttgtctccatccccaaaaccaatgacagcttccgtcttctttacgacaccaagggacgtttccgtctccactgcatcagagatgaggaagcaaagttcaagctttgcaaggtgagggctatcctgctcggacgaaagggaatcccttacctcaacacttacgacggtcgcaccatccgttaccccgacccgctcatcaaacccaacgacaccatcaagctcgacctcgaggagaacaagattgtcgagttcatcaagttcgacgttggcaacgttgtgatggtgactggcggtagaaacagagggcgtgttggtgtcattaagaaccgtgagaagcataagggaagctttgagactattcacatccaagactcgacggggcatgagttcgccacgaggttgggtaatgtgttcactctggggaaaggaactaagccgtgggtgtctcttccgaagggtaaaggtattaagctgaccatcattgaggaagctaggaagaggctttctgctcagcaagctgcttagatgttgaatcgttcaagaccgtttgttcgcttcttgcttcagttttgagtttgtttttttctttctattacatgtttctttcttgcaaaaccccataagaaaaagaaaaacagctgaacgttttagagagttttgtaatatttgtattgatatttttttatagtaatttactcttcaaaatc

SEQ ID NO: 4433 - DNA, 980 bp, Triphysaria pusilla
aaaatggcaagaggtctaaagaaacacctgaagaggctcaatgccccgaaaatttgggatttggacaaactcggtggtgcttttgcccccaaaccatcatcagggccccacaagtcaagggagtgcctgccgcttagtctgattctacgaaacaggctcaagtatgccctaacttaccgtgaggtgattgctatcctgatgcaacgccatgttcaggttgacggcaaggtcaggacagacaagacatatccttctggtttcatggatgttgtctctattcctaagaccaatgaaaatttccgtatgctgtatgacaccaagggccgtttcaggttgcactctgtccgtgacgaggaggctaagttcaagctatgcaaaatccgttcagttcagttcggcaagaaaggtatccccttcatcaacacttacgacggaaggacaatccgctaccctgacccactgatcaaagccaacgacaccatcaagctcgaccttgagagcggcaagatcatcgatttcatcaaatttgatgtcgggaatgttgtgatggtgacaggtggcaggaacaggggacgagtcggtgtgatcaagaaccgtgagaagcaaaagggcagtttcgagactattcacgttcaggatgcttctgggcatgagtttgcaacgaggctgggcaatgttttcacgatcgggaaagggacaaagccgtgggtgtcacttcccaagggtaagggtattaagctgacaatcatcgaggaggctaagaagaggcttgctgctcaaactaccgcagcttaatagatatttttgagttttgttttagatggtattttgatgctataggatgttttgtggtggatttatgattttgcgttacttatcttttgttgtcttcatattttttataactgtagttttttttatttgctagaaaatttgaaattttctattacctgagcttataaagtgatgaaaaatgttgg

SEQ ID NO: 4434 - DNA, 910 bp, Taraxacum officinale
attaagaagatcccctggggtgcggcagcgagttgcagagtactggagaggagagcagcaggttagccgaagagttcaaccggagatttagatctcccgtcgtacaacgcaaccatggctagaggattaaagaaacacatgaagaggctcaatgccccaaagcattggatgctcgacaaacttggcggtgcttttgcccctaaaccatcatcaggaccccacaagtcccgtgaatgtctacccttgatcctaatcctccgtaacaggttgaagtatgcactaacataccgtgaggtccaatctatcctaatgcaacgacatgttcttgttgataacaaagtcaggaccgataaaacttacccagctggtttcatggatgttgtttctatccccaaaaccaatgaaaacttccgtcttctttatgacacaaaaggtcggttcagactacactcagtcagggatgaggaatctaagtttaaattgtgcaaggttaggtcagtccaattcgggtcaaagggaatcccatacatcaacacatacgatgggcgaacaatccggtacccggacccactaatcaaagccaacgacaccatcaagcttgacctcgagtcaaacaaaatcgttgactttatcaaatttgatgtcgggaatgtggtgatggtaactggaggaagaaacacagggcgagttgggatccttaaaaacagggaaaaacataagggaagctttgaaacagttcacattcaagattccactggacatgagtttgccacccgtttgggtaacgtgtttacagttgggaaagggtcgaagccttgggtgtcgcttccaaggggaagggtattaagttgacgattattgagggagctaggaagaagaaggctgctcaggaatctgttgcttaaagctg

SEQ ID NO: 4435 - DNA, 838 bp, Helianthus annuus
ccggagatttacatctcccaccgcaaaccgcaaccatggcaagaggtctcaagaagcacatgaagaggctcaatgccccaaagcattggatgcttgacaaactcggtggtgcttttgctcctaagccatcatctgggccacacaagtctagggaatgcctgcccttgatcctcattctgaggaacaggttgaagtatgctttgacataccgtgaggtacaatctattttgatgcagcgtcatgttcttgttgacaacaaggtcaggaccgacaagacttaccctgccggtttcatggatgttgtttctattcctaagaccaatgaaagcttccgtcttctttatgacaccaaaggtagattcaggttgcactcaatcagagacgaggagtcaaagtttaagttgtgcaaggttcgttcagtccagttcggttcaaagggcattccgtacatcaacacttatgacggtcgaaccatccgctatccagacccccttatcaaagccaacgacaccattaagctcgatctagaatcaaacaagatagttgattttatcaagttcgacgttggaaatgtcgtcatggtaactggcggaagaaacacaggccgtgttggaatcctcaagaacagagaaaaacataagggcagcttcgaaacagttcacattcaagatgctaccggtcacgagtttgctactcgtttgggtaacgtgttcaccctcggaaagggttcgaaaccatgggtctctctacccaagggtaagggtatcaagttaaccatcattgaagaggctagaaagaggcaggctgcccaagagctgctgcttagatgtgtttggtt

SEQ ID NO: 4436 - DNA, 874 bp, Lippia dulcis
aggttctcacattcgtcttcaatatggctagaggtttgaagaaacacttgaagaggctaaatgcccccagtcattggatgctggacaagcttggtggtgcttttgctccgaaaccatcatctggaccccacaaatccagggaatgccttccgttgattctgatcctcaggaacaggctcaagtatgctcttacttaccgtgaggttattgctattttgatgcaacgccacattcaggttgatggaaaggtcaggactgacaagacttatcctgctggtttcatggatgttgtgtctattccaaagaccaatgagaatttccgtcttctctatgataccaagggtcgcttcagacttcactctattcgtgatgaggaagctaagtttaagatgtgcaaggttcgttcagttcagttcggaaagaagggcattccttacatcaacactttcgatggaaggaccattcgctatccagaccctcttatcaaggccaacgactacctatcaagctggtatcttgagagcaacaagattgtcgatttcatcaagtacgacgtgggcaatgttgtcatggtgaccggtggtaggaacagaggacgtgttggtgtgatcaagaaccgtgagaagcataagggaagcttcgagacccttcacatccaggactgccaccggccacgagtttgcaaccagatcaggtaatgtgttcacaatcggcaagggcacgaaaccgtggatatctcttccaaagggcaaagggtattaagctgaccattattgaggaggcaaggaagaggctttcaggctcaggctgctacagcttagttgtcttaattgttttggaagtagtacgatgagatgatcattgtgctattata

SEQ ID NO: 4437 - DNA, 995 bp, Centaurea maculosa
tggctagaggtttgaagaaacatatgaagaggctcaatgcgcctaagcgttgtggatgcttgacaaacttggtggtgcttttgctcccaaaccatcctcaggacctcacaagtccagggaatgcttgcctttgattcttatcctccgaaataggttgaagtatgcccttacataccgtgaggtgatttctatcttgatgcaaaggcatgttcttgtcaacaacaaggtcaggactgacaagacctacccagctggtttcatggatgttgtttctattccaaagaccaatgagaacttctgtctcctatacgataccaaaggtagattcaggctacattctatcagggatgaggaggcaaagttcaagctatgcaaggttcgttcagtccagtttggctcaaagggcattccttacttcaacacatatgatggtcgaaccatccgctacccagacccactcattaaggccaacgataccattaagcttgatttggattcaaacaagattgttgatttcatcaagtttgacgtgggaaatgtcgttatggttactggtggacgaaacactggacgtgttggaattctaaagaacagggaaaagcataagggcagcttcgagactgttcacattcaggatgctaccggccacgagtttgccacgcgtttggggaacgtgttcacggttggaaagggtacaaagccgtgggtgtctcttcccaagggtaagggtatcaagttaaccatcatcgaggaggctaggaagagacgggctggccaagaccctgttgcctagatcctctgattttggtgttttgttcttgcaggttcgtgggaagttttcttttctcttgctttttgttatggtacaattttaaacctatgttttgatgctgcaagttatgttaaactattgttagttaatttgattacaaaattggttaaagtctttttgtttaaattgctattaagctattccttcctttgttattggtttg

SEQ ID NO: 4438 - DNA, 1023 bp, Brassica napus
aaccagtcgttcggagctaaaacgagagaagtcgtcgtctggatcatcggagctacactttcaaactccaaccatgacgagaggtttaaagaagcatttgaagaggctcaatgcccctaaaatttggggtcttgacaaacttggtggtgcctttgcccccaagccatcttccggaccacataagtcgagggagtgtcttcccctcgtccttatcatcaggaacaagttgaagtacgctcttacctaccgtgaagtcatctccatcttgatgcagaggcatatccaggtcgatgggaaagtcaggactgacaagacctaccctgctggtttcatggatgttgtctctatccctaagaccaacgagaacttccgtcttctctatgataccaagggacgtttccgtcttcactccatcaaggatgaggaagccaagtttaagctttgcaaggttcgaactatctccttcggacagaagggaatcccttaccttaacacgtacgatggtcgcaccatccgttaccctgacccgctcatcaagcctaacgacaccattaagctcgaccttgaggagaacaaggttgtcgagttcatcaagttcgatgtcggcaatgttgtgatggtgactggtggaagaaacagagggcgtgttggtgtgattaagaaccgtgagaagcataagggaagctttgagacgatccacatccaggacgcgacagggcatgagtttgcaacaaggttggggaatgtcttcactctagggaaagggacaaagccgtgggtgtctcttcctaagggtaagggtatcaagcttaccatcattgaggaagctaggaagaggcttgcggctcaataggctgcttaatttttttttatttccagctatttattatgatgcgtttctagacttattgtttctttgacccaaaaaaaaaaaagacttaatgtttcttagactctatttacagtttttgattcgctcccggttttgaaacttgtgttattttatctatttcaagagttaaa

SEQ ID NO: 4439 - DNA, 895 bp, Brassica napus
ggcaagaggattgaagaagcatctgaagaggctcaatgcccccaagcattgggatcttgacaaacttggtggtgccttcgctcccaagccctcttctggaccccacaagtctagagaatgccttcctctcgtcctgatcatcaggaacaagttgaagtacgctttgacataccgtgaagtcatctccatcttgatgcaaaggcatatccaagtcgatggtaaagtcaggactgacaagacttaccctgccggcttcatggatgttgtctccatccccaagacgaatgagaacttccgtcttctctatgacaccaagggacgtttccgtctccactccatcagggatgaggaagctaagttcaagctttgcaaggttaggacgatccagctagggcaaaagggaatccctttcctcaacacatacgacggtcgcaccatccgttaccccgacccactcatcaaaccgaacgacaccatcaagctcgacctcgaggagaacaaggtcgtggacttcatcaagttcgacgtcggcaacgttgtgatggtgactggagggagaaacagagggcgtgtgggtgtgattaagaaccgtgagaagcataagggaagctttgagacgatccacattcaagattcaaccggacatgagtttgccacgaggttgggcaatgtgtttaccttggggaaagggacgaagccgtgggtgtctcttccgaaggggaaaggttttaagcttaccatcattgaggaagctaggaagagggtctctgttgaagatggtgcttaagaaaaattagttacaaaagatgtttcattcttcaactcccttactgactgggatttgaggtttttttccccttcgacgtcgctgccaaaagcaaacaaaagagaaggg

SEQ ID NO: 4440 - DNA, 1065 bp, Tragopogon dubius
acagcttaagaagattgtaaggggcgcggcagcaagttgcagaggagtggagcaggttagccgaagaattcaaccggagacttagatctcccgcaaaacaccgcaaccatggctagaggtttgaagaaacacatgaagaggctcaatgccccgaggcattgggggctcgacaaactcggtggtgctttcgctcctaaaccatcatctggaccccacaaatcaagggaatgcttacccttgatcctcattctccgtaacagattgaagtatgctttgacataccgtgaggttcaatctatattaatgcaacgacacgtgtgtgttgacaacaaggtcagaaccgacaagacttaccctgctggttttatggatgttgtctccattcccaaaaccaatgaaagctttcgtcttctttacgacacaaaaggtcgattcaggctgcactctatcagagatgaggagtctaagttcaagttatgcaaggtccgttcggtccaattcgggtcaaagggtattccatacatcaacacctatgatggtcgaaccattcgctaccctgacccacttatcaaggccaatgacactatcaaactcgacctggagtcaaacaagattgttgatttcataaaatttgacgttgggaatgtggttatggtgactggtggaagaaacacagggcgagttgggattttgaagaacagggaaaaacataagggtagttttgagactgtccaccttcaagatgctactggaaatgagtttgctactcgtttgggcaacgtgtttacccttggaaagggtacgaagccgtgggtgtcgcttcctaagggcaagggtattaagttgactatcattgaggaggctaggaagaggcgggctgctcaagagactgctgcttaagtttttgatttcggttttgtgggtgggagacttttgttggtttgattttgttgaacttatgttttgatgttacatgttataaggtatgttagttttatgacgttttttaataattttgtagtaaaatggttaaacttttgttaaatgggatctttttgtgataag

SEQ ID NO: 4441 - DNA, 973 bp, Lippia dulcis
actagggagagaagctgaggaggcgccgctgtgttctgcatccaccacctccaacatggctagaggattgaagaaacacttgaagaggctcaatgccccaaagcactggatgttggataaactgggtggtgccttgcccccaaaccatcatccggtccccacaaatctaggaagtgcttgccttggattctcattctgcgaaacaggctgaagtatgctttaacttaccgcgaggtaattgccattctgatgcaacgccatatccttgttgatgggaaagtaaggactgacaagacctaccctgctggatttatggatgttgtctcgatccccaagacaaatgaaaacttccgtctactgtacgacaccaagggtcgtttcaggctccattctatcagggatgaggaagccaagttcaagctgtgcaaagtccgcaatatacagtttggcaagaaagggattccttatctcaacacatatgattggaaggaccgtccgttaccctgaccctctcatcaaggccaacgacacaatcaaactttgaccctgagagcaataagattgtcgacttcatcaagtttgatgtaggtaatgttgttatggttacaggcggtaggaacagagggcgtgttggtattctcaagaaccgtgagaagcataagggaagcttcgagactgtccacatccaggatgccactgggcatgagtttgccacccgattgggcaatgtctacaccattggaaagggtacaaagccatgggtatctctaccaaagggtaagggtatcaagctacctatcattgaggaggccaagaagaggattagcgcccaagccgttacagcttagaaggatccttgtattctcgatgtacgatgtagttttagctccctttttattttgttgtcctgcgctgcttctatatttgttgacattcttatcgttgtaccattgcaaaaatagttaagccctaa

SEQ ID NO: 4442 - DNA, 1368 bp, Cedrus atlantica
agcaacgagggtttggtaaagggtatagggtttcaaagagttattagggttttaaagcttatgttcggagtgtggaggtcttcctttgtgttatttggtttgcagaagacgcctggcgggccgaaggatttttcctctacctcttactgagcggatcgtagagacaacatggctcgtggactgaagaaacatttaaagaggctcaatgctcctaagcattggatgcttgacaaacttggtggtgcttttgcaccaaaaccatctcctggtcctcacaagggtagggaatgccttcctcttgtggttcttattaggaacaggctgaaatatgctctcacataccgtgaagtcatagccattgtaatgcaaagacttatttctgttgatggaaaagtcagaacagacaaatgctatcctgcagggtttatggatgtcctgtcgattgcaaaaacaaatgagaattttaggcttctttatgatgcaaagggtcgtttccgtttgcattcaatcaaggatgaagaagcaaagtataaactttgcaaggttcgttctgtacaatttggagataagggtatcccttacctcaatacttatgatgggcgcacaattaggtacccagacccattaatcaaggccaatgatacaatcaagattgacctagagacaggcaagatcaaggagttcatcaaatttgatgttggtaatgttgtaatggttacgggaggtcgtaacagaggtcgtgttggagtcattaagcacagagaaaagcataagggtagctttgagattattcacgtgcaagatgctgctgggcaggaatttgcgacccgacagggtaatgtgttcacaattggaaagggcacaaagccttgggtttccttacccaagggcaagggagtcaagctatccatcattgaagaggccaggaaacgccatgcagctgcaactgccgcagcataagttttgttcattggaaaacttgatgggttttgatagtcagaatttgttagcttagtataaatcaactgttatcagaaattttgttgggaaaacttaggagctaccattgatttatgtttgaacggttttcatttgcatttttaagagcagctttgaggttctactgcaatctacatatgctattttttatatcatttttcttatctaatttaaatgcaatactgaatatttgtcggccaagccattttaccccgcctccggccatatttgatcagataaaatctaaattttcgaagatcaagaagcaaattcttccgggatacaatgcagattctttacacggttagccggctaacaagcaaattttgtttcaagacatttgcacaagattcaggattttcatctttc

SEQ ID NO: 4443 - DNA, 811 bp, Centaurea maculosa
gggatgtgtttgtggagagaggcggagttcttccgaagaaaatcacacaacgcaaccatggctagaggtttgaagaagcatctgaagaggctcaatgcccctaaacattggaatcttgataaactcggcggtgcttttgctcccaagccttcatccggaccccacaagtccagagagtgcttgcccttgattctcattctccgaaataggttgaaatatgctttgacataccgtgaagtcatatctattttgatgcaacgtcatgtacttgttgacaacaaggtcaggaccgacaagacttaccctgctggtttcatggatgttgtttcaattcccaaaaccaatgaaaactttcgccttgtttacgatacgaagggtagattcaggctgcactcgatcagggatgaggagtcaaagttcaagctgtgcaaggttcgttccgttcagtttgactccaagggtattccgtacattaacacctacgatggccgcacaatccgctaccctgaccccctcatcaaggccaacgacaccataaaactcgacttggactccaacaagatcgtcgatttcatcaagttcgatgttggaaacgttgtgatggttaccggcggaagaaacacaggccgtgtcggaatccttaagaacagagaaaaacataagggaagtttcgagaccgtgcacatccaggatgccactggtcacgagtttgctactcgtttgggcaacgtttttacgatcggaaagggttcgaagccgtgggtgtctctccccaagggcaagggtatcaagttgacaattattgaagagg

SEQ ID NO: 4444 - DNA, 1126 bp, Distylium racemosum
cagggccatcacaaagaggatggtataattgataaatatattatgcatgcatttgtaggtaattgtattttctgagataaatatttagagttgagcgagggacggcccctgttgctgctttcgttctaggtttttttccttcgtttttcccctgcctgcggtgagccaagtgcaagtgcaagcgcgcgctcaaaatggctcgtggattgaagaaacatttgaagaggctcaatgctcctaagcattggatgcttgacaaacttggtggtgcttttgcaccaaagccttcacctgggccccataaggggagggaatgccttcctcttgtggttcttctaaggaacaggctgaaatatgctcttacataccgtgaggtcattgctattgtcatgcaaagacttatttcggttgatggaaaagtcaggacagataaatgctaccctgcaggattcatggatgtgatatcaattgcaaaaaccaacgagaacttcaggcttctttatgatgccaagggtcgcttccgtttacatgcaatcaaggatgaagaagccaagtataagctctgtaaagtccgaggagttcagtttggagataagggtatcccttacctgaacacttatgatgggcgcactatccggtatccggatccattgatcaaggccaatgatacaatcaagattgatcttgagacaggcaagatacaagattttattaagtttgatgttggtaatgttgttatggttactggaggccgtaacagaggtcgggttggggtgataaaaaacagagaaaagcataagggtagctttgagattattcatgtccaggatgcagctgggcaagaatttgcaacaagacagggcaatgtgttcacaattggaaagggcaccaaaccttgggtgtcactaccgaagggcaaaggtgtgaagctgtccatcatcgaggaggccaggaaaaggcatgcagctggaactgctgcagcttaatttttgctatatttggaaaatccaattgtcttagttgaactttggtcatgtagaatgttttgaccattagcagagactcggctggaaagacacttagaatctagtgtagatctatatttgggcttcaaaggttgcggtgg

SEQ ID NO: 4445 - DNA, 1022 bp, Raphanus sativus
ggatcacagcttaaccagtcgttcagagctaaacgagaggagtgagtcgtctggatcataggagctacgctttgaaaactccaaccatggcgaaaggtttaaagaaacatttgaagaggctcaatgcccctgatcattggggtcttgacaaacttggtggtgcttttgcccccaagccatcttctggaccccacaagtcgagggagtgtcttcccctcgtccttatcattaggaacaagttgaagtacgctcttacctaccgtgaagtgatctccattttgatgcaaaggcatattcaggttgatgggaaggtcaaaactgacaagacctaccctgctggtttcatggatgttgtctctatcccaaagaccaacgagagcttccgtcttctctatgataccaagggacgtttccgtcttcactctatcagggatgaggaagccaagtttaagctttgcaaggttcgaactatccagctcggaacgaagggcatccctctcctgaacacatacgatggtcgcacaatccgttaccctgacccgctcatcaagcctaatgacaccattaagctcgaccttgaggagaacaagattgtcgagttcatcaagttcgatgtcggcaatgttgtgatggtgactggaggaagaaacagagggcgtgtgggtgtgattaagaaccgtgagaagcataagggaagctttgagacgatccacatccaagacgcaacgggacatgagtttgcaacgaggttggggaatgtgttcacgttaggcaaaggaacaaagccgtgggtgtctcttcctaagggtaagggtattaagctgaccatcattgaggaagctaggaagaggctttctgctcaacaagctgcttgatttttgtgatttccaactatttattaacgtcttatttttctctgactctgtttaacattttttggttcactgctctgttttgaaaatttatgaaattatctatttaaagagtttaaaaaatgaaatttgcgtatcttatgcgtccta

SEQ ID NO: 4446 - DNA, 1093 bp, Senecio madagascariensis
aagcagtggtatcaacgcagagtacgcgggacactggaattctcaaaaccaaattttaggtttgcggcagtcaaccggagctctttaaacctaactatctcgccggagactcagatctcccaccggacacgtcatcatggctcgaggtttgaagaaacatttgaagaggctcaatgcgcctaggaattggatgcttggcaaacttgatggtgctttcgctcctaaaccatcatcaggaccacacaaggcgagggaatgcttgcctttgatcctcattctccgaaacaggttgaagtatgctttgacttaccgtgaggttcaatctatcttgatgcaaaggcatgtgcttgttgacaacaaggtcaggactgacaagacttacccagctggtttcatggatgttgtgtctatccctaagaccaacgaaagcttccgtctactttacgacaccaaaggtagattcagacttcactcaatcagagatgaggaatcaaagtttaagttgatcaaggttcgttcagtccagtttggttcaaagggtattccatacatcaacacctatgatggccgaactatccgttacccagacccactcatcaaagccaacgacaccatcaagtttgacttggaatcacaaaagattgtcgacttcatcaagttcgacgtaggaaacgttgtcatggttactggtggaagaaacacaggtcgtgttggtatccttaagaaccgtgaaaagcataagggcagctttgaaaccgttcacatccaggactctactggccatgaattcgctactcgtttgggaaatgtgtttactcttggaaagggctccaagccatgggtttctctacctaagggtaagggtatcaagttgaccatcatcgaagaggctaggaagaggcgtgctgctcaagaagccactgcttagattgttttgttttggtaatactttgtcggttgtttgatttaattttggtacaattttgaacctatgttttgatgttgccagttatgctagacttgactgttggctcttttcgttattaaatgttaaacttgtttaaaaaataaaaagttaggagtaccgactgcg

SEQ ID NO: 4447 - DNA, 1064 bp, Primula obconica
agagagagagagagaggcgccgctgccggagtgtcgaagctgactgatcatggcgagtaggtttgaagaagcacttgaagaggctcaatgctccaagtcattggatgcttgacaagcttggtggagcctttgcccccaagccatcatctggacctcacaagtcaagggaatgccttccattgattctgattttgcgaaacaggctgaagtatgctcttacataccgtgaagtgcaatctattgtgatgcagcgccatattcaggttgatggaaaagttaggactgataagacttaccctactggtttcatggatgttgtgtctattcccaaaacaaatgagaacttccgtctcctgtatgacaccaagggtcgctttagacttcactccctcagagatgaggaggctaagttcaagctgtgcaaggttcgttcactccgatacgggtcgaaaggcatcccttacgtcaacacctttgatgggagaacgatccgttacccagaccctctgataaaggccaacgacactatcaaacttgacttagacacaatgaagattgttgattttatcaagtttgatgttgggaatgttgtgatggtgactggtggtagaaacagaggcagagttggtgtcattaagagcagagagaagcataagggtagctttgagaccattcacgttcaggattcaaagggtcacgagtttgccacacgtatgggaaatgtattcaccattggtaagggttcaaagccatgggtctctcttccaaagggtaaaggtattaagctcaccatcatcgaggaggctaggaagaggcagaacccagaagcacctcaagttgctgcttaaatcttatattttattcatcaaaactaaaaatggtttcttttttctgttagtgttaagcttgcaaggttggatttgtattggaaccttgatgtttttttttgcctttatcgtactagactaagttttggatcatcttttagtatgtgttttttttgcaagttttcgacagttttgctgaactactatcatcggtaatttcatctattctacttcttg

SEQ ID NO: 4448 - DNA, 1060 bp, Linum usitatissimum
gaggggtttgaagaagcacttgaagaggctcaatgctcccaagcattggatgctcgacaagctcggcggcgctttcgctcctaagccttcatctgggccgcacaagtctagggagtgcctcctttggttcttattctgcgaaacaggttgaagtacgctttgacctaccgtgaggttcagtccatcttgatgcagcgtcatgtgatggttgataacaaggtcaggactgataagaccttcccagctgggtttatggatgtggtctccatccccaagaccaatgagaatttccgtctgctgtatgataccaagggaaggttcagactgcactccatccgtgatgaggaggcaaagttcaagctgtgcaaggtcaggaacatccaattcggttccaagggtatcccatacctaaatacctatgatggccgcaccatccgctaccccgacccgctcatcaaggctaacgacaccatcaagctggacctcgattccactaagattgttgacttcatcaagtttgacgttggcaacgttgtcatggtcaccggaggcaggaacagaggccgagtcgggatcctgaagaacagagagaagcataagggaagcatcgagacagtccacatccaggactctactggtcacgagtttgccactcttctgtccaatgttttcaccatcggcaagggttccaagccctgggtgtctctccccaagggcaagggtatcaagcttaccatcattgaggaggccaagaagaggattgctgctcaggctgctgcttaggatgtttctcttctttaatcaatcaatgaaaactggatgtgtttctttccaaatgctagaacttggtatctagttttgttctgtttggaattttggatcattagctgatacattatctagtaatttaatgttttgaggttgtttcagacgttattttaatggtaattgtggttcatagacataaatttggtttctctccagttttgatcgtcttctaaactttttaatgcttgaatcgatttggatttgtgaaagtttaatcaattgattctatccg

SEQ ID NO: 4449 - DNA, 819 bp, Solanum lycopersicum
tctgtcgaaaaaccgccaaaatggcaagagggttgaagaaacatttaaagaggctcaatgcgcctaagcattggatgcttgataaattgggaggtgcttttgctcccaagccttcgtctggtccacataaatcaaaggaatgtttgccattggttattatcctcaggaacaggttgaaatatgctttgacataccgtgaggtcatttctatcttgatgcaacgccaagttatggttgatgggaaagttagaacagataagacttaccctgctggtttcatggacgttgttactattccaaagacgaatgagtgcttccgacttctttatgacactaagggtcagttccgtctacactcactcagagatgagaaagccaagttcaaactttgcaaggttcgattagtgcagtttggacagaagggtatcccatatctcaacacgtatgaaggaagaacaatccgctaccccaatcccctcatcaaggctaatgacaccattaagctggacttagattccaataagattgttgacttcatcaaatttgatgttggtaatgtggttatggtgactggtggtagaaacagggggcgttggaattctgaagaatagagagaagcacaagggtagctttgagacagttcacattcaggattccctggggcatgagtttgctactcgtttgggaaatgtgttcactcttggtaaaggaagtaagccatgggtgtctctacctaagggtaaaggtatcaagttatctatcattgaagaggctcgcaaaaggatggttgctcaatcagctacaactatttaaaaatga

SEQ ID NO: 4450 - DNA, 991 bp, Brassica napus
acagcttaaccagtctaaaacgagagaagtcgtcgtctggataaccggagctacgctttcaaactccaaccatggcgagaggtttaaagaagcatttgaagaggctcaatgcccctaccatttggggtcttgacaaacttggcggtgcttttgcccccaagccatcgtccggaccacataagtcgagggagtgtcttcccctcgtccttatcatcaggaacaagttgaagtacgctctcacttaccgtgaagtgatcgccatcttgatgcaaaggcatatccaggtcgatgggaaagtcaggaccgacaagacctaccctgctggtttcatggatgttgtctccatccctaagaccaacgagtgcttccgtcttctctatgataccaagggtcgtttccgtcttcactccatcaaggatgaggaagccaagtttaagctttgcaaggttaggactatctccttcggacagaagggaatcccttacctgaacacatacgatggtcgcaccattcgttaccctgacccgctcatcaagcctaacgacaccatcaagctcgatcttgaggagaacaaggttgtcgagttcatcaagttcgatgtcggcaatgttgtgatggtgactggaggaagaaacagagggcgtgtgggtgtgattaagaaccgtgagaagcataagggaagctttgagacgatccacatccaggacgcgacagggcatgagtttgcgacaaggttggggaatgtcttcactctagggaaagggacaaagccgtgggtgtctcttcctaagggtaagggtattaagcttaccatcattgaggaagccaggaagaggcttgcggctcaataggctgcttaattttgtgatttttgtgctctttgttatggctttttagacatcttatgattcttagactctgtttacattgtctgtttttttttaactatgttattttatctatttcaagtagttaaagattgaaatttgcg

SEQ ID NO: 4451 - DNA, 1020 bp, Distylium racemosum
caaaatggctcgtgggttgaagaaacatttgaagagactcaatgctcctaagcattggatgcttgacaaacttggtggtgcttttgcaccaaagccttcagctggccctcataaggggagggaatgccttcctcttgtggttcttctaaggaacaggctgaaatatgctcttacgtaccgtgaggtcattgctattgtcatgcaaagacttatttcggttgatggaaaagtcaggacagataaatgctaccctgcaggattcatggatgtgatatcaattgcaaaaaccaatgagaacttcaggcttctttatgatgccaagggtcgcttccgtttacatgcaatcaaggatgaagaagcgaagtataagctctgtaaagttcgtggagttcagtttggagataagggcatcccttaccttaacacttatgatgggcgcactatccgctatccggatccattgatcaaggccaatgatacagtcaagattgatcttgagacgggcaagataaaggattttattaagttcgatgttggtaatgttgttatggttactggaggtcgtaatagaggtcgggttggagtgataaaaaacagagaaaagcataagggtagctttgagattattcatgtccaggatgcggctgggcaagaatttgcaacaagacagggcaatgtgtttacaattggaaagggcaccaaaccttgggtatctctaccaaagggcaaaggtgtgaagctgtccatcattgaagaggccaggaaacgccatgcagcagtaactgctgcagcttaatttttgctatctgaaaaatctgattgtcttagttgaacttaggtcatgtagaatattttgaccattaacaaagactcagctggaaagacatttagaatctagtgtaggtttatatttgagcttaaaagaatgtcctggttaataggattttaaagaggtctgcattgaggtgtactgaaatctcaatcatttcaagctttttttgactttggcctgtgtttccc

SEQ ID NO: 4452 - DNA, 977 bp, Medicago truncatula
ttacggccgggggttcagcggggagtggttgctgcagcgcattcaacaggaacaagtgcagaagcgaagccaaaatggcgcgtggattaaagaaacatttgaagaggctcaatgcccctaagcattggatgcttgacaaacttggtggtgcttttgcacctaaaccatcagcgggtcctcacaagggaagagaatgtcttcctctagtggttcttctgaggaataggctgaaatatgccctgacataccgtgaagtcattgctattgtaatgcaacgactcattgctgttgatggaaaagtcagaactgataagtgctaccctgcaggattcatggatgttgtgtctattgcaaagaccaatgagaactttaggcttctctatgatgctaaaggtcgtttccgtctgcattcaatcaaggatgaggaagcaaagtataaactttgcaaagttcgtggagttcagtttggagataagggtatcccttatctaaacacttatgatgggcgtaccattaggtacccagatccattgatcaaggccaatgacaccatcaaaattgatctagaaacgggcaagatcaaggactttatcaagtttgatgttggtaatgttgtcatggttactggaggtcgtaacagagggcgtgttggagttattaagaacagggagaagcataagggcagctttgagattattcatgtccaggattctgctgggcaggaatttgcaacacgacagggtaacgtgtttaccattggaaagggtacaaagccttgggtatctttaccaaagggcaaaggtgtcaagctgtcaatcattgaagaagccaagaaacgccatgcagctcccactgctgctgcttaattttgggagctagaaaatatgattattttaaatagccaaactttgctcacttcacttcaatgacacctagaatgtagtttagttttatgtaccattttgcggccttcactg

SEQ ID NO: 4453 - DNA, 1073 bp, Medicago truncatula
  misc_feature (851)..(851): n is a, c, g, or t
  misc_feature (930)..(930): n is a, c, g, or t
  misc_feature (932)..(932): n is a, c, g, or t
  misc_feature (959)..(959): n is a, c, g, or t
  misc_feature (966)..(966): n is a, c, g, or t
  misc_feature (1001)..(1003): n is a, c, g, or t
  misc_feature (1006)..(1009): n is a, c, g, or t
  misc_feature (1011)..(1011): n is a, c, g, or t
  misc_feature (1013)..(1015): n is a, c, g, or t
  misc_feature (1017)..(1018): n is a, c, g, or t
  misc_feature (1041)..(1041): n is a, c, g, or t
  misc_feature (1045)..(1046): n is a, c, g, or t
  misc_feature (1051)..(1051): n is a, c, g, or t
  misc_feature (1053)..(1053): n is a, c, g, or t
  misc_feature (1060)..(1063): n is a, c, g, or t
  misc_feature (1069)..(1072): n is a, c, g, or t
ttacggccgggggttcagcggggagtggttgctgcagcgcattcaacaggaacaagtgcagaagcgaagccaaaatggcgcgtggattaaagaaacatttgaagaggctcaatgcccctaagcattggatgcttgacaaacttggtggtgcttttgcacctaaaccatcagcgggtcctcacaagggaagagaatgtcttcctctagtggttcttctgaggaataggctgaaatatgccctgacataccgtgaagtcattgctattgtaatgcaacgactcattgctgttgatggaaaagtcagaactgataagtgctaccctgcaggattcatggatgttgtgtctattgcaaagaccaatgagaactttaggcttctctatgatgctaaaggtcgtttccgtctgcattcaatcaaggatgaggaagcaaagtataaactttgcaaagttcgtggagttcagtttggagataagggtatcccttatctaaacacttatgatgggcgtaccattaggtacccagatccattgatcaaggccaatgacaccatcaaaattgatctagaaacgggcaagatcaaggactttatcaagtttgatgttggtaatgttgtcatggttactggaggtcgtaacagagggcgtgttggagttattaagaacagggagaagcataagggcagctttgagattattcatgtccaggattctgctgggcaggaatttgcaacacgacagggtaacgtgtttaccattggaaagggtacaaagccttgggtatctttaccaaagggcaaaggtgtcaagctgtcaatcattgaagaagccaagaaacgccatgcagctccnactgctgctgcttaattttgggagctagaaaatatgattattttaaatagccaaactttgctcacttcacttcaatgananctagaatgtagtttagttttatgtacnattttgnggccttcactgaaaatttgtttttttgattttttnnncgnnnntngnnntnncttttagcagtactcgtcccatnaacnnttttncnaatcatnnnntggctnnnna

SEQ ID NO: 4454 - DNA, 1283 bp, Pseudotsuga menziesii
gttagggttaagtttagagctagaagagcaactagtttttggtgaaggttatagggtttcaaagagctaccaagttttttaagctcgcgttcgaagttatgaggttttcggtttgtgtcatttgatttgctgaaggcgcctggcagagctcaaggatttctccgattcttcttactgagcggatcgtagagacatcatggctcgtggattgaagaaacatttgaagaggctcaatgctcctaagcattggatgcttgacaaactcggtggtgcttttgcaccaaaaccatctgctggtcctcacaagggcagggaatgccttccccttgtggttcttattaggaacaggctgaaatatgctctcacatatcgtgaagtcatagccattgtaatgcaaagacttatatctgttgatggaaaagtcaggacggacaaatgttatcctgcagggtttatggatgtcctgtcgattgcaaaaacaaatgagaattttaggcttctttatgatgcaaagggtcgtttccgcttgcattcaatcaaggatgaagaagcaaagtataaactttgcaaggtacgttccgtacaatttggagataagggtatcccatacctcaacacttatgatggacgcacaattagatacccagacccattggtcaaggccaatgacacgatcaagattgacctagagacggggaagatcaaggaattcattaagtttgatgttggtaatgttgtaatggttaccggaggtcgcaacagaggtcgtgttggagtcattaagcacagagaaaagcacaagggtagctttgagattattcacgtgcaagatgctgctgggcaggaatttgcgacacgacagggtaacgtgttcacaattggaaagggcacaaagccttgggtttccttacccaagggcaagggtgtcaagttgtccatcattgaagaagccaggaaacgccatgcagctgccactgctgcagcataaagttttgttcattggaaaacttgatggttttgatagtcagaatttgttagcttagtatactttcactgttatcaaaaccattggtttaaatcaagcatgatttctaatggttaggccttgaacgatattggaagtccaaatgttattttgaccgatttctaatggttagggcttgaaccatactggaagtccaaatgttattttgaccgagaatttaagctatgggaagagtccttgttgcattaagaaaattatacctagatttggaactaagattaatccatcataagccgag

SEQ ID NO: 4455 - DNA, 2115 bp, Pseudotsuga menziesii
aagcctggaggccttctttgtgttatttggattgcagaaggcgtctggcggggctcagggatttctcctccacctcttactgagcgggtagcagaaacatcatggctcgtgggttgaagaaacatttgaagaggctcaatgctcctaagcattggatgcttgacaaactcggtggtgcttttgcaccaaaaccatcacctggtcctcacaagggcagggaatgccttcctcttgtggttcttattaggaacaggctgaaatatgctcttacataccgtgaagttatagccattgtaatgcaaaggcttatatctgttgatggaaaagtcaggacagacaaatgctatcctgcagggtttatggatgtcctgtcaattgcaaaaacaaatgagaattttagacttctttatgatgcaaagggtcgtttccgtttgcattcaatcaaggatgaagaagcaaagtataagctttgcaaggttcgttctgtacaatttggagataagggtatcccttatctcaacacttacgatggacgcacaattaggtacccagatccattagtcaaggccaatgatacaatcaagattgacctggagactggcaagatcaaggagttcatcaagtttgatgttggtaatgttgtaatggttactggaggccgcaacagaggccgtgttggagtcattaagcacagagaaaagcataagggtagctttgagattattcatgtgcaagatgctgctgggcaggaatttgcaacccgacagggtaatgtgttcacaattggaaaaggcacaaagccttgggtttccttacccaagggtaagggtgttaagttgtccatcattgaagaggccaggaaacgccatgcagctgcaactgctgcagcataagttttgttcattggaaaatttgatggttttgatattcagaatttgatagcttaatatacttttatatcagaaactccgttgggaaaacttaggagctaccattggtttatgtttagagcgaaaggagttttattttgcatttttaagagcacctttgaggttttagggaaatctatatatgctattttttgatatcaattttctaaccggtttaaatgcaatactgaatattttttgtggccaaacaagaatggaatcagaatatggcagaggaactttgtttcatgtggcattggaataaataatatatttaagaacgagcataagcctctaatggaaaggctattatcatcactgcaaaattcaggctcgtactgacttcttcttccaaaaaccgtagcccgatttgtccgcgcctggtgtcgtttacgtgtgttctgttggagttaacagcgcggcccatttcgccaaattgcctgcttgtagttgggcagttcaccgttccccacaggcgaggttcgaaatctgcacctcaaatctgtgtcgaccgcagttgtcatgtcagataattattagctggcagactgctttttgttcaggatttagtgtggaaaagtactttcggtaccaaaacgcagtgagacaagatgccgggtcggatacagattccaggtgaggtgtttggtgaagctggaggacagcaggctgatttggcgcaacagaatgggagcagtttatcttcacaagcatcaaatctgggaggtacacgaaggtcatggcatatggagtttacggacactgatatatatcaactgcggcaatatatcacagagaagatcttgcatgtatttcgtggaccgatttctttagaatggcaacagcggctacccaacctcgtgaggcgcttggaggaagctctattcatggaggctgcttcaaaggaagaatacatgaacttaaatactttggagcggcgtttgacctctttgatgcaacggtttcaacgtaatcgtaaccagaatgtcagtcatcacgatcctcatgttggaacaatgatactaactccagaattgcaacaaagtggaaatgcaagtacaatgattcctgcaccaggtactgatatttctacggttaatggtcatggcacaagcaatatgctccccaacacagttggcatgtgaaacatgctaccaagtagtaatttaaatgttggcatgtgaaa

SEQ ID NO: 4456 - DNA, 1057 bp, Brassica rapa
ctatcacagcttaaccagtcggtcggagctaaaacgagataagtcgtcgtctggatcatcggagctacgctttcaaactccaaccatggcgagaggtttaaagaagcatttgaagaggctcaatgcccctaccatttggggtcttgacaaacttggcggtgcttttgcccccaagccatcttccggaccacataagtcgagggagtgtcttcccctcgtccttatcatcaggaacaagttgaagtacgctctcacttaccgtgaagtgatcgccatcttgatgcaaaggcacatccaggtcgatgggaaagtcaggaccgacaagacctaccctgctggtttcatggacgttgtctctatccctaagaccaacgagtgcttccgtcttctgtacgataccaagggtcgtttccgtcttcactccatcaaggatgaggaagccaagtttaagctttgcaaggttaggactatctccttcggacagaagggaatcccttacctgaacacatacgatggtcgccccatccgttaccctgacccgctcatcaagccaaacgacaccatcaagctcgaccttgaggagaacaaggttgtcgagttcatcaagttcgatgtcggcaatgttgtgatggtgactggaggaagaaacagagggcgtgtgggtgtgattaagaaccgtgagaagcataagggaagctttgagacgatccacatccaggacgcgacagggcatgagtttgcgacaaggttggggaatgtcttcacgctagggaaagggacaaagccgtgggtgtctcttcctaagggtaagggtattaagcttaccatcattgaggaagccaggaagaggcttgctgcacaataagctgcttgattttgtgatttccagctacttattatgcctttatagacctaattgtttcttagacttcgtttacatttttttgttcactcccggttttgatacatgtgttattttatctatttcaagagttaaacaatgaaatttgcggattctatatgagccacttcttgtcctgaaataactaaatctaaa

SEQ ID NO: 4457 - DNA, 1138 bp, Picea glauca
ttaattaaattaatcccccccccccccgagcgtcgattttttctttgtattatttcgtttgctgaaggcgtctggcgggggtcagggatatctcctccaactcttactgtcatggctcgtggattgaagaaacatttaaagaggctcaatgctcccaggcattggatgcttgacaaacttggtggtgcttttgcaccaaaaccatctcctggtcctcacaagggccgggaatgccttcctcttgtggttcttattaggaacaggctgaaatatgctctcacataccgtgaagtcatagccattgtaatgcagagacttatttctgttgatggaaaagtgaggacagacaaatgttaccccgcagggtttatggatgtcctgtctattgcaaaaacaaatgagaattttaggcttctttatgatgcaaagggtcgtttccgtttgcattcaatcaaggatgaagaagcaaagtataaactttgcaaggttcgttctgtgcaatttggagataagggtatcccttacctcaacacttatgatggacgcacaattaggtacccagacccattggtcaaggccaatgatacaatcaagattgacctagagacaggcaagatcaaggagttcatcaagtttgatgttggtaatgttgtaatggttaccggaggtcgcaacagaggtcgtgttggagtcattaagcacagagaaaagcataagggtagctttgagattattcatgtgcaagatgctgctggtcaggaatttgcgacccgacagggtaatgtgtttacaattggaaaaggcacaaagccttgggtttccttacccaagggtaagggtgtcaagctgtccatcattgaagaggccaggaaacgccatgctgctgccactgctgcagcatgagttttgttcattgcaaatctctatggttttgatagtcagaatttgttagattagtatactctgattgttatcagaaactttgtttggaaaacttaggagctaccattgattttagtctgaacaaaaagggctttattttgcatttctaagtgcagctttgaggttctactgaaatctaaatgctatatttttttgacatcaattttcctaactggtttaaatgcattactgaata

SEQ ID NO: 4458 - DNA, 1097 bp, Abies balsamea
agttattagggtttttaagtttatatttcagaatcttggtgtcttcgtttttgttatttggtctgcagaagacgcctggcggggctcaaggatttctcctctacctcttactgagcggatcgtagagacatcatggctcgtggattgaagaaacatttaaagaggctcaatgctcctaggcattggatgcttgacaaactcggtggtgctttcgcaccaaaaccatctcctggtcctcacaagggtagggaatgccttcctcttgtggttcttattaggaacaggctgaaatatgcactcacataccgtgaagtcatagccattgtaatgcaaagacttatttctgttgatggcaaagtcagaacagacaaatgctatcctgcaggttttatggatgtcctgtcaattgcaaaaacaaatgagaattttagacttctctatgatgcaaagggtcgtttccgcctgcattcaatcaaagatgaagaagcaaagtataaactttgcaaggttcgtagtgtacaatttggagataagggtatcccttacctcaacacttatgatggacgcacaattaggtacccagatccattggtcaaggccaatgatacgatcaagattgacctagagacgggcaagatcaaggagtttatcaagtttgatgttggtaatgttgtaatggttaccggaggccgcaacagaggtcgtgttggagtcatcaagcacagagaaaagcataagggtagctttgagattattcacgtgcaagatgctgctgggcaggaatttgcaacccgacagggtaatgtgttcacaattggaaagggcacaaagccttgggtttccttacctaagggtaagggtgtcaagctatccatcattgaagaggccaggaaacgccatgcggctgcaactgctgcagcataagttttgttcattagaaaacttgatggttttgatagttgaaatttgttatttagtatactttgactgttagtatcatttgttagcttagctaccgtatatttatgtttgaacggaaaaaaggttttattttgcatttttaagagcagatttgaggttctactgcaatctagatg

SEQ ID NO: 4459 - DNA, 1315 bp, Cephalotaxus harringtonia
gcctgcccgcaaagagatttttaacagagttggggtttgaagggctagggtttgctagacagttggaaggtttattagggttgtgagctgaacaattgaaaactctttgaccatttgttaagaggcaaggaaaggagaggccattgccttcaacggagacactgcagagtctaaatcaaaatggcgcgtggattgaagaaacatttaaagaggctcaatgctcctaaacattggatgcttgacaaacttggtggcgcttttgcacctaaaccatcagctggtcctcacaagggaagggaatgccttcctcttgtggttcttctgaggaacaggctgaaatatgcccttacataccgtgaagtcattgctattgtaatgcagcggcttattgctgttgatggaaaagtcaggactgataaatgctaccctgcagggtttatggatgttgtgtctattgcaaagaccaatgagaactttaggcttctctatgatgcaaaaggtcgtttccggttgcattcaatcaaggacgaggaagcaaagtataaactttgcaaggttagaggagtccagtttggagataaggccattccttatcttaacacttatgatggacgcaccattcggtacccagatccattgatcaaggccaatgataccatcaaaattgatctggaaacgggcaagataaaggattttattaagtttgatgttggcaatgttgtcatggttactggaggtcgtaacagaggccgtgttggagtgattaagaacagggaaaagcataagggtagctttgagattattcatatccaggattctgctgggcaggaatttgcaactcgacaggggaatgtgttcaccattggaaagggcacaaagccctgggtatctctaccaaagggcaaaggtgtcaagttgtctatcatcgaagaggctaggaaacgccatgctgccggaaccgcggcagcttaagttttggaccaggaaaatataattgtctttcatagacaaactttggtgatttggtatgacttctagagtctagttttatattttaatttcaaggattgcggtgggtattaattctatataagtgtttttgttttaggccagtactggaatcttgttcattttaatctttttgacactggtttgcattagcaattcaaatgtcttagaaacaattagttatatttagattttaaaaaggtcatggcttttgtagggaggatgcatgaggattgtttaaactatatcaatcgagatatgtttacagtcctgtatttattttaatgctatcttgggcttctttgtt

SEQ ID NO: 4460 - DNA, 1154 bp, Cephalotaxus harringtonia
tttgagctgaagtattgaaaccatttgttccgaggaggaaaagagaggcctgctgcacatcgcattcgacggaactgaagggaagcgtacaagtgcagagtctaaagcaaaatggcgcgtggattgaagaaacatttaaagcggctcaatgctcctaaacattggatgcttgacaaacttggtggtgcttttgcacctaaaccatcagctggtcctcacaagggaagggaatgccttcctcttgtggttcttctgaggaacaggttgaaatatgcccttacataccgtgaagtcattgccattgtaatgcaacgacttattgctgttgatggaaaagtcaggactgataaatgctaccctgcagggtttatggatgttgtgtctattgcaaagaccaatgagaattttaggcttctctatgatgctaaaggtcgtttccgcttgcattcaatcaaggacgaggaagcaaagtataaactttgcaaggttagaggagtccagtttggagataaggccattccttatcttaacacttatgatggacgcaccattaggtacccagatccattgatcaaggccaatgataccatcaaaattgatctggaaacgggcaaaatcaaggattttatcaagtttgatgttggcaatgttgtcatggttactggaggtcgtaacagaggccgtgttggagtgattaagaacagggaaaagcataagggtagctttgagattattcatatccaggattctgctgggcaggaatttgcaactcgacaggggaatgtgttcaccattggaaagggcacaaagccctgggtatctctaccaaagggcaaaggtgtcaagttgtctatcatcgaagaggctaggaaacgccatgctgccggaactgcggcagcttgagttttggaccaggaaaatataattggctttcatagacgaattttggtgacttagtacgacatctagaatgtagtctagttgtatattttaatttcaaggattgtggtgggtattagttcctatataagtgtttttgttttaggcctgtactggaatcttgttctttttattctttttgacatttgtttcattagcactgcaaatgtcttaaaaacaatttttatgtttagatttaaaaaggtcatggcttt

SEQ ID NO: 4461 - DNA, 1648 bp, Gnetum gnemon
gtcaagactcgagcatccctagagccggcatgaacttgatctatcacgatgcattcattaaacgttagctagatggtgaaaccctcatttccaaccctaatttcgaggaggccggtgagtcagggtttttaggccgtctagggtttttgttgccaagtgcggaaagaagaggagctcatcagaaggaaggcagagtcgagagcggaggtgaggagaaggagcaacgaggcaacagctgcagctgcagcggggatcaggcgctgcgtttcaatcattcactgtgactaaaccatggctcgaggattgaagaagcatttgaagcgactgaatgctcccaggcattggatgcttgataaacttggtggtgccttcgcgccaaaaccatctgctggtcctcacaagggacgagaatgtcttcccttggtggttcttttaagaaacaggttgaaatatgcactcacatatcgtgaggtcattgctatcgtgatgcagagattgatagctgtggatggcaaagtcaggactgacaaatgttacccagccggttttatggatgttgtttcaattgccaaaacaaacgaaaattttaggcttctttatgatgctaaagggcgtttccgactgcattcaattaaagatgatgaagcgaagtacaagctttgcaaggttaggtctgttcagttcggagaaaaaggtattcctttcctgaacacatatgatggtcgcacaattaggtatccagatccactgatcaaagccaatgatacaatcaagattgacttagagactggaaagattatcgaccacataaagtttgatgttggcaatgttgtaatggtaactggtggtcgcaacagaggtcgtgtgggagtaattaaaaacagggaaaaacataagggtagttttgagatcattcacattcaggatgccgctggtcatgaatttgctactcgccaaggcaatgtttttactattgggaagggcactaagccttgggtttctctgccaaagggtaaaggtattaagctctcaatcatagaggaggccagaaagcgtcatgctgctactgcagctgcttaagttttggaaatggaaatcatttatattcaagaaccttgttttttgatggaataccatagcatgtagggattgagacttgctattattcattttgaagcttccatacaagttttgtatcatttcattggtatttggttattttgacagatttatgttagcatgataaacatcagttatttcaaatgtttatttgtttctatgtcttggttttggtggcatttgaacgtttgctgaaaaccggaaagagtctttaagcatggataaagctgaaagtgatttttataatgttattgagtatttgcttgtgcctgtattcatttgtgaaaaattgtcagctgttggaaccatattgcggaaagaaatgcaggaaatttgtgctatgttaagttggtatgttctcgaggattgggaggacttttttgtggtatgtttcagaagttggtgtgcctttcaggatttgaacgttgagtgagtaccgaaaaattccatcttttgagtatgtaggaaatctttgtggttatgttggtatgccctgtcggattagaaattttcttggtcggattagtgc

SEQ ID NO: 4462 - DNA, 1056 bp, Sciadopitys verticillata
agaagtagaaggagaaggggctgcaggttttgaagcaaagcaaatatggctcgtgggttgaagaaacatctgaagaggctcaatgctcctaagcattggatgcttgacaaacttggtggtgcttttgcaccaaaaccatcagctggtcctcacaaggggagggaatgccttcctctcgttgttctactgaggaacaggctgaaatatgcccttacgtaccgtgaagtcattgccattgtaatgcaaagacttatttctgttgatgccaaagttaggactgacaaatgctaccctgcagggtttatggatgtcgtctccattgcaaagacaaacgagaattttaggcttctttatgatgccaaaggtcgtttccgtttgcattcaatcaaggatgaggaagcaaagtataaactttgcaaagttcgtggagtccagtttggagataagggtatcccctatctaaacacttatgatggccgtaccatcaggtatccagatcctttgatcaaggccaatgatacaatcaagcttgatctggagacaggcaagataaaggattttattaagtttgatgttggcaatgttgtcatggttactggagggcgtaacagaggtcgtgttggggtgattaagaacagggaaaagcataagggtagctttgaaattattcatgtccaggattctgctggacaggaatttgcaacgcgtcagggtaatgtgttcacaattggaaagggcacaaagccttgggtatctctacctaagggcaaaggtgtcaagctgtccatcattgaagaggccagaaaacgtcatgcagctggaactgctgcagcttaattttggacctggataatatgtttctcttccatggtcaaactttggtgacttagggtagttggggtattagcaaaaactgagttggaaaagacatctagaatctagattagagttatatttaaacttcaaatgttgcggcgtgtattagttttaaaaaggcttttgtgttgagatctactaaaatcatctcaatcattttaattttttgacatcggtttg

SEQ ID NO: 4463 - DNA, 1145 bp, Sequoia sempervirens
aatggcgcgtggattaaagaaacatttgaagaggctcaatgcccccaagcattggatgcttgacaaacttggtggcgcttttgcacccaaaccatcagcaggtcctcacaagggaagagaatgccttcctctagtggttcttctgagaaataggttgaaatatgctctgacataccgtgaagtcattgctattgtaatgcaacgactcatttgtgttgatggaaaagtcagaactgataagtgctaccctgcaggatttatggatgttgtgtctattgcaaagaccaatgagaactttaggcttctctatgatgctaaaggccgtttccgcctgcattcaatcaaggatgaggaagcaaagtataaactttgcaaagttcgtggagttcagtttggagataagggtatcccttatcttaacacttttgatgggcgtaccattaggtacccagatccattgatcaaggccaatgataccatcaaaattgatctggaaacaggcaagatcaaggactttatcaagtttgacgttggtaatgttgtcatggttactggaggtcgtaacagaggccgtgttggagtgattaagaacagggagaagcataagggcagctttgagattattcacgtccaggattctgctgggcaggaatttgcaacacgacaaggtaatgtgtttactattgggaagggcacaaagccttgggtatctttaccaaagggtaagggtgtcaagctgtcaatcatcgaagaggccaagaaacgcaatgcagctccaactgctgctgcttaattttgggacataggaaatatgattgtttttaatagccaaacattggtaactttaaggagatctagaatatagtgtagtttatgtacaattttgaggcatttactgaaaatttgttattttgatattttttgatcttggtttgtgttagattagcagtactcagtctcataaacagtttttccatatcatgttatgactccaactcttgcatggaggatgcatgagactttcataatggcgttgttaaattatcaagtgagatgatgttctccatatcatgctataactcttgcatggaggatgcatgagaatttcataatggcgttgttaaattatcaaatgatttttacag

SEQ ID NO: 4464 - DNA, 1310 bp, Sequoia sempervirens
agaaataagtcaggatacaggtaaatatgtatttggtattgatgatactttaaaggcactggaggcgggatgttttcggatttccgcgaattagaaactcacaatacaatacgattagacctggatctcatatatattttcacattagggcgctgaggcgtgtgttttgagctagagaagtggagcggcgggcgcaggagagcgacgaggaagggcgtcaatggctcgtggattgaagaagcatttgaagaggctcaatgcccctaagcattggatgcttgacaaacttggtggcgcttttgcaccaaaaccctcagctggtcctcacaagggaagagaatgccttcctcttgtggttcttctgaggaataggctgaaatatgccctaacataccgtgaagtcattgccattgtaatgcaacggctcattgaggttgatggaaaagtcagaactgataaatgctatcctgcaggattcatggatgttgtttctattgcaaagaccaatgagaactttaggcttctctatgacactaaaggtcgtttccgcttgcattcaatcaaggacgaggaagcaaagtataaactttgcaaagttcgtggagtccattttggtgataagggtatcccttatcttaatacttacgatgggcgtaccattaggtacccagatccattgatcaaggccaatgataccgtcaaaattgatctggaaacaggcaagatcaaagaatttatcaagttcgatgttggtaatgttgtcatggttactggaggtcgtaatagaggccgtgttggagtaattaagaatagggaaaagcacaagggtagctttgagattattcatgtccaggattctgctgggcacgaatttgcaacacgacagggtaatgtgttcaccattggaaagggcacaaagccttgggtatccttaccgaagggcaaaggtgtcaagctgtctattattgaggaggctaagaaaaggaatgcagctcaaactgctgcagcttaattttgggatctggaaaatataaatttctttaatggttaaactttggtgacttggtatgggatctagaatgtagtgtagttctgcgttacaaatttgaggcatatattttctgtacacatgccatataaacagtttttctaaaacatgtcatggcttttgcattgaggattttatgatagtcttgttagttactgccggtaggcagcttactatagcatccattttgtgcaattaattctgatgaagacccaatcatatcattttattttaatccatgctaaggtttcaatatataaac

SEQ ID NO: 4465 - DNA, 1117 bp, Picea glauca
attttttctttgtattatttcgtttgctgaaggcgtctggcgggggtcagggatatctcctccaactcttactgtcatggctcgtggattgaagaaacatttaaagaggctcaatgctcccaggcattggatgcttgacaaacttggtggtgcttttgcaccaaaaccatctcctggtcctcacaagggccgggaatgccttcctcttgtggttcttattaggaacaggctgaaatatgctctcacataccgtgaagtcatagccattgtaatgcagagacttatttctgttgatggaaaagtgaggacagacaaatgttaccccgcagggtttatggatgtcctgtctattgcaaaaacaaatgagaattttaggcttctttatgatgcaaagggtcgtttccgtttgcattcaatcaaggatgaagaagcaaagtataaactttgcaaggttcgttctgtgcaatttggagataagggtatcccttacctcaacacttatgatggacgcacaattaggtacccagacccattggtcaaggccaatgatacaatcaagattgacctagagacaggcaagatcaaggagttcatcaagtttgatgttggtaatgttgtaatggttaccggaggtcgcaacagaggtcgtgttggagtcattaagcacagagaaaagcataagggtagctttgagattattcatgtgcaagatgctgctggtcaggaatttgcgacccgacagggtaatgtgtttacaattggaaaaggcacaaagccttgggtttccttacccaagggtaagggtgtcaagctgtccatcattgaagaggccaggaaacgccatgctgctgccactgctgcagcatgagttttgttcattgcaaatctctatggttttgatagtcagaatttgttagattagtatactctgattgttatcagaaactttgtttggaaaacttaggagctaccattgattttagtctgaacaaaaagggctttattttgcatttccaagtgcagctttgaggttctactgaaaatctaaatgctatatttttttgacatcaattttcctaactggtttaaatgcattactgaatattttatgtggcca

SEQ ID NO: 4466 - DNA, 1196 bp, Picea glauca
agagcgtcgattttttctttgtattatttcgtttgctgaaggcgtctggcgggggtcagggatatctcctccaactcttactgtcatggctcgtggattgaagaaacatttaaagaggctcaatgctcccaggcattggatgcttgacaaacttggtggtgcttttgcaccaaaaccatctcctggtcctcacaagggccgggaatgccttcctcttgtggttcttattaggaacaggctgaaatatgctctcacataccgtgaagtcatagccattgtaatgcagagacttatttctgttgatggaaaagtgaggacagacaaatgttaccccgcagggtttatggatgtcctgtctattgcaaaaacaaatgagaattttaggcttctttatgatgcaaagggtcgtttccgtttgcattcaatcaaggatgaagaagcaaagtataaactttgcaaggttcgttctgtgcaatttggagataagggtatcccttacctcaacacttatgatggacgcacaattaggtacccagacccattggtcaaggccaatgatacaatcaagattgacctagagacaggcaagatcaaggagttcatcaagtttgatgttggtaatgttgtaatggttaccggaggtcgcaacagaggtcgtgttggagtcattaagcacagagaaaagcataagggtagctttgagattattcatgtgcaagatgctgctggtcaggaatttgcgacccgacagggtaatgtgtttacaattggaaaaggcacaaagccttgggtttccttacccaagggtaagggtgtcaagctgtccatcattgaagaggccaggaaacgccatgctgctgccactgctgcagcataagttttgttcagcataagttttgttcattgcaaatctctatggttttgatagtcagaatttgttagattagtatactctgattgttatcagaaactttgtttggaaaacttaggagctaccattgattttagtctgaacaaaaagggctttattttgcatttctaagtgcagctttgaggttctactgaaatctaaatgctatatttttttgacatcaattttcctaactggtttaaatgcattactgaatattttgtgtggccattcaaatcatcccattagttttcaataatgccattttattgccttttaatttcaa

SEQ ID NO: 4467 - DNA, 1004 bp, Centaurea maculosa
ggcgggaggtcatttttgtataatatccccaaaaaaataggatgatcagaatttccagtctgccggcaaaaaagccggattcaactattcaagcttgaccatccccatggggacatccgaagcagttggtagggttttggctgtttcaaagatgccaattcttcttattcttatttttagttacttctcgcttatgcggagtagcagatcagcttcgatcttcagcaatcaatcacacaatggcaaggggactgaagaagcacatgaagaggctcaatgcccccacacactggatgcttgacaaacttggaggagcatttgctcccaagccatcatctgggcctcacaaatccagggagtgtctgcctctgatcctgatcttgcggaatagattgaaatatgctcttgactatcgtgaggtcaatgccatcttaatgcaaaggcatgtccttgtggacgggaaggtcaggactgataaggcatatcctgcaggattcatggatgttgtttccatccccaaaacaaatgagaacttccgtctactttatgacaccaaaggccgtttccgtcttcactcaatcagggacgaagaagcgaagttcaagctatgcaaggttcgatctgtgcagttcgggcataagggaataccatacctgaatacctacgatggtcacaccatccgctatccagatccactcatcaaggccaactacaccatcaagtatgatctcgagtccaacaagatcgtagatttcatcaaatttgatgtcgggaatgtggttatggtgacgggtggaaggaacagggggcgagtgggaatcatcaagaacaaagagaagcataagggtagttttgagattatccacatccaagatgcaacaggtcaggagtttgcgactcgtgtgggttatgtatttaaccctcggcaagggtaccaaaccatgggtgagccttcctaagggcaagggtatcaagttatccatcatcgaagaggcgaggaagag

SEQ ID NO: 4468 - DNA, 841 bp, Eschscholzia californica
ctacagactacaggggactcacaggcgaaaggagaaggcggggagttttcaagcgaagaagaataactcaatcatggcaagaggactgaagaagcatttgaagaggctcaatgccccaagccactggatgctcgacaagcttggtggtgcatttgctccaaaaccatcctctggaccccacaaatccagggaatgcctcccattgattcttatcctgcgaaataggttgaaatatgctcttacatatagggaggttgttgctattttaatgcaacgacatattttggttgatggaaaggtgcgaacagatcaaagatatccatcaggcttcatggatgtcgtgtcgatcccgaaaacaaatgagaacttccgtcttctctatgataccaaaggtcgtttccgtctccattcaatcaaggatgaagaggctaagttcaagctctgtaaggtccgtaatgtgcagtttggacagaagggtatcccttacattaacacctatgatgggcgcacaatccgctaccctgacccacttatcaaggctaacgacaccgatcgaacttgacctcgaaaccaacaaaatcaccgacttcatcaagtttgatgtcggaaatgtcgtgatggtcactggtggaagaaacaggggacgtgttggagttatcaagaacagagagaagcataaaggaagtttcgagactatccatgtccaagatgcgactggtcacgaatttgccactcgttaggaatgtttcacatcggaagggaactaagccgtggctttcacttcccaagggcagggtatcaagttgtcgatcattgaagaggccaggagagacttgctgct

SEQ ID NO: 4469 - DNA, 945 bp, Phaseolus coccineus
  misc_feature (360)..(360): n is a, c, g, or t
gaaacatttgaagaggctcaatgctcctaagcattggatgcttgacaaattgggtggtgcatttgctcccaaaccctcatctggaccccacaaatcaagggagtgccttcccctcatactcatcctgcggaaccggttgaagtatgctctgacctaccgtgaagtcattgctattctgatgcagcgacatgtgcttgttgatggcaaagtcagaacagacaagacatatccttctggtttcatggatgttgtatctatacctaaaacaaacgagaacttccgcctgctctatgacaccaaaggtcgtttccgtcttcactctgtcagggatgatgaggcaaagtttaagctctgcaaggntaaagtcggtgcagtttggtcagaaaggtattccatacctgaacacctttgatggtcgtaccatccgatacccagaccctgtcatcagagccaatgacaccattaagctggatctggaggaaaacaagatcgttgattttatcaaatttgatgttgggaacgttgttatggttactggaggaagaaacagggggcgtgttggagttattaagagcagggagaggcaaaagggcagctttgacacaattcacgttcaggatgccactggacatgaatttgctactcgtttggcaaacgtgttcactattggcaaggggacaaagcctttgatttcacttcccaagggtaagggtattaagctatccatcattgaggaagctagaaaaaggactgtcgcccagcaagcaactgctgcttaaatccccttctgaattaatagacttgagcatttcgtagtttaattctatgtttttggtgtttaattccttttgtccgacagattttattgttgaatttttgactcttgcactatacaacttcattgtggctgttaaattcatgatgtaatcgtttctttctccagtt

SEQ ID NO: 4470 - DNA, 1677 bp, Zingiber officinale
  misc_feature (34)..(34): n is a, c, g, or t
  misc_feature (294)..(294): n is a, c, g, or t
  misc_feature (438)..(438): n is a, c, g, or t
  misc_feature (630)..(630): n is a, c, g, or t
  misc_feature (675)..(675): n is a, c, g, or t
  misc_feature (934)..(935): n is a, c, g, or t
  misc_feature (1069)..(1069): n is a, c, g, or t
  misc_feature (1081)..(1081): n is a, c, g, or t
  misc_feature (1622)..(1622): n is a, c, g, or t
  misc_feature (1655)..(1655): n is a, c, g, or t
aaacggctcaatgcccccaagcattggatgttgnacaagcttggtggggcttttgctcccaagccatcatctggcccacataaatcaagggaatgtttacccttgatacttattttgagaaacaagctgaaatatgctcttgtataccgtgaagccattgctatattgatgcaacgccatataatggttgatggaaaggttaggactgataagacatatccagctggtttcatggatgttgtgtcaattcctaagactaatgagaacttccgtctcctttatgacaccaagggncgcttccgtctccattctgttagggatgaagaagctaagttcaagctatgcaaggttagatctgtccgatttggacacaagggcattccctatttgaacacctatgatggtcgcaccatccgctacccagacccacttatcaangccaatgacaccatcaaatttgacttggagaccaacaagatcgtagacttcattaagtttgatgttgggaacgttgtgatggtgactggtgggcgaaatactggccgtgttggtgtgctcaagaacagggagaagcacaagggaagctttgagacggttcacatccaagatgccactgggcatgagtttgcnactcgcctcggaaatgtgttcaccattgggaaaggaacaaagccntggatatctcttcccaaaggcaagggtatcaagctaagcatcattgaggaggcaagaaagcgcttggccgctactgctggaactgctgccactgcttagttctcatttctacaattacctgaatttgcttccttagtttatgctatcttattatgctatctatctatctggtttatggagtttgagaacaagagtatgttatttcatagaacatttgacgcaagttgacaattagcgtttgctggttctcacaatcganntcgtgccgaattcggcacgaggcggcacccctcatgggtgggacgtccctttctacatcttccaggtcctcaaaggcgtcctcttgttcacggtcatcgtcctcataggcaccggctggtccttcctcaagccnttcctgcaggancgcgagaagaaggttatcatgatcgtgatcccgctccagatcgttgctaacatcgcgtcggttgtgatcggcgagactgggccgttcatcaaagactgggtcacctggaaccaggttttccttctcatcgatatcatctgctgctgtgccgttctgttccccatcatctggtccataagatctctgcgagagacgtccaagactgacgggaaggccgcgaggaacctcacgaagctcactttattccggcaattctacattgtcgtgattggatacctttacttcaccaggatcgttgtctttgctttgaagacgatcgcgtcctacaaataccggtgggtgagcgtggccgccgaggagaccgtgggccttattttctatttattcatgttctacatgttccggccagtagagagaaatcagtactttgcgatcgacgatgaagaggaagaagctgcagaattagctcttcgtgaggaagaattcgaactctgattggcaatagcaaggagatatgattttttttccacacttcttggtntgatctttactgatctctgatagtgctcttgcnataggctaaaagagaaccagag

SEQ ID NO: 4471 - DNA, 1119 bp, Picea glauca
tttttctttgtattatttcgtttgctgaaggcgtctggcgggggtcagggatatctcctccaactcttactgtcatggctcgtggattgaagaaacatttaaagaggctcaatgctcccaggcattggatgcttgacaaacttggtggtgcttttgcaccaaaaccatctcctggtcctcacaagggccgggaatgccttcctcttgtggttcttattaggaacaggctgaaatatgctctcacataccgtgaagtcatagccattgtaatgcagagacttatttctgttgatggaaaagtgaggacagacaaatgttaccccgcagggtttatggatgtcctgtctattgcaaaaacaaatgagaattttaggcttctttatgatgcaaagggtcgtttccgtttgcattcaatcaaggatgaagaagcaaagtataaactttgcaaggttcgttctgtgcaatttggagataagggtatcccttacctcaacacttatgatggacgcacaattaggtacccagacccattggtcaaggccaatgatacaatcaagattgacctagagacaggcaagatcaaggagttcatcaagtttgatgttggtaatgttgtaatggttaccggaggtcgcaacagaggtcgtgttggagtcattaagcacagagaaaagcataagggtagctttgagattattcacgtgcaagatgctgctggtcaggaatttgcgacccgacagggtaatgtgtttacaattggaaaaggcacaaagccttgggttcccttacccaagggtaagggtgtcaagctgtccatcattgaagaggccaggaaacgccatgctgctgccactgctgcagcatgagttttgttcattgcaaatctctatggttttgatagtcagaatttgttagattagtatactctgattgttatcagaaactttgtttggaaaacttaggagctaccattgattttagtctgaacaaaaagggctttattttgcatttccaagtgcagctttgaggttctactgaaaatctaaatgctatatttttttgtacatcaattttcctaactggtttaaatgcattactgaatattttatgtggccattc

SEQ ID NO: 4472 - DNA, 977 bp, Citrullus lanatus
gttctatgggtttgacaggcaagaggtttgaagaaacacttgaagaggctgaatgctccgaagcattggatgctcgacaaacttggtggtgcatttgccccaaaaccttcatcaggacctcataaatcaagggaatgtctcccattaatcctcattttgcgaaaccgattgaaatatgctctcacataccgtgaggttattgcaattttgatgcaacgccatgttttagttgatgctaaggtcaggactgataagacctatccggctggcttcatggatgtcgtatccattcccaaaacaaacgagaatttccggcttctttacgacacaaaaggtcgtttccgtcttcactcaatcagggatgaagaggctaagttcaagctctgtaaggtccgctcagtgcagtttgggcagaaaggaattccttatctgaacacttatgatggacgtactatccgttaccccgaccccctgatcaaggcgaatgacaccatcaagttggaccttgactcaaacaagattgctgatttcattaaattcgatgtaggaaacgttgtgatggtgactggtggaagaaacagaggtcgagtgggagtaattaagaacagagagaagcacaagggaagctttgagaccattcacattcaggatgcaaccgggcacgaatttgccactcggctcggcaatgtgtttacaatcgggaaggggacgaagccgtgggtgtccctccccaagggcaagggtataaaactatccatcattgaagaagccaggaaaaggcttgcaagccaagcagcagttactgcttaagagttttgagtattctaaattgtagtcatgagtttttttaatcgtgtttgatagacatatctttcttgacttttgctcttattatttatgtctaagtttttcttttgagacaattaatttctaccagaaatattggtgaggccgtccgttccctctatgattttgtt

SEQ ID NO: 4473 - DNA, 1069 bp, Citrullus lanatus
gtttgacaggcaagaggtttgaagaaacacttgaagaggctgaatgctccgaagcattggatgctcgacaaacttggtggtgcatttgccccaaaaccttcatcaggacctcataaatcaagggaatgtctcccattaatcctcattttgcgaaaccgattgaaatatgctctcacataccgtgaggttattgcaattttgatgcaacgccatgttttagttgatgccaaggtcaggactgataagacttatccagctggcttcatggatgttgtgtccattcccaaaacaaacgagaatttccggcttctttacgacacgaaaggtcgtttccgtcttcactcaatcagggacgaagaggctaagttcaagctctgtaaggttcgctcagtgcagtttgggcagaagggaattccttatcttaacacttacgatggacgtacaatccgctaccccgacccccttatcaaagcgaacgacaccatcaagttggaccttgactcaaacaaaattgctgatttcattaagttcgatgtaggaaacgtcgtaatggtgaccggtggaagaaacagaggtcgagtgggagtaattaagaacagagagaagcacaagggaagctttgagaccattcacattcaggatgcaaccgggcacgaatttgccactcggctcggcaatgtgtttacaattgggaaggggacaaagccgtgggtgtccctccccaagggcaagggtataaaactatccatcattgaagaagccaggaagaggctggcaagccaagcagcagttactgcttaagagttttgagtatcctcaaaatgtattcatgagttttttaaatcgtttttgatagacacatatcttctcgaatttggctctcttattatttatgtctaagtttgtcttttaagacaatttatttctacgagaaatattggtgaggccgttgcctctatgattttgttgttaaaaaacacttgtagctgatattagttgtgttatgactctgctctgtagccttaattattatctatagtcaaattttggatggaaatattattattta

SEQ ID NO: 4474 - DNA, 1021 bp, Ambrosia trifida
cgggtccgacgtaagtctaacggactacgaggtacgacgggggtagggaagggtaggtcggacgtagttgaattttattaaaaattaaccggagatttacatctccgatcgaacacagcaaccataggcaagaggtttaaagaaacatatgaagaggctcaatgcccctaagcattggatgcttgacaaacttggtggtgcttttgctcctaagccgtcatccggcccacacaagtccagggaatgcctgcccttgatcctcattctgaggaacaggttgaagtatgctttgacataccgtgaggtacaatctattttgatgcagcgtcatgttcttgttgacaacaaggtcaggaccgacaagacttaccccgcgggtttcatggacgttgtttctattcctaagaccaatgaaagcttccgtcttctttatgatacaaaaggtagattcaggctgcactcaattagagacgaggagtcaaagtttaagttgtgcaaggttcgttcagttcagtttggttcaaagggcattccatacatcaacacctacgatggtcgtaccattcgctacccagacccactcatcaaagccaacgacaccattaagcttgatctagaatcaaacaagatcgtcgactttatcaagtttgacgttggaaatgttgttatggtgactggtggaagaaacacaggccgtgttggaatcctcaagaacagggaaaagcataagggcagctttgaaaccgttcacattcaagatgctactggccatgagtttgctactcgtttgggtaatgtgtttacccttggaaagggttcaaaaccatgggtttctctccccaagggtaagggtattaagttaaccatcattgaagaggctagaaagaggcaggctgcgcaagaatctgctgcctagattgtgtttggttatcttgtttttgatttaaggttgtttggtagttttactgtcctttattatggtacaatttttgaacctatgctttgatgttgataatttggt

SEQ ID NO: 4475 - DNA, 1042 bp, Artemisia annua
aactcaactgcagtaaaacaccgccgccgtcgtacatttccaccgctgcagccatggcaagaggattgaagaaacatatgaagaggatcaatgctcctaagcattggatgcttgataaaattcatggagtttttgctcctaagccatcatctggaccgcataaggctagggagtgtttgcccttggttcttatcctaaggaataggttgaagtatgccttgacgtatcgtgaggtacaatctattttgatgcaaaggcatgtgcttgttgacggcaaggtcaggaccgataagacttaccctgctggtttcatggatgtggtgacaattcctaagactaacgaaagcttccgtcttctatacgatacaaagggaaggttcaggatgcacgccatcagggatgaggaatcaaagttcaaattgtgcaaggttcgatcggttcagtttggttcaaaagggattccatacatcaacacatatgatggtcgcaccatccgctacccagatcctctcatcaaagctaatgacacaatcaagcttgacttggagactcaaaagattgttgattttattaagtttgatgtcgggaacgttgtcatggtgactggtggacataacacaggccgtgttggtatccttaagaacagggaaaaacataagggaagctatgagactgttcatattcaagatgcaagtggtaatgagtttgctactcgtttgggtaatgtgttcactgttggaaagggtacaaagccgtgggtatctctaccaaagggcaagggtatcaagctgaccattattgaggaggctaggaagaggcaggctgctctagctgctaaggttgcttaatatgttctttttggccagtcatatttaaactttatctgagcacttgtttttagagcggtttttattcttattcttattcttattaattacaattttgaaacttttgatctgggtgttttctttactttagttacatattaaacatttgctattaaaatttatgttttcgtcatttacatgtcttaatgttgata

SEQ ID NO: 4476 - DNA, 915 bp, Persea americana
agcatttgaagaggcttaatgccccgaagcattggatgcttgacaagcttggtggtgcatttgcaccgaagccatcttctggccctcataaagccagggaatgcttgcctttgattctaatcctgcgaaacaagttgaagtatgcacttacctaccgtgaggtcatctcgattttgatgcaacggcatgtcttggttgatggaaaggttaggactgacaagacatatcctgcaggattcatggatgttgtctcaattccaaaaacaaatgagaacttccgacttctttatgacactaagggtcgcttccggctccactcaatcagggatgaagaggcgaagttcaagctctgcaaggtccgatctgtgcagtttggacaaaagggaattccctatcttaacacctatgatggccgcaccatccgctacccagacccgcttatcaaggccaacgacaccatcaagcttgacctggaaacttacaagattgttgatttcatcaagtttgatgtcggaaatgttgtcatggtgactggtggcaggaacaggggacgtgtcggtgtgatcaagaatagggaaaagcataagggtacctttgagacaatccatgttcaggatgccactggccatgagtttgctactcgtctggctaatgtcttcaccattggcaagggaacgaagccctgggtctctcttcccaaaggcaaaggtatcaagctcacgatcattgaggaggccagaaaacgccttgcagcagcagcagctacaactgcctaatcaattgcactttctacaggcctgttataggatggtattgcattttggtttgtcctgttttccgtctcctgtaggaccctttttcttcgattagattttagtagtttggatgaacactgcagtcatagggtttttttga

SEQ ID NO: 4477 - DNA, 814 bp, Centaurea maculosa
  misc_feature (196)..(196): n is a, c, g, or t
  misc_feature (268)..(268): n is a, c, g, or t
  misc_feature (292)..(292): n is a, c, g, or t
  misc_feature (307)..(307): n is a, c, g, or t
  misc_feature (388)..(388): n is a, c, g, or t
  misc_feature (412)..(412): n is a, c, g, or t
  misc_feature (466)..(466): n is a, c, g, or t
  misc_feature (784)..(784): n is a, c, g, or t
  misc_feature (790)..(790): n is a, c, g, or t
  misc_feature (793)..(793): n is a, c, g, or t
cggagcttacagatagtgagaagaagcagttcagccggagaatttcaccggagatttagatctcctctaagacaccgcagccatggcgagaggtttgaagaaacatatgaagaggctcaatgcgcctaagcattggatgcttgacaaacttggtggtgcttttgctcccaaaccatcctcaggaccacacaaatcnagagaatgcttgcctttgattctcatcctccgaaataggttgaagtatgcccttacgtaccgtgaggtcatntctatcttgatgcaaaggcatgtncttgtcgacaacaangtcaggaccgacaagacctacccagctggttttatggatgttgtttctattccaaagactaatgagaacttccgtctcctntacgataccaaaggtagattcagnctacactcaatcagggacgaggaagcaaagttcaagctatgcaaggttcgttcngtccagtttggttcaaagggcattccttacatcaacacatacgatggtcgaaccatccgttacccagacccactcattaaggccaacgacaccattaagcttgatttggaatcaaacaagattgttgatttcatcaagtttgatgtgggaaatgtcgttatggttactggtggacgaaacactggccgtgttggaattctaaagaacagggaaaagcataagggcagcttcgagaccgttcacattcaggacgctaccggccatgagtttgccacacgtttggggaacgtgttcacggtgggaaagggtacaaagccntgggtntcncttcccaagggtaagggtatc

SEQ ID NO: 4478 - DNA, 1217 bp, Cryptomeria japonica
gagaggttaagaaaattcctgcgatgatggttttgggttttcgactacacactacttaagacctggatctcatctataggtcgcagtagggcgctcaggtgtgtgttttcagctagagaagcggagcagcgggcgcaggagagcgacgaggaagatcaatggctcgtggattgaagaaacatttgaagaggctcaatgcccctaagcattggatgctcgacaaacttggtggtgcttttgcacccaaaccctcagctggtcctcacaagggaagagaatgccttcctcttgtggttcttctgaggaataggttgaaatatgccctaacataccgtgaagttattgctattgtaatgcaacgcctcattgctgttgatggaaaagtcagaactgataaatgctaccctgcaggattcatggatgttgtgtctattgcaaagacgaatgagaacttcaggcttctctatgatgctaaaggtcgtttccgcttacattcaatcaaggaggaggaagcaaagtataaactttgcaaagttcgtggagtccagtttggtgataagggtatcccttatcttaatacttatgatgggcgtaccattaggtacccagatccattaatcaaggccaatgataccatcaaaattgatctggaaacaggcaagatcacagaatttattaagttcgatgttggtaatgttgtcatggttactggaggtcgtaatagaggccgtgttggagtaattaagaacagggaaaagcataagggtagctttgagattattcatgttcaggattctgctgggcatgaatttgcaacacgacaaggtaatgtgttcaccattggaaagggcacaaagccttgggtgtctttaccaaagggcaaaggtgtcaagctgtctatcactgaagaggccaagaaacggaatgcagctcaaactgctgcagcttaattttgggacctggaaaatataattttctttaatggttacactttggtgacttatatgagatctagaatgtagcgtagttctatgttaaattttgaggcctttgctgaaaatctggcattttactttttccaacattggtttatattttctgtaaacatgccacataaacaatttttccaaaacgtgccatggcttttgcataaaaagatgcgtgaagattttataatagtctttgttaattactgttggtaggcaggttactatagc

SEQ ID NO: 4479 - DNA, 1354 bp, Sciadopitys verticillata
gggagctgtcgaacacggatcaggagacggagaaggggtttgtaggacaagtgcagaggcaaaggcagaggcaaaggcagaggccttaagcaaagcaaacatggctcgcgggttgaagaaacatttgaagagactcaatgcacctaggcattggatgcttgacaaacttggtggtgcttttgcaccaaaaccatcagctggtcctcacaaggggagggaatgccttccccttgttgttcttctgaggaacaggctgaaatatgcccttacataccgtgaagtcattgccattgtaatgcaaagacttatttctgttgatgctaaagttaggactgacaaatgctaccctgcagggtttatggacgttgtctccattgcaaagacaaatgagaattttaggcttctttatgatgccaaaggtcgtttccgtttgcattcaatcaaggatgaggaagcaaagtataaactttgcaaagttcgtggagttcagtttggagataagggtattccctatctaaacacttatgatggacgcaccatcaggtatccagatcctttgatcaaggccaatgatacaatcaagcttgatctggagacaggcaagataaaggattttatcaagtttgatgttggtaatgttgtcatggtcactggagggcgtaacagaggtcgtgttggggtgatcaaaaacagggaaaagcataagggtagctttgaaattattcatgtccaggattctgctggacaagaatttgcaacgcggcagggtaatgtgttcacaattggaaagggcacaaagccttgggtatctctacctaagggtaaaggtgtcaagctgtccatcattgaagaggccaggaaacgccatgcagctggaactgctgcagcttaagttttggacctgcagaagatgttcctcttccatagtcaaaatttggcgacttagcttagttgggctatttgcaaaaactgagttggttaagacatctagaatctagattagacttatatttaaaattcaaatgttgcggtgatatggaggcaaggtctgagtgttccctggagccatggagctttggagatctaccctctgcgggttctgtttatcaaaacagttttgattcttgccttgggctgttgtaaattcatatcaaagtagactgctggtgtgatgtttgatattgcggggctatgaaaattgccatactattctgttagtctggtaaatcttaactctgttgagctcatatgcgagtcgtgactaaagaaagaacatattttaatgtttttatcaattgtgttactgttttacttgactggatagtgcattttgtatgttgtaagttgctctcag

SEQ ID NO: 4480 - DNA, 793 bp, Papaver somniferum
ggcttaatgccccaaaacattggatgcttgataaacttggaggcgcatttgctcccaagccatcatcaggtccacacaaatctagggaatgccttcccttgattcttatcctgcgaaatagattgaagtacgcccttacataccgtgaggttattgctattttgatgcaaaggcacattcttgttgatggaaaagtgcgaacagacaagacctatccatctggattcatggatgttgtttcgattcccaagacgaacgagaacttccgtctcctgtatgacaccaagggtcgcttccgtctccactcaatcaaggatgaagaagctaagttcaagctctgcaaggttagaaatgtacactttggatctaagggtatcccatacattaacacctttgatggtcgcaccattcgttaccctgaccctcttatcaaggctaatgacaccatcaagctagatctcgagagcaacaagattgtcgattttatcaagttcgacattggtaatgtcgtcatggttactggaggtagaaacagaggccgtgttggtgttatcaagaacagagaaaagcataagggaagtttcgatacccttcacatccaggactctacaggccatgagttcgccacccgtttggccaatgtgttcaccattgggaaaggtaccaagccatgggtttcactccccaagggcaagggtatcaagttgactatcattgaagaagcaagaaagagacttgccgctcaaggagctgcaaccgcctaagctcatcgaaggtgtcggctagcatgagg

SEQ ID NO: 4481 - DNA, 941 bp, Papaver somniferum
ggcttaatgccccaaaacattggatgcttgataaacttggaggtgcatttgctcccaagccatcatcaggtccacacaagtctagggaatgccttcccttgattcttatcctgcgaaacagattgaagtatgcccttacataccgtgaggttattgctattttaatgcaaaggcacattcttgttgatggaaaagtgcgaacagacaagacctatccatctggattcatggatgttgtttcgattcccaagacgaacgagaacttccgtctcctgtatgacaccaagggtcgcttccgtctccactcaatcaaggatgaggaagctaagttcaagctctgcaaggttagaaatgtacacttcggatctaagggtatcccatacattaacacctttgatggtcgcaccattcgttaccctgaccctcttatcaaggctaatgacaccatcaagctagatcttgagagcaacaagattgtcgattttatcaagtttgatattggtaatgtcgtcatggttactggaggtagaaacagaggccgtgttggtgttatcaagaacagagaaaagcataagggaagtttcgatacccttcacatccaggactctacaggccatgagttcgccacccgtttggccaatgtgttcaccattgggaaaggtaccaagccatgggtttcactccccaagggcaagggtatcaagttgactatcattgaagaagcaagaaagagacttgccgctcaaggagctgcaaccgcttaagctcatcgttcatgtgtcagccatcatgaggttctgtttttgcggcctgtttacaattgctgttttagtttatttctactttttgaacaaaattttgaagccgactctgtgatcaagaacaaaatcttagtttatttctacttcaaggaattgtgtgatctcttttgcataattacc

SEQ ID NO: 4482 - DNA, 813 bp, Papaver somniferum
ggcttaatgccccaaaacattggatgcttgataaacttggaggcgcatttgctcccaagccatcatcaggtccacacaaatctagggaatgccttcccttgattcttatcctgcgaaatagattgaagtacgcccttacataccgtgaggttattgctattttgatgcaaaggcacattcttgttgatggaaaagtgcgaacagacaagacctatccatctggattcatggatgttgtttcgattcccaagacgaacgagaacttccgtctcctgtatgacaccaagggtcgcttccgtctccactcaatcaaggatgaagaagctaagttcaagctctgcaaggttagaaatgtacactttggatctaagggtatcccatacattaacacctttgatggtcgcaccattcgttaccctgaccctcttatcaaggctaatgacaccatcaagctagatcttgagagcaacaagattgtcgattttatcaagtttgatattggtaatgtcgtcatggttactggaggtagaaacagaggccgtgttggtgttatcaagaacagagagaagcataagggaagtttcgatacccttcacatccaggactctacaggccatgagttcgccacccgtttggccaatgtgttcaccattgggaaaggtaccaagccatgggtttcactccccaagggcaagggtatcaagttgactattattgaagaggctaggaaaaggttggctgctcaaggagctgccacagcttaggtgctgccatcatgacctgttttgcagtttggaaataactcttggctta

SEQ ID NO: 4483 - DNA, 786 bp, Papaver somniferum
ggcttaatgcccctaaacattggatgcttgataaattgggcggtgcttttgcccctaagccatcatctggaccacacaagtctagggaatgccttcccttgattcttatcctgcgaaacagattgaagtatgcccttacataccgtgaagttattgctattttgatgcaaaggcacattcttgttgatgggaaagtgcgaacagacaagacctatccatctggattcatggatgttgtgtcgattcccaagacgaatgagaacttccgtctcctgtatgacaccaagggtcgcttccgtctccactccatcaaggatgaagaagctaagttcaagctctgcaaagttagaaatgtacactttggatctaagggtattccatacattaacaccttcgatggtcgcaccatccgttaccctgaccctcttatcaaggctaatgataccatcaagctagatctcgagagcaataagattgtggattttatcaagtttgatattggtaatgtcgtcatggttactggaggtagaaacagaggccgtgttggtgttatcaaaaacagagagaagcataagggaagttttgatacccttcacatccaggattctactggccatgagttcgccactcgtttggccaatgttttcaccattgggaaaggtaccaagccatgggtttcactccccaagggcaagggtatcaaattgactattatcgaagaggctaggaaaaggttggccgctcaaggagctgccacagcttaggtgcttccatcatgacctggtg

SEQ ID NO: 4484 - DNA, 921 bp, Papaver somniferum
ggcttaatgcccctaagcattggatgcttgataaactgggtggtgcttttgcccctaagccctcatctggaccacacaagtctagggaatgtcttcccttgattcttatcctgcgaaacagattgaagtatgcccttacataccgtgaagttattgctattttgatgcaaaggcacattcttgttgatgggaaagtgcgaacagacaagacctatccctctggattcatggatgttgtttcaattcccaagacgaacgagaacttccgtctcctgtatgacaccaagggtcgcttccgtctccactcaatcaaggatgaagaagctaagttcaagctctgcaaggttagaaatgtacactttggatctaagggtatcccatacattaacacctttgatggtcgcaccattcgttaccctgaccctcttatcaaggctaatgacaccatcaagctagatcttgagagcaacaagattgtcgattttatcaagtttgatattggtaatgtcgtcatggttactggaggtagaaacagaggccgtgttggtgttatcaagaacagagagaagcataagggaagtttcgatacccttcacatccaggactctacaggccatgagttcgccacccgtttggccaatgtgttcaccattgggaaaggtaccaagccatgggtttcactccccaagggcaagggtatcaagttgactattattgaagaggctaggaaaaggttggctgctcaaggagctgccacagcttaggtgctgccatcatgacctgttttgcagtttggaaataactcttggcttaaaagaacaactgctgttttagtttaactttcagaacaaaattttgaagctgctttttgtttagcttttccaacattactaggatattattataagcttaatctatcta

SEQ ID NO: 4485 - DNA, 818 bp, Papaver somniferum
ggcttaatgccccaaaacattggatgcttgataaacttggaggcgcatttgctcccaagccatcatcaggtccacacaaatctagggaatgccttcctttgattcttatcctgcgaaacagattgaaatatgcccttacataccgtgaggttattgctattttgatgcaaaggcacattcttgttgatggaaaagtgcgaacagacaagacctatccatctggattcatggatgttgtttcgattcccaagacgaacgagaacttccgtctcctgtatgacaccaagggtcgcttccgtctccactcaatcaaggatgaagaagctaagttcaagctctgcaaggttagaaatgtacacttcggatctaagggtatcccatacattaacacctttgatggtcgcaccattcgttaccctgaccctcttatcaaggctaatgacaccatcaagctagatcttgagagcaacaagattgtcgattttatcaagtttgatattggtaatgtcgtcatggttactggaggtagaaacagaggccgtgttggtgttatcaagaacagagaaaagcataagggaagtttcgatacccttcacatccaggactctacaggccatgagttcgccacccgtttggccaatgtgttcaccattgggaaaggtaccaagccatgggtttcactccccaagggcaagggtatcaagttgactatcattgaagaagcaagaaagagacttgccgctcaaggagctgcaaccgcctaagctcatcgaaggtgtcggctagcatgaggttctgttttgtggcctgttaaacaa

SEQ ID NO: 4486 - DNA, 784 bp, Papaver somniferum
ggcttaatgcccctaaacattggatgcttgataaattgggcggtgcttttgcccctaagccatcatctggaccacacaagtctagggaatgccttcccttgattcttatcctgcgaaacagattgaagtatgcccttacataccgtgaagttattgctattttgatgcaaaggcacattcttgttgatgggaaagtgcgaacagacaagacctatccatctggattcatggatgttgtgtcgattcccaagacgaacgagaacttccgtctcctgtatgacaccaagggtcgcttccgtctccactccatcaaggatgaagaggctaagttcaagctctgcaaagttagaaatgtacactttggatctaagggtattccatacattaacaccttcgacggtcgcaccatccgttaccctgaccctcttatcaaggctaatgacaccatcaagctagatcttgagagcaataagattgttgattttattaagttcgatattggtaatgtcgtcatggttactggaggtagaaacagaggccgtgttggtgtaatcaagaacagagagaagcataagggaagtttcgatacccttcacatccaggattctactggccatgagttcgccacccgtttggccaatgttttcaccattgggaaaggtaccaagccatgggtttcactccccaagggcaagggtatcaaattgactattatcgaagaggctaggaaaaggttggccgctcaaggagctgccacagcttaggtgcttccatcatgacctgg

SEQ ID NO: 4487 - DNA, 826 bp, Papaver somniferum
ggcttaatgccccaaaacattggatgcttgataaacttggaggcgcatttgctcccaagccatcatcaggtccacacaaatctagggaatgccttcctttgattcttatcctgcgaaacagattgaaatatgcccttacataccgtgaggttattgctattttgatgcaaaggcacattcttgttgatggaaagtgcgaacagacaagacctatccatctggattcatggatgttgtttcgattcccaagacgaacgagaacttccgtctcctgtatgacaccaagggtcgcttccgtctccactcaatcaaggatgaagaagctaagttcaagctctgcaaggttagaaatgtacactttggatctaagggtatcccatacattaacacctttgatggtcgcaccattcgttaccctgaccctcttatcaaggctaatgacaccatcaagctagatctcgagagcaacaagattgtcgattttatcaagttcgacattggtaatgtcgtcatggttactggaggtagaaacagaggccgtgttggtgttatcaagaacagagaaaagcataagggaagtttcgatacccttcacatccaggactctacaggccatgagttcgccacccgtttggcgaatgtgttcaccattgggaaaggtaccaagccatgggtttcactccccaagggcaagggtatcaagttgactatcattgaagaagcaagaaagagacttgccgctcaaggagctgcaaccgcttaagctcatcgttcaggtgttcatgaggttctgttttgcggctgtttacaattgcttgttttagtt

SEQ ID NO: 4488 - DNA, 1002 bp, Citrullus lanatus
tgaaattaatgcctatggctatgacaggcgagaggactgaagaaacatttgaagaggctcaatgctccaaagcattggatgcttgataaacttggtggtgcatttgcccccaaaccttcatctggacctcataagtcgagggaatgcctccctttgatccttatattgaggaaccgactgaaatatgctctcacatatcgtgaggtaattgcaattttaatgcaaagacatgttttggtcgatgggaaggtcaggacagacaagactttccctgctggtttcatggacgtcgtgtcaattcccaagacaaatgagaatttccggcttctttatgacacaaaaggtcgattccgtctacactcagttagggatgaagaggctaagtataagctgtgcaaagttcgctcggtgcagttcgggcaaaagggtatcccttatctgaacacttacgacggacgcacaatccggtatcctgaccctctgatcaaggcgaatgacaccatcaagctagacctcgagtccaacaagattgctgatttcatcaagtttgatgtaggaaatgttgtgatggtgactggtggaagaaacaggggcagggttggagtgataaagaacagggagaagcataagggaagctttgaaacaatccacattcaggatgcaaccgggcacgaatttgcgactcgtcttggcaatgtgttcacaattggcaaggggactaagccatgggtgtccctacccaagggtaagggtattaaattatccatcattgaagaggccaggaagaggctagcaagccaagccgcagttaccgcttaagacttaaatgtagtgtagtcatgatgaaaggtgggattttgctcttagttttatattttggtcaactagatctctcctcgaaaagattgatactttgttttttctactagaattgtgtgaggctactgccctgattttgtcattccaaaactttttgctacaatggactaacttttttggaaa

SEQ ID NO: 4489 - DNA, 1357 bp, Pinus pinaster
gggttaagtttagaggtaaaagcgcaactagggtttggtaaagggtatagggtttcaaagagttaagcccgtgtttgaaccctcaagatccttgattggctgggttcattgatttctgctcctcctactgaatcgatcgtagaggtctttgcctctgtaatttgatttgcagaaggtgcctggcagggtttaaggatttctcattctcctcttcttgagccgatcgtagagacatcatggctcgtggattgaagaaacatttaaagaggctcaatgcacctaggcattggatgcttgacaaactcggtggtgcttttgcaccaaaaccatctcctggtcctcacaaggggagggaatgccttcctcttgttgttcttcttaggaataggctgaagtatgctctcacataccgtgaagtcatagccattgtaatgcaaaggcttatatctgttgatggaaaagtcaggacagacaaatgctatcccgcagggtttatggatgtcctgtcaattgcaaaaacaaatgagaattttaggcttctttatgatgcaaagggtcgtttccgcttgcattcaatcaaggatgaagaagcaaagtataaactttgcaaggttcgttctgtacaatttggagataagggtatcccttacctcaatacttatgatggacgcacaattaggtacccagacccattgatcaaggccaatgatacaattaagcttgacctagagacgggcaagatcatggagttcataaagtttgatgttggtaatgttataatggttactggaggccgcaatagaggtcgtgttggagtcattaagcacagagaaaagcacaagggtagctttgagattattcacgtgcaagatgccgctgggcaggaattcgcgacccgtcagggtaatgtgttcacaattggaaagggcacaaagccatgggtttccttacccaagggtaagggtgtcaagttgtccatcattgaagaggccaggaaacgccatgcagctggaactgctgcagcataaattttgttcattggaaaactcgatggttttgatagtcagaatttgttagcctagtaaatactgtcattattagagaagattagaaggttgggaaaacttggtagctatcgttgatttatggctggaaatcaatgtagaagctaagtctaatcggtccaaatctagcactaatattagaaggtaggccttgaatcatatcggaagtccgaagtgttactcttgccagagaatattaaagtataaaagtctttataatttaggtcttgaatgatattgaagtgcaaagtgttatttttacctaaaattttaagtgcggaagagccttatat

SEQ ID NO: 4490 - DNA, 1448 bp, Pinus taeda
cggccggggaatcccgtttattttctagcaaacgaaatacgtagagagcttagttgtctagccgcaacaaagggaagggttaagtttagaggtaaaagcgcaactagggtttggtagagggtatagggtttcaaagagttaagcccgtctttggaccctcaagatcttcgattggctgggttcaatgatttctcctcctcctactgaatcgatcgtagaggtcttcgcctctgtaatttgatttgcaaaggtgcctggcagggtttaaggatttctcattctcctcttcttgagccgatcgtagagacatcatggctcgtggattgaagaaacatttaaagaggctgaatgcacctaggcattggatgcttgacaaactcggtggtgcttttgcaccaaaaccatcccctggtcctcacaaggggagggaatgccttcctcttgttgttcttcttaggaataggctgaagtatgctctcacataccgtgaagtcatagccattgtaatgcaaaggcttatatctgttgatggaaaagtcaggacagacaaatgctatcccgcagggtttatggatgtcctgtcaattgcaaaaacaaatgagaattttaggcttctttatgatgcaaagggtcgtttccgcttgcattcaatcaaggatgaagaagcaaagtataaactttgcaaggttcgttctgtacaatttggagataagggtatcccttacctcaatacttatgatggacgcacaattaggtacccagacccattgatcaaggccaatgatacaatcaagctggacctagagacgggcaagatcatggagttcataaagtttgatgttggtaatgttataatggttactggaggccgcaatagaggtcgtgttggagtcattaagcacagagaaaagcacaagggtagctttgagattattcacgtgcaagatgctgctgggcaggaatttgcgacccgtcagggtaatgtgttcacaattggaaagggcacaaagccatgggtttccttacccaagggtaagggtgtcaagttgtccatcattgaagaggccaggaaacgccatgcagctggaactgctgcagcgtaaattttgttcattggaaaactcgatggttttgatagtcagaatttgttagcctagtaaatactgtcattattagagaagattagaaggttgggaaaacttggtagctatcgttgatttatgtctggaaatcaatgtagaagctaagtctaatcggtccaaatctagcactaatattagaaggtaggccttgaatcatatcggaagtccgaagtgttattcttgccagagaattttaaagtataaaaagtctttataatttaggtcttgaatgatattgaagtgcaaagtgttacttttaccaaaattttaagtgcggaaagagcctttatataattaagcaattac

SEQ ID NO: 4491 - DNA, 959 bp, Platanus occidentalis
cttcataggctgaagaagcagcggaggcgtagttcgtcgagggtcgaagcgcggagccggcagatttccaggcgaagagcgcaaacatggctcgagggttgaagaaacatttgaagaggctcaatgctccgaagcattggatgctagacaaacttgggggtgcatttgctcccaagccatcatctgggcctcacaaatccagggaatgtctgccgttgatcctaatcctacgaaacaggttgaagtatgctctcacttaccgtgaggtcattgccatattgatgcaacgacatgttcttgttgatgggaaggttaggactgataagacgtatcctgctggcttcatggatgttgtatcaattcctaaaacaaatgagaacttccgtcttctttatgacaccaagggtcgcttccgtctccactcaattaaggatgaagaggccaagtttaagctgtgcaaggtccggtctgtgcaatttgggcagaaaggcattccatacatcaacacctatgatggtcggacaatccgctacccagacccgctcattaaggccaatgacaccatcaagcttgacctcgagagcaacaagatcattgacttcattaagtttgatgttggaaatgttgtcatggtgactgggggaaggaacaggggtcgtgttggagtcatcaagaacagagagaagcacaaggggagctttgagaccatccacgtccaggatgcaactggccatgagtttgccactcgtttgggtaatgtctacactattggcaaggggacaaagccatgggtctcccttccaagggcaagggtataaagttgtccataattgaagaggccaggaagaggctcgcagctcaagcagcttccactgcttaatctttatgatgacaacaactctcaggtattattgcagagtttcacaatttactctctatttttcactttttttggcacc

SEQ ID NO: 4492 - DNA, 1474 bp, Picea glauca
gacacatcataaggtgtgttcatcatgtttgaagagcaaaacacagaggttagttgtctagtagcaagaaagggctagggttagagctagaagagcgactagggttcttcaaaacacatagagaggttagttgtctagtagcaagaaagggctagggttagagatacaagagcaactagggtttggtagagcgtatcaaagatttaagctcggagtctcagaatcttcgtttgtcatttgatttgcagaacgcgggtggcagggctcaatagttgctcctcctcttactgaaccgatcgtagaggtcttcgcttgtgtcattttatttgcagaagccgatctctcatcctcctcttactgagccgatcgtagaggcgcaatggctcgtggattgaagaaacatttaaagaggctcaatgctcctaggcattggatgcttgacaaactcggtggtgcttttgcaccaaaaccatctcctggtcctcacaaggggagggaatgccttcctcttgttgttcttattaggaataggctaaaatatgctctcacataccgtgaagtcatagccatagtaatgcaaagacttatatctgttgatggaaaagtcaggacagacaaatgctatcccgcagggtttatggatgttctgtcaattgcaaaaacgaatgagaattttaggcttctttatgatgcaaagggtcgtttccgcttgcattcaatcaaggatgaagaagcaaagtataaactttgcaaggttcgttctgtacaatttggagataagggtatcccttacctcaacacttatgatggacgcacaattaggtacccagacccattggtcaaggccaatgatacaatcaaggtggacctagagacaggcaagatcaaggagttcatcaaatttgatgttggtaatgttataatggttactggaggccgcaacagaggtcgtgttggagtcattaagcacagagaaaagcacaagggtagctttgagattattcacgtgcaagatgctgctgggcaggaatttgcgacccgacagggtaatgtgttcacaattggaaagggcacaaaaccctgggtttccttacccaagggtaagggtgtcaagttgtccatcattgaagaggccaggaaacgtcatgcagctgcaactgctgcagcataagttttgttcatcggaaaacctcatggttttgatagtcataatttttaaatttgttagcttagtatactgtcattgttattagaagctttgttgggaaaacttagagctactgttgatttatgtctaaacgaaattcatcgaagtagaaaccatcgaaatcatgttggttcaaatcaaacattattattagaattttggccttgaatcatattggacgtccaagtgttatttttaccggaatttaaactatggaaagagcctttatagaagtaagaaattatacctaggttgggagctaaaaaa

SEQ ID NO: 4493 - DNA, 1120 bp, Cajanus cajan
agggtttaaagagacgcactctcgctatttgttttcagtttcggtggtgtcgtagcagcgaagctcggagcttagttcccgactcgaagatggcaagaggattgaagaagcatttgaagaggctcaatgccccaaagcattggatgcttgacaaactgggtggtgcatttgctcctaagccctcatctggtccccacaaatctagggaatgtttgccacttatactcatattgcgaaaccgtctgaagtatgctctgacataccgtgaagtcattgctattctgatgcagcgacatgtccttgttgatggcaaagtcaggacagacaagacatatccttctggtttcatggatgttgtatctatccctaaaacaaatgagaactttcgcctgctgtatgacacaaaaggtcgattccgtctccactcagtcagggatgaggaggctaagttcaagctctgtaaggttcgctcagtgcagttcgggcagaaaggtatcccatacctgaacacctatgatggtcgaactatccgctacccagatcctctcatcagggccaatgataccattaagctagatttggaggaaaacaagattgttgatttcatcaaatttgatgtgggtaatgtagtcatggtgaccggtggaaggaacagagggcgtgttggagtgataaaaaacagggagaggcataagggtagctttgagactatccatgttcaggatgccactgggcatgaatttacaactcgtatgggcaatgtgttcactattggcaagggcacgaaaccatggatatctcttcccaagggtaaggtattaagctatcaatcattgaggaagctaggaaaaggattgctgcccaaaagcaactgctgcttaaacttttaggatatgaatagacttgagtgcttggtatttttgttcaatggttttgtttctaatttatttttctcgagattttatctgttgaattttgtctcttaaatgcactatagaacttttattgtggcggctatattcatgaaggaatctttccattcctggttttgatgtagtttaaatcggataaattacttaagcaagtccactctaaagaaatatcggaataacttctcttg

SEQ ID NO: 4494 - DNA, 1398 bp, Picea glauca
agttgtctagtagcaagaaagggctagggttagagctagaagagcgactagggttcttcaaacacatagagaggttagttgtctagtagcaagaaagggctagggttagagatacaagagcaactagggtttggtagagcgtatcaaagatttaagctcggagtctcagaatcttcgtttgtcatttgatttgcagaacgcgggtggcagggctcaatagttgctcctcctcttactgaaccgatcgtagaggtcttcgcttgtgtcattttatttgcagaagccgatctctcatcctcctcttactgagccgatcgtagaggcgcaatggctcgtggattgaagaaacatttaaagaggctcaatgctcctaggcattggatgcttgacaaactcggtggtgcttttgcaccaaaaccatctcctggtcctcacaaggggagggaatgccttcctcttgttgttcttattaggaataggctaaaatatgctctcacataccgtgaagtcatagccatagtaatgcaaagacttatatctgttgatggaaaagtcaggacagacaaatgctatcccgcagggtttatggatgttctgtcaattgcaaaaacgaatgagaattttaggcttctttatgatgcaaagggtcgtttccgcttgcattcaatcaaggatgaagaagcaaagtataaactttgcaaggttcgttctgtacaatttggagataagggtatcccttacctcaacacttatgatggacgcacaattaggtacccagacccattggtcaaggccaatgatacaatcaaggtggacctagagacaggcaagatcaaggagttcatcaaatttgatgttggtaatgttataatggttactggaggccgcaacagaggtcgtgttggagtcattaagcacagagaaaagcacaagggtagctttgagattattcacgtgcaagatgctgctgggcaggaatttgcgacccgacagggtaatgtgttcacaattggaaagggcacaaaaccctgggttccttacccaagggtaagggtgtcaagttgtccatcattgaagaggccaggaaacgtcatgcagctgcaactgctgcagcataagttttgttcatcggaaaacctcatggttttgatagtcataatttttaaatttgttagcttagtatactgtcattgttattagaagctttgttgggaaaacttagagctactgttgatttatgtctaaacgaaattcatcgaagtagaaaccatcgaaatcatgttggttcaaatcaaacattattattagaattttggccttgaatcatattggacgtccaagtgttatttttaccggaatttaaactatggaaagagcctttatagaagtaagaaatta

SEQ ID NO: 4495 - DNA, 845 bp, Secale cereale
gagcaggcggcggcggtgccgaagaggagaagcacggcgacctagcccgagctcgcaaccatggctaggggtttgaagaagcatctgaagaggctcaatgccccgtctcattggatgcttgacaagcttggtggagcttttgcccccaagccatcatctggtcctcacaaggccagggagtgcctgcctctgatcctcatcctgaggaacagactgaaatatgctctcacctaccgtgaagtgcaatctatccttatgcagcgccatatcatggttgatggaaaggtccgcactgacaagacctaccctgctgggttcatggacatcatttccattcccaagactggtgagaactacaggcttctgtatgacaccaagggccgcttccgccttcactctgtcaaggatgaggatgctaagttcaagctctgcaaggtcaggtctgtccagtttggccagaagggtatcccctacctcaacacctatgatggccgcaccatccgctacccagacccactcatcaaggccaatgacaccatcaagcttgacctggagaccaacaagattgttgacttcatcaagtttgacgtaggcaacgtggtcatggtgactggtgggcgcaacactgggcgtgttggtgtgatcaagaacagggagaagcataagggaacctttgagaccatccacgttgaggatgcccagggccaccagttcgccacccgtctgggcaatgtgttcaccatcggcaagggccaccaagccgtgggtgagcctccccaagggcaagggtatcaagctcaccatcattgaggagcagaggaagcgggatgccgctgcccaggctg

SEQ ID NO: 4496 - DNA, 1009 bp, Cucumis sativus
ataaatgcctatggcgatgacaggcaaggggactgaagaagcatttaaagaggctcaatgctccgaagcattggatgcttgacaagcttggtggtgcatttgcccccaaaccttcatctggacctcacaagtcgagggaatgcctccctttgatccttatattgagaaaccgactcaaatatgccctcacgtaccgtgaggtaattgcaatattaatgcaacgacatgttttggtcgatgggaaggttaggacagacaagactttccctgctggtttcatggacgttgtgtcaattcccaaaacaagtgagaatttccggcttctttatgacacaaaaggccgatttcgtttacactcagttagggatgaggaggccaagtataagctgtgcaaagttcgctccgtacagtttgggcaaaagggcatcccttatctgaacacctatgatggacgcacaatccgttatcctgaccctttaatcaaggcgaatgacaccatcaagctggacctcgagtccaacaagattgcagatttcatcaagttcgatgtaggaaatgttgtgatggttaccggtggaagaaacagaggcagggttggagttataaagaacagggagaagcataagggaagctttgaaacaatccacattcaggatgcaactgggcacgaatttgctactcggctgggcaatgtgttcacagttggcaaggggactaagccatgggtgtccctacctaagggcaagggtattaaattatccatcatcgaagaagccaggaagaggctggcaagccaagccgcagttactgcttgagatttagtgtagtgtagtcattgatgaaaggtgggattttgctcttgttagttttgtttttcttggttttttttttggttaagtagatctaaaaaaggttgatactttgttatttctactacaattatgcaaggctactgctacaatctttgtcattccagaactctttgctataatgaacaaacttttggaaa

SEQ ID NO: 4497 - DNA, 898 bp, Lactuca sativa
gcggggctcgatttagaaatcgtttcgggtgcggcagtgagttgcagagaagtggcgaggagaggagcaggctagccgaaaaattcaaccggagatttagatctcccgcaggacaccgccaccatggctcgaggattaaagaaacacatgaagaggctcaatgcccctaagcattggatgcttgacaaactcggtggtgcttttgctcctaaaccatcatccggaccccacaaatcccgagaatgtctgccattgatcctcatcctccgtaataggctgaaatatgcattgacatatcgtgaggtccaatcaatcttaatgcaaagacatgttcttgttgacaacaaagtcagaactgataaaacttatccagctggattcatggatgttgtttctatccccaaaaccaatgaaaactttcgtcttttgtatgatacaaaaggtcgattcaggcttcattcagtcagagatgaggagtctaagtttaaattgtgcaaggtaagatcagtccaatttgggtcaaagggaattccctacatcaacacatatgatggaagaacaattcgttacccggacccactaatcaaagccaacgacacaatcaagctcgacctcgactcaaacaaaatcgtcgatttcatcaaattcgatgttgggaatgttgtcatggtgacaggtggcagaaacacagggcgtgttggaattcttaagaacagggagaaacataaggggagctttgaaactgttcatattcaagattcaactggacatgaatttgctactcgtttggggaatgtgtttactcttggaaaagggtcaaagccttgggtgtctcttcctaaggggaagggaattaagtgactatcattgaggaggctaggaaaagaagagctgctca

SEQ ID NO: 4498 - DNA, 1128 bp, Pinus pinaster
gtgtttgaaacttcgacgccttcttggtgttattaggtttgcagaaggcgtcgggtggggatcaaggatttctcctccacctcatactgagcggatagcagagacatcatggctcgtggattgaagaaacatttaaagaggctcaatgctcccaggcattggatgcttgacaaacttggtggtgcttttgcaccaaaaccatctcctggtcctcacaagggcagggaatgcctgccgcttgtggttcttcttaggaacaggctgaagtatgccctcacataccgtgaagtcatagccattgtaatgcagagacttatttctgttgatggaaaagtgaggacagacaaatgctatcctgcagggtttatggatgtcctgtcgattgcaaaaacaaatgagaattttaggcttctttatgatgcaaagggtcgtttccgcttgcattcaatcaaagatgaagaagcaaagtataaactttgcaaggttcgttctgtacaatttggagataagggtatcccttacctcaacacttatgatggacgcacaattaggtacccagatccattggtcaaggccaatgatacaatcaagattgatctagagacaggcaaaatcaaggagtttatcaagtttgatgttggtaatgttgtaatggttactggaggccgtaacagaggtcgtgttggaaccattaagcacagagaaaagcataagggtagctttgagattattcatgtgcaagatgctgctgggcaggaatttgccacccgacagggtaatgtgttcactattggaaaaggcacaaagccttgggtttctttacccaagggtaaaggtgtcaagctgtccatcattgatgaggccaggaaacgcaatgcagctgcaactgctgcagcataagttttgttcattagaaaactcgatagtttttatggtcagaatttgttagtttactctgactattatcggaaactttgttgggaaaacttaggagctaccatcgttttacttctgaacgaaaagggttttattttgccatttttaagtgcagctttgaggttctactgctatctaaatattttatttttgacatcaattttccagaccagattaaatgcaatgcagtat

SEQ ID NO: 4499 - DNA, 793 bp, Orobanche aegyptiaca
ccctcacttcaacagtcgagcgagaaacgcagagagggaggcgccgccgtatacaccatctatcagcaaaatggcgagaggattgaagaaacatttgaagaggctcaatgcccccaagcattggatgttggacaagcttggtggtgcctttgcccccaaaccttcatctggaccacacaagtccagggaatgcttgcccttaattctaattctgcgaaacagattgaaatatgctctaacttaccgtgaggtcatctctattctgatgcaacgacacatccttgttgacggcaaggtcaggactgacaagacatatcctgctggtttcatggatgtggtctctattccaaagaccaatgagaacttccgtcttctttatgacaccaagggccgattccgtcttcattctgtcagggatgaggaagccaagttcaagttatgcaaggtccgtcaagttcagtttggcaataaaggtattccttacgtcaacacctacgacggaaggaccatccgctatccggacccgttgatcaaggcgaacgacactatcaagctcgatctagagaacaacaagattgttgattttatcaaattcgatgtgggaaatgttgtcatggtgactggtggtcgtaacaggggtcgtgtaggtgtgctcaagaatcgtgagaagcataagggaagctttgaaactgtccacattcaggattccactggacacgagtttgctactcgattgggcaatgttttcactatcggaaagggtacaaagccgtgggtgtctcttcccaaggga

SEQ ID NO: 4500 - DNA, 1173 bp, Podocarpus macrophillus
ccagtggtcttttagggttttaaaacttatctttgcttatcgaccagggtttctggcaggggcatttgctggtcaaggttcaatatttactcttcctgctgctgccgtgaaccaagtgcactttcaatatggctcgtggattgaagaaacatttgaagaggctcaatgctcctaagcattggatgcttgacaaacttggtggtgcttttgcacccaagccatcacctggtccacacaagggtagggagtgccttccccttgtggttcttttgaggaacaggctgaaatatgctctcacataccgtgaggtcattgcaattgtaatgcaaagacttatttcagttgatggaaaagttaggacagataaatgttaccccgcagggttcatggatgtcgtatctatttcaaaaaccaatgagaactttaggcttctttatgatgccaagggtcgcttccgtctacattcaatcaaggatgaggaagcaaagtataagctctgcaaagttcgtggagttcagtttggggataaggctatcccttacctgaacacatatgatgggcgtaccatcaggtatccagatccattgatcaaggccaatgatacagtcaagattgatcttgagacgggtaagataaaagattttatcaagtttgatgtcggtaatgttgttatggttactggaggacgcaacagaggtcgtgttggagtaattaagaacagggaaaaacataagggaagctttgagattattcatgtccaagatgctgctggacaagaatttgctactcgacaaggtaatgtgttcacaattgggaagggcacaaagccttggatatctttaccaaagggcaaaggtgttaagctgtccatcattgaagaggccaggaaacgccatgcagctggaacaactgcagcttaattttgttacctggataatctagttatccgtctagttgtttgatattttgactgttttagccagtagtattttttgatccggataaaaggcacctagaatgtagtgtagttttatatttaaacttcaattgctggtggtttatagttttcagaagtgttttggtccgacttttactgaatactggtacttttattttaaattttattgacattggcttgcattagcggttaagtgttttttaacagaatatttt

SEQ ID NO: 4501 - DNA, 1247 bp, Podocarpus macrophillus
ggtttttggagtttgctggaaattgcagagagcacacgaccaaacaccgttgtgagcagagaggactccttccttcaagatggctcgtggattgaagaaacatttgaagagactcaatgcgcctaagcattggatgcttgacaaactcggtggtgcttttgcaccaaagccgtcacctggtcctcacaaggggagggaatgcctgcctcttgtggtccttctgaggaacaggctgaaatacgctcttacatatcgtgaggtcattgccattgtaatgcaaagacttatttgtgttgatggaaaagtaaggactgacaaatgctaccctgcaggtttcatggatgttgtatctattgcaaaaaccaatgagaattttaggcttctttacgatgccaagggtcgcttccgcttacattcgatcaaggatgaggaagcaaagtataagctttgtaaagttcgaggagttcagtttggggacaaggctatcccttacctaaacacgtatgatggacgcactattagatatccagatccattgatcaaggcgaatgatacagtcaagattgatcttgagacaggcaagataaaggatttcattaagtttgatgttggtaatgttgttatggtcactggtggccgtaacagaggtcgtgttggagtgatcaagaacagagaaaagcataagggtagctttgagattattcatgtccaggatgctgctggacaagaatttgcaactcgacaaggtaatgtgttcacaatcggaaagggcacaaagccttggatatctttaccaaagggcaaaggtgtcaagttgtccatcattgaagaggccaggaaacgccgtacagtaggaactgctgcagcttaatttttctgactggaaaatgttaattgtatgaattgaactttggttgtggagatcattttttactttatattgacaaaaaagaggaggaaaagacatctagaatctagtctagatttagatttcaacttaacaaatagaggttatctatagcattcacaagatgcctcaagattcagtacccgaaattcagttagaaggtttttttgacattggcttttctttccacagtttacatcctttctaaagtgtttgctaagattcaaaacatgttttgacttctatcgcaaggttgtgggaggaggaggttttcatttatgctggttgaatttgttctcatgtatttattcaaatgctatgatttggagtgcacaaatgc

SEQ ID NO: 4502 - DNA, 1227 bp, Taxus baccata
gctagggttttgcttgagggttgtaaaggagtttattagggtttggtttcgaagattgaaacttctcattcattttttaagtgggaaggcaaggggagctgcgcagcacagtcaagcgaagaagtgcagcgaaatggctcgtggattgaagaaacatttaaagaggctcaatgctcctaagcattggatgcttgacaaactaggtggcgcttttgcaccaaaaccatcagctggtcctcacaaggggagggaatgccttcctcttgtggttcttctgaggaacagactaaagtatgcccttacataccgtgaagtcattgctattgtaatgcaacgacttattgctgttgatggaaaagtcaggactgataaatgctaccctgcagggttcatggatgttgtgtctattgcgaagactaacgaaaactttaggcttctctatgatgctaaaggtcgtttccgcttgcatacaatcaaggatgaggaagcaaagtataagctttgcaaggttcgcggagttaagtttggagataagggcatcccttatctcaacacttatgatgggcgtaccattaggtacccagatccattgatcaaagcaaatgataccatcaagattgatattgaaactggcaagatcaaggaatttatcaagtttgatgttggtaatgttgtcatggttactggaggccgtaacagaggtcgtgttggagtgattaagaacagggaaaagcacaagggtagctttgagattattcatgtccaggattctgctgggcaggaatttgcaacaagacagggcaatgtgttcaccattgggaaaggcactaagccttggatatccctaccgaagggcaaaggtgtcaagctttctatcattgaagaggccagaaaacgtcatgcagctggaactcctgcagcttaagtttttgacctggaaaatattattgtttttcatagtaaaacctttagtatgacatctagaatgttttatatttcagcttcaaggattgtggtgggtattaactcctaaaagagtttttctttgaaggcctgtaatggaaatcttagtcattttaatcttttttgacattccactagcagtacaaatctgttaaaacatttattttcttgtttagatttaaaaaggtatggcttttgctagggaggatgtatgaggagtgtttgaattttgttgattgaaatatcaatcaagatgatgtttac

SEQ ID NO: 4503 - DNA, 1133 bp, Zamia vazquezii
  misc_feature (564)..(564): n is a, c, g, or t
cgttggagcgtgtagattccaaccatggctcgtggattgaagaagcatttaaagagacttaatgctcctaagcattggatgcttgacaaactcggcggtgcttttgctccaaagccatctcctggtcctcacaaagggagggaatgccttccccttgtggttcttctaagaaacaggctgaaatatgctcttacataccgtgaggtcattgctattgtaatgcaacgacttatatgtgttgatggaaaagttcggacagataaatgctaccctgctgggttcatggatgttgtctctattgctaaaaccaatgagaattttaggctgctttatgacactaaaggacgtttccgtttgcattcaatcaaggaggaggaagcaaagtttaagctttgtaaagttcgctcagctcggtttggagataagggtattcctttcatcaacacatatgatggtcgaaccatcaggtatccagatccattgatcaaggccaatgataccatcaagattgacctggagactggcaaagtaaaagatttcatcaagtttgatgttggtaatgtngttatggttactggaggccgtaacagaggccgggttggtgtgattaagcacagggaaaagcacaagggcagctttgagattattcatgtgcaggatgctgcggggcaggaatttgctactcgccagggtaatgtgttcacaattgggaaaggcacaaagccatgggtgtctttaccaaaaggtaagggtgtcaagttgtccattattgaagaggctaagaaacgccatgctgcagcaactgctgcagcgtaaattttgatccttaaaaagcatagttctgttttccatacaagcagtatggtaatcaagtatgctctgattattgttacaagctgcacccatggatgctgagtcaggattgggtagctttatctggaactttggaggtctccattgtggtagtgtttgattttgaaaaatagcttagttggagaaattagggcaatttaattttaacttttttgggttaagttttcagcttatacactggaattcaaatttatcatttttccttttgatgatattatttctactgacacttaatgtgatgctcataatgtgccggtagc

SEQ ID NO: 4504 - DNA, 862 bp, Brassica napus
gctctctcacaacttcactagtcgtctgaatcggagcaacgcttgcaaactccaatcatggcgagaggtttgaagaagcatttgaagaggctcaatgcccctaagcattggatgcttgacaaactcggtggtgcttttgcccccaagccatcttctggaccccacaagtcgagggagtgccttcccctcgttcttatcatcaggaacaggttgaagtacgctctcacctaccgtgaagtcatctccatcttgatgcaaaggcacatccaggttgatggcaaagtcaggactgacaagacctaccctgctggtttcatggatgttgtctctatccccaagactaacgagaacttccgtcttctctatgacaccaagggacgtttccgtctccactccatcagagatgaggaagccaagtttaagctttgcaaggttcgaactatccaggtgggacagaagggcattccttacctcaacacatacgatggtcgcaccatccgttaccctgacccactcatcaagcctaatgacaccatcaagctcgacctggaggagaacaagattgtggactccatcaagtttgatgtcggcaatgttgtgatggtgactggaggaagaaacagagggcgtgttggtgtgattaagaaccgtgagaagcataagggaagcttcgagacaatccacatccaagactctacaggacatgagtttgcaacacggttgggaaatgtcttcaccctcggcaaaggaactaagccctgggtttctcttcctaagggtaaggtattaagctcaccatcatcgaggaagccaggaagaggctctctgggcaacaagctgcttaagttttcgactttcagct

SEQ ID NO: 4505 - DNA, 1119 bp, Manihot esculenta
tttttttttaatgtatataacaggcaagaggcttgaagaaacacttgaagaggcttaatgccccaaaacattggatgcttgacaagcttagcggtgcatttgccccaaagccatcatctggacctcacaagtcaagggaatgtttgcctttgatccttattttgcggaataggctgaagtatgccctcacatatcgtgaagttatttctattctgatgcagcggcatgttcttgttgatgggaaagttaggacagataaaacataccctgttggtttcatggatgttgtgtcgataccaaagacaaatgagaacttccgtctcctttatgacactaagggccgtttccgtctccactccattagagatgatgaggcaaagtttaagttgtgcaaagtccgatctgttcagtttggacagaaggggatcccatacctgaacacctatgatggacgcactattcgctacccagatccacttatcaaggctaatgataccatcaagttagacctagaaagcaacaagatcactgagttcataaagtttgatgtgggaaatgttgtcatggtcacaggaggcagaaacagggggcgagttggaatcatcaagaacagagagaagcataagggaagttttgaaactatccacattcaagacgctactggtcatgagtttgctactcgcctgggcaatgtgtttacaattggaaaagggactaaaccatgggtgtctctccccaagggcaagggtatcaaattgtcaatcattgaagagtcccggaagaggcttgctgcagctcaaactgttgcatagaaatttttggaaatttgtctgcgttgctgaagcttactggtgttggcttttattgtgtcagtcgttgttttgtttagctaaaacagtattagagctttatttttatcatctatgggcataaatttgaactatatttgtttttgaatgtcagtttggctttttactggtgaaatagtttcatgactttgggtggtttcatgcatgtaagctaccatggcaaccttcagcttgttggtctgatgggcagatgggattttggatgggattcttacaattactatttcataattcataactactcttgcag

SEQ ID NO: 4506 - DNA, 1113 bp, Cycas rumphii
  misc_feature (756)..(756): n is a, c, g, or t
  misc_feature (826)..(826): n is a, c, g, or t
  misc_feature (848)..(848): n is a, c, g, or t
  misc_feature (855)..(857): n is a, c, g, or t
  misc_feature (859)..(859): n is a, c, g, or t
  misc_feature (864)..(865): n is a, c, g, or t
  misc_feature (873)..(874): n is a, c, g, or t
  misc_feature (882)..(883): n is a, c, g, or t
  misc_feature (887)..(887): n is a, c, g, or t
  misc_feature (899)..(899): n is a, c, g, or t
  misc_feature (904)..(905): n is a, c, g, or t
  misc_feature (916)..(916): n is a, c, g, or t
  misc_feature (925)..(925): n is a, c, g, or t
  misc_feature (927)..(927): n is a, c, g, or t
  misc_feature (929)..(929): n is a, c, g, or t
  misc_feature (934)..(934): n is a, c, g, or t
  misc_feature (939)..(939): n is a, c, g, or t
  misc_feature (949)..(949): n is a, c, g, or t
  misc_feature (970)..(970): n is a, c, g, or t
  misc_feature (972)..(972): n is a, c, g, or t
  misc_feature (975)..(976): n is a, c, g, or t
  misc_feature (1060)..(1060): n is a, c, g, or t
ggtatcgtcgacaggcatcggaacgtcgagctttcaataatggcgcgcggattgaagaaacatttgaagagactcaatgctcctaagcattggatgctcgataaacttggtggtgcttttgcaccgaaaccatctccaggtccccacaaagggagggaatgccttcctctcgtggttcttttgagaaacaggcttaaatatgctctcacgtatcgtgaagtcattgccattgtaatgcaacggcttatatgcgttgatggaaaagttcggacagataaatgctaccctgcagggttcatggacgttgtctccattgctaaaaccaacgagaattttaggcttctttatgacaccaagggccgttttcgtttgcattcaattaaggatgaggaagcgaagtttaaactttgcaaagttcgtgcagctcagtttggagataagggcatcccttacatcaacacttacgatggccgcaccatcaggtatccagatccattgatcaaggccaatgataccatcaagattgacctagaaaccggcaaagtaaaagagttcatcaagtttgatgttggtaatgttgttatggttactgggggccgtaacagaggccgtgttggtgtgattaagcacagggaaaagcataagggtagttttgagattattcatgtgcaggatgctgcagggcaggaatttgcaacccgtcagggtaatgtgttcacaattgggaaaggcacaaagccatgggtatctctaccnaaagggaagggtgttaagctgtccattattgaagaggctaggaagcgccatgctgcaggaactcctgcancataaattttggtaccttgaanacataannnanttttnnatacaagnnatatggtnnctgngtatgtttgacnattgnnagaaactgcantaggggcangntnttcangattntgtagttttntgtgaaacttcatttattgcngnagnntttggttttcaaaaccagcttttagtctgagaaagcgggtgaatttgattttaactttatttgccgaagttctcaactcatacntttcgctcaatttctgggttttaccttttgatagaagtatttttatggaccca

SEQ ID NO: 4507 - DNA, 1092 bp, Gnetum gnemon
acagcagcagcagaagcacaacggagatatggcccgtggactgaagaaacatctgaagaggcttaatgcacctaggcactggatgctggacaaacttggtggtgcttttgcaccaaaaccttctcctggacctcacaagggtagggaatgccttccccttgtagttcttctgagaaacagattgaaatatgctctaacataccgtgaagttattgcaattgtcatgcaaagacttatagcagttgatgggaaaattagaacagacaaatgttatccagcaggcttcatggatgttgtgtccattgctaagacaaatgaaaactttcggcttttgtacgacgctaagggacgcttccgtttgcactccatcaaagatgaagaagcaaagttcaaactctgcaaagtgcggactgttcagtttggtgataagggcattccttatctaagcacctttgatggacgtacaattaggtaccctgatccactgattaaagccaatgacacgatcaaaatagatttggagaccggaaagataatagattttattaagtttgatgttggtaatgtggtgatggtcactggtggacgcaacagaggtcgtgttggagtaatcaagaatagagaaaagcacaagggtagctttgagatcattcatattcaagatgctgctggccatgaatttgctacccgacaagggaatgtatttaccattggaaagggtaccaggccatgggttgctctgcccaagggcagaggaattaagttatcaattattgaagaggcaagaaagcgtcatgcagctgaagctgcctaagttttgctcgagaggtggtgttctaggaagttttgtttgtgctaccgtttttgaagcaagaagatttagttagagactgcttctttcagttttacgggatccaacttctggccgaaacagcagatttaaaatattgcacgagtttaataagtaatttgaattttgtttgatatgaatttcggtttttctgctcgaaaagtattgcatcaagagtatgtcacgtgttaaattggaaagcatactttgttttaaataatacagtaaagcctcatcttctt

SEQ ID NO: 4508 - DNA, 775 bp, Glycyrrhiza uralensis
gcactggagttttgccctaactctgcagcgcttgtttgcttcgcatatccaacatggctagaggattgaagaagcatttgaagaggctcaatgccccgaagcattggatgcttgacaaactgggtggtgcatttgctcctaagccctcttctggaccacacaagtctagggaatgcctcccactcattctcatattgcgaaacaggctgaagtatgctctgacataccgtgaagtcattgctattctgatgcagcgccatgtccttgttgataacaaagtcaggacagacaagacatatccagctggattcatggatgttgtgtcaattcccaagacaaatgagaactttcgcctgctttatgacactaaaggtcgattccgtctccactcagtcagggatgaggaggcaaagttcaagctctgcaaggttcgatcagtgcaatttgggcaaaagggtatcccatatctgaacacctatgatggtcgcactatccgctacccggaccctgtcatcagggcaaatgacaccattaagctggatcttgaggaaaacaagattgttgatttcatcaagtttgatgtcgggaacgtagttatggtgacaggtggaaggaacaggggacgagttggagtgattaagagcagggagaagcacaagggaagctttgagacaatccatgttcaggatgccactgggcacgaattcgcaactcgtttgggtaatgtgttcaccattggcaagggtacaaaaccatggatatctcttccaaaggg

SEQ ID NO: 4509 - DNA, 858 bp, Saccharum officinarum
gcggcggcggcggagcggaaggcgaaggaggaggaggagcagcagcagcagcagcaggcggcgccgaggagcggcttcccaccccgagcttgcaaccatggctaggggactgaagaagcacttgaagaggctcaatgcgcccaagcattggatgctggacaagcttggcggagcttttgctcccaagccatcgtctggtcctcacaagtcaagagagtgcctgcctctgatcctcatcatcaggaacaggctcaagtatgctctgacataccgtgaggtcatttctatcctgatgcaacgccatgtacttgttgatggcaaggtcaggactgacaagacctaccctgctgggttcatggatgtcatttccatccctaagaccaatgaaaactacaggcttctgtatgacaccaagggccgcttccgtcttcacccaatcagggatgaggatgctaagttcaagctctgcaaggttaggtctgttcagtttggccagaagggcatcccctacctgaacaccaatgacggccgcaccatccgctaccctgacccgctcatcaaggccaatgacaccatcaagatcgatctggagaccaacaagattgtggacttcatcaagttcgatgttggcaatgtcgtcatggtgactggtggaaggaacactgggcgtgttggtgttatcaagaacagggagaagcataagggcagctttgagaccatccatgtcgaggactccctgggccccagtttgccacccgtatgggcaactgttcaccatcggaaagggcaacaagccgtgggtgagcctgcccaaaggcaggggtataaagctgagcatcattgaagagcaaaagaagc

SEQ ID NO: 4510 - DNA, 879 bp, Taraxacum officinale
gagagagcgctgcataggaccgctgcagtttcgtcgtatgattattccggagattattatctcctactacacacgccgcaaccatggaatcgaggtttgaagaagctcatgaagaggcccaatgccccccagcattgcatgctcgataaactcggtggtgcttttgcaccccagccgtcatcaggaccacacaaatcccgcgatatacctacccttgatcctcattctccgtaacaggctcaagtacgccttaacctaccgtgaggtccaatccatcctaatgcaacgccatgttcttgttgacaacaaggtcagaaccgacaagacctacccagctggtttcatggatgttgtctccatccccaaaaccaatgaatacttccgtcttctatacgacaccaaaggtagattcagattgcactcagtcagagatgaagagtcaaagtttaagttatgcaaggttcgatcagtccaatttggacaaaaggggattccatacatcaacacatatgatgggcgaacaatccgttatccggacccactaatcaaagccaatgacacgatcaagcttgatttggacacgaacaagatcgtggatttcatcaagtttgatgttgggaatgtggtgatggtgacaggtggcaggaacacggggcgtgttgggatccttaagaaccgtgaaaaacataaggggagttttgagacggttcatattcaggattcaacgggtcatgagtttgcgacccggttggggaacgtgtttacggttgggaaggggagtaagccgtgggtgtcgctgccaaagggaaggggattaagtgactattattgaggaggctaggaaagagcaggctgccctagctgcccaagttgcttgat

SEQ ID NO: 4511 - DNA, 969 bp, Centaurea maculosa
  misc_feature (37)..(37): n is a, c, g, or t
  misc_feature (54)..(54): n is a, c, g, or t
  misc_feature (79)..(79): n is a, c, g, or t
  misc_feature (94)..(94): n is a, c, g, or t
  misc_feature (98)..(98): n is a, c, g, or t
  misc_feature (259)..(259): n is a, c, g, or t
  misc_feature (319)..(319): n is a, c, g, or t
  misc_feature (451)..(451): n is a, c, g, or t
  misc_feature (460)..(460): n is a, c, g, or t
  misc_feature (508)..(508): n is a, c, g, or t
  misc_feature (520)..(520): n is a, c, g, or t
  misc_feature (541)..(541): n is a, c, g, or t
  misc_feature (550)..(550): n is a, c, g, or t
  misc_feature (556)..(556): n is a, c, g, or t
  misc_feature (595)..(595): n is a, c, g, or t
  misc_feature (601)..(601): n is a, c, g, or t
  misc_feature (622)..(622): n is a, c, g, or t
  misc_feature (628)..(628): n is a, c, g, or t
  misc_feature (631)..(631): n is a, c, g, or t
  misc_feature (640)..(640): n is a, c, g, or t
  misc_feature (661)..(661): n is a, c, g, or t
  misc_feature (664)..(664): n is a, c, g, or t
  misc_feature (694)..(694): n is a, c, g, or t
  misc_feature (727)..(727): n is a, c, g, or t
  misc_feature (778)..(778): n is a, c, g, or t
  misc_feature (825)..(825): n is a, c, g, or t
  misc_feature (828)..(828): n is a, c, g, or t
  misc_feature (843)..(843): n is a, c, g, or t
gggcattgagaggctcaatgcgcctaagcattggatncttgacaaacttggtgntgcttttgctcccaaaccatcctcnggacctcacaagtcnaggnaatgcttgcctttgattcttatcctccgaaataggttgaagtatgcccttacataccgtgaggtgatttctatcttgatgcaaaggcatgttcttgtcgacaacaaggtcaggactgacaagacctacccagctggtttcatggatgttgtttctattccnaagaccaatgagaacttccgtctcctatacgataccaaaggtagattcaggctacattcnatcagggatgaggaggcaaagttcaagctatgcaaggttcgttcagtccagtttggttcaaagggcattccttacatcaacacatacgatggccgaaccatccgttacccagacccactcattaaggccaangataccatnaagcttgatttggattcaaacaagattgttgatttcatcaagtttgangtgggaaatgtngttatggttactggtggacgnaacactggncgtgtnggaattctaaagaacagggaaaagcataagggcagtttngagacngttcacattcaggatgctacnggccangantttgccacncgtttggggaacgtgttcacngtnggaaagggtacaaagccgtgggtgtctctncccaagggtaagggtatcaagttaaccatcatngaggaggctaggaagagacgggctggccaagaccctgttgcctagatcctntgattttggtgttttgtttcttgcaggttcgtgggaagttttctttnttntgctttttgtatggnacaattttaaacctatgttttgatgctgcaagttatgttaaactattgtttagtaatttgattacaaaatggttaagcttttgttttaatgcattaagcatccttcctttgtgtggtctgctgctt

SEQ ID NO: 4512 - DNA, 792 bp, Parthenium argentatum
cggctgttacttgtagaagaacttcaccggagattcacatctcccacccaacactgcaaccatggctagaggtttaaagaagcatatgaagaggctcaatgccccgaagcattggatgcttgacaaacttggtggtgcttttgctcctaagccatcatccgggccacacaagtctagggaatgtttgccgctcatcctcattttgaggaacaggttgaagtatgctttgacttaccgtgaggtgcaatctattttgatgcagcgtcatgttcttgttgacaacaaggtcaggactgacaagacttaccctgctggtttcatggatgttgtttctatccctaagaccaatgaaagcttccgtcttctttatgatactaaaggtagattcaggttgcactcaatcagagacgaggagtcaaagtttaagttgtgcaaggttcgttcagttcagtttggatcaaagggcattccatacatcaacacttatgatggtcgaaccatccgctacccagacccactcattaaagccaacgacaccattaagcttgatctagattcaaacaagatcgttgactttatcaagtttgacgtgggaaatgttgttatggtgactggtggaagaaacacaggccgggttggaatccttaagaacagggaaaagcataagggcagctttgaaaccgttcacattcaagatgctacgggacacgagtttgctactcgtttgggtaacgtgtttaccattggaaagggttccaaaccttgggtgtctctccccaagggcaagggtat

SEQ ID NO: 4513 - DNA, 916 bp, Ananas comosus
agcttcgcgggagctctcggggctcttcggaagggatcgaaaaagccccaattttggtgcaaaatggcaaggggattgaagaagcatctgaaacggcttaatgccccgaagcattggatgctcgacaagctcggcggagctttcgccccgaagccgactcaaggtcctcacaaagcgcgggagtgccttcctctggttcttattttacagaacaagctgaaatatgcgctgagttacaatgaagtgacctcaattttgatgcagcgccatgtaatgatcgatggaaaggtccggacggacaagacctatcctgctggttttatggatgttgtaacaataccgaaaacgagcgaaaactttagactactctatgatacgaagggtcgcttccgtctccgctctatcagcgacgaagaagctaagttcaagctctgtaaggtccggtccgtgcagtttggggagagaggcatcccccacctcaacacttacgacggccgcacgatacgctatcccgaccccctcatcaaagccaatgacaccatcaaactcgacctcgagacgtacaagatcaccgacttcatcaagtttgaggttggtaacgtcgtcatggtgaccggtggaaggaacaggggccgggtcggtgtgatcaagaacagggagaagcatccggggaccttcgagacggtccacatccaagatgcaacacgccaggagttcgcgacgcgtctggggaacgtgttcatcatcggtaaggggacgaagccgtgggtagcccttcctaaggataagggcatcaagcttagcatcatcgaagaggctaggagacgccgcgccgcgtctagtggatctgccactgcttaatagtgtctgtgtttgtctgtgtagtagtatgttatgaatctagtgactaaataat

SEQ ID NO: 4514 - DNA, 1028 bp, Raphanus sativus
ggaagaaaggtgaacaacagagtgaaccgctgcttgagccgtcggagattcattcacctgctgcagacatggcaaggggattgaagaaacatctcaagaggcttaatgccccaaagcattggatgcttgacaaacttggtggtgcctttgcccccaagccatcttctggaccacacaagtccagggagtgccttccccttgtccttatcatccgtaataggttgaagtatgctttgacataccgtgaggtgatttctatcttgatgcaaaggcatatccaagttgatgggaaagtcagaactgacaagacataccctgctggtttcatggatgttgtgtctatcccaaagacaaatgagaacttccgtctgctgtatgacaccaagggacgcttccgtcttcactccatcagggacgaggaagcaaagttcaagctgtgcaaagtgagaactatccagcttggacagaagggaatcccttacctcaacacatacgacggtcgcaccatccgttaccccgacccgctcatcaagcccaacgacaccatcaagctagacctcgaggagaacaaggttgtggagttcatcaagtttgatgttggaaacgttgtgatggtgactggaggaagaaacagaggtcgtgttggtgtgatcaagaaccgtgagaaacacaagggaagcttcgagaccatccacattcaagactctactggacatgagtttgcaacgaggttagggaatgtgttcacgcttgggaaaggaacaaagccgtgggtgtctcttcccaaagggtaaaggtattaagcttaccatcattgaggaagctaggaagaggctttctgctcaacaagctgcttgaaactgttttttttttgtttcctctgtttcagaaaacctatgttctgtttttttttgtatcttgctattgagttccttgttcttattagactttcatgtctttgattgctgctattgagttccttatttaatttttatacattgagtaaaatgtttgcttcatcaggttta

SEQ ID NO: 4515 - DNA, 1024 bp, Triticum aestivum
gcctcgatcgctcctccgccacctcggcgctccgtcgtcttctcacgtgagcgtgcgagaagccacaggaaccgagaaaaatggcgaggggtctgaagaagcatgtgaagaggctcaatgcccctaaacattggatggttgaaaagcttggtggagcatttgcacctaagccgtcttctggtccccacaaagctagggagtgcttgccattgatccttatgctcaggaacaggctgaagtatgctctgacctatagtgaagttgtttcgatcatgatgcagcgacatattatggttgatgggaaggttaggactgacaagacatatcctgctggattcatggatgttgtgtcaattccgaagacaggggagaacttccgccttctttacgacaccaagggtcgcttccgtctccacagcatcaaggatgaggaggctaagttcaagctctgcaaggttaggactgtgcaatgtgggcagaagggtgtcccttccctcaacacctacgacggccgcaccatccgctaccctgaccctgccatcaaacccaacgacaccatcaagattgacctggagaccaataagattgtggatttcatcaagtttgaggtcgggaattttgtgatggtgaccggaggcaggaacaccgggcgcatcggggtgatcaagagcagggagaggcacgagggcagcttcgagaccatccacgtcgaggatgccctcggccatcagttcgccacccgcctggccaacgtcttcagcattggcaaggataggaagtcgtgggtctctcttcccaagggcaagggcatcaagctcaccatcattgaagaggcaaggaagcgcattgctgcggcttgatttcagaaccctcctggaataaataaatggattagttgtgacttgtgaggagtcatttagaatgttagatgttcctattggagacgagccatgttttagttctgcgtttgacattcgttgaactgttctagttgttgcgttactttgagcactgaaagtaatga

SEQ ID NO: 4516 - DNA, 1188 bp, Triticum aestivum
tcgcgggagcataatccctggctgtcgctgccgccatcgctatttctagggtatatctccgccttgattgctcctccgccacctcggcgctccgtcgtcttctcacgtgagcgcgcgagaagccacaggaaccgagcaaaatggcgaggggtctgaagaagcatgtgaagagactcaatgcccctaagcattggatggttgaaaagcttggtggagcatttgcacccaagccgtcttcaggtccccacaaagctagggagtgcttgccattgatccttatgctcaggaacaggctgaagtatgcactgacctatcgtgaagttgtttcaatcatgatgcagcgacatattatggttgacgggaaggttaggactgacaagacatatcctgctggattcatggatgttgtgtcaattccgaagacaggggagaacttccgccttctttacgacaccaagggtcgcttccgtctccacagcatcaaggatgaggaggctaagttcaagctctgcaaggttaggactgtgcaatgtggacagaagggcatcccttccctcaaaacctacgacggccgcaccatccgctaccctgaccctgccatcaaacccaacgacaccatcaagattgacctggagaacaacaagattgtggatttcatcaagtttgaggtcgggaattttgtgatgatgaccggaggtaggaacaccgggcgcatcggggtgatcaagagcagggagaagcacgagggcagcttcgagacgatccacgtcgaggatgccctcggccatcagttcaccacccgcctggccaacgtcttcaccatcggcaaggacaggaaggcgtgggtctctcttcccaagggcaagggcatcaagctcaccatcatcgaagaggcgaggaagcgcgttaccgcggctgctgtttcagaaccctccgagaataaataaatggatttgctgtgaggagtcacttagatgtgcctgttggagacgagccatgttttagtgctgcgtttgactattttttggttaagcattttcttgtcgtttgtactttctattgtaactagttctagtcgttgtccttactttgtagcactgaagtagtattagtaataaaagtaaaaataagacagtaattactttttagttactaatagaagaagttaatgttagtagacgaaaagtt

SEQ ID NO: 4517 - DNA, 805 bp, Musa acuminata
gctctcggcttcgggactttaaaggcccccctcgacgcttccgagttcttgaggaggaggcgcgcaaacaggaggccgacatccgaaaaagatggccaggggattaaagaaacatctaaagaggctcaatgcccccaagcattggatgctggacaagcttggtggagcctttgctcccaaaccatcatctggccctcataaagccagggaatgcttgcccttgattctgatattaagaaacaaactgaaatacgcacttacgtatcgtgaagtcattgctattctgatgcaacgccatgtaatggtggatggaaaagtcaggactgacaaaacttacccagctggtttcatggatgttgtctcaattcccaagacaaatgaaaacttccgcctcctgtatgacaccaagggacgcttccgtctccattcgataagggatgaagaggcaaagttcaagctctgcaaggttcgctctgtccagtttggacagaagggcatcccctatttaaacacctacgatggtcgtaccattcgctaccccgaccctctcatcaaggccaatgacaccatcaagcttgatctggaaaccaacaagattgtagacttcatcaagttcgatgtcggaaatgttgtgatggtgacgggcggaagaaacaccggtcgtgttggcgtgattaagaacagggagaagcacaaggggagttttgagaccatccacatccaagatgctactgggcatgagtttgcgactcgcttgggcatgtcttcaccgtcggtaagcgactaagccatgggtgtctcttcc

SEQ ID NO: 4518 - DNA, 941 bp, Gossypium hirsutum
tcccgctggcatcttcctaaagaacgctgaaggctctcagcggaaacagcagcttccagaccaaccgaaatgactagagggttaaagaaacatttgaagaggctcaatgctccaaggcattggatgtttggcaagcttggcggtgcatttgcacccaagccgtcatgtggaccacacaagtccagagaatgcttgccgctcattctcattctgcgaaacagattaaagtacgctctaacatatagagaagtgattgccattcttatgcaaaggcatgttatggtagatgggaagatgttgtatcgattccaaagacgaatgaggacttccgcctcctttatgacacaaaaggtcgtttttgccttcatgccatcaccagtgatgagaccaagtttaagctctgcaaagttcggtctgtccaatttggtcaaaagggtatcccctaccttaatacgtacgatggacgcaccatccgctacccagatcctctaatcaaggctaacgataccatcaagcttgacctagagaacaacaaaattgtagatttcattaagtttgatgtcgggaatgttgtcatggtcactggaggaagaaacagagggcgtgttggagtgattaagaaccgtgagaagcataagggtagcttcgagacaatccatgtccaagatgctgctggacacgagtttgcgactcgtctaggcaatgtcttcacgattggtaaaggaacgaagccatgggtgtcacttccaaagggcaagggtatcaaattgtccatcattgaggaagccaggaagaggcttgcagcccaagctactgtctaaattttatgattaaagatataatatctggaattgttttttgtcaaatgaattaatctgtttggtggccctttgtgtttgctttggtaggatttatgttacagttttggaccaattgttata

SEQ ID NO: 4519 - DNA, 928 bp, Taraxacum officinale
cttaagagatcccctggggtgcggcagcgagttgcagagcactggagaggagagcagcaggttagccgaagaattcaaccggagatttagatctcccgtcggacaacgcaaccatggctagaggattaaagaaacacatgaagaggctcaatgccccaaagcattggatgctcgacaaacttggcggtgcttttgcccctaaaccatcatcaggaccacacaagtcccgtgaatgtctacccttgatcctaatcctccgtaacaggttgaagtatgcactaacataccgcgaggtccaatctatcctaatgcaacgacatgttcttgttgacaacaaagtcagaaccgataaaacttaccccgctggtttcatggatgttgtttctatccccaaaaccaatgaaaacttccgtcttctttatgacacaaaaggtcgattcagactacactcagtcagagacgaagagtccaagtttaagttatgcaaagttaggtcagtccaattcgggtcaaagggaatcccatacatcaacacatacgatgggcgaacaatccggtacccggacccactaatcaaagccaacgacaccatcaagctggacctcgagtcaaacaaaatcgttgactttatcaaattcgatgtcgggaatgtggtgatggtaactggaggaagaaacacagggcgagttgggatccttaaaaacagggaaaaacataagggaagctttgaaacagttcacattcaagattccactgggcatgagtttgctacccgtttgggtaacgtgtttacagttgggaaagggtcgaagccttgggtgtcgcttccaaagggaagggtattaagttgacgattattgaggaggctaggaagagaaaggctgctcaggaatctgttgctaaagctgtttggttttgtgggttttat

SEQ ID NO: 4520 - DNA, 897 bp, Raphanus sativus
  misc_feature (880)..(880): n is a, c, g, or t
aagcattggatgcttgacaaacttggtggtgctttgcccccaagccatcttctggaccacacaagtccagggagtgccttccccttgtccttatcatccgtaacaggttgaagtatgctttgacataccgtgaggtgatttctatcttgatgcaaaggcatatccaagttgatgggaaagtcagaactgacaagacataccctgctggtttcatggatgttgtgtctatcccaaagacaaatgagaacttccgtctgctgtatgacaccaagggacgcttccgtcttcactccatcagagacgaggaagcaaagttcaagctgtgcaaagtgagaactatccagcttggtcagaagggaatcccttacctgaacacatacgatggtcgcaccatccgttaccccgacccgctcatcaagcccaacgacaccatcaagctagacctcgaggagaacaaggttgtggagtttatcaagtttgatgtaggaaacgttgtgatggtgactggaggaagaaacagaggtcgtgttggtgtgatcaagaaccgggagaaacacaagggaagcttcgagaccatccacattcaagactctactggacatgagtttgccacgaggttagggaatgtgttcacgctcgggaaaggaacaaagccgtgggtgtctcttccaaagggtaaaggtattaaacttaccatcattgaggaagctaggaagaggctttctgctcaacaagctgcttgaaactgtttttttcctctgtttcagaaaacctatgctctgtttttgttttgtatcttgctattgagatcattattctcagactttcatgtctttgattgctgctattgagttccttgtttaattcttatacattgagnaaaaggtttgcttcatc

SEQ ID NO: 4521 - DNA, 766 bp, Cynodon dactylon
ccggggacgtattgcccgttcgcgtccgtctgtcttgttcatccattccccacgcgagaccttcgccgcctctagggttttctccgtcgcccgctccagccgccgccatgcctcgccgctcaggaggaaggtcagcaccgcgtcctgctccgcgtgcagctccagtgaggaacccgccacagccagcacgccaggctcctcctcctgcacctgctcagcagaatggtggtggctctatccttggaggaattggctccactattgctcaaggcatggcttttgggactggcagtgccatggcacaccgagctgttgatgctgtaatgggtccccggaccattcagcatgagactgttgtttcagaggctgctgcttctgccccggctgccccatcagtgaacactgattcttgctccattcattccaaggccttccaagactgcattaatttctacggaagtcgacatcagcaagtgccagttctaccttgacatggtgaacgagtgccgccgtggtggtgtctctgcttaaatagctgctgcttgattggagttgattcatctcatggtcctattaataatacttcgtgagacttcgatgcctgtaatgtgacatcgtcccttattgtggtttttattgttgtgttgcctgagagtagtacatcctatcctatcctataaaaaattgctggatctatcgtggaactggtgatcataaatatttcaatgaaccagttgcttttggattatttgttttcgtttgctcc

SEQ ID NO: 4522 - DNA, 921 bp, Sorghum bicolor
gcgcgagcccacacgtcagatcttcttgtctcgcaagacagcccccagcgcgtcgagtcgagacctcgagtgccctctccgcctataaaaccgaaccctagcccggtgtccgtgttcaatctccttgcccgttcgtgtctgtctctgttcattcgttccccacctcgccctcgagccgtctcgctagggtttcgccgccgccgccgccgccgccgccatgcctcgccgcagctcaggaaggtctgccccacgcccggctccacgtgctgctccagtgaggaacccaccacagccagcacgccaggctcctcctccagctcctgttcgggatggtggtggctccattcttggaggaattgggtccaccattgctcaaggtatggcatttggtactggtagtgccatggcgcacagggctgttgatgctgtaatgggtccccggaccattcagcatgagactgttgtctcagaggcggctgctgctgcccccgctgctccagcgatgaacactgatgcttgtggcatccattctaaggccttccaagattgtctcaacaactatggcagcgacatcagcaagtgccagttctaccttgacatgctgaacgagtgccgccgtggtggtgtgtctgcctaagcacctctattgggactactcatgggttttcttttaactctcatggtatctcattaataagacaccgtgaaacttgaaccatctgcttgaaacgtatgtaccgtgacatcactggtccatcttgttgaagctatggttataccgtctttcctgggagtggtacattctgttatcccgtattgttggaacagacatctgtatctgtgtctctggtgatcataaatatttgaatgaaccagttatgttggaatatgttgtctcaagcgaacaaggcgttagtctat

SEQ ID NO: 4523 - DNA, 1162 bp, Sorghum bicolor
gcgcgagcccacacgtcagatcttcttgtctcgcaagacagcccccagcgcgtcgagtcgagacctcgagtgccctctccgcctataaaaccgaaccctagcccggtgtccgtgttcaatctccttgcccgttcgtgtctgtctctgttcattcgttccccacctcgccctcgagccgtctcgctagggtttcgccgccgccgccgccgccgccgccatgcctcgccgcagctcaggaaggtctgccccacgcccggctccacgtgctgctccagtgaggaacccaccacagccagcacgccaggctcctcctccagctcctgttcgggatggtggtggctccattcttggaggaattgggtccaccattgctcaaggtatggcatttggtactggtagtgccatggcgcacagggctgttgatgctgtaatgggtccccggaccattcagcatgagactgttgtctcagaggcggctgctgctgcccccgctgctccagcgatgaacactgatgcttgtggcatccattctaaggccttccaagattgtctcaacaactatggcagcgacatcagcaagtgccagttctaccttgacatgctgaacgagtgccgccgtggtggtgtgtctgcctaagcacctctattgggactactcatgggttttcttttaactctcatggtatctcattaataagacaccgtgaaacttgaaccatctgcttgaaacgtatgtaccgtgacatcactggtccatcttgttgaagctatggttataccgtctttcctgggagtggtacattctgttatcccgtattgttggaacagacatctgtatctgtgtctctggtgatcataaatatttgaatgaaccagttatgttggaatatgttgtctcaagcgaacaaggcgttagtctatataggcgcgacgctgcccttgctattcgagggggctgttgaccgacgcacacgcggcatttccaatggcaactcctggaacatctgttcttcctctccaaggaccttgttctttcgctaactgccacgctcgccttcccgccacagcacaaaaaaacatgtttattttttatcgcgttccaaataaggccctttatgatcttgcctaccgtttgctccttggcagctagcgtttcctcgcc

SEQ ID NO: 4524 - DNA, 885 bp, Panicum virgatum
gtgttcagccttcctgcccgttcgtatcctcttcctgttcaatcgttccccacctcgccgacaagctagggtttcctccgccgcccgttccagccgccaccatgcctcgccgcagctcaggaaggtctgcgtcgcgccctgctccgcgtgctgctccgatgaggaacccgccacagccagcgcgccaggctcctcctccagctcctgctcagagtggtggtggctccatccttggaggaattgggtccacaattgctcaaggtatggcatttggtactggcagtgccatggcacacagagctgttgatgctgtaatgggcccccgtaccattcagcatgagactgttgtctcggaggcggctgctgctgctcccgctgctccgatgatgaacgctgattcttgtggcaaccattccaaggccttccaagactgtctcaaccactatggcagcgacatcagcaagtgccagttctaccttgacatgctgaacgagtgccgccggggtggcgccacagcttaagctgctgcttcattggagttgattcctgggttcccttttcactttcattaataagacttaagtgaaactatgaactgcagccacaacctgatgttgtgtgccgtggccattatcattggtgcatgctgttgaggttgtggtaatgttctgttatcctgggagtagtacattctgctatcctatattgttggtgcagacttctatagcactgatgattataaatatttgaatcaagcagtgatcttgggattaagtttgttctgtgtagcagcccctgcttctttgattcgttttgtgatgtttagtactcctattataaaatataggttgttttggctttattacgttcatagattttactagc

SEQ ID NO: 4525 - DNA, 777 bp, Cenchrus ciliaris
  misc_feature (429)..(429): n is a, c, g, or t
  misc_feature (569)..(569): n is a, c, g, or t
  misc_feature (661)..(661): n is a, c, g, or t
tgcccgttcgtgtcctcaccctgttcattggtttcccaccccgaccccgccgcctcgctagggtttcgtctgcctaccgttccagccgccgccatgcctcgccgcagctccgccggaaggtcctcgcgtcctgctccgcgtgctgcccctgtgagaaacccacctcagccagcacgccaggctcctcctccagctcctgctcagagtggtggtggctccattcttggagggattgggtccacgattgctcaaggtatggcgtttggtactggcagtgccgtggctcacagagcggttgatgctgtaatgggccccaggaccattcagcatgagactgttgtttcggaggctgctgctactgctcctgctccaatgatgaacgctgctgattcttgtggcaaccattccaaggccttccaagattgtctnagccactacggaagcgatatcagcaagtgccagttctaccttgacatgctgaacgagtgccgccgtggtggtgcgactgcataagcctgctctacattggagttgattcctgggttctcttttcactctcatgatatctnattaataagactaagtgaaactatgaactaccaccacaacttgatgcttgtgtgccggggcactatcactggcacgtgttgaggttgtggtnatgttctgttatcctgggaggagtacattctcgtatcctatattgttggaacttctatgtatggtgctgatggtgatgataaaagtactttaatcaaacaattatcttcggactga

SEQ ID NO: 4526 - DNA, 893 bp, Saccharum officinarum
caagaagtgaagaaactgggaagtgccctctccgcctataaaaccgaaccctagcccagtgcccaggcccttccgtaatctccttgcccgtttgtgtcctctctgttcattcgttccccacctcgccccgagccgtcacgctagggtttcgccaccgccgccgccgccatgcctcgccgcagctcaggaaggtccgccccacgcccggctccacgtgctgctccagtgaggaacccaccacagccagcgcgccaggctcctcctccagctcctgttcgggatggtggtggctccattcttggaggaatcgggtccaccattgctcaaggtatggcatttggtactggtagtgccatggcacacagggctgttgatgctgtaatgggtccccggaccattcagcatgagactgttgtctcagaggctgctgctgctgcccctgctgctccagcgatgaacactgatgcttgcggcatccattctaaggccttccaagattgtctcaacaactatggcagcgagatcagcaagtgccagttctaccttgacatgctgaacgagtgccgccgtggtggtgtgtctgcctaagctacctcttctgttgggattattcatggattctcttctcttttcactcatggtatctcattaataagacaccttgaaactttgaaccatctccacagcttgaaacatatgtaccgtgacatcaccggtccatcttgttgaagctatggttatgttttactgtcgtgggagtagtacattctgttatcccatattgttggaacagacttctgtctctggtctctggtgatcataaatattcaaatgaaccagttatgttggaatatgttgtgttttaatctatctatctatattgatttaagtcc

SEQ ID NO: 4527 - DNA, 864 bp, Setaria italica
cgcctataaaatcgaaccctaacctaggccctctccgtgttcaaccttcctggccgttcgtgtcctctctgttcgttccccaccttgccccgcgccgcctcgctagggtttctttcgtccgccgaccgttccagccgccgccatgcctcgccgcagctcaggaaggtcagcatcgcgtcctgctcctcgcgctgctcctctgagaaacccacctcagccagcgcgccaggctcctcctccagctcctgctcagagcggtggtggctccatccttggaggaattgggtccacgattgctcaaggcatggcttttggtactggcagtgccatggcacacagagctgttgatgctgtaatgggcccccggaccattcagcatgagactgttgtctcggaggctgctgctgctgctcctgctgctccaatgatgaacggtgctgattcttgcggcaaccattccaaggccttccaagattgcctcaaccactatggaagcgacatcagcaagtgccagttctaccttgacatgctgaacgagtgccgccgtggtggtgcgactgcctaagccgcctaagctgccgccgcctcattggatttgattcatgggttctcttttcactctcatgatctcccattaataagaccaagtaaaactatgaactaccgccacaacttgatgtctgtgtgccgtgacactatcactggtgggtgttgagtttgtggttatgttctgttatcctgggagtagtacattctgatatcctatattgttggaacttctatggtgctgataatgataaatatttgaatcaaacagttgtggtgctatgtgtttggttctgtgttgcagcagccagcatggct

SEQ ID NO: 4528 - DNA, 793 bp, Panicum virgatum
ccctctccgtgttcaaccctcctgcccgttcgtgtcttccccctgttcaatcgttccccacctcgcctcgcgccgcctcgctagggtttcctccgccgcccgttccagtcgccaccatgcctcgccgcagctcaggaaggtcagcaccacgccctgctccgcgtgctgctcctatgaggaacccaccacagccagcacgccaggctcctcctccagcccctgctcagagtggtggtggctccatccttggaggaattgggtccacaattgctcaaggtatggcgtttggtactggcagtgccatggcacacagagctgttgatgctgtaatgggcccccgtaccattcagcatgagactgttgtctcggaggctgctgctgctgctcccgcttctccaatgatgaacgctgatgcttgcggcaaccattctaaggccttccaagattgtctcaaccactatggcagcgacatcagcaagtgccagttctaccttgacatgctgaacgagtgccgccgcggtggcgcaactgcataagctgctgcttcattggagttgattcgtgggttcccttttcactttcatgatatcttattaataagactaagtgaaactatgaactacagccacaacttgatgttttgtgtgccgtgaccactatcactggtgcatgaggttgtggttatgttctgttgtcctgggagtagtacattctgctatcctatattgttggtccagacttgtatggcaccgatgattataaatatttgaatcaagcagtgatcttgggacta

SEQ ID NO: 4529 - DNA, 632 bp, Triticum aestivum
agctcaggaaggtctgccccacgcccggctccacgtgctgctccagtgaggaacccaccacaaccagcacgccaggctcctcctccagctcctgttcgggatggtggtggctccattcttggaggaattgggtccaccattgctcaaggtatggcatttggtactggtagtgccatggcgcacagggctgttgatgctgtaatgggtccccggaccattcagcatgagactgttgtctcagaggcggctgctgctgcccccgctgctccagcgatgaacactgatgcttgtggcatccattctaaggccttccaagattgtctcaacaactatggcagcgacatcagcaagtgccagttctaccttgacatgctgaacgagtgccgccgtggtggtgtgtctgcctaagcacctctattgggactactcatgggttttcttttaactctcatggtatctcattaataagacaccgtgaaacttgaaccatctgcttgaaacgtatgtaccgtgacatcactggtccatcttgttgaagctatggttataccgtctttcctgggagtggtacattctgttatcccgtattgttggaacagacatctgtatctgtgtctctggtgatcataaat

SEQ ID NO: 4530 - DNA, 834 bp, Zea mays
gttgcgcgagcccacacgtcagatcttcttgtgtcgcaagacaggcccacaaactgggactaatggttcgagagtcgagacttcgagtgccttctcccttataaaaccgaacgcccagggccctccatgttcaatctcgttgtccgttgtactctctctctctattcgttccccgcctcaccccgagccagccgtctcgctagggtttcgccgccgccgccgccatgcctcgccgcagctcaggaaggtctgccccacgcccagctccccgtgctgctccagtgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgatgctgtattaggtccccggaccattcagcatgagactgttgcctcagaagctgctgctgctgcccctgcccctccagtgatgaatgctgatgcttgcagcatccattctaaggctttccaagattgtctcaacaactatggcagcgagatcagcaagtgccagttctacctagacatgctgaacgagtgccgccgtggtggtgtgtctgcctaagctgcctctggggttattcatggattttctttcggtgatgctatctcattaataagataccgtgaaacttttgtctccacagcttgaagctaaacttcctgggattaatacattttgttatcctatgctgttggagcagacttttgtctcttgatcataaatatttaaacgaacctgttatgttggaata

SEQ ID NO: 4531 - DNA, 753 bp, Pennisetum glaucum
tgtcctccccgttcattggttccccatctcgactcgcgccgcctcgctagggtttcgtccgccgaccggtacagccgccgccatgcctcgccgcagctcaggaaggtcatcgcgtcctgctcctcgtcctgctccacgtgctgcacctgtgagaaacccgcctcagccagcacaccaggctcctcctccagctcctgctcagagtggtggtggctccattcttggagggattgggtccacgattgctcaaggtatggcgtttggtactggcagtgccatggctcacagagctgttgatgctgtactgggccccaggaccattcagcatgagactgttgtttcggaggcggctgctgctgctcctgctcctgcaccaatgatgaacggggctgattcatgtggcaaccattccaaggccttccaagactgtctgaaccactacggaagtgacatcagcaagtgccagttctaccttgacatgctgaacgagtgccgccggggtggtgcgactgcataagcttcctcttcatcagagttgattcatgggttctcttttcactctcatgatatcccattaataagactaagtgaaactatgaacttctgccagaacttgatgcttgtgtgccgtggcactgtcactagttgtggttatgttctgctatcctgggagtagtacattctcatatcctatattgttggaacttctatgatgctgatggtgatgataagtattttaatgaaacggttatc

SEQ ID NO: 4532 - DNA, 771 bp, Triticum aestivum
gatccgttggcctcctgttcatccgctcccccctcccgccgccgcctccagcctagggtttcctcccgccgtccgccacacccgccgccatggctcgccgcagcggaggaggaagatcttcccgccctgctccacgtgctgctccagtgagaaacccaccagcgccagcccgtcaagctcctccacctgctactacccagagcagcggtggtggtatcatgagcggaattgggtccactattgctcagggcatggcttttggtactggcagtgctatggcgcacagggctgttgatgctgtgatgggtccccgtaccattcagcatgagactgttgtcggtgaggctgctgcatctatgactccaatggacaacgctgctgatgacaagtgtggcaacccttccaaggccttccaagattgcatcaaccactacggcagcgacatcagcaagtgccagttctacctcgacatgctgaacgagtgccgccgtggaggagcaggagctggtgcaactctttaagctactatctttgcttgattggggcttaattggtcggagcctgttttcagtcatgatgatgatgatatatatctcctaaataattcattggcaatattatgaacctatgccacagcttatgtctattacctaccctagtttgtggtctctgttgtcttgggagtatttccttgtattgatgttggatctaccttcatggcaccaggtttataaatatggagtttaaatatggtgtgttgcgacttcattt

SEQ ID NO: 4533 - DNA, 888 bp, Triticum aestivum
cccattccgatccgttggcttcctgttcatacattctcccctcccggcgccgcctccagcctagggtttcctcccgccgtccgccacacccgccgccatggctcgccgcagcggaggaggaagatcttcccgccctgctccacgtgctgctccagtgagaaacccaccagcgccagcccgtcaagctcctccacctgctactacccagagcagcggtggtggtatcatgagcggaattgggtccactattgctcagggcatggcttttggtactggcagtgctatggcgcacagggctgttgatgctgtgatgggtccccgtaccattcagcatgagactgttgtcggtgaggctgctgcatctatgactccaatggacaacgctgctgatgacaagtgtggcaacccttccaaggccttccaagattgcatcaaccactacggcagcgacatcagcaagtgccagttctacctcgacatgctgaacgagtgccgccgtggaggagcaggagctggtgcaactctttaagctactatctttgcttgattggggcttaattggtcggagcctgttttcagtcatgatgatgatgatatatatctcctaaataattcattggcaatattatgaacctatgccacagcttatgtctattacctaccctagtttgtggtctctgttgtcctgggagtatttccttgtattgatgttggatctaccttcatggcactgggtttataaatatggagtttaaatatggtgtgttgcgacttcatttcttgtgtggttttgagagcttgccatctgtaatccgttgttccctttaaatatgcctgccacaagtgcagcaccggtttgaatggttcaaatcttgcaaaatggatcac

SEQ ID NO: 4534 - DNA, 880 bp, Avena sativa
ccattctgatccgttggctccctgttcatccgtttcccctccagccgccgcctctcccctagggtttcctccgccgtccgctccagccgccgccatgcctcgccgcagtggaggaggaggaaggtcacgccctgctccccgtgctgctccagtgaggaacccaccacagcctgcccgtcaagctcctcctcctgctcctgctccccagagcagtggtggtggcatcatgagtggaattgggtccactattgctcagggtatggcttttggcactggcagtgctgttgcacacagggctgttgatgctgtgatgggtccccgtaccattcagcatgagacagttgtctctgaagctgcttcatctatgactccaatgggcaacactgctggatctgattcatgcgacaactcttccaaggctttccaagattgcatcaaccactatggaagcgacatcagcaagtgccagttctacctcgacatgctcaacgagtgccgccgtggaggagcaggagctggttctactctttaagctgctaccttgcctgaatgggttgattgattgatcggaacttgttcgatgatgatgatatcataaataatataattggcgaactggactcctgccacagcttatggtctttattagttcgtggtatgctctgttgtcctgggagtatttccttgtattgatgttggaactaccttaatggcagtgggattataaatatggagtctgaatatcgcgtcctggtactttaatttgaatatatatcaatgtttctaatataacctctgagagctgtcattgagcataacagttctgtgatgccaaggcatctgttgttgccattaacgttgtctgttggtaacttgctgc

SEQ ID NO: 4535 - DNA, 826 bp, Avena sativa
aaccattctgatccgttggctccctgttcatccgtttcccctccagccgccgcctctcccctagggtttcctccgccgtccgctccagccgccgccatgcctcgccgcagcggaggaggaggaaggtcccgccctgctccccgccctgctccccgtgctgctccagtgaggaacccaccacagcctgcccgtcaagctcctcctcctgctcctgctccccagagcagtggtggtggcatcatgagtggaattgggtccactattgctcagggtatggcttttggcactggcagtgctgttgcacacagggctgttgatgctgtgatgggtccccgtaccattcagcatgagactgttgtctctgaagctgcttcatctatgactccaatgggcaacactgctggatctgattcatgcgacaactcttccaaggctttccaagattgcatcaaccactacggaagcgacatcagcaagtgccagttctacctcgacatgctcaacgagtgccgccgtggaggagcaggagctgggtctactctttaagcagctaccttgcctgaatggtttgattgattgatgggaacttgttcgatgatgatgatatcataaataatataattggcgaaatgaactcgtgccacagcttatggtctttattagttcgtggtatgctctgttgtcctgggagtatttccttgtattgatgttggaactaccttcatggcagtgggattatgaatatggagtctgaatatcgcgtcctggtactttaatttgaatatatatcaatgtttctaatattactcctgagagctgtcattga

SEQ ID NO: 4536 - DNA, 788 bp, Secale cereale
gccgccgccatggctcgccgcagcggaggaggaaggtcttcccgccctgctccacgtgctgctccagtgagaagcccacctgcgccagcccgtcaagctcctccacctgctactactacccagagcagcggtggtggtatcatgagcggaattgggtccactattgctcagggcatggcttttggtactggcagtgctatggcgcacagggctgttgatgctgtgatgggtccccgtaccattcagcatgagactgttgttggtgaggctgctgcatctatgactccaatggacaacgctgctggtgacaagtgtggcaacccttccaaggccttccaagattgcatcaaccactacggaagcgacatcagcaagtgccagttctacctcgacatgctgaacgagtgccgccggggaggagcaggagctggtgccgccactctttaagctgctacctttgcttgatcggggcttaattggttggaacctgttttctgtcatgatgatgatgatatatatctcctaaataattcattggcaatattatgaacctgccacagcttatgtctattaccctagtttgtggtctctgttgtcctgggagtatctccttgtattgatgttggatttaccttcatggcacctgggtttataaatatggagtttaattatggtgtttggccaacttcatttgattccgtttacattttgtggttttgagagctttgatatgctgttgcttatgtaaatccattgtgctcaaatcttgcaaaatggatcaccaactg

SEQ ID NO: 4537 - DNA, 702 bp, Secale cereale
gccgccgccatggctcgccgcagcggaggaggaaggtcttcccgccccgctccacgtgctgctccagtgagaagcccaccagcgccagcccgtcaagctcctccacctgctactactacccagagcagcggtggtggtatcatgagcggaattgggtccactattgctcagggcatggcttttggtactggcagtgctatggcgcacagggctgttgatgctgtgatgggtccccgtaccattcagcatgagactgttgtcggtgaggctgctgcatctatgactccaatggacaacgctgctggtgacaagtgtggcaacccttccaaggccttccaagattgcatcaaccactacggaagcgacatcagcaagtgccagttctaccttgacatgctgaacgagtgccgccggggaggagcaggagctggtgccgccactctttaagctgctacctttgcttgatcggggcttaattggttggaacctgttttctgtcatgatgatgatgatatatatctcctaaataattcattggcaatattatgaacctgccacagcttatgtctattaccctagtttgtggtctctgttgtcctgggagtatctccttgtattgatgttggatttaccttcatggcacctgggtttataaatatggagtttaattatggtgtttggccaacttcatttgattccgtt

SEQ ID NO: 4538 - DNA, 785 bp, Secale cereale
ccccagccgccgccatggctcgccgcagcggaggaggaaggtcttcccgccctgctccacgtgctgctccagtgagaagcccaccagcgccagcccgtcaagctcctccacctgctactactacccagagcagcggtggtggtatcatgagcggaattgggtccactattgctcagggcatggcttttggtactggcagtgccatggcgcacagggctgttgatgctgtgatgggtccccgtaccattcagcatgagactgttgttggtgaggctgctgcatctatgactccaatggacaacgctgctggtgacaagtgtggcaacccttccaaggccttccaagattgcatcaaccactacggaagcgacatcagcaagtgccagttctacctcgacatgctgaacgagtgccgccggggaggagcaggagctggtgccgccactctttaagctgctacctttgcttgatcggggcctaattggtcggaacctgttttctgtcatgatgatgatgatatatatctcctaaataattcattggcaatattatgaacctgccacagcttatgtctattaccctagtttgtggtctctgtcgtcctgggagtatctccttgtattgatgctggatttaccttcatggcacctgggtttataaatatggagtttgattatggtgtgtggcaacttcatttgatttccattacattttgtggttttgagagctttgataggtttcttctgtaatccgttgtgctcaaatcttgcaaaatgggatcacca

SEQ ID NO: 4539 - DNA, 773 bp, Secale cereale
agtttaaggtaacttacccttagtttacaattaccaataccccccaacctcccgccgccgcctccagcctagggtttcctcccgccgcccgtccgcacccccccacccgccgccatggctcgccgcagcggaggaggaaggtcttcccgccctgctccacgtgctgctccagtgagaagcccacctgcgccagcccgtcaagctcctccacctgctactactacccagagcagcggtggtggtatcatgagcggaattgggtccactattgctcagggcatggcttttggtactggcagtgctatggcgcacagggctgttgatgctgtgatgggtccccgtaccattcagcatgagactgttgttggtgaggctgctgcatctatgactccaatggacaacgctgctggtgacaagtgtggcaacccttccaaggccttccaagattgcatcaaccactatggaagcgacatcagcaagtgccagttctacctcgacatgctgaacgagtgccgccggggaggagccggagctggtgccgccactctttaagctgctacctttgcttgatcggggcttaattggtcggaacctgttttctgtcatgatgatgatgatatatatctcctaaataattcattggcaacattatgaacctgccacagcttatgtctattaccctagtttgtggtctctgttgtcctgggagtatctccttgtattgatggtggatttaccttcatggcacctgggtttataaatatggagtttaa

SEQ ID NO: 4540 - DNA, 704 bp, Secale cereale
ccccagccgccgccatggctcgccgcagcggaggaggaaggtcttcccgccctgctccacgtgctgctccagtgagaagcccaccagcgccagcccgtcaagctcctccacctgctactaccacccagagcagtggtggtggtatcatgagcggaattgggtccactattgctcagggcatggctttcggtactggcagtgccatggcacacagggctgttgatgctgtgatgggtccccgtaccattcagcatgagactgttgtcggtgaggctgctgcatctatgactccaatggacaacgctgctggtgacaagtgtggcaacccttccaaggccttccaagattgcatcaaccactatggaagcgacatcagcaagtgccagttctacctcgacatgctgaacgagtgccgccggggaggagcaggggctggtgccgccactctttaagctgctacctttgcttgatcggggcttaattggttggaacctgttttctgtcatgatgatgatgatgatatatatctcctaaataattcattggcaacattatgaacctgccacagcttatgtctattaccctagtttgtggtctctgttgtcctgggagtatctccttgtattgatggtggatttaccttcatggcacctgggtttataaatatggagtttaaatatggtgtgtggcaacttcatttgatt

SEQ ID NO: 4541 - DNA, 777 bp, Secale cereale
ccccagccgccgccatggctcgccgcagcggaggaggaaggtcttcccgccccgctccacgtgctgctccagtgagaagcccaccagcgccagcccgtcaagctcctccacctgctactactacccagagcagcggtggtggtatcatgagcggaattgggtccactattgctcagggcatggcttttggtactggcagtgccatggctcacagggctgttgatgctgtgatgggtccccgtaccattcagcatgagactgttgttggtgaggctgctgcatctatgactccaatggacaacgctgctggtgacaaatgtggcaacccttccaaggccttccaagattgcatcaaccactacggaagcgacatcagcaagtgccagttctacctcgacatgctgaacgagtgccgccggggaggagcaggagctggtgctgccactctttaagctgctacctttgcttgatcggggcttaattggtcggaacctgttttctgtcatgatgatgatgatatatatctcctaaataattcattggcactattatgaacctgccacagcttatgtctattaccctagtttgtggtctctgttgtcctgggagtatctccttgtattgatggtggatttaccttcatggcacctgggtttataaatatggagtttgattatggtgtgtggcaacttcatttgatttccattacattttgtggttttgagagctttgataggtttcttctgtaatccgttgtgctcaaatcttgcaaaatgg

SEQ ID NO: 4542 - DNA, 575 bp, Secale cereale
ccacgcgtccgcgtccccattccgatctgttggctccctgttcatccatcccccacctcccgccgccgcctccagcctagggtttcctcccgccccagccgccgccatggctcgccgcagcggaggaggaaggtcttcccgccctgctccacgtgctgctccagtgagaagcccaccagcgccagcccgtcaagctcctccacctgctactactacccagagcagcggtggtggtatcatgagcggaattgggtccactattgctcagggcatggcttttggtactggcagtgccatggcgcacagggctgttgatgctgtgatgggtccccgtaccattcagcatgagactgttgttggtgaggctgctgcatctatgactccaatggacaacgctgctggtgacaagtgtggcaacccttccaaggccttccaagattgcatcaaccactacggaagcgacatcagcaagtgccagttctacctcgacatgctgaacgagtgccgccggggaggagcaggagctggtgccgccactctttaagctgctacctttgcttgatcggggcctaatt

SEQ ID NO: 4543 - DNA, 744 bp, Triticum aestivum
gtccccattccgatccgttggcttctgttcatccattccccctcccggcgccgcctccagcctagggtttcctcccgccgcccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaaggccttccaagattgcatcaaccactacggaagcgatatcagcaagtgccagttctaccttgacatgctgaacgagtgccgccgtggaggagcaactctttaagctactatctttgcttgattggggcttaattgggcagaacctgttttcagtcatgatgatgatgatatatatctcctaaataattcattggcaatattatgaacctatgccacagcttgtgtctattacctaccctagttcgtggtctctgttgtcccgggagtatttccttgtattgatgttggaattaccttcatggcagtgggtttataaatatggagt

SEQ ID NO: 4544 - DNA, 1423 bp, Triticum aestivum
acacaaaccatctccgcagcgcactccgtgggaaccagcaggtctcatctggaagagagaaagccaccatcaaccggaagaatgacaccattgatcattgaggccttatctgacaacagatacaagactggatcagcaatttcatgtggttcagcgaatcgtttcaaaggaatttttgctttcattggatctccaatttcaggctttccccaagcttcttttccgaggtcggtgaggcagactgttggattgacgctgttgactcggatgttgtgtggtcctagctctagtgcccattccgatccgttggcttcctgttcatacattctcccctcccggcgccgcctccagcctagggtttcctcccgccccgtccgccccacccgccgccatggcccgccgcagcggaggaggaaggtcttcccgccctgctccacgtgctgctccagtgagaaacccaccagcgccagcccgtccagctcctccacctgctaccacccagagcagcggtggtggtatcatgagcgggattgggtccaccattgctcagggcatggctttcggtactggaagtgccatggcgcacagggctgttgatgctgtgatgggtccccgtaccattcagcatgagactgttgtcggtgaggctgctgcatctatgactccaatggacaatgctgctgatgacaagtgtggcaacccttccaaggccttccaagattgcatcaaccactacggaagcgatatcagcaagtgccagttctaccttgacatgctgaacgagtgccgccgtggaggagcaactctttaagctactatctttgcttgattggggcttaattgggcagaacctgttttcagtcatgatgatgatgatatatatctcctaaataattcattggcaatattatgaacctatgccacagcttgtgtctattacctaccctagttcgtggtctctgttgtcccgggagtatttccttgtattgatgttggaattaccttcatggcagtgggtttataaatatggagtttgaatatggtgtgttgcgacttcatttatttgtatggttttgagagcttgatatgcctgttgcatctgtaatccgttgttccctttaaatatgcttgccacaagtgcagcaccagatggagtgggacaaatcttgcaaaatggatcacaaacaagttcttggccatttttttcctgaaacttaggacactaaatcaaactttattttcaaattatgacgactgttgtagtttcacatattctattggtgcaccaaggtagcctgtcatggatcctccatgcctatttgtaaagtttgctcaatattttgggcagcctaaaaatacaaccagttgttggaaatatatgtgctgctatcaaatcctgtggtcgctgcattttaatgttgcc

SEQ ID NO: 4545 - DNA, 780 bp, Avena sativa
gccgccgcctctcccctagggtttcctccgccgtccgctccagccgccgccatgcctcgccgcagtggaggaggaggaaggtcacgccctgctccccgtgctgctccccgtgctgctccagtgaggaacccaccacagcctgcccgtcaagctcctcctcctgctcctgctccccagagcagtggtggtggcatcatgagtggaattgggtccactattgctcagggtatggcttttggcactggcagtgctgttgcacacagggctgttgatgctgtgatgggtccccgtaccattcagcatgagacagttgtctctgaagctgcttcatctatgactccaatgggcaacactgctggatctgattcatgcgacaactcttccaaggctttccaagattgcatcaaccactatggaagcgacatcagcaagtgccagttctaccttgacatgctcaacgagtgccgccgtggaggagcaggagtcggttctactctttaagctgctaccttgcctgaatgggttgattgattgatcggaacttgttcgatgatgatgatatcataaataatataattgccgaaatggactcgtgccacagcttatggtctttattagttcgtggtatgctctgttgtcctgagagtatttccttgtattgatgttggaactaccttcatggcagtgggattataaatatggagtctgaatatcgtgtcctggtactttaatttgattatattaatgtttctaatattacactgagttctgtccttgaac

SEQ ID NO: 4546 - DNA, 850 bp, Avena sativa
gagcgtctcaccattctgatccgttggctccctgttcatccgtttcccctccagccgccgcctctcccctagggtttcctccgccgtccgctccagccgccgccatgcctcgccgcagcggaggaggaggaaggtcacgccctgctccccgccctgctccccgtgctgctccagtgaggaacccaccacagcctgcccgtcaagctcctcctcctgctcctgctccccagagcagtggtggtggcatcatgagtggaattgggtccactattgctcagggtatggcttttggcactggcagtgctgttgcacacagggctgttgatgctgtgatgggtccacgtaccattcagcatgagactgttgtctctgaagctgcttcatctatgactccaatgggcaacactgctggatctgattcatgcgacaactcttccaaggctttccaagattgcatcaaccactatggaagcgacatcagcaagtgccagttctacctcgacatgctcaacgagtgccgccgcggaggagcaggagttggttctactctttaagctgctaccttgcctgaatgggttgattgattgatcggaacttgttcgatgatgatgatatcataaataatataattggcgaactgaacttgtgccacagcttatggtctttattagttcgtggtatgctctgttgtcctgggagtatttccttgtattgatgttggaactaccttcatggcagtgggattataaatatggagtctgaatatcgcgtcctggtactttaatttgaatatatatcaatgtttcttaatagttaaaaaaaaaaaactaaaagagacacgcacagggag

SEQ ID NO: 4547 - DNA, 969 bp, Hordeum vulgare
gcacccgagacccgtctccggctataaaatgccagccctagggctaggtccgcctcagcgtgtccccattccgatccgttgctcatccattccggcgccgcctccatcctagggtttccgtctcccgccctcaccacccgccatggctcgccgcagcggaggaggaaggtcttcccgccctgctccacgtgctgctcctgtgagaaacccaccagctccagcccgtcaagctcctcctcctgctactacccagagcagcggtggcggtatcatgagcggaattgggtccactattgctcagggcatggctttcggtactggcagtgctatggcgcacagggctgttgacgctgtgatgggtccccgtaccattcagcatgagactgttgtgtctgaggccgctgcatctatgactccaatggacaatgctgctgatgataagtgtggcaacccatccaaggccttccaagattgcatcaaccactacggcagcgacatcagcaagtgccagttctaccttgacatgctgaacgagtgccgccggggaggagctggggctggttcaactctttaagctgctgctgctgctatcttgattggggcttaatttgtcggaacctgttttcagtcatgatgatgatgatatatatcttttaaataattcattggcgatattctgaacctatatgccacagcatgtctattaccctagtttgtggtctctgctgtcctgggagtatttccttgtattgatgttggaattaccttcatggcactgggtataaatatggagtttaaatatggtgtggtgcaacttagtttcatatttttcttccaattttgttgtttttggagattcttccataagttgatgcatgtgtaattgccgtaaatatgtgcagtaccagttggaattgggcaaaccttgcaaaatggatcaccaaaaccaagattaactctaaagaatcc

SEQ ID NO: 4548 - DNA, 720 bp, Hordeum vulgare
ttccggcgccgcctcctgcctagggtttccgtctcctgccctcaccacccgccgccgccgccatggctcgccgcagcggaggaggaaggtcttcccgccctgctccacgtgctgctcctgtgagaaacccaccagctccagcccgtcaagctcctcctcctgctactacccagagcagcggtggcggtatcatgagcggaattgggtccactattgctcagggcatggctttcggtactggcagtgctatggcgcacagggctgttgacgctgtgatgggtccccgtaccattcagcatgagactgttgtgtctgaggccgctgcatctatgactccaatggacaatgctgctgatgataagtgtggcaacccatccaaggccttccaagattgcatcaaccactacggcagcgacatcagcaagtgccagttctaccttgacatgctgaacgagtgccgccggggaggagctggggctggttcaactctttaagctgctgctgctgctatcttgattggggcttaatttgtcggaacctgttttcagtcatgatgatgatgatatatatcttttaaataattcattggcgatattctgaacctatatgccacagcatgtctattaccctagtttgtggtctctgctgtcctgggagtatttccttgtattgatgttggaattaccttcatggcactgggtataaatatggagtttaaat

SEQ ID NO: 4549 - DNA, 833 bp, Hordeum vulgare
ggagcgtgtccccattccgatccgttgctcatccattccggcgccgcctccatcctagggtttccgtctcccgccctcaccacccgccatggctcgccgcagcggaggaggaaggtcttcccgccctgctccacgtgctgctcctgtgagaaacccaccagctccagcccgtcaagctcctcctcctgctactacccagagcagcggtggcggtatcatgagcggaattgggtccactattgctcagggcatggctttcggtactggcagtgctatggcgcacagggctgttgacgctgtgatgggtccccgtaccattcagcatgagactgttgtgtctgaggccgccgcatctatgactccaatggacaatgctgctgatgataagtgtggcaacccatccaaggccttccaagattgcatcaaccactacggcagcgacatcagcaagtgccagttctaccttgacatgctgaacgagtgccgccggggaggagctggggctggttcaactctttaagctgctgctgctgctatcttgattggggcttaatttgtcggaacctgttttcagtcatgatgatgatgatatatatcttttaaataattcattggcgatattctgaacctatatgccacagcatgtctattaccctagtttgtggtctctgctgtcctgggagtatttccttgtattgatgttggaattaccttcatggcactgggtataaatatggagtttaaatatggtgtggtgcaacttagtttcatatttttcttccaattttgttgtttttggagattcttccataagttgatgcatgtgtaattgc

SEQ ID NO: 4550 - DNA, 861 bp, Triticum aestivum
agcgcgtccccattccgatccgttggcttcctgttcatacattctcccctcccggcgccgcctccagcctagggtttcctcccgccgtccgccgccatggctcgccgcagcggaggaggaaggtcttcccgccctgctccacgtgctgctccagtgagaaacccaccagcgccagcccgtcaagctcctccacctgctactacccagaatagcggtggtggtatcatgagtggaattgggtccaccattgctcagggcatggctttcggtactggcagtgccatggcgcacagggctgttgatgctgtgatgggtccccgcaccattcagcatgagactgttgtcggtgaggctgctgcatctatgactccaatggacaatgctgctgatgacaagtgtggcaacccttccaaggccttccaagattgcatcaaccactacggaagcgacatcagcaagtgccagttctacctcgacatgctgaacgagtgccgccgtggaggagcaggagctggtgcaactctttaagctactatctttgcttgattgcggcttaattggtcggaacctgttttcagtcatgatgatgatgatatatatctcctaaataattcattggcaatattatgaacctatgccacagcttatgtctattacctaccctagtttgtggtctctgttgtcctgggagtatttccttgtattgatgttggaattaccttcatggcagtgggtttataaatatggagtttaaatatggtgcgttgcaacttcattttttgagtacttttgagagcttgatgtccctgctgtaccctttaaatatgcttgccctaagtgcagcaccagttggagtgagac

SEQ ID NO: 4551 - DNA, 789 bp, Brachypodium distachyon
tctcattgttctgatccattgttacgctgttcatccatctcccctccccgcgccgcctccaacctagggtttcctccgttgtcctctacagccgtcgccatgcctcgccgcagctcaggaaggtctgcaccccgccctgctccacgtgctgctccagtgagaaacccaccccagccagtccgacaagctcctcctcctgctcctacccagagtggtggtggtggcatcctcagcggaattgggtctactattgctcagggcatggcttttggtactggtagtgccgtggcacacagggctgttgatgctgtaatgggtccccgtaccattcagcatgagaatgtggtctctgaggctgttgcaacccctgctcccatgggtaacactgctgggtctggttcatgtgacaacccttcaaaggccttccaagattgcataaaccactacgggagcgacatcagcaagtgccagttctacttggacatgctgaatgagtgccgtcgtggaggagccggttcaactctttaagctgtttctatgctggattggggtcgttcggaacttgtttcttcactcgtgctcgtgatatctcataaataattgattggcaaaatgatgaacttgtgtcacaacttatgtctatttgttcgtggcatactatgctgtcttgagagtatttccttttattaatgttggaactaccttcatggcactcggattatatatgttgattgaacctgctgtcttcgagctgagaaattgaatatagttctaatttttttctgtgaa

SEQ ID NO: 4552 - DNA, 901 bp, Brachypodium distachyon
ggggcccttcaagcggtccgcgtctataaaacttaaccctaggcgtgtcttcccttctcattgttctgatccattgttacgctgttcatccatctcccctccccgcgccgcctccaacctagggtttcctccgttgtcctctacagccgtcgccatgcctcgccgcagctcaggaaggtctgcaccccgccctgctccacgtgctgctccagtgagaaacccaccccagccagtccgacaagctcctcctcctgctcctacccagagtggtggtggtggcatcctcagcggaattgggtctactattgctcagggcatggcttttggtactggtagtgccgtggcacacagggctgttgatgctgtaatgggtccccgtaccattcagcatgagaatgtggtctctgaggctgttgcaacccctgctcccatgggtaacactgctgggtctggttcatgtgacaacccttcaaaggccttccaagattgcataaaccactacgggagcgacatcagcaagtgccagttctacttggacatgctgaatgagtgccgtcgtggaggagccggttcaactctttaagctgtttctatgctggattggggtcgttcggaacttgtttcttcactcgtgctcgtgatatctcataaataattgattggcaaaatgatgaacttgtgtcacaacttatgtctatttgttcgtggcatactatgctgtcttgagagtatttccttttattaatgttggaactaccttcatggcactcggattatatatgttgattgaacctgctgtcttcgagctgagaaattgaatatagttctaatttttttctgtgaaccgtgagcttttatcgaaccagttcatgttgtgacaatttgaatttcggatcgaacg

SEQ ID NO: 4553 - DNA, 805 bp, Aristolochia fimbriata
atctcatctgcctgcgacctgctagggtttacagttctgatatttctcttctcgtcggcttccgtcttcaatctcgatagtgataatgcctcgccgaagctctggaggtaggcctgctcgcccagctcctcgtgctgccccagtgcgaaacccacctcagccagccactcatgctcctcctcctgcacctgtccaaagcggtggtggatctctgcttggaggaattggttccaccatagctcaaggaatggcatttggaaccggtagtgcagttgcacacagagctgtggatgcagtgatgggaccacgtaccattcaacatgaaactgtggttagtgaggctgcggctgcggctccagctaactcaaccagtatggattcttgtggaatccactccaaggcatttcaagattgtgtcaatgccaatgggacagacattagcaagtgccagttctatctggacatgcttcacgagtgccggaggagtggtgctggcctaggtgcttgattgctcatctgggctttggtctgggattgattgtttttcttagtctttgggatgaacttccaataaattgtttaatgtttaaaatgttgcaaactgttgactattgaaatgcagattcttgccaactcacaacgtgggtgtctttattatggaagttttcatatgttcaagaacttggattagatgaagaattgtgttttatgtctggttatgctagaatgaaaatttgctgctgctaaattgcttataggcatgtccggcacgagggactgcatgtggtaaaaccactatagggaa

SEQ ID NO: 4554 - DNA, 702 bp, Triticum aestivum
attcgttcccggcctcaccccgagccagtcgtctcgctagggtttcgccgccgccgccatgcctcgccgcagctcaggaaggtctgccccacgcccagctccccgtgctgcttcactgaggaacccgccacagccagcacgccaggctcctcctccagctcctgttcgagatggtggtggctccatgtttggaggaattgggtccaccattgctcaaggtatggcgtttggcacgggtagtgccatggcacacagggctgttgactctgtattaggtccccggaccatccagcatgagactcttgccacagaagctcctgctgctgcccctgctgctccagcgatgaatgctgatgcttgcagcttccattctaaggctttccaagattgtctcaacaactatggcagcgacatcagcaagtgccagttctaccttgacatgctgaacgagtgccgccgtggtggtgtgtctgcctaagcacctctattgggactactcatgggttttcttttaactctcatggtatctcattaataagacaccgtgaaacttgaaccatctgcttgaaacgtatgtaccgtgacatcactggtccatcttgttgaagctatggttataccgtctttcctgggagtggtacattctgttatcccgtattgttggaacagacatctgtatctgtgtctctggtgatcataaat

SEQ ID NO: 4555 - DNA, 1566 bp, Brachypodium distachyon
ggcaatggcgatgcggatggggaagtacgagatggggcggacgctgggggaaggccacttcggcaaggtgaggctggccaggcacgccgacgacggccgcgccttcgccatcaagatcctcgaccgccaacgcatcctcgccatgaaaatccacgagcagataaagagggagatcgcgacgctgaagctgctcaagcatcccaacgtcgtccgcctatacgaggtttcagcaagcaagaccaagatatacatggtcctagagtatgtaaatggaggagagctattcgacaaaatcgcattaaagggtaagttgtcagagaaagaagggagaagactgttccagcagctaatggatgctgtaagctattgccacgagaagggagtttatcatagggaccttaagccagaaaatgtccttgttgatgcaaaaggaaacataaaggtttctgatttcggattaagtgcccttccacagcatcaacggaaagatggattactgcataccacatgtggcagccctaactacatagcccctgaggtccttctcaacagaggttatgatggctccatgtcagacatatggtcctgtggtgttatcctgtacgttatgcttacagggaaccttccatttgatgacgaaaatatggttgtcctttatcagaagattctgaaggggagtgttcatattcctaaatggctttcgccaagcgcccaagatattctgcgcaaaatcctggatcctaaccccattacccgcttcggtatggatggaataagggcacacgattggttcaatcaaagttatactccggctgtgcctattgatgatgatgacgataactacattggtgatgataacccacaaataaccgagcaaaatgacattcaagacaaccctgcaatcaaccagataaatgcttttcaactcattgggatgtcctcatgccttgatttatctggattttttgagaaagaggatgtctcggaaaggaaaaccagatttgcatcaaaccattcccctagttatttatttgagaagatagagagcaatgttacaaatatgggcttccaagtacagaagaacaatggcaagctaaaagtgatccaagatcgcaagggaccatcgaatccaagaggacatgaattgctattaatctctgctgaggtatttgagatcaatgaatctctttatgtagttgagctaaaaagatcatctggagattgttccttatacagacagctgtgtgcaacgctctcagatgacttgggaatatgcaaaagccagcaacctttgaagaaggattctataagacaagaactttatcgatataatagtagcttttgatagaaaaatcccctccccacatgtcctttttacttttttagcaagaggattcactaggtaaaagggccctccccttttttaacaagaggacccactaggtgccaagtatgagacatttttgtaaactaagctgtagatatacaggctaccaaatatcagagaaaagtgtagccatccgcaccgcaaaagaaacattttcaattgatacttcatgatcaata

SEQ ID NO: 4556 - DNA, 2794 bp, Brachypodium distachyon
ggattatggctaagtggggtactctgggtcaccggaacggaagagagaaccccttccagttcccgagccacagccgcagcttccgataaaagccccgcgttcgcgctctccggcctctgctcccccacctaacgttctccctcggccaaactctagcttaattctccgcgagtcctcctagagcttgacctttcttcttccatcagcccatcgagaagcttaatttgacgagccggcggagaactggacaagtcacgtggggggagcaagcagaaagcagaggagggcaatggcgatgcggatggggaagtacgagatggggcggacgctgggggaaggccacttcggcaaggtgaggctggccaggcacgccgacgacggccgcgccttcgccatcaagatcctcgaccgccaacgcatcctcgccatgaaaatccacgagcagataaagagggagatcgcgacgctgaagctgctcaagcatcccaacgtcgtccgcctatacgaggtttcagcaagcaagaccaagatatacatggtcctagagtatgtaaatggaggagagctattcgacaaaatcgcattaaagggtaagttgtcagagaaagaagggagaagactgttccagcagctaatggatgctgtaagctattgccacgagaagggagtttatcatagggaccttaagccagaaaatgtccttgttgatgcaaaaggaaacataaaggtttctgatttcggattaagtgcccttccacagcatcaacggaaagatggattactgcataccacatgtggcagccctaactacatagcccctgaggtccttctcaacagaggttatgatggctccatgtcagacatatggtcctgtggtgttatcctgtacgttatgcttacagggaaccttccatttgatgacgaaaatatggttgtcctttatcagaagattctgaaggggagtgttcatattcctaaatggctttcgccaagcgcccaagatattctgcgcaaaatcctggatcctaaccccattacccgcttcggtatggatggaataagggcacacgattggttcaatcaaagttatactccggctgtgcctattgatgatgatgacgataactacattggtgatgataacccacaaataaccgagcaaaatgacattcaagacaaccctgcaatcaaccagataaatgcttttcaactcattgggatgtcctcatgccttgatttatctggattttttgagaaagaggatgtctcggaaaggaaaaccagatttgcatcaaaccattcccctagttatttatttgagaagatagagagcaatgttacaaatatgggcttccaagtacagaagaacaatggcaagctaaaagtgatccaagatcgcaagggaccatcgaatccaagaggacatgaattgctattaatctctgctgaggtatttgagatcaatgaatctctttatgtagttgagctaaaaagatcatctggagattgttccttatacagacagctgtgtgcaacgctctcagatgacttgggaatatgcaaaagccagcaacctttgaagaaggattctataagacaagaactttatcgatataatagtagcttttgatagaaaaatcccctccccacatgtcctttttacttttttagcaagaggattcactaggtaaaagggccctccccttttttaacaagaggacccactaggtgccaagtatgagacatttttgtaaactaagctgtagatatacaggctaccaaatatcagagaaaagtgtagccatccgcaccgcaaaagaaacattttcaattgatacttcatgatcaatatttgactttgggttactacttctccttgggaaaattatatactgactatgcattaaaattgatgtaacaattgaagtgtgcatatagaagttacctgatctctatttctgttctgaagttatgtactagaactggaatgcgagcttctgtcttgctccttcagctattaaatggcttccatgacttcgaaaaaatatatgggattgttcttctagtgtgattctttcaatgcatgctcagctataagaattcgagtaatcttatagttcagattacttgcaggtacgaagaaagaattgctacaccatattttttttctggttcaagattgtaacttcaccagtaatccttgcatgagcactgcccttcactgaaatgatggaaacggttccggtctctaacaatcaatttccgatcatatgccaatgatataagtttaatggctgaatggcagtcttcacaggctctgagattctttgttattcgaagggttgatcttgcaggggtgaccagcagaccaaaagcaatagctagtttctcactatgttcagccaatgcacgcttcttagattgctcatcaatatcttgcaataccaagcttgtcattggcctgtatcctgcttgtcttaaccggtccatcatctcttccaacattttgtagatctcctcaatcctcggatgcgatctatcaccagaaacaaactcgtgaactgtgttctcccattcgatcgaacttcttccaggaaccctctgaatgttctccctccttatcgtctttctcatttctgcaacaccttcccacgagtttgcttgtgcatatatgtttgacaataacacatagtgtccatcagcaagaggatccaacactttcagttttgccatagcttcctctgcaatctctacattcttgtggatgcgacatgcgccaaggagagttctccaa

SEQ ID NO: 4557 - DNA, 1738 bp, Hordeum vulgare
tcgcgtcctgacctttacccccgccgagaggtgccggcaggccggcgaacccgcgccggcatggcggcgacggagggagcaatgcggatgggcaagtacgagatggggcggacgctgggggaggggcacttcggcaaggtgaggctggcgcggcacgccgacacgggccggcccttcgccatcaagatcctcgaccgccagcgcatcctcgccatgaagatcgacgagcagataaagacggagatcgcaacgctgaagctgctcaagcaccccaacgtcgtccgcctctacgaggttgccgcaagcaagaccaagatatacatggtcctcgagtacgtaaatggtggagagctatttgagaaaattgcactaaagggcaagctgccagagaaggaagggaggaaactgttccagcagctaatggatgctgtaagctattgccacgagaggggggtttatcatagggaccttaagcccgagaatgtcctggttgatgcgaaagggaacataaaggtctctgatttcggactgagcgcccttccacagcatcaacggaaagatggattactgcataccacatgtggcagccctaactacatagcccctgaggtccttctcaacaaaggctatgatggctccatgtcagacgtatggtcctgtggcgttatcctctatgtgatgcttacagggaatcttccgttcgatgacgaaaatatggttgtcctttatcagaagattctgaaaggggattatcgtattcctaaatggctttcgccaggagcccaagatatactgcgaaaactcctggatccgaaccccattactcgccttggcatggatggaatgagggcgcatgattggttcaatcaatgttatactccagcagtgccttttgatgatgatgacgataattacgttggcgatgacaactcccacatgaccaagcacaatggcattcaagacaaccccgcaatcaaccagatgaatgcttttcaactcattggaatgtcctcgtgccttgatttatctgggttttttgagaaagaagatgtctcagaaagaaaaatcagatttgcatcaaactatccccctacttatctatttgagaagatagagagcaatgtcataaatatgggcttccaagtacagaagaacaacggcaagctaaaagtgatccaagagcgcaagggaccaacaaatccaagagggcatggatcattattaatctctgctgaggtgtttgagatcaatgaatctctttatgttgttgagctaaaaaggtcatgtggagactgttccctatacagacagctgtgtgcaacgctctcagacgacttgggaatatgcaaaagccagcaacttctgaagaaggactccatgagacaagagctttatcgatataatagtagcttttgataaaaggcccccctaccttttttctagcaagcctactaggtaaaagggtcctccctttttgacaagaggacccaggccaccactaggtaccatgtatgtcacatttttgtaaaaccaacttgtagatatacaagttacaccattcaaataccaaatattgaccatccaaggaaaaaaaagatttctcttggatggttcatcgtaattttatcttttttactttgggctaccctccttgggcatatttgctactgactttgtgtgaaatatgatgtaaacagttgaagtgtacatataagaattacctgatctttgtttcacc

SEQ ID NO: 4558 - DNA, 3779 bp, Triticum aestivum
ataaaagcccgcgctctccctgccctccacctaacgttctcccagcctccagtccaccccaccacgcacgcgcgtgcgcgctctagctcgccctcgctctcgggtcctagctgctcccgcgtcttcttgacctttccccccgccgagaggtgccggcaggtcggcgaacccgcacccgcgcgcgctctagctctcgctgtcgagtcctatccttcttgacctttccgcccgccgagagggaggtgccggcaggccggggaacccgcgcccgcgccgcgcgcgccgcgccggcatggcggcgtcggagggagcaatgcggatgggcaagtacgagatggggcggacgctcggggaggggcacttcggcaaggtgaggctggcgcggcacgccgacaccggccgcgccttcgccatcaagatcctcgaccgccagcgcatcctcgccatgaagatcgacgagcagataaagacggagatcgcgacgctgaagctgctcaagcaccccaacgtcgtccgcctctacgaggtcgccgcgagcaagaccaagatatacatggtcctcgagtatgtaaacggaggagagctatttgagaaaatcgcactaaagggcaagctgccggagaaggaagggaggaaactgttccagcagctaatggacgctgtaagctattgccacgagaggggggtttatcatagggaccttaagcccgagaatgtcctggttgatgcgaaagggaacataaaggtctctgattttggactaagtgcccttccacagcatcaacggaaagatggattactgcataccacatgtggcagccctaactacatagcccctgaggtccttctcaacaaaggttatgatggctccatgtcagatgtatggtcctgtggtgttatcctctatgtgatgcttacagggaatcttccgttcgatgacgaaaatatggttgtcctttatcagaagattctgaaaggggattatcgtattcctaaatggctttcgccaggagcccaagatatactgcgaaaactcctggatccgaaccccattacccgccttggcatggacggactaagggagcacgattggttcaatcaaagttatactccagcagtgccttttgatgatgatgacgataattacgttggtgatgacaactcccacatgaccaagcacaatggcattccagacaaccccgcaatcaaccagatgaatgcttttcaactcatcggaatgtcctcgtgccttgatttatctgggttttttgagaaagaagatgtctcagaaagaaaaaccagatttgcatcaaactatccccctacttatctatttgagaagatagagagcaatgtcataaatatgggcttccaagtacagaagaacaatggcaagctaaaagtgatccaagagcgcaagggaccaacaaatccaagagggcatggatcattattaatttctgctgaggtgtttgagatcaatgaatctctttatgttgttgagctaaaaaggtcatgtggagactgctccctatacagacagctgtgtgcaacgctctcagacgacttgggaatatgcaaaagccagcaacttctgaagaacgactccataagacaagagctttatcgatttaatagtagcttttgataaaacggccccctacctttttctagcaaaagagcctactaggtaaaaggatcctcccttttaaacaagaggacccaccaggccaccactaggtaccatgtatgacacatttttgtaaaaccaagttgtagatatacaagttacaccattcaaataccaaatattgaccagccgaggaaaaaaagatttctcttggatggttcatgatagttttatttttattactttgggcagatttgctactgactatgtatgaaatattatgtaaacagttgaagtgtgcatataagaattacctgttctttgtttcccctcttaagtttgatgtatactggaaggcacatcttctgtccaaatccttcagcttctaaatgacttccatgactttcggaagaatataatatatgatactgtagaagattgttcttctagtgcagttctttcagatgcatgctcaagtataagaatatctagcaaccttaaacttcagaatgctagcagggtacggccaaacaattgctacaccaaaaccttttctggtataaaaggttctaagtttaccagtaatccttacatgagcactgcccttcactaaaatggtggaaacgattccggtctctaacaatcaacttgcgaccatataccaaggatataagcttaatcgctgaatggcagtcttcacaagctctgaggttctttgttattcgaagagttgaccctggaggggtggtcagcagcccaaaagcaatggccagcttctcgctatgttcagccagtgcccgcttcttagactgctcatcaatatcttgcaataccaagcttgtcattggcctatatcctgcttgtattaaccggccaatcatctcttccagcatcttgtagatctcctcaatcctcggatgcgatctatcaccggaaacaaactcgtgaactgtgttctcccattcgatcgaacttcttcccggaaccctctgaatgttctccctcttgatcgtctttctcatttctgcaacaccttcccatgagtttgcttgtgcatatatgtttgacagtaacacatagtgcccatccgcaagaggatccaacactctcagtttagccatagcttcctctgcaatctccacattcttatggatgcgacaggcgccaagaagtgttctccaaataattgcatctggctcaaaaggcatgctcctgataagctgcattgcctcctcaacatggcctgcacgacccaaaagatcgaccatgcatccgtagtgctcgacccttggcaccacaccgtgaacgtcagtcattgagctgaaatacttcttgccatcactcactagaccaacatgagtgcacgccataagaactccaacgaaggtgatctcatttggttgcagtccttgtgatatcatctctgagaacaaacttagagcatcatggccaagtccgtgattggccagtccgatgatcattgaactccaagtaagcacatccatcacaggcatagcgcggaacaccttcagagaattctcaatgtcgccgcacttggcatacatgtcaaccagagcagtacccagcttcatgtctacctcaaccctgtggctctcgacaaaccggtgcacctctgcgccaatggtcagcgcccccatgtcgctgcatgccgagagcacgctcaccatggtgatgcagtctggagcgacacgcgccgctcgcatcaccttccacagctccagcgcctccttggaccgacggcccttggcgtacgcggagatcatcgagctccacgagaaggcgtccctgtcgctcgtcgcgtcgaatatctccctcgccatgccgacgtcccctctcacggcgtacccgtggatcatcgtgttccaggacaccaggtccctgtcccgcattccgtcgaacaccctcctcgcctccgcgacctcgccgcgcgcgacgtaggccgcgagcatgacgttgcagaggaacacgtcacggcggggcgcctcgtcgaacgcggcgcgcgcgagctccgcgcggcccgacttggcgtacatctcgacgagcgcggtgcgcacgaagaggtcggcggcggcgaagccggacctgaccgcgcgcgcgtggagcgaggcgccgagcggccgggtcgcgg

SEQ ID NO: 4559 - DNA, 1977 bp, Triticum aestivum
ccgcgctctccctgccccccacctaacgttctcccagcctccagtccaccccgccacgcacgcacgcgcgcgcgcgctctagctcgctctcgctctcgggtcctagctgctcccgcgtcttcttgacctttccccccgccgagaggtgccggcaggtcggcgaacccgcgcccgcgcgcgctcaggctctcgctctcgagtcctagccgtcttgaccttcacccccgccgagagggaggtgccggcaggccggcgaaccagcgcccgcgcgcgcgccgggccggcatggcggcggcggagggggcaatgcggatgggcaagtacgagatggggcggacgctgggggaggggcacttcggcaaggtgaggctggcgcggcacgccgacaccggccgcgccttcgccatcaagatcctcgaccgccagcgcatcctcgccatgaagatcgacgagcagataaagacggagatcgcgacgctgaagctgctcaagcaccccaacgtcgtccgcctctacgaggtcgccgcgagcaagaccaagatatacatggtcctcgagtatgtaaacggaggagagctatttgagaaaatcgcactaaagggcaagctgccggagaaggaagggaggaaactgttccagcagctaatggacgctgtaagctattgccacgagaggggggtttatcatagggaccttaagcccgagaatgtcctggttgatgcgaaagggaacataaaggtctctgattttggactaagtgctcttccacagcatcaacggaaagatggattactgcataccacatgtggcagccctaactacatagcccctgaggtccttctcaacaaaggttatgatggctccatgtcagatgtatggtcctgtggtgttatcctctaagagatgcttacagggaatcttccgttcgatgacgaaaatatggttgtcctttatcagaagattctgaaaggggattatcgtattcctaaatggctttcgcaggagcccaagatatactgcgaaaactcctggatccgaaccccattacccgccttggcatggacggactaagggagcacgattggttcaatcaaagttatactccagcagtgccttttgatgatgatgacgataattacgttggtgatgacaactcccacatgaccaagcacaatggcattccagacaaccccgcaatcaaccagatgaatgcttttcaactcatcggaatgtcctcgtgccttgatttatctgggttttttgagaaagaagatgtctcagaaagaaaaaccagatttgcatcaaactatccccctacttatctatttgagaagatagagagcaatgtcataaatatgggcttccaagtacagaagaacaatggcaagctaaaagtgatccaagagcgcaagggaccaacaaatccaagagggcatggatcattattaatttctgctgaggtgtttgagatcaatgaatctctttatgttgttgagctaaaaaggtcatgtggagactgctccctatacagacagctgtgtgcaacgctctcagacgacttgggaatatgcaaaagccagcaacttctgaagaacgactccataagacaagagctttatcgatttaatagtagcttttgataaaacggccccctacctttttctagcaaaagagcctactaggtaaaaggatcctcccttttaaacaagaggacccaccaggccaccactaggtaccatgtatgacacatttttgtaaaaccaagttgtagatatacaagttacaccattcaaataccaaatattgaccagccgaggaaaaaaagatttctcttggatggttcatgatagttttatttttattactttgggcagatttgctactgattatgtatgaaatgttatgtaaacagttgaagtgtgcatataagaattacctgttctttgtttccctcttaaaaaaaaaaaaaaaactcga

SEQ ID NO: 4560 - DNA, 1964 bp, Setaria italica
gtccccttcttcagactccacctaacgttacaccggccggtcagcctccagtccaccaccgcgctcgacgtctcgacgcttccacccgccgagggccgggcgccgcacagcctcaagttccccgcgcgggcgcgcgagagcgtcttcgagcctcgccccggcccttacacccgccgcgaggtagggagctagctccggcgtcgacgcccgttcgtacgcacggcaccggggccgggcgagggcggcgcggcacggcgggcggcggaggaatgcggatggggaagtacgagatggggcggacgctcggggagggccacttcggcaaggtgaggctggcgcgccacgccgagacgggccgcgccttcgccatcaagatcctcgaccgccagcgcatcctcgccatgaagatcgacgagcagataaagagggagatcgccacgctgaagctgctcaagcaccccaacgtcgtccggctctacgaggtttcagcaagcaaaacaaaaatatacatggtccttgagtatgtaaatggaggagaattatttgacaaaatcgcattgaagggtaagctgactgagaaggaagggagaaaactattccagcagctaatcgatgccgtaggctattgccacgagaagggggtttatcatagggatctcaagccagagaatgtccttgttgatgcgaaaggaaacataaaggtatctgatttcggactaagtgcacttccacaaaatcaacggaaagatggtttgttgcataccacatgtggcagccctaactacatagcccctgaggtccttctgaacaaaggttatgatggctcgatggctgatatatggtcctgtggtgttattctatatgtaatgcttacagggaatcttccatttgacgaccaaaatgtggttgtcctttatcagaagattctgaaggggaatgctcacattccaaagtggctctcacaaggtgcccaagatatactgcgaaaaattctggatcctaacccaattacccgcatagatgtggatgggataagggcacacgattggttcaagcaaggttatactcctgctgtgccatttactgatgatgaagatatcagcatggatgaaggcagcttaaatgtgactgagcataatggcattcaagacaacatagcaatcaaccaaatcaatgctttccagctcattgggatgtcctcctgccttgatttatctggattttttgagaaagaggatgcttcggaaaggaaaatcagatttgcatcaaatcattccccagcttatttatttgagaagattgggagcatcgtcagaaaaatgggtttccaagtacataagagcaatggcaagctaaaagtgatccaagattgcaagggatcagcaaattccagagggaaagaatcattattaatttctgcggaggtgtttgagatcaatgaatctctttatgtggtcgagctaaagaagtcatctggagactgctccctgtacagaaagttgtgtgagacgctctcagaggacttgggcatatgcaaaagccagcaacttttaaagcaagattctattaaacaagaaataggtagatataatagtagcttttaacaaaaagccccctgctaactaagcagtagacagaaactaacaaaaacaatatactgaatttaaaaaacagtatattggccacgcacctattacaagtgtgcgttcttatgccttttgtcatggatctagcctttagaggcttagatcacaacaaattggcaactgacatgtatggaatttctcctaatggataatatgatgtaaacgagtaaactatacatataagggtttctgagttacctggtccctttgtttctcttatatattgatactggaatgtaagattctttccttctgaagcccctgactgactttcacgactcaagaaagagattatgatatgctgttacttcgaatgaa

SEQ ID NO: 4561 - DNA, 2003 bp, Sorghum bicolor
ctagcgagctgcttcccttcgccccctccccacctaacgttaccggccggtcagcctccagtccacccgcgcgtccgtccgccgcacggccgcagcagagcctctagttagttacttcacccttcatcggacgcgggcgggcgctgtcgtctgtcgagtcgcgcgcggccctttccgcccgccgagcgccgagccgagagctgcggtgcgcgcgcgtcgacgcccgccgcgccgaggatcgacgagcgagctccggcggcgcggcggaggaatgcggatggggaagtacgagatggggcggacgctcggggaaggccacttcggcaaggtgaagctggcgcggcacgcggacacgggcaggaccttcgccatcaagatcctcgaccgccagcgcatcctcgccatgaagatcaacgagcagatcaagagggagatcgccacgctgaagctgctcaagcaccccaacgtcgtccgcctctacgaggtttcagcaagcaagaccaaaatatacatggtccttgagtatgtaaatggaggagagctattcgacaaaatcgcgttgaagggtaagctgacagagaaggaagccagaaaactattccagcagctaatagatgccgtggcatattgccacgagaagggggtttatcatagggacctcaagccagagaatgtccttgttgatgcaaaaggaaacataaaggtttctgatttcggactaagtgcacttccacaaaaccaacgaaaagatggtttgttgcataccacatgtggcagccctaactacatagcccccgaggtccttctgaacaaaggttatgatggctcgatgtctgacatatggtcctgtggtgctattctatatgtaatgcttacagggaatcttccctttgacgaccaaaatgtggttgtcctttatcagaagattctgaaggggaatgctcacattccaaagtggctctctcaaggtgcccaagatatactgagaaaaatcctggatcctaacccgattacgcgcatagatgtggatggaataagggcacatgattggttcaagcaaggctatgctgctgctgtgccatttaatgatgatgaagatatcagcatagatgaagacagcctacatatgactgagcgtaatggcattcaagacaagatagcaatcaaccaaatcaatgctttccagctcattgggatgtcctcctgccttgatctatctggattttttgagaaagaggatgcttctgaaaggaagatcagatttgcatcaaattattccccagcttatttatttgagaagattgaaagcattgtcagaaaaatgggtttccaggtacataaaagcaacggcaagctaaaagtgatccaagattgcaagggactagcaaagtcaagagggcaagaattattattaatttctgctgaggtgtttgagatcaatgaatctctttatgttgtcgaactaaagaagtcatctggagactgctccctgtacagaaagctgtgtgagactctctcagaggacttggggacacgcaaaagccagcaatttttaaagcaggattctatccgacaagagataggtagatacaatagtagcttttaacaaagagccccttactaaataggctatagccacaaactaacacaaacaatatactgaatttaaaacagtatattggccatgcaccttttacaaatgtgctccattatgccaattgtcatgaaaccttaagaggcttagactatgacagattggcaactgacaatgtatcgaactcctaagggataatatgatgtaaacaagtaaactacacatataagagattcagagttacctggtctctatgtttctcttatatattgatattggaatgtaagattgcttgcttttgaagcccctggctgacttccatgactcaagaaacaaattatgatatgctgttcgttgaaagaagtccttgcagatgcatgttcaactaaaagaatacctgtgagaacca

SEQ ID NO: 4562 - DNA, 2016 bp, Sorghum bicolor
ccgatatccatcgatggttgggtataaacccgcacgcgctagcttcttggcgatggccgctagcgagctgcttcccttcgccccctccccacctaacgttaccggccggtcagcctccagtccacccgcgcgtccgtccgccgcacggccgcagcagagcctctagttagttacttcacccttcatcggacgcgggcgggcgctgtcgtctgtcgagtcgcgcgcggccctttccgcccgccgagcgccgagccgagagctgcggtgcgcgcgcgtcgacgcccgccgcgccgaggatcgacgagcgagctccggcggcgcggcggaggaatgcggatggggaagtacgagatggggcggacgctcggggaaggccacttcggcaaggtgaagctggcgcggcacgcggacacgggcaggaccttcgccatcaagatcctcgaccgccagcgcatcctcgccatgaagatcaacgagcagatcaagagggagatcgccacgctgaagctgctcaagcaccccaacgtcgtccgcctctacgaggtttcagcaagcaagaccaaaatatacatggtccttgagtatgtaaatggaggagagctattcgacaaaatcgcgttgaagggtaagctgacagagaaggaagccagaaaactattccagcagctaatagatgccgtggcatattgccacgagaagggggtttatcatagggacctcaagccagagaatgtccttgttgatgcaaaaggaaacataaaggtttctgatttcggactaagtgcacttccacaaaaccaacgaaaagatggtttgttgcataccacatgtggcagccctaactacatagcccccgaggtccttctgaacaaaggttatgatggctcgatgtctgacatatggtcctgtggtgctattctatatgtaatgcttacagggaatcttccctttgacgaccaaaatgtggttgtcctttatcagaagattctgaaggggaatgctcacattccaaagtggctctctcaaggtgcccaagatatactgagaaaaatcctggatcctaacccgattacgcgcatagatgtggatggaataagggcacatgattggttcaagcaaggctatgctgctgctgtgccatttaatgatgatgaagatatcagcatagatgaagacagcctacatatgactgagcgtaatggcattcaagacaagatagcaatcaaccaaatcaatgctttccagctcattgggatgtcctcctgccttgatctatctggattttttgagaaagaggatgcttctgaaaggaagatcagatttgcatcaaattattccccagcttatttatttgagaagattgaaagcattgtcagaaaaatgggtttccaggtacataaaagcaacggcaagctaaaagtgatccaagattgcaagggactagcaaagtcaagagggcaagaattattattaatttctgctgaggtgtttgagatcaatgaatctctttatgttgtcgaactaaagaagtcatctggagactgctccctgtacagaaagctgtgtgagactctctcagaggacttggggacacgcaaaagccagcaatttttaaagcaggattctatccgacaagagataggtagatacaatagtagcttttaacaaagagccccttactaaataggctatagccacaaactaacacaaacaatatactgaatttaaaacagtatattggccatgcaccttttacaaatgtgctccattatgccaattgtcatgaaaccttaagaggcttagactatgacagattggcaactgacaatgtatcgaactcctaagggataatatgatgtaaacaagtaaactacacatataagagattcagagttacctggtctctatgtttctcttatatattgatattggaatgtaagattgcttgcttttgaagcccctggctgacttccatgactcaagaaacaaattatgatatgctgttcgttgaaagaa

SEQ ID NO: 4563 - DNA, 1622 bp, Panicum virgatum
  misc_feature (362)..(362): n is a, c, g, or t
  misc_feature (370)..(370): n is a, c, g, or t
  misc_feature (372)..(372): n is a, c, g, or t
  misc_feature (384)..(384): n is a, c, g, or t
  misc_feature (390)..(390): n is a, c, g, or t
  misc_feature (466)..(466): n is a, c, g, or t
  misc_feature (519)..(519): n is a, c, g, or t
  misc_feature (552)..(552): n is a, c, g, or t
  misc_feature (582)..(582): n is a, c, g, or t
  misc_feature (627)..(627): n is a, c, g, or t
  misc_feature (660)..(660): n is a, c, g, or t
  misc_feature (720)..(720): n is a, c, g, or t
  misc_feature (1384)..(1384): n is a, c, g, or t
  misc_feature (1621)..(1621): n is a, c, g, or t
atggggaagtacgagatggggcggaggctcggggagggccacttcggcaaggtgaagctggcgcggcacgccgagacgggccgcgccttcgccatcaagatcctcgaccgccagcgcatcctcgccatgaagatcgacgagcagataaagagggagatcgccacgctgaagctgctcaagcaccccaacgtcgtccggctgtacgaggtttcagcaagcaaaacaaaaatatacatggtccttgagtatgtaaatggaggagaactatttgataagatcgcattgaagggtaagctgacagagaaggaagggagaaaactattccagcagctaatggatgccataggctattgccacgagangggggtcnancatagggacctnaagccngagaatgtccttgttgatgcaaaaggaaacataaaggtttctgatttcggactaagtgcacttccgcaaaatcaanggaaagatggtttgttgcatactacatgtggcagccctaactacatagccccngaggtccttctgaacaaaggttatgatggctcnatgtctgacatatggtcctgtggtgtgatnctgtacgtaatgcttacagggaatcttccatttgatgaccaaaanatggttgtcctttaccagaagattctgaagggnaatgctcacattccaaaatggctctcacaaggtgcccaagatatactgcggaaaattctngatcctaaccctattacccgcatagacttggatggaataagggcacacaattggttcaagcaaggttatgctcctgctgtgccatttaatgatgatgaagatatcagtatgtctgaaggcagcctaaatatgactgagcataatggcattcaaggcaacatagcaatcaaccaaatcaatgctttccagctcattgggatgtcctcctgccttgatttatccggattttttgagaaagaggatgcttcggaaaggaaaatcagatttgcatcaaatcattccccggcttatttatttgagaagattgagagcattgtcagaaaaatggggttgcaagtacataagagcaatggcaagctaaaagtgatccaagattgcaagggaccagcaaattccagagggctagaatcattattagtttctgcagaggtgtttgagataaatgaatctctttatgttgtcgagctaaagaagtcatctggagactgctccctgtacagaaagttgtgtgagacgctttcagaggacttgggaatatgcaaaagccagcaactcctaaagcaagattctatcaaacaagaaatagttagatataatagtagcttctaacaaagagccccttactaactaggctgtagacagaaactaacgcaaacaatatacngaattttaaacagtatattgtccatgcacctattacaaatgtgctctcttacgccttttttcatgaatctagccttaagaggcttagattacgtcaaattggcaactgacatgtatggaactcctcctaagcaataatatgatgtaaacaagtaaactatacatatatgagtttcagagttacctggtctctgtttctcttacatattgataaatgaatgtaagattctttgattcng

SEQ ID NO: 4564 - DNA, 1829 bp, Zea mays
agcgctgctctgcttccctccctccgctccgcccccacctcctctaacgttacgtcagcctctagtcgtccaccagccggagcagagcctcttgttggtagcggatcggaatgcggatgggcaagtacgagatggggcggacgctcggggagggccacttcggcaaggtgaggctggcgcggcacgcggacacgggccggcccttcgccatcaagatcctcgaccgccagcgcatcctcgccatgaagatccacgaccagatcaagagggagatcgcgacgctgaagctgctcaagcaccccaacgtcgtccgcctctacgaggtttccgcaagcaagaccaaaatatacatggtgcttgagtacgtcaatggaggagagctgtttgacaagatcgcgttgaagggtaagctgacggagaaggaagggaggaaactgttccagcagctcatagatgccgtgggatactgccacgagaagggggtttatcacagggacctcaagccagagaatgtccttgttgatgcaaaaggaaacataaaagtttctgatttcggattaagtgcccttccacagaaccaacaaaaagatggtttgttgcataccacatgtggcagccctaactacatagcccctgaggtccttctgaacaaaggttatgacggctcgatatctgacgtatggtcctgtggtgttattctatatgtaatgcttacagggaatcttccattcgacgaccaaaatgtggttgtcctttaccagaagattctcaaggggaatgctcacattccaaagtggctctcccaaggtgcccaagatatactgagaaaaatcctggatcctaacccggttacacgcatagatgtggatggaataagggcacatgattggttcaagcaaggctatgctccagctatgccatttagcgatgatgaagaagatatcagcatggatgaagacagcctaaacatcaccgagcataatgacatccaagacaagatagcaatcaaccaaatcaatgctttccagctcattggaatgtcctcctgccttgatctatccggattttttgagaaagaggatgtttctgaaaggaaaatcagatttgcatcaaattattccccagcttatttatttgagaagattgagagcattgtcagaaaaatggggttccaggtacataagagcaacggcaagctaaaagtgatccaagactgcaagggactagcaaattcaagagggcaagagtcattattaatttctgctgaggtgtttgagatcaatgaatatctttatgttgtcgaactaaagaagtcatctggagactgctccctgtacagaaagttgtgtgagacgctctcagaggacttgggcacatgcaaaagccagcaatttttaaagcaggactctatcagacaagatataggtagatataatagtagcttttaacaaagagacacttactaaatagcctatagacacaaactaacacaaacaatatactgaatttaaaacagtatattgtccatgcacctattttaaatgtgctctcttatgccttttgtcatgaaacctcaagaatcttagtttatgacaaattggcatctgacgatgtattgagctcctaagggataatatgatgtaaacaagtaaactacacatataagagattcagagttacctggtctctatgtttctctagcctaccccaacttgcttgggataaaaggctttgttgttgttgttggaatgtaagattgtttgtttttgaagcccctggttgacttccatgactcaagaaaaattgtgatatgttgttcgttgaaagaa

SEQ ID NO: 4565 - DNA, 1594 bp, Pennisetum glaucum
cgagatggggaggacgctcggggaggggcacttcggcaaggtgaagctggcgcgccacgccgagacgggccgcgccttcgccatcaagatcctcgaccgccagcggatcctcgccatgaagatcgacgagcagataaagagggagatcgccacgctcaagctgctcaagcacccccacgtcgtccggctctacgaggtttcagcaagcaaaacaaaaatatacatggtccttgagtatgtaaatggaggagaattatttgacaaaatcgcattgaagggtaagctgacagagaaggaagccagaaaactattccagcagctaatcgatgccgtagcctattgccacgagaagggagtttatcatagggatctcaagccggagaatgtccttgttgatgcgaaagggaacataaaggtatctgatttcggactaagtgcacttccacaaaatcaacggaaagatggtttgttgcacaccacatgtggcagccctaattacatagccccagaggtccttataaacaaaggttatgatggctcgatggctgatatatggtcctgtggtgttattctatatgtaatgcttacagggaatcttccattcgacgaccaaaatgtggttgtcctttatcagaagattctgaaggggaatgctcacattccaaagtggctctcacaaggtgcccaagatatactgcgcaaaattctggatcctaacccaattacccgcatagatgttgatggaataagggcacatgattggttcaagcaaggttatactcctgctgtaccatttactgatgatgaagatatcagcatggatggaggcggcttaaatgtgaccgagcataatggcattgaggaaaacataccaatcaatcagatcaatgctttccagctcattgggatgtcctcctgcctcgatttatctggattttttgagaaagaggatgcttccgaaagaaaaatcagatttgcatcaaatcattccccagcttatttatttgagaagattgagagcatcgtaagaaaaatgggtttccaagtacacaagagtaacggaaagctaaaagtgatccaagattgcaagggaccggcaaattccaaagggaaagcatcattattagtttctgcggaggtgtttgagatcaatgaatctctttatgttgttgaactaaagaagtcatctggagactgctccctgtacagaaagctgtgtgagacactctcagaggacttgggcatatgcaaaagccagcaacttttaaagcaagattctattaaacaagatataggtagacataatagtagcttttaacaaaaagccccatgctaactaagctgtagacagaaactaacaaaaaacaatatactgaatttaaaaacagtatattggccatgcacctattacaagtgtgctttcttatgccttttgtcatgaatctagccttaagaggcttagaccacgacaaattggcgactgacatgtatggaatttctcctaaggataatatgatattatgatgtaaacgagtaactatacatataagggtttctgagttacctggtctctatgtttctgttatatatatat

SEQ ID NO: 4566 - DNA, 1915 bp, Zea mays
ccgcggcctccccgatcgccatcgacggtcccgtataaacccgcctccctgcgcttgggcagcttccctcccctcccctcccctccccacctaacgttaccggccggtcagcctctagtccacccgagcgcggccggccggtccgtccgtccgccgcagcagagcctctagcctgtagccagttggttccccgcccgcggccggcgacagatcgatgcggcgtgcgtggacgcccgccgacgagcgagcagcgacgacgacgagcgagcaccggcggcggaggcggatggggaagtacgagatggggcggacgctcggggagggccacttcgggaaggtgaggctggcgcgggacgcgggcacgggccggtccttcgccatcaagatcctcgaccggcagcgcatcctcgccatgaagatcgacgagcagatcaagagggagatcgcgacgctgaagctgctcaagcaccccaacgtcgtccgcctgtacgaggtttcagctagcaagaccaagatatacatggtcctcgagtacgtgaacggaggagagctatttgacaaaatcgcactcaagggtaagctgacggagaaggaagggaggaaactgttccagcagctgatagacgccgtgggatactgccacgagaagggggtttgtcacagggacctcaagcctgagaatgtcctcgttgatgcaaagggaaacataaaggtttctgattttggactaagcgcccttccgcaaaaccaacgaaaagatggtttgttgcataccacatgtggcagccctaactacatagccccggaggtccttctgaacaaaggttacgatggctcggtatctgacgtgtggtcctgtggtgttattctatatgtaatgcttacagggagtcttccatttgacgaccaaaatatggttgtcctctatcagaagattctgaaagggaatgctcacattccaaagtggctctctcaaggtgcccaagatctactgcgaaagatcctggatcctaacccgatcacgcgcgtagatgtggatgggataagggcacacgattggttcaagcaaggctacgctccttctgcgccgtttaatgatgacgaagaagatatcaacgtggatgaagaagacagcctaaatatgactgagaatggcattcaagacaagatagcaatcaaccaaatcaatgctttccagctcattgggatgtcctcctgccttgatctatccggattttttgagaaagaggatgcttctgaaaggaaaatcagattcgcatcaaattatcccccagcttacttgtttgagaagatcgagagcattgtcagaaaaatgggtttccaggtacacaagagcaacggcaagctaaaagtgatccaagattgtaagggactagcaaatttaagagggaaagagtcattattaatttctgctgaggtgtttgagattaatgaatccctttacgttgtcgagctaaaaaagtcatctggagactgctccctgtacagaaagttgtgtgagacgctctcggaggacttgggcacatgcaaaagccagcaatttttaaagcaggattctatcagacaagagataggtagacataacagtagcttttaactaagagcccccttgttaaataggctatagacacaaactaacacaaacaatatactgaatttaaaacagtatattgggcatgcacctattacagatgtgctctctcatgccttttgtcatgaaaccttaagagacttagactatgaaaaattggcaactgacaatgtatcgaactccaaagggataatatgatgatgtaaacaagtaaaatacgcatataagtgattcagagctacctggtctctatgtttctcttatatattgattgatattggaacgtaagattgtttgcttttg

SEQ ID NO: 4567 - DNA, 1348 bp, Leymus cinereus x Leymus triticoides
ccgttgctgtcgccgttgctgtcgcttgacctttccgtccgccgagaggcgccggcaggtcggcgaacccgcgcgccggcatggcggcgtcggagggagcaatgcggatgggcaagtacgagatggggcggacgctcggggaggggcacttcggcaaggtgaggctggcgcggcacgccgacaccggccgcgccttcgccatcaagatcctcgaccgccagcgcatcctcgccatgaagatcgacgagcagataaagacggagatcgcgacgctgaagctgctcaagcatcccaacgtcgtccgtctctacgaggtttccgcgagcaagaccaagatatacatggttcttgagtacgtaaatggaggagagctatttgagaaaatcgcactaaagggcaagatctcagagaaggaagggaggaaactgttccagcagctaatggatgctgtaagctattgccacgagaggggggtttatcatagggaccttaagcccgagaatgtcctggttgatgcgaaagggaacataaaggtctctgattttggactaagtgcccttccacagcatcaacggaaagatggattactgcataccacatgtggcagccctaactacatagcccctgaggtccttctcaacaaaggttatgatggctccatgtcagacgtatggtcctgtggcgttatcctctatgtgatgcttactgggaatcttccgttcgatgacgaaaatatggttgtcctttatcagaagattctgaaaggggattatcgtattcctaaatggctttcgccaggagcccaagatatactgcgaaaactcctggatccgaaccccattacccgccttggcatggacggaataagggcgcacgattggttcaatcaaagttatactccagcagtgccttttgatgatgatgacgataattacgttggtgatgacaactcccacatgaccaagcacaatggcattcaagacaaccccgcaatcaaccagatgaatgcttttcaactcattggaatgtcctcgtgccttgatttatctgggttttttgagaaagaagatgtctcagaaagaaaaaccaggtttgcatcaaactatccccctacttatctatttgagaagatagagagcaatgtcataaatatgggcttccaagtacagaagaacaatggcaagctaaaagtgatccaagagcgcaagggaccaacaaatccaagggggcatggatcattattaatttctgctgaggtgtttgagatcaatgaatctctttatgttgttgagctcaaaaggtcatgtggagactgctccctatacagacagctgtgtgcaacgctctc

SEQ ID NO: 4568 - DNA, 907 bp, Triticum aestivum
ctaacacacccgcgcgctagctagtgtcatccacactctagcttctagcagtccggaggccggcggcaaaagcaaagcaaagcaagcagcttggtagcgatggcgtccacctcctgcttcctccaccagtccaccgcccgcctcggcgcgtcgccgcgcgtcgcggccgcgccacgcagcgcccagctgttcgtctgcaaggcccagcagaagcagcagcaggacgccgccgccgtggatcagagcgacgtctctcgccgcgccgcgctcgcgctcttcgccggcgtcgccgccgtcagcgccaaggtcagccccgccgccgccgcctacggagaagcagccaacgtgttcggcaagcccaagacgaacacggagtacatcgcgtacaacggcgacgggttcaagctgctgatcccgtccaagtggaaccccagcaaggagcgggagttcccggggcaggtgctccgctacgaggacaacttcgacgccaacagcaacgtctccgtcatcatccagcccacctccaagaagaccatcaccgagtacggctcccccgaggagttcctctcccaggtcgacttcctcctcggcaagcaggccttcggcggcagcaccgactccgagggtgggttcgagaccggcgcggtggccacggccaacgtgctggagagctccacgcccgtggtggacggcaagcagtactacagcgtctccgtgctgacaaggacggcggacggcgacgagggcggcaagcaccagctcatcacggccaccgtctccgacggcaagctctacatctgcaaggcgcaggccggcgacaagaggtggttcaagggcgccaggaagggcgtcgagaaggccgccgcctccttcagcgtcgcataataatgaaattgtgctgcatcgg

SEQ ID NO: 4569 - DNA, 907 bp, Triticum aestivum
ctaacacacccgcgcgctagctagtgtcatccacactctagcttctagcagtccggaggccggcggcaaaagcaaagcaaagcaagcagcttggtagcgatggcgtccacctcctgcttcctccaccagtccaccgcccgcctcggcgcgtcgccgcgcgtcgcggccgcgccacgcagcgcccagctgttcgtctgcaaggcccagcagaagcagcagcaggacgccgccgccgtggatcagagcgacgtctctcgccgcgccgcgctcgcgctcttcgccggcgtcgccgccgtcagcgccaaggtcagccccgccgccgccgcctacggagaagcagccaacgtgttcggcaagcccaagacgaacacggagtacatcgcgtacaacggcgacgggttcaagctgctgatcccgtccaagtggaaccccagcaaggagcgggagttcccggggcaggtgctccgctacgaggacaacttcgacgccaacagcaacgtctccgtcatcatccagcccacctccaagaagaccatcaccgagtacggctcccccgaggagttcctctcccaggtcgacttcctcctcggcaagcaggccttcggcggcagcaccgactccgagggtgggttcgagaccggcgcggtggccacggccaacgtgctggagagctccacgcccgtggtggacggcaagcagtactacagcgtctccgtgctgacaaggacggcggacggcgacgagggcggcaagcaccagctcatcacggccaccgtctccgacggcaagctttacatttgcaaggcgcaggccggcgacaagaggtggttcaagggcgccaggaagggcgtcgagaaggcccccccctccttcagcgtcgcataataatgaaattgtgctgcatcgg

SEQ ID NO: 4570 - DNA, 1003 bp, Sorghum bicolor
tgactgaagaaaatcgatggatccttgcatgcatggaaatggagctctccttagtctttgttgttctcatgtacaatcaaaggaacacatacacaagcatgctctctacgttgtgcatcccctgatgaagccaaaccatcaaagaaataataatcccggccgatgcagcacaatttcattattatgcgacgctgaaggaggcggcggccttctcgacgcccttcctggcgcccttgaaccacctcttgtcgccggcctgcgccttgcagatgtagagcttgccgtcggagacggtggccgtgatgagctggtgcttgccgccctcgtcgccgtccgccgtccttgtcagcacggagacgctgtagtactgcttgccgtccaccacgggcgtggagctctccagcacgttggccgtggccaccgcgccgacctcggagtcggtgctgccgccgaaggcctgcttgccgaggaggaagtcgacctgggagaggaactcctcgggggagccgtactcggtgatggtcttcttggaggtgggctggatgatgacggagacgttgctgttggcgtcgaagttgtcctcgtagcggagcacctgccccgggaactcccgctccttgctggggttccacttggacgggatcagcagcttgaacccgtcgccgttgtacgcgatgtactccgtgttcgtcttgggcttgccgaacacgttggctgcggcggcggcggggctgaccttggcgccgacggcggcgacgccggcgaagagcgcgagcgcggcgcggcgagagacgtcgctctgatccacggcggcggcgtcctgctgctgcttctgctgggccttgcagacgaacagctgggcgctgcgtggcgcggccgcgacgcgcggcgacgcgccgaggcgggcggtggactggtggaggaagcaggaggtggacgccatcgctaccaagctgcttgctttgctttgcttttgccgccggcctccggactgctagaagct

SEQ ID NO: 4571 - DNA, 1078 bp, Sorghum bicolor
tgactgaagaaaatcgatggatccttgcatgcatggaaatggagctctccttagtctttgttgttctcatgtacaatcaaaggaacacatacacaagcatgctctctacgttgtgcatcccctgatgaagccaaaccatcaaagaaataataatcccggccgatgcagcacaatttcattattatgcgacgctgaaggaggcggcggccttctcgacgcccttcctggcgcccttgaaccacctcttgtcgccggcctgcgccttgcagatgtagagcttgccgtcggagacggtggccgtgatgagctggtgcttgccgccctcgtcgccgtccgccgtccttgtcagcacggagacgctgtagtactgcttgccgtccaccacgggcgtggagctctccagcacgttggccgtggccaccgcgccgacctcggagtcggtgctgccgccgaaggcctgcttgccgaggaggaagtcgacctgggagaggaactcctcgggggagccgtactcggtgatggtcttcttggaggtgggctggatgatgacggagacgttgctgttggcgtcgaagttgtcctcgtagcggagcacctgccccgggaactcccgctccttgctggggttccacttggacgggatcagcagcttgaacccgtcgccgttgtacgcgatgtactccgtgttcgtcttgggcttgccgaacacgttggctgcggcggcggcggggctgaccttggcgccgacggcggcgacgccggcgaagagcgcgagcgcggcgcggcgagagacgtcgctctgatccacggcggcggcgtcctgctgctgcttctgctgggccttgcagacgaacagctgggcgctgcgtggcgcggccgcgacgcgcggcgacgcgccgaggcgggcggtggactggtggaggaagcaggaggtggacgccatcgctaccaagctgcttgctttgctttgcttttgccgccggcctccggactgctagaagctagagtgtggatgacactagctagcgcgcgggtgtgttaggccgcggcgtacgtgttaacgatgggaggggaggcg

SEQ ID NO: 4572 - DNA, 1106 bp, Saccharum officinarum
taacacgccacggcggcctagctaacacacccgcgcccgcccgcgctagtgccatccacactcttctcccagtcctgaggcaggcggcaaaaagcaagcaaagaaagcagcttggtagccatggcgtccacctcctgcttcctccaccagtccaccgcccgcctcggcgcgtcgccgcgcctggcggccccgcgcagcagccagctgttcgtctgcaaggcccagaagcaggacgccgcggatcagagcgacgtctctcgccgcgccgcgctcgcgctcttcgccggcgtcgccgccgtcggcgccaaggtgagccccgccgccgccgcctacggagaagcagccaacgtgttcggcaaggtcaagacgaacacggactacatcgcgtacagcggcgacgggttcaagctgctgatcccgtccaagtggaaccccagcaaggagcgggagttcccggggcaggtgctccgctacgaggacaacttcgactccaacagcaacgtgtccgtcatcatccagcccacctccaagaagaccatcaccgagtacggctcccccgaggagttcctctcccaggtcgacttcctgctcggcaagcaggccttcggcggcaagaccgactccgagggtgggttcgagaccggcgcggtggccacggccaacgtcctggagagctccacccccgtggtggacggcaagcagtactacagcgtgtcggtgctgacgaggacggcggacggcgacgagggcggcaagcaccagctcatcacggccaccgtctccgacggcaagctctacatctgcaaggcgcaggccggcgacaagaggtggttcaagggcgccaggaagggcgtcgagaaggccgccgcctccttcagcgtcgcataatataatgtaattgtgcatcgatcgggattattgtttctttgatggtttggtttcgtcagggatgcactgcacgcaccgtgtgtacgtagagaggccaggccggcccaggccaggctgagcatgcttgtgtatgtgttcctttgattgtacatgagaacaacatgttggaattgatctcccaccgattaggcccaacggcctaattgggccttgaaaaa

SEQ ID NO: 4573 - DNA, 1388 bp, Zea mays
ccgccctagcgtgtggtatagcagagacaccatgagacgagacagagctggcaaacggagagggggagagagccgtgtgtgtgtgtgtcggccgaaacatcgcgatccgacgtggcccaatggcgcgtcgcggaaccttatcccgcggcgtcgcccctgatccgaactccatccgctgcccggggcgccgcgcaccacaagtaggcgcgccccggcgcgcgaccccaccgccgccccgcctcccatcgttacgttagtcgtccgcccgcgctagtgccatccacactcttctcttctccccggccggaccggagtcaggcagccgaagcaagaaaagcaagcggctttggaagttgggatccatggcgtccacctcgtgcttcctccaccagtccaccgcccgcgtggccgcgccgtcgccgcgcctcgccgccccgccgcgcagcgcgcaactgttcgtctgcaaggcccagaagcagcaggccgccgcggcggagagcgacgtgtcgcgccgcgccgcgctcgcgctcctcgccggcgtcgcggccgtcggcgccaaggcgagccccgccgccgccgcctacggggaagcagccaacgtgttcggcaagaccaagaagaacacggacttcatctcctacgtcggcgacggcttcaagctgctgatcccgtccaagtggaaccccagcaaggagcgggagttccccgggcaggtgctccgctacgaggacaacttcgacgccaacagcaacgtgtccgtcatcatccagcccacctccaagaaggccatcaccgagtacggctcccccgaggagttcctctcgcaggtcgactacctgctcggcaagcaggcctacggcggcaagaccgactccgagggcgggttcgagaccgacgccgtggccaccgccaacgtgctggagagctccacccccgtggtggacggcaagcagtactacagcatcaccgtgctgaccaggacggcggacggcgacgagggcggcaagcaccagctcatcaccgccaccgtctccgacggcaagctctacatctgcaaggcgcaggccggcgacaagcggtggttcaagggcgccaggaagggcgtcgagaaggccgccgcctccttcagcgtcgcgtgaccgacgtaaactattgtttctttgatgcttttcatcagggatgcacatgcacgcaccgtgtgtacgtagagagctaggcatggcctggctcgccatgcttgttgtgtgtttctttgattgtacatgagaggacccgtttctgctgccatccaagttgtttgagaaatcttggtactaatattgcttcgtcttttttttttaaaaaaaaaaacttcctgccatttagccagagattctaaaaggcacttt

SEQ ID NO: 4574 - DNA, 1101 bp, Zea mays
tccaaactccatctgccggggcgccacgcaccacaggcacaggtacggtatgcgaccccacggccgcctcccctcgttaacacgtcgcggcctcgctaacgcgcccgcgctagcgcgagtggtggcacccacgcacactcttctcccccacagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcccgccgccgcggcatacggagaagcagccaacgtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaacgtgtccgtcatcatccagcccacgtccaagaagaccatcgccgactacggctctcccgaggagttcctctcccaggtcgactacctgctcggcaggcaggcctacggcggcaagaccgactccgagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgcctcctccttcagcgtcgcatgatgatgtaattttatttcttcgatgggatgggatgcacgcactacgtagagagcttggctaggccaggcctggctgagcacgcttgtgtgttccttcgactgtacatgagaacaaagactaaggagagctccattcccgtac

SEQ ID NO: 4575 - DNA, 1220 bp, Panicum virgatum
gactctagaggagacagtcgcaggaggccaggagaagcagccggcgagcagcaagccatggcgtccaccacctgcttcctccaccagtccaccgcccgcttcggcgccgccgccgcctcggcgcgcccccaggcgccgcgggcccagcagctcgtgtgcagggcgcagaagccgcaggacgccgccgccgagggcgacgccgcggtcacccgccgcgccgcgctcacgctcctcgcgggcgccgccgccgtcggcgccaaggtgaaccccgccgccgccgcctacggagaagcagccaacgtgttcgggaagcccaagacgaacacggaattcatcgcctacagcggcgacggcttcaagctgctgatcccgtccaagtggaaccccagcaaggagcgcgagttccccggccaggtgctccgctacgaggacaacttcgacgccaacagcaacgtctccgtcatcgtccagcccaccaccaagaagaccatcaccgactacggctcgcccgaggagttcctcgcccaggtcgactacctcctcggcaagcaggcctacgccggcaagacggactccgagggcgggttcgagaccgacgcggtggccacggccaacatcctggagagctcggcgccagtggtggacgggaagcagtactacagcgtgtccgtgctgaccaggacggcggacggcgacgagggcggcaagcaccagctcatcacggccaccgtctcggacggcaagctctacatctgcaaggcgcaggccggcgacaagaggtggttcaagggcgccaggaagggcgtcgagaaggcagccagctccttcagcgtcgcataagcagtgcacgcatcatctgtgtgccggaatttgtttcttttggttcagggatgcttacgtagatagaggttgggcatgcgtgtgcgctccggcctttgattgtacatgagaacaaagaccaaggagagctccatttcgtccctgcaaggattgatttctgctctcacgatgtttaagaactcctagtactaataatgcttcgtttttgtatcttggtgctctaggtagggggtgcgtgatatactagtacttcctcccatcatctaaaagtagatagtagtgcaagcttcttccagggggatttcttctccacattcatccacacaagaacatttgacacacaatatagtcatgaccaccagctcactgatattttgtca

SEQ ID NO: 4576 - DNA, 1412 bp, Setaria italica
ctcccctcgttatcactcgtagcgtccggtgcatccacaagtcttctagaggaagatagtagcagcagcagcaggagccagctagcgagcaacgagcggcagccatggcgtccacctcctgcttcctcctccagtccaccgctcgcctcggcgccgccgccgcctcggcgcgcccccaggtgccgcgggcccagctcgtctgcaaggcgcagaggcaggacgccgccgccgagagcggtgacgccgccgcggtcacccgccgcgccgcgctcacgctcctcgccggcgtcgccgccgtcggcgccaaggtgagccccgccgccgccgcctacggagaagcagccaacgtgttcgggaagcccaaggcgaacacggacttcatcgcctacagcggcgacgggttcaagctgctgatcccgtccaagtggaaccccagcaaggagcgcgagttccccggccaggtcctccgctacgaggacaacttcgacgccaacagcaacgtctccgtcatggtccagcccaccaccaagaagaccatcaccgagttcggctccccggagcagttcctcgcccaggtcgactacctcctcggcaagcaggcctacagcggcaagactgactccgagggcgggttcgagaccgacgcggtggcgacagccaacatcctggagagctcggcgccggtggtggacgggaagcagtactacagcgtgtcggtgctgacgaggacggcggacggcgacgagggcggcaagcaccagctcatcacggccaccgtctcggacggcaagctctacatctgcaaggcgcaggccggcgacaagaggtggttcaagggcgccaggaagggcgtcgagaaggcggccagctccttcagcgtcgcataagcattcttttccttggttttcaggggtgcaccgtgtgtacgcagatagagaggttgggctgggcatgcatgtgtgctcctttgattgtacatgagaacaaaggccaaggagagcaaggattcatttctgctctcatccacgatgtctaagaactcttagtatcttaatgcttcgtttttgtatcttgctgtgagctctaggtagggggtgcgtcatcatataccagtacttctttccatcatctaaaagtagatactagtgcttcaagtttttccggggggatttcgattctcctccacattcattttacatgctagaaaacctagttgaaggccctgcttagcacagattattttctagctttctcactgattcagccgaagctctatcaaacggcaggattcttcagtcgattatcacttatcagtaagcagaatccaagaatgtactgaataagcacaatgttggcttttcgccagcttttccggaaatgaagattatacacaatcacaagcttttgtgacc

SEQ ID NO: 4577 - DNA, 1107 bp, Pennisetum glaucum
gcgccgaggcgggcggtggactggagaggaagacacacagttgcagtagcagcagccaagcgagcaacgagctagcggcagcagccatggcgtccacctcctgcttcctcatccagtccaccgcccgcctcggcgccgccgcagcctcggcgcgcccccaggtgccgcgggcccagctcgtgtgcaaggcgcagcggcaggacgccgccgagggtggtgacgcggtcacccgccgcgccgcgctcacgctcctcgccggcgtcgccgccgtcggcgccaaggtcagccccgccgccgccgcctacggggaagcagccaacgtgttcgggaagcagaagccgagcacggagtacatcgcctacagcggcgacgggttcaagctgctgatcccgtccaagtggaaccccagcaaggagcgcgagttccccggccaggtcctccgctacgaggacaacttcgacgccaacagcaacgtctccgtcattgtccagcccaccaccaagaagaccatcaccgagttcggctcaccggaggagttcctcgcccaggtcgactacctcctcggcaagcaggcctacagcggcaagactgcctccgagggcgggttcgagaacgacgcggtggcgacggccaacatcctggagagctcggcgccggtggtggacgggaagcagtactacagcgtgtcggtgctgacgaggacggcggacggcgacgagggcggcaagcaccagctcatcacggccaccgtctcggacggcaagctctacatctgcaaggcgcaggccggcgacaagaggtggttcaagggcgccaggaagggcgtcgagaaggcggccagctccttcagcgtcgcatgagcattctttttctttggttccagcaccgtgtacatgtaacgcagatagagagaggctgggcatgcatgtgtgctcctttgatttgtacatgagaacaaaggccaaggagagcgaggattcatctctgctctcatccacgatgtctaagaactcttagtatcccatcgtaatgcttcgttgttgtacatcttgctgtgagctctaggtagggggtgcgtcatcatacactatactagctacttcttcc

SEQ ID NO: 4578 - DNA, 924 bp, Zea mays
cactcttctcccccacgagtccggaccccggaggagccaagccatggcgtccacctcctgctgcctcctccaccagtcaaccgcccgcctcggcgcgtcgccgcgcctggccgccgccccgccgcgcagcgcccagctgctcgtctgcaaggcccggaagcaggaagccgccgcggaccagagcgacgtctcgcgccgcgccgcgctcgcgctcctcgccggcgtcacggccgccgccggcgccaaggtgggtcctgccgccgcggcatacggagaagcaggtaagtgttcggcaagcccaaggcgagcacggagtacatcgcgtacagcggcgacggcttcaagctgctgatcccgtccaagtggaaccccagcaaggagcgggagttccccgggcaggtgctccgctacgaggacaacttcgacgccaacagcaatgtgtccgtcatcatccagcccacgtccaagaagaccatcgccgactacggctctcccgaggagttcctctcccaggtcgactacctgctcggcaggcaggcctacggcggcaagaccgactccgaggtccgtaatataaccctgtggaatgaatcgacgtgcgtgcagggcgggttcgagaccggcgccgtggccaccgccaacgtcctggagagctccacccccgtgatcgacggcaagcagtactacgccgtgtccgtgctcaccaggacggcggacggcgacgagggcggcaagcaccagctcatcgcggccaccgtctccgacggcaagctctacatctgcaaggcgcaggccggcgacaagaggtggttcaagggcgccaggaagggagtcgagaaggccgcctcctccttcagcgtcgcatgatgatgtaattttatttcttcgatgggatgggatgcacgcactacgtagagagcttgg

SEQ ID NO: 4579 - DNA, 1018 bp, Panicum virgatum
agtcgcaggaggccaggaccaggagcagcagcgagccatggcgtccaccacctgcttcctccaccagtcctccgcccgcttcggcgccgccgcgtcggcgcgcccccagcaggcgccgcgggcccagcagctcgcgtgcagggcgcagaagctggacgccgccgagggcgacgccgcggtcacccgccgcgccgcgctcacgctcctcgcgggcgccgccgccgtcggcgccaaggtgaaccccgccgccgctgcctacggagaagcagccaacgtgttcgggaagcccaagacgaacacggacttcatggcctacagcggcgacggcttcaagctgttgatcccgtccaagtggaaccccagcaaggagcgcgagttccccggccaggtgctccgctacgaggacaacttcgacgccaacagcaacgtctccgtcatcgtccagcccaccaccaagaagaccatcaccgactacggctcgcccgaggagttcctcgcccaggtcgactacctcctcggcaagcaggcctacgccggcaagacggactccgagggcgggttcgagaccgacgcggtggccacggccaacatcctcgagagctcggcgccggtggtggacgggaagcagtactacagcgtgtccgtgctgaccaggacggccgacggcgacgagggcggcaagcaccagctcatcacggccaccgtctcggacggcaagctctacatctgcaaggcgcaggccggcgacaagaggtggttcaagggcgccaggaagggcgtcgagaaggcagccagctccttcagcgtcgcatgagcacgcaccatctgtgtgtcggccggaatttgtttcttttggttcattcaggaatatgcttacgtagatacagaggctgggcatgcctctgattgtacatgagaacaaagaccaaggagagctccatttcgtccctgcaaggattgatttctgctctcatccacgatgtttaagaactcctagtactaataatgcttcgttttt

SEQ ID NO: 4580 - DNA, 1523 bp, Oryza sativa
gccttatcccgcgatccgaacaccatccactcgccgcgccaaacaccacaagtcctcgccaccgccgcgcccccactgcgctctcctcttcgttatcccgtcgccacctcgccccatcaccctctccctccaccacactacaccccgctccactctcaggcaggcaatcagcggcgaggcaccagcccaccggccggcaatggcgtccacctcctgcttcctccaccagtccacggcccgcgtcgccgcgcgcgtcgcctccccgtccccggcgacacggacccacctcctcgtctgccgcgcccagaagcaggacgacgccgacgtctcccgccgcgcggcgctcgcgctgctggccggagcgacggcggcggtgggggtgaaggtggcgcccgccgccgcggcctacggcgaggcggcgaacgtgttcgggaagcccaagacgaacacggagttcatcgcctacagcggcgaggggttcaagctgctgatcccgtccaagtggaaccccagcaaggagcgcgagttccccggacaggtcctccgctacgaggacaacttcgacgccaacagcaacgtctccgtcataatcaaccccaccaccaagaagaccatcaccgagttcggctcccccgaggagttcctcgcccaggtcgacttcttgcttggcaagcaggcctactccggcaagacagattccgagggtgggtttgagtcggacgcggtggcgacggcgaacatcctggagagctcggcgccggtggtgggagggaagcagtactacagcgtaacggtgctgacgaggacggcggacggcgacgagggcggcaagcaccagctgatcacggccaccgtcaacgacggcaagctgtacatctgcaaggcgcaggccggcgacaagaggtggttcaagggcgccaggaagttcgtcgagagcgcagccagctccttcagcgtcgcatgatcgtcgaaatctctatctcagcttctctttaatccctagcgaatcaaaatcaaatcaatcgagttcgttgctcagagagatgcagtgcacgcatgtgtgtgtgcgtgtgtgtttctttgattgtacatgagaattaagaacaagttaaggagagaggtcgatccatcgatttcccctgcatgcaaggattgattttctgtgatccgtgtgttaagtaatcctagtaattaatcatgtttcatttttgtatctatgttaatttaatccatgcttgacatgacactcatatatatgtaggagctgctttatttagtttaatctagtgcattttcatacttgatgcacagctatgccaatcggaaggataggatagcgagaagcagaaccgaatggccattgaagttttcagttcctaattaacctgaagttttgtttggctgaatttgggggcggaaattggaaattgatagtttcatacaccaccatttgtccatttcatattccagcttcaaatgggcactgaacttgtccagatttctaatttgctatgtttagcttt

SEQ ID NO: 4581 - DNA, 1185 bp, Oryza sativa
tcgccgcgccaaacaccacaagtcctcgccaccgccgcgcccccactgcgctctcctcttcgttatcccgtcgccacctcgccccatcaccctctccctccaccacactacaccccgctccactctcaggcaggcaatcagcggcgaggcaccagcccaccggccggcaatggcgtccacctcctgcttcctccaccagtccacggcccgcgtcgccgcgcgcgtcgcctccccgtccccggcgacacggacccacctcctcgtctgccgcgcccagaagcaggacgacgccgacgtctcccgccgcgcggcgctcgcgctgctggccggagcgacggcggcggtgggggtgaaggtggcgcccgccgccgcggcctacggcgaggcggcgaacgtgttcgggaagcccaagacgaacacggagttcatcgcctacagcggcgaggggttcaagctgctgatcccgtccaagtggaaccccagcaaggagcgcgagttccccggacaggtcctccgctacgaggacaacttcgacgccaacagcaacgtctccgtcataatcaaccccaccaccaagaagaccatcaccgagttcggctcccccgaggagttcctcgcccaggtcgacttcttgcttggcaagcaggcctactccggcaagacagattccgagggtgggtttgagtcggacgcggtggcgacggcgaacatcctggagagctcggcgccggtggtgggagggaagcagtactacagcgtaacggtgctgacgaggacggcggacggcgacgagggcggcaagcaccagctgatcacggccaccgtcaacgacggcaagctgtacatctgcaaggcgcaggccggcgacaagaggtggttcaagggcgccaggaagttcgtcgagagcgcagccagctccttcagcgtcgcatgatcgtcgaaatctctatctcagcttctctttaatccctagcgaatcaaaatcaaatcaatcgagttcgttgctcagagagatgcagtgcacgcatgtgtgtgtgcgtgtgtgtttctttgattgtacatgagaattaagaacaagttaaggagagaggtcgatccatcgatttcccctgcatgcaaggattgattttctgtgatccgtgtgttaagtaatcctagtaattaatcatgtttcatttttgtatc

SEQ ID NO: 4582 - DNA, 1116 bp, Leymus cinereus x Leymus triticoides
  misc_feature (1079)..(1081): n is a, c, g, or t
cacgcgcacgcacgcacagtcctagctaagctaagctaaacagcagcggcagcagcgagcaatggcgtccacctcctgcttcctccaccagtccaccgcgcgcctggccgcctcggcgcgccctgcgcccgccgtcgggcgcacccagctgttcgtctgcaaggcgcagaagaacgacgaggctgcatctgacgctgccgtcgtcaccagccggcgcgccgcgctgtccctcctcgccggtgccgccgccgtcgccgtcaaggtctcccccgccgctgccgcctacggagaagcagcgaacgtgttcggcaaggcgaagaagaacacggacttcgtggcgtacagcggcgacgggttcaaattgatgatcccggccaagtggaaccccagcaaggagcgtgagttccctgggcaggtgctccgctacgaggacaacttcgacgccaccagtaacctctccgttataatcaaccccaccaccaagaagaccatcaccgagtacggttcccctgaggagttcctctcccaggtcggcttcctcctcggccagcagtcctacggcggcaagaccgactccgagggtgggttcgagtcagacgctgtggcgacggcgaacgtgctggagagctcggcgccggtggtggacggtaagcagtactacagcataacagtgctcacgaggaccgcggacggagacgagggagggaagcaccagctcatcaccgccaccgtcgccgacggcaagctctacgtctgcaaggcgcaagccggagacaagaggtggttcaagggcgccaagaagttcgtcgagaacgccgcaggatccttcagcgtcgcataaatatacatgaccgatcggcgaatttaatggaatttcctcagggatgcaccgtgtagagaccgatcgagggcatgcatgtgtgtttctttgatttgtacatgaggatggatgaactaagaggtcgatttccctcgaggattcatgtgtgcacaatgattaagaaatcttagtaataatgtttcatttttgtatctccttatctttgttggcagcgcttcaatttagtgttgtgaagaannntgtatcaatgtgtctatataagttcagttttgcta

SEQ ID NO: 4583 - DNA, 1069 bp, Saccharum officinarum
cgtcttgcccacaccatctcgctgagccggaagacccgcacacacacgcgagttgtaacaccatggcgccccgggtggcggacaagtcgccgttgccgccggccaccggcctcggactgggcgttggcggaggagtcggaggcgtgggcatgggcccacactacagaggcgtgaggaagcgcccctggggacgttacgccgcggagatccgcgaccctgccaagaaaagccgcgtgtggctgggcacgtacgacacggccgaggaggccgccaaggcctacgacgccgccgcccgcgagttccgaggcgccaaggccaagacgaacttcccgttcgcgtcccagtgccccgtcgccgccggcggtgctggtagcccctgcagcaacagcaccgtggactcgagcggtggcggcagcggcgcctgtggcgtccaggcgcctatgcaggccattctgctgcctccggccctcgatctcgatctcttccaccgggcggccgccgtcaacgcggtctccgccggcggcatgcggttcccgttcaagggctaccccgtcgcgcgcccgacgtcgcaccagtacttcttctacgagcaggcggcggcagccgcggccgcggcggccggctaccggatgctcaaggtcgccccaccgccggtcaccgtggccgccgtcgcgcagagtgactccgactcctcgtctgtggttgatcacaccccttcgcctcccgcggtgacggcgaagaaggaagtgggcttcgaactggatctgaactggccgccgccggcagagaactaggcacgccggagtttttagctgacgacttagtagtttctttttcccttttgccttcatcaggaatgtttacttctggttgtttggtcctgtattcttgttctgtagactatgagatggggaaccttgtaaatagtttttttttttcgcggagacggaaatgatctgagatctgttcgtctgtctggacagatcaaaccggcgttgatatgggcttaaaccatggagtatttattagtataattcctaagtactgagaatatatataattgttgagc

SEQ ID NO: 4584 - DNA, 1214 bp, Setaria italica
cccctcgccttatcctagacgccacacacacacccccgcccgcagcacctccctgaaccggaagacccgcacacacacgccacttgtacgccatggcgccccgggcggcggacaagtcgccggtgccgccggcgaccggcctcggtctcggcgtcggcggtggagtcggaggcgttggcatgggcccgcacttcaggggcgtccggaagcgcccgtggggacggtacgccgcggagatccgcgaccctgccaagaagagccgcgtgtggctgggcacgtacgacacggctgaggaggccgcccgcgcctacgacgccgccgcgcgcgagttccgcggcgcaaaggccaagaccaacttcccgttcgcgtcgcagtgccccgtcgccgccggcgccggcagccccagcagcaacagcaccgtggactcgagcggaggcggcagcgcctgcggcgtccaggcgcctatgcaggccatgccgctgcccccggccctcgatctcgatctcttccaccgggcggcggccgtgaccgcggtctcctccggcggcatgcggtttccgttcaagggctaccctgtcgcgcgcccgacgccgcatccgtacttcttctacgaacaggcggcagcggccgccgccgcggcggccggctaccggatgctcaaggttgccccgccgccggtcaccgtggccgcagtcgcgcagagcgactccgactcctcgtcggtggtcgatcacaccccttcgccgcccccggtgaccacaaagaaggaggtgtccttcgatctggatctgaactggccgccgccggcggagaactaggcacaccggcggtttagctgacgacttagtagtttctttcctttttgccttgaggaatattacttttgtttttttttggtcctctagcctgtatttttgtttagtagcctgtgagagacggaggaaccttgtgtaaatagtttttccgccgaggacggaattgatctgagatctgttcgtctgtctagacagatcaagccggcgtttgatatggagtaaattactatgtactggtatttcagtttattagtactatgaggatattattattcaccattaaaaaggaaattattattcagaggaaaaaacacagcagaaacatgtccagaagagcttcagacgtttcctttcgatctttccattcaagaaaaggtgtctagcttggttgggaagcgc

SEQ ID NO: 4585 - DNA, 992 bp, Zea mays
gtcctagacgcaatacacatacagcccctcttgcccacaccacctcgctgaaccggaagacccgcacacacacgccacttgtagaccatggcgccccgggtggcggacaagtcgcctctaccgccggccaccggcctggggctgggcgttggcggaggagtcggaggcgtgggcatgggcccgcactacagaggcgtgaggaagcgtccatggggacgctacgccgccgagatccgcgaccctgccaagaaaagccgtgtgtggctcggcacgtacgacacggccgaggaggccgccaaggcgtacgattccgccgcccgcgagttccgaggcgccaaggccaagacgaacttcccgttcccctcccagtgctccgtcgcctccggtgctgccggtagcgccagtagcaacagcaccgtggattcgagcggtggcggtagcggctgtggcatccaggcgcctatgcaggccatgccgcttcctccggctctcgatctcgacctcttccatcgggcggccgccgtgaacgcagtctccaccggcatgcggtttccgttcaagggctatcctgtcgcctgcccgacgccacagcagtactttttctacgagcaggcggctgccgcggcatccggataccggatgctcaaggtcgctccaccggccgtgactgtggccgcggttgcgcagagcgactccgactcgtcgtctgtggttgatcactccccttcgcctcccgcggtgacggcaaacaaggtgggcttcgaactggatctgaactggcccccgccggcagagaactaggcaggccggagtttttggctgacgacttagtagcttccttttcccttttgccttcatcaggaatgttacttgtggttgttttggtcctgtatggctgtattcttgttctgtagactaagagatggggagtcttgtaaatattttttttccgtcgagacggaaatgaactgagatctgttcgtctgtctgat

SEQ ID NO: 4586 - DNA, 1073 bp, Cenchrus ciliaris
  misc_feature (432)..(432): n is a, c, g, or t
  misc_feature (486)..(486): n is a, c, g, or t
  misc_feature (490)..(490): n is a, c, g, or t
  misc_feature (505)..(505): n is a, c, g, or t
  misc_feature (517)..(517): n is a, c, g, or t
  misc_feature (588)..(588): n is a, c, g, or t
  misc_feature (591)..(591): n is a, c, g, or t
  misc_feature (594)..(594): n is a, c, g, or t
cacacacacaaacaccaccgcccgcacgcagcacctcgctggaccggaagacccgcacacacacgccacttgtacgccatggcgccccgggcggcggacaagtcgctgctgccgccggcgaccggcctcggcctaggcgtcggcggcggagtcggaggcgtggccacgggcccgcacttcaggggcgtccggaagcgcccctggggacggtacgccgcggagatccgcgacccggccaagaagagccgcgtgtggctgggcacgtacgacacggccgaggaggccgcccgcgcctacgacgccgccgcgcgcgagttccgcggcgccaaggccaagaccaacttccctttcgcgtcgcagtgccccgtcgccgccggcgccggcagccccagcagtaacagcaccgtggactcgagcggaggcggcagcggntgcggcgtccaggcgcctatgcaggccatgccgctgcccccggccctcgatctngatntcttccaccgggcgncggccgtgaccncggtctcctccggcggcatgaggtttccgttcaagggctaccctgtcgcgcgcccggcgacacacccgtanttnttntacgaacaggcggcagcggccgcggccgcggcggcaggctaccggatgctcaaggtcgcaccgccgccggtcaccgtggccgccgtcgcgcagagtgactccgacgcctcgtcggtggtcgatcacaccccttcgccgcccccggtgacaacaaagaaggaggtgtccctcgatctggatctgaactggccgccgccggcggagaactaggcccaccggaggttttagctgacgacttagtagtttcttttctttttgcctacttgtgttgtttttttggccgtctagcctgtatttttgtttagtagcctgtgagagacggaggaaccttgtgtaaatagttttttccgccgaggacggaattgatccgagatctgttcgtctgtctagacagatcaaaccggcgtttgatatggagtaaattatgtactactagtatttcaatctatattagtactatgaggatatcattattcaga

SEQ ID NO: 4587 - DNA, 1078 bp, Panicum virgatum
cacacacaccatctctgccctcagctcctcgccgaaccggaacacccgcacacccacgccacttgtacaccatggcgcccccgtcggcgcacaagtcgccggtgccgccggccaccggcctcggtctcggcgtcgtcggtggcgtcggaggcgtgggcatgggcccccacttcaggggcgtgcggaagcgcccgtgggggcggtacgccgcggagatccgcgacccggccaagaagagccgcgtctggcttggcacgtacgacacggccgaggaggccgcccgcgcctacgacgccgccgcgcgcgagttccgcggcgccaaggccaagaccaacttcccgttcgcgtccaagtgccccgtcgccgccggcgccggcagccccagcagcaacagcaccgtggagtcgggcggaggcggcggcggcggcgtccaggcgcctatgcaggccatgccgctgcccccggccctcgatctcgatctcttccaccgggcggcggccgtgaccgcggtctcccccggcggcatgcggtttcccttcaaagggttccctgtcgcgcgcccgaccccgaacccctacttcttctacgaacaggcgtccggctaccggatgctcaaggtcgccccgccgccggtcaccgtggccgccgtcgcgcagagcgactccgactcctcgtcggtggtcgatcacaccccttcgccgcccgcggttaccgcgaagaaggaggtctccttcgatctggatctgaactggccgccgccggcggagaactagccacaccagagtttttagctgacgacttcgtagtttctctttcctttttgcctcgagtaatattacttctgttgttttttggtcctctagcctgtagtttttgttcagtagcctgcgagagacggaggagcctgtgtaaatagtttttccgccgaggacggaattgatttgagatctgttcgtctgtctagacagatcaaaccggcgctgatatggagtaaattatgtactactagtatttcattccattagtactatgaggatattactattcagagaaacgaaaacaccgagtaaattcgtgc

SEQ ID NO: 4588 - DNA, 1072 bp, Zea mays
cttatcctagacgccacacacacacacacatcgcttctccacacgacctcgctgaaccggaagacccgcgcacacacgccacttgtgcaccatggcgccccgggtggcggacaagtcgccattgccgctggccaccggcctgaagcttggcgttggcggaggagtcggaggcatgggcttgggtccacactaccgaggcgtgaggaagcggccgtggggacgctacgccgcggagatccgcgacccagccaagaagagtcgcgtgtggctgggcacgtacgacacggccgaggaggccgccaaggcctacgacgtcgccgcccgcgagttccgtggcgccaaggccaagactaacttcccgttccccctcgccgtcgccgtcgccggcggtgctggtagccccagcagcgacagcaccaccttggaatcgagctgtggcggcagcgggtgtggcgtcgaagcgcctgtgcaggcggccatgccgctgaccccggccctcgacctcgatctcttccaccgggcggccgccgtcagcgcggtcaccaccggcggcatgccctttccgttcaaggccttccccgtcgtgcgcccgaccccacatcagtacttcctctacaatcaggccgcggcggccgcggcagccgggtacaggatggtcaaggtcgcctcagctccagtcaccgtagccgccgtcgcgcagagcgactccgactcctcgtctgtggttgatcgcacctgttcgcctcccgcggtgacggcaaagaaggaggtcagcttcgaactggatctgaactggccgccgccggcagagaactagtcgcaccggagttttcagctgacgactttgcagtttcctttttcccttttggccttcatcaggaattgtagtgtagctctgggtgtttggtcttttttttttcttgcatgtagagtgtagactatgatatggtggagccttgtacatagtactgtagtgttttttttttccgccgagacggagtagatctgttcgtgtgtctggacagatcaaaccggcgttgatatgggctttaaaccatggagcatattgatt

SEQ ID NO: 4589 - DNA, 1072 bp, Leymus cinereus x Leymus triticoides
  misc_feature (7)..(11): n is a, c, g, or t
cacaccnnnnncaccccccacctcaccaaaacgcccgcataaccaaagatacgcgcacgccacttgtatacctgctgcacgcatggcgcctagagcggcggagaaggcgcctgtctccccggccaccgggctcgttcttggcgttggcggcggggtcggggtcgttgccgggggcgcgcactacaggggcgtccggaagcgcccgtggggacgttacgccgcggagatccgtgacccggccaagaagagcagggtgtggctcggcacgtacgacacggcggaggaggccgcgcgcgcctacgacaccgccgcgcgcgagttccgcggcgccaaggcgaaaacaaacttcccgttcccttcgtcgtcgtcccctgtcgccggcggcggcagcccgagcagcaacagcaccgtggactcgagcggcggagggagcggcggctgcgtccaggcgcctatgcaggccatgccgctgccgcccgccctcgacctggacctctttcaccgcgcggctgccgtgacggcggtcgccgccggcggcatgcgcttcccattcaacggttacccggtggcgccgcgccagcctctgcacccgtacttcttctatgaacaggccgcggcggcggcggcggcgtcggggtatcgcacgctgaagatggcgcagccggtcaccgtggcagccgttgcccagagcgactccgactcctcgtcggtcgttgatctgtccccgtcgccccccgcggtgacagcgcataaggcggtcgcgtttgatctggatctgaaccggccgccgccttcggaggactagacaaaggacaaattttagatgatgactagtttctcatttttcctgcagggaacgtttttttcttcttctgttttggtcctcttgtatttttgtttagttgtcttgagacagaccgagcagccttgtaaatagtttttccgccgagaacatggcagaaccgatctgagatctgttcgtctaagcggatcaaaccggcgttgaggtgaactgagacttgagtatatgtgtatctcgtaagatgagtgtagtatgatgatgaatttttca

SEQ ID NO: 4590 - DNA, 1051 bp, Saccharum officinarum
atcctcctcccaccatcaccaccacggtctcctctctctagacctcaatataccaccaccaccattagtgttcttgagagagagagagggacgggagtggagaggagatgagagagagattgagcatgtaacagcctcttctcccatctctgtctccctctctctcctctccactactcacagagtcacacaggcaagagagcgaggatgatgtggtcgcatgagccggcagcggagcagaaggcagcggcggcctcgccgccgactcggcagcggagctccgtggccaagctgacgacggcctcctcgtccttggcgaacctcctctcggtcttcgtcggggcgaataacaacaactccccggccgacccgaggccgccgccgaggcggagcttcgacgagggcggcggcgtcgggctcggcatcgtcgcggccatgagccacgcctgcctgaccggggccgagccgatcgccatcggagccgcggctaggcggcgcgcgcgcgaggaggacgagagttacacgtgcgtcatcacgcacgtggccggcgctggcggcggcagcgtccggaagcgggtctactttgggttcggcgacggcggtggctggctcgtggaagccgacgaggaggcgcccggcgccggcgcccgacttcctgagccggtgctgcctctgtgacaagaggcttgatgggctcgatatctacatgtacagaggggagaaagccttctgcagctcagagtgccgatgccagcagatgctaatggacgaccgcgctgacaagtgtggatctgaagccttcatcaggtccggcgactactcgtactcggtgtcgccgcactctgccccgatggccttctcaccgagcgtcgcagcagcctagtacatggactgctcggcctcaagctgctccactacgagcaaggagtctagctagaagagactaaagtctaaacgggccgtttaaacaaatggatcatatatagagtaatttataaaatgcttcttaactgtgacatgaataaaagcgagggagaaagttttgagactc

SEQ ID NO: 4591 - DNA, 1137 bp, Zea mays
cccccctctttctcgctagacctcaacgataccaccaccgctagcgctagtgctctactgctctgctctttagggagagagagacgggagtgagagagcagagatggcagctgagagctagactgagcacgcacgtaacgtaacaagctcttctcccatctccgtctctggcaagagagagagagagcgcagaagatgatgtggtcgcacgagccggcagcggagcagaaggcggcggcctcggcgccgcctacccggcagcggagctccgtggccaagctgacgacggcctcctcgtccttggccaacctcctctccgccttcgtcagcgcgaacaactcctccccagacccgaggccgccgccgccgaggcggagcttcgacgagcgcggcgccgtcgggctcggcatcgtcgcggccatgggccacggggccgagccgatcgccatcggcgccgcggccaggcggcgcgcgcgcgaggacgacgagagctacacgtgcgtcatcaagcacgtggccggcgccggcggcgccagcgtccgcaagcgggtgtactttgggttcggcgacggcggcggtggatggctcgtggaggccgacgacgcggcgccggcgccggcgcccgacttcctcagccggtgctgcctctgcgacaagaggcttgatgggctcgatatctacatgtacagaggggagaaagccttctgcagctcagagtgccgatgccagcagatgctactggacgaccgtgctgccaaatgtggatcatccgaagccctcatcaggtccggcgactactccgtgtcgccgcactccgccccgatggccttctccccgagcgtcgcagcagcctagtagtctactcgccctcgatcgagctgctccgatccgctatgactctgtgagcaataatgcaaaggagtctagctagaagaggctataatctaaacgggtctcgtttaataaacaaacggatcatatatatgtataccgagtaacgtataagatgcttcttaattttaactatgacatgaataagagcgaggaagacagttttgtgtgactatgcagtaacagcaagatgttaaacactttaatcgtgcttgaattttatttatttttattcttgttgcaaga

SEQ ID NO: 4592 - DNA, 1728 bp, Zea mays
ggtgcattgcacctgcacctgctgcacatgcacatgcacgcagcagggccgaaacgaaacgaaaggaacgtgctgggtcgtctccttctccatttgcctcttggcttccttgggcagcccccctgtccctgcccaccccacgacagcccaaagccccaaacccaaccccggcacacagactgcagcccgctacatacaaaacgagctggtggcttggcctctcctccaccagtggcagtggcagtggctggccacccaatcgtctcgttcgtcatctacctctccctcctccaacccaagctaagctaaacagcttacacagcttgctccgccatcaccgtatcgagagagacagagacaggctagcgagggaatggagaggatgctggccaggctgatgcggcggcggagctccgtccccctgtccggcctcctccaccacggaggagcgcccgccccgctgcaggccgccggcgccactggggcctccccgctgatcttgtcgcaccagcagcagcagcagcacacggccgcctccgccgtcctgccggggctcaagatcagggactccgcgtcccagctgatcgggaggaccccgatggtgtacctgaacaaggtgaccgaggggtgcggcgcccgggtggctgccaagctcgagttcctgcagccgtccttcagcgtcaaagacagaccggcgatctcgatgctggaagacgctgaaaagagggggctcatcactccaggaaagaccacgttgatcgagcccacgtcggggaacatgggcatcgggctggcgttcatggcggcgctcaaggggtacgagctcgtgctcaccatgccgtcctacaccagcctggagaggagggtgacgatgcgggcgttcggcgccaacctggtgctgaccgacccggccaaagggatgggcgggacggtgaggaaggcgacggagctgtacgagagacatcccagcgcgcacatgctccagcagttccagaaccctgccaacgtcaaggtgcactacgacacgacgggaccggagatctgggaggacacgcttggccaggtcgatatcttcgtcatggggatcgggagcggcggcaccgtcacgggagtcggcaagtacctcaaggagaaaaaccctaacgcaaagatctatggagttgaacctgccgaggcaaatgttctgaatggtggaaagccaggacctcacctcatcactggaaacggagtagggttcaagccagatattctggacatggacgtgatggaaaaggtgctcgaggtgaaaggtgaggacgccgtcaagatggctcgagagctggcagtcaaggagggtcttttggtcgggatatcatcgggagccaacaccgttgctgctctcgagctagccaagaggccggagaacaaggggaagctcatcgtgaccgttcttccgagccttggcgagcggtacctgtcgtccgcgctgttcgatgagctgaggaaggaggcacaagccatggaaccggtcgcggtggattgatctcgccggtcaagctagctagcctgccgggcacgctggagatctggttcctatcgtcacagctgccagccaagccaattgtacttccattcccccctcatccagttttttattttattttaccgtcagtgtgtcacctcatctatgaaccttgcgaaaaggaaaaaaaaagtgcatgaataatgatgggaaaatgttgaaagaga

SEQ ID NO: 4593 - DNA, 1490 bp, Saccharum officinarum
gcctgccttgtcctcctcctccctctctccaccacccaacccaccagtgggcagtggctgggcacccaatcatcagcagcgagctgagctctcctctcctctcgctcctctccctcactactggtactctaactcgatccgatatcgaggaggaatggagaggatgctggccaggctgatgcggcggcggagctccccgctgcccggcctcctctaccagggaggagcagcggcggcggcagcgcccgcctcgctgcaggactcatcgctcttctcccaccaccaccagcagcacacggccgccgccctgccgggtctcaagatcagggactccgcgtcccagctgattggtcggacgccgatggtgtacctgaacaaggtgacggagggatgcggcgcccggatcgctgccaagctcgagttcctgcagccctccttcagcgtcaaagacagaccagcaatttcaatgttggaagatgctgaaaagaggggattgatcactccaggaaagaccacactgatcgagcccacatctgggaacatgggcattggcttggcgttcatggctgccctaaaagggtacgaactcattcttacgatgccgtcatacaccagtcttgagaggagggtgaccatgagggccttcggtgcaaacctggtccttaccgacccaacaaaagggatgggtgggacagtgagaaaagcagcagagctttatgagaaacatcctagtgcatacatgcttcaacagtttcagaatcctgctaatgtcaagatacattatgagacaacgggtccagaaatatgggaggacacacttggacaggttgatattttcgtcatggggattgggagtggcggtactgtcacgggcgtcggcaagtacctcaaggagaagaaccctaatgcaaagatctatggagttgaacctgctgaagcaaatgttctgaatggtggaaagccaggaccacacctcatcactggaaatggagtagggtttaagccagatattttggatatggatgtaatggaaaaggttcttgaggtcaaaagtgaggatgctgttaagatggctcgggaattggcagtcaaggagggtcttttggttggaatatcatcaggagcaaacactgttgctgctcttgagctagcaaagaagccggaaaacaaaggaaaactcattgtgactgttcttccaagccttggggagcgatacttgtcgtcggcgctgtttgatgagttgagaaaggaggctgaagccatggaaccagtggcagtggattaatttggccaatcaaacagggcactggaatctggatatttggtgcacaataaactcgccggcagatatgttacaactgccagttgtacttccattcccctcatccaatttctatcatcggtctgtcatctcatttgtgaaccttgtgtaaaaaaaatagaaaatgttgaaaaagagcaactttagtctctaaaaaaaaaaaaaaaaa

SEQ ID NO: 4594 - DNA, 2194 bp, Pennisetum glaucum
ccaccaaccattccaccactgatttcaaattccacttcttttgcacaaatcgatctactacaaaaatcttcttcttttacattcacattcaccaaaccagctagctaattaagggtagcactagcagagtagcaggcaggaaataatttttttttaaaaaaaaactcaagcaactacaactagcagctactagtgacgaaatcatcaggagctagctagcagccgccggccggccggccggccagccgcccagccaggagccagctccgccgtgctcctccgccgccgtcgatggcatcaaatctcacatgacggcgcaggcgttggggttctcgtcgctgaaggcgttgccgtacctgacctcggtcgacgacgcccttgcgagcggcgcggcggtggggtcggcgacgacgttgcggacgtacccgggcggcgccttcttgtcgtaggcccccggtgcgtaggggtgcgccaccacgtcgtagggcacgtagggccacggctcgacgcgcttgcccgtcttgtaggcgacgcggcgcatgaccttgccggcgtcgacgtaccccgtcaccgtcaccttgtgctgccgcgccgccacgtccacggagctcacgccctccatgccctccagcgccttgcgcaccttgcgctcgcacccgtcgcagtcgatcagcaccttcatctccaccgtctggaactgcttgcgcttcttgaggtggcggcgggttcggggcagcgtgcagtactcggagacgacgtcgacgatgcccatggcggcgagttagagagcaacctgccgagaggaggtttctggagagggagaaagaggatcggatcgctctggtctggtgttctgctctgctgtggtgtggtgtggtgtgtgtgtgagagagagaggggtagcgagcgagctagagggcgtcgacggcaatggagaggatgctggcgaggctcgtgcgcaggaggtcgcttctccaccagggagcggcggcagcggcggcgcccatggcagcgctggccggcgccggcggctcaccgtctctcttctccacgcagcagcagcggcagcaggtcgccgcggacccgggcgtcctgccggccgggctcaacatcagggactccgcatctcagttgatcgggaggacgccgatggtgtacctgaacaaggtcaccgagggatgcggcgcccggatcgcagccaagctcgagttcctgcagccgtccttcagcgtcaaagacagaccagcaatttcaatgttggaagatgctgaaaagaaagggttgatcactccagggaagacgacactgattgagcccacatctgggaacatgggcattggcttggcattcatggctgccctaaaagggtatgaactcgttcttacaatgccctcctacaccagtcttgagaggagggtgaccatgagagccttcggggcaaacctggtccttactgacccaacaaaagggatgggtggaacagtgagaaaagcaacagagctttatgagaagcatcctagtgcatacatgcttcaacagttccagaatcctgctaatgtcaaggtacactatgagacaactggtccagaaatatgggaggatacacttggacaggttgatattttcgtaatggggattgggagtggtggcactgtcacaggtgttggcaaatacctcaaggagaagaaccccaatgcaaagatctatggagttgaacctgctgaagcaaatgttctgaatggtggaaagccaggacctcacctcatcactggaaatggggtaggtttcaagccagatattttggatatggatgtaatggaaaaggttcttgaggtgaaaagtgaggaggccgttaagatggcacgagaattagcacttaaggagggtcttttggttgggatatcatcgggagctaacactgttgctgcccttgaactagcaaagaagccagaaaacaaaggaaaactcattgtgactgttcttccaagtcttggggagcggtacttgtcgtctgcactgttcgacgagttgagaaaggaggctgaagccatggaaccagtgccagtagactaatctcaccaatcaaacagagtactggatatttggtgcttaagaaacttcccagcaaccatgttgcaattgccagctgtacttaattcttctgatcaaaccagtaccttcagccccccccccc

SEQ ID NO: 4595 - DNA, 1378 bp, Panicum virgatum
tgcgcgacacacagtgagcgagagctaggtagcttgctagcttggccagagggcgtcgagaatggagaggatgctggcgaggctcatgcggaggaggtcgtcgctcctccaccagggagcagtagcagcagctcccatctcgctggcgggttcgtcgtcgctcttctccacgcagcagctgcaagcggtcgccgcggatccgggcgtcctgcccgggctcaagatcagggactccgcgtcccagctgattgggaggacaccgatggtctacctgaacaaggtcaccgagggatgcggcgcccggatcgcggccaagctcgagttcctgcagccgtccttcagcgtcaaagacaggccagcaatttcaatgttggaagatgctgaaaagaaggggttgatcacaccaggaaagacgacactgatcgagcccacatctgggaacatgggcattagcttggctttcatggctgccctaaaagggtatgaactcattcttacaatgccatcatacaccagtcttgaaaggagggtgaccatgagggcctttggtgcaaatctggtccttaccgacccaacaaaagggatgggtggaacagtgagaaaagcaacagagctttatgagaaacatccaagtgcatacatgcttcaacagtttcagaatcctgctaatgtcaagatacattatgagacaactggtccagaaatatgggaggacacacttggacaggttgatatttttgtcatggggatcgggagtggtggcactgtcacaggtgtcgggaagtacctcaaggagaagaacccaaacgcaaagatctatggagttgaacccgctgaagcaaatgttctgaatggtggaaagccaggaccacacctcatcactggaaatggagtaggcttcaagccagatattttggatatggatgtaatggaaaaggttcttgaggtgaaaagtgaggatgctgttaagatggctcgagaattagcagttaaggagggtcttttggttgggatatcatcaggagcaaacactgttgctgctcttgaactagcaaagaaaccggaaaacaaaggaaaactcattgtgactgttcttccaagccttggggagcggtacttgtcgtctgcactgtttgatgagttgagaaaggaggctgaagccatggaaccagtgccagtagactaatctagtatatggtaaatcaaacagaggactggataatcggtgcataatgaatatcctagcaaccatgttgcaacttcaagttgtatttcaattcctctcatcaaagttgtaccttcagtttgtcatctgtggaccttgtgggaaaaaacaaaaataacaattaaaatgttgaaaaaagcaaatttaatctct

SEQ ID NO: 4596 - DNA, 1595 bp, Setaria italica
agaacgtgctctctcctcaccaaccaaaaagccaaccagagtcctcccttcgctggctgctagtattttagtagcgcctcacgcacactggcctcctcccactcgtggccactcctcttcatccacggtgacacagtgagagagagaggtagcaagctagagggcgtcgacaatggagaggatgctggcgaggctcgtgcgcaggaggtcgctcctccaccagggagcggcggcggcgtcaatggagctggccagcgcaggcggctcgccgtcgctcttctccacgcagcagcagcaagcggccgccgcggatcccggcgtcctgccggccgggctcaacatcagggactccgcgtcccagctgattggaaggacaccaatggtctacctgaacaaggtcaccgagggatgcggcgcccggatcgcggccaagctcgagttcctgcagccgtccttcagcgtcaaagacagaccagcaatttcaatgttggaagatgctgaaaagaaagggttgatcactccaggaaagacaacactgatcgagcccacatcagggaacatgggcattggcttggcgttcatggctgccctaaaagggtatgaactcgttcttacaatgccctcctacaccagtcttgagaggagggtgaccatgagagccttcggtgcaaatctggtccttaccgacccaacaaaagggatgggtggaacagtgagaaaagcaacagagctttatgagaaacatcctagtgcatacatgcttcaacagttccagaatcctgctaatgtcaagatacactatgagacaactggtccagaaatatgggaggatacacttggacaggttgatattttcgtcatggggattgggagtggtggcactgtcacgggtgtcggcaaatacctcaaggagaagaaccccaacgcgaagatctatggagttgaacctgctgaagcaaatgttctgaatggtggaaagccaggacctcacctaatcactggaaatggcgtaggattcaagccagatattttggatatggatgtcatggaaaaggttcttgaggtgaaaagtgaggatgctgttaagatggctcgagaattagcagttaaggagggtcttttggttgggatatcatcaggagcgaacaccgttgctgctattgaactagcaaagaagccagaaaacaaaggaaaactcattgtgactgttcttccaagtcttggggagaggtacttgtcgtctgcactgttcgatgagttgagaaaggaggctgaagccatggaaccagtgccagtagactaatctcaccaatcaaacagagtactggatatttggtgcataataaacttcccagcaaccatgttgcaattgccagctgtacttcaattcttctcatcaaaattgtactttcagtccccctaaaaaactctccttaaaaaaaaggttgtactttaagtctgtcatgtgcagaccttgtgaaaaaaagagcaaaaataacaatgaaaatgtttagcaagagcaattttagtctctggacatttgtgatggtcatttctgggcttctgggttattacaggtcatagtcctaaccagc

SEQ ID NO: 4597 - DNA, 2859 bp, Oryza sativa
atatatcatctcctctcttctgaattccggggcttccggcgccacataataaataaacaaagccagccagcagcatcgccagtgagccacagcaccgccggcagtgaccaacagcaaccaatcagcaaatcagcaatggagagggctctgatgagcctcatgaggcggcgctccctcctccagagcggcggacgagcaccgccggcgatggccgccgccgccggtggctcaccattcttctccaccctgcagcaagcagccgccgcagacccggtccagtcgcctggcatcttgccagggctcaagatcagggactctgcgtcacagctgattgggaggacacccatggtttacctgaacaaggtcactgaaggatgtggggcccggattgctgctaagctcgagttcttgcagccgtccttcagcgtcaaggacagaccagcaatttcaatgttggaagatgctgaaaagaaggggttgatcaccccaggtaagaccacactgatcgagccgacatcagggaacatgggtattggcctggcattcatggctgctcttaaagggtatgaactcatactcacaatgccttcatacaccagccttgagaggagggtgaccatgagggccttcggcgcaaaactcgtccttaccgacccaacaaaaggtatgggaggcacggtgaggaaggccgccgagctgtatgagaaccatcctagcgcgttcatgctgcagcagtttgagaatcctgcaaatgtcaaggtacactatgagacaactggtccagaaatctgggaggatacacttgggcaggttgatatttttgtcatgggaatcgggagcggcggcaccgtcactggtgttggcaagtatcttaaggagaagaaccccaatgcaaagatctatggagttgaacctgctgaagcaaatgttttgaatggtggcaaaccaggtcctcacctcatcactggaaatggagtgggatttaagccggaaattttgaatatggatataatggaaaaggttattgaggtgaaaggtgaggatgctgttaagatggctcgagaattggcactgaaggagggtcttctggttggaatatcatcaggagctaacacagttgctgctcttgaactagcaaagaagccagaaaacaaagggaagctcattgtgactgttcttccgagtttaggggagagatacctgtcatctgcattgtttgaggaattgagagcggaggctgaggccatgcagccagtgccagtggactaacttggataatcaacctaggcattgagtatttgatgaacgaaattgctatactctaaataaattttcaatttgtactttaattccccattacaaattatgtatcttcagattgtgctgtcactgaactatatagatggactctctctatgtaattccacatttatcagaataacctatgatctccctctcctttctttttaagttcgagtttctattttccaattttaatggaacaggttaaaaatgtaacaaagatatccatctaactatctgcaactcttcggcccccaaaaaatacagaactcaaaaaggagatgataactatgaggatatcaacttggacatgatagtcattgagcatcctgattatgccaatagtgtagcaccatttggagattggagagggagtaagccatgctaatgtggccaatgaacaagtgttgagtgccgtagcgattctgatgaacagggtcgattcgttgcatctgcatgacaattcttccatcaccaatgtcaatcctaaacacatgttgctgtcaggagatagaagaagttagatggcttcgtctaaagtggtgctgcattgatagatgtcacaagttggacactgtctttgtcaccgatcatgcttactagcgctttagatcactggaggcattttcagcagctgagctcatgatggctacttgtgtttggagcagaggaaggatgaacacagctgagcacataatttcctttgcaaaactggggagcatacacctgggagatgtttgcccatttgtgaaggtacacctgaatatatagcccaacattctctgttgtttttctccttagttccatgtatgcatagtccacaatatcatctgcaaataagtactatctatatgtagtatccacctgcagcacctctgctaatggctagttaaaatgcaactaattaaaaatgaatcatatcggggcttatagtaaattgttattatatctctatggcaattgtttagttgtgttccttgatatgatccactaatcacgtgatcacctctgtagatttccagaactccatggtgtgagactatttagttccaaaagactggagaatggagataaattatatacgtgattgatgcggcatcctgctaatgccgcaacaaatgtttctaaggatgcacttgcatagcctttgaacagaaaacaactttagtgattcagttaattggaacttaattgtttgaggatatggtgatgtccctctctgacatttctactgcaagtaaaaggggtgtgaaatgctatgatacaacctggaccaaattacctgctcaatgaaacccattgttatgtctaagccaaaaagaaagcagaaatctacaattaaaggcacactataggccgtgaattaaataggttaaattttataaagcaagcattcatcactgaacagaagcaaaaatatttaccgtgatatcatatatagaacaaagtcgacgggaatagtatatccaccttttttatatcatattcttgaagaagcctttaaagcattggctacttgttaaagataactacagaacacgtacagagatatctata

SEQ ID NO: 4598 - DNA, 1459 bp, Oryza sativa
atatatcatctcctctcttctgaattccggggcttccggcgccacataataaataaacaaagccagccagcagcatcgccagtgagccacagcaccgccggcagtgaccaacagcaaccaatcagcaaatcagcaatggagagggctctgatgagcctcatgaggcggcgctccctcctccagagcggcggacgagcaccgccggcgatggccgccgccgccggtggctcaccattcttctccaccctgcagcaagcagccgccgcagacccggtccagtcgcctggcatcttgccagggctcaagatcagggactctgcgtcacagctgattgggaggacacccatggtttacctgaacaaggtcactgaaggatgtggggcccggattgctgctaagctcgagttcttgcagccgtccttcagcgtcaaggacagaccagcaatttcaatgttggaagatgctgaaaagaaggggttgatcaccccaggtaagaccacactgatcgagccgacatcagggaacatgggtattggcctggcattcatggctgctcttaaagggtatgaactcatactcacaatgccttcatacaccagccttgagaggagggtgaccatgagggccttcggcgcaaaactcgtccttaccgacccaacaaaaggtatgggaggcacggtgaggaaggccgccgagctgtatgagaaccatcctagcgcgttcatgctgcagcagtttgagaatcctgcaaatgtcaaggtacactatgagacaactggtccagaaatctgggaggatacacttgggcaggttgatatttttgtcatgggaatcgggagcggcggcaccgtcactggtgttggcaagtatcttaaggagaagaaccccaatgcaaagatctatggagttgaacctgctgaagcaaatgttttgaatggtggcaaaccaggtcctcacctcatcactggaaatggagtgggatttaagccggaaattttgaatatggatataatggaaaaggttattgaggtgaaaggtgaggatgctgttaagatggctcgagaattggcactgaaggagggtcttctggttggaatatcatcaggagctaacacagttgctgctcttgaactagcaaagaagccagaaaacaaagggaagctcattgtgactgttcttccgagtttaggggagagatacctgtcatctgcattgtttgaggaattgagagcggaggctgaggccatgcagccagtgccagtggactaacttggataatcaacctaggcattgagtatttgatgaacgaaattgctatactctaaataaattttcaatttgtactttaattccccattacaaattatgtatcttcagattgtgctgtcactgaactatatagatggactctctctatgtaattccacatttatcagaataacctatgatctccctctcc

SEQ ID NO: 4599 - DNA, 1466 bp, Brachypodium distachyon
actggctaccttttatagctagctagtatcactcactcactctcactcactggctcgctgcagaccacaccaaccgcgtctcatctttccatttggcagttaccctctttcacacacagagacagagcgagtgagaatggagaggatggtgatgaggctgatgaggaggaagtctctcctccacggaggcagcggcgggttattagcagcatccacggcgaacggcagcgtcgtctccggcgccggtggctcgcctttcttctccacgcagcaacagcagcaggaggatcccatccttccagcgctcaagatcagagacacggccgcccatctgattgggaggacgccactggtgtacctgaacaaggtgacggagggatgcggcgcccggatcgccgccaagctcgagttcctgcagccctccttcagcgtcaaagacaggccagcgatttcaatgatggaagatgctgaaaagaaggggttgatcaccccaggcaagaccacattgattgagcccacgtcagggaacatgggcattggcctcgcattcatggctgctctcaaagggtatgaactggttctcacaatgccgtcatacaccagccttgagaggagagtggtcatgagggccttcggcgcgcagcttgttcttaccgaccccgcgaaagggatgggagggacagtgaggaaagcaacccagctctacgagaaccatcctagcgcattcatgctccaacagtttgagaatcctgccaatgtgaaggtacactatgagacaactggtccagaaatatgggaggacacactgggacaggtcgacattttcgtcatgggaatcgggagtggtggaaccgtcactggggtcggcaagtacctcaaagagaagaaccccaatgcaaagatctatggagttgaacctgctgaagcaaatgttctgaacggtgggaagccagggcctcacctcattactggaaatggagtgggatttaagccagatattttggacatggatataatggagaaggttcttgaggtaaaaggtgaggatgctgttaagatggcgcaacaattagcacttaaagaaggcctgttggtagggatatcatcgggagccaacacagttgcagctattgaactcgcaaagaggccagaaaacaaagggaagctcattgtgactgttcatccgagcgcgggggaacgatacttatcagcagcgttgtttgaggatttgaggaaggaagccgaggctatgcagccagtgccagtggactaagttgcagcttgcaagcatgcaaatggatccttggtgcatcacatattggatcttacaaaataaattccctggctaccatgttacaagtacctagaaatgaactcttcaaatatgagcttgcaatttgtgcctcctgtggaccttatgtaaagaacaattaaaatgattcagaaaggactttatttttcttgcc

SEQ ID NO: 4600 - DNA, 1744 bp, Brachypodium distachyon
ccccagatatatgcataaataatatgaagccgccggcctccactgggcactggctaccttttatagctagctagtatcactcactcactctcactcactggctcgctgcagaccacaccaaccgcgtctcatctttccatttggcagttaccctctttcacacacagagacagagcgagtgagaatggagaggatggtgatgaggctgatgaggaggaagtctctcctccacggaggcagcggcgggttattagcagcatccacggcgaacggcagcgtcgtctccggcgccggtggctcgcctttcttctccacgcagcaacagcagcaggaggatcccatccttccagcgctcaagatcagagacacggccgcccatctgattgggaggacgccactggtgtacctgaacaaggtgacggagggatgcggcgcccggatcgccgccaagctcgagttcctgcagccctccttcagcgtcaaagacaggccagcgatttcaatgatggaagatgctgaaaagaaggggttgatcaccccaggcaagaccacattgattgagcccacgtcagggaacatgggcattggcctcgcattcatggctgctctcaaagggtatgaactggttctcacaatgccgtcatacaccagccttgagaggagagtggtcatgagggccttcggcgcgcagcttgttcttaccgaccccgcgaaagggatgggagggacagtgaggaaagcaacccagctctacgagaaccatcctagcgcattcatgctccaacagtttgagaatcctgccaatgtgaaggtacactatgagacaactggtccagaaatatgggaggacacactgggacaggtcgacattttcgtcatgggaatcgggagtggtggaaccgtcactggggtcggcaagtacctcaaagagaagaaccccaatgcaaagatctatggagttgaacctgctgaagcaaatgttctgaacggtgggaagccagggcctcacctcattactggaaatggagtgggatttaagccagatattttggacatggatataatggagaaggttcttgaggtaaaaggtgaggatgctgttaagatggcgcaacaattagcacttaaagaaggcctgttggtagggatatcatcgggagccaacacagttgcagctattgaactcgcaaagaggccagaaaacaaagggaagctcattgtgactgttcatccgagcgcgggggaacgatacttatcagcagcgttgtttgaggatttgaggaaggaagccgaggctatgcagccagtgccagtggactaagttgcagcttgcaagcatgcaaatggatccttggtgcatcacatattggatcttacaaaataaattccctggctaccatgttacaagtacctagaaatgaactcttcaaatatgagcttgcaatttgtgcctcctgtggaccttatgtaaagaacaattaaaatgattcagaaaggactttatttttcttgccattactgctttcctcaaaagaaaatcaatgacatattatgacatcctttatttgaataccttcgacagcacagtgtaatgcatctcgaggcttgtgtaattaatgttccatatggtgccatacactataattgacagaaatgcaggataaccagcaaaacaaagaggactgcaccaatcctgtgagatgagagtttgtgtggtacctatgtggctcatcaggctgcctca

SEQ ID NO: 4601 - DNA, 1613 bp, Secale cereale
gccacaccacaccgcaccaaccgcgcctctcactgacccatcaactccactccactaccaatcgtaccttccgcccgaccgaccgaccagcgatggagaggatggtgatgaggctgatgagaaacaagaaccactccctccgccagctgcaaggggccgccgccggcgggctagcgtcgccgtcctcctcctccgcctccggcgccgccgcctcctccttctccaccctgcagcagcagcagcaggaggaccatcccgctcccggggcgctcaacatcagggacaccgccgcccacctcatcggccggacgccgctggtgtacctcaacaaggtgacggaggggtgcggcgcccgggtcgccgccaagctcgagttcctccagccttccttcagcgttaaggacaggccagcaatctccatgattgaagatgcggagaagaaggggctgataaccccaggcaagacgacgctgatcgagcctacatccgggaacatgggcatcggcctggcgttcatggctgcactcaaagggtacgagctcgtgctgacaatgccatcatacaccagcctcgagaggagggtggtcatgaaggccttcggtgcgcagctcgtgctcactgacccggccaaggggatgggaggcaccgtcaggaaagcaacccagctctatgagaaccatcccagcgccttcatgctccagcagttcgagaatcccgccaacgtccaggtgcactacgagaccaccggtccagagatatgggaggacacgctcggtcaggtcgacatcttcgtcatgggaatcggcagtggcggcaccgtcaccggcgtcggcaagtacctcaaggagaagaaccccaacgcaaagatctatggagttgagcctgccgaagcaaatgtactgaatggtggcaagccagggcctcacctcatcactggaaatggagttggatttaagccagatattttggacatggatataatggaaaaggttttagaggtgaaaggcgaggacgccgttaagatggcgcaacagttggcactgcaggagggcctgctggtggggatatcatcaggagccaacacagtggcagcaatcgaactcgcaaagaggccagaaaacaaagggaagctcatcgtgactgttcatccgagcgcgggagagcgatacctatcgtcggcgctattcgagggcctgaggaaggaggccgaggcaatgcagccagtgccagtggactaacttggagctacacaacgcatgcagaataaattcactgccaaccatgttgcgagtgctagtcatacctcatttgcaattcttcagtttgttcatcatgtgggcctggtgtaaacaacagttgtagtggttgaaaaagggactttatacctctctggagatctatgatgcacatgtagtttagcgttgtggggatcatgggtcaagtgatactatgtgcttccatcttgccaaagtcgaacagcctttgctctgtcagtgtgtgcggcgccgacatgcctgctcgggccgcctcgggtggtccactgggttgcgtcgtacttggggttccaccggcgagcccgctttgctggaatcgctgaaagtattcttagtcaa

SEQ ID NO: 4602 - DNA, 1487 bp, Secale cereale
ccacaccgcaccaaccgcgcctctcactgacccatcaactccactccactagcaatcgtaccttccgcccgaccgaccgaccagccatggagaggatggtgatgaggctgatgaggaacaagaaccactccctccgccagctgcaaggggccaccgccggcgggctagcgccgtcgtcctccgcctccggcgccgccgcgtcctccttctccaccctgcagcagcagcagcagcagcaggaggaccgtcccgctcccggggcgctcaacatcagggacaccgccgcccacctcatcggccggacgccgctggtgtacctcaacaaggtgacggaggggtgcggcgcccgcgtcgccgccaagctcgagttcctccagccttccttcagcgttaaggacaggccagcaatctccatgatcgaagatgcggagaagaaggggctgataaccccaggcaagacgacgctgatcgagcctacatccgggaacatgggcatcggcctggcattcatggctgcgctcaaagggtacgagctcgtgctgacgatgccatcatacaccagcctcgagaggagggtggtcatgaaggccttcggtgcgcagctcgtgctcactgacccggccaaggggatgggaggcaccgtcaggaaagcaacccagctctatgagaaccatcccagcgccttcatgctccagcagttcgagaatcccgccaacgtccaggtgcactacgagaccaccggtccggagatatgggaggacacgctggggcaggtcgatatcttcgtcatgggaatcggcagcggcggcaccgtcaccggcgtcggcaagtacctcaaggagaagaaccccaacgcaaagatctatggagttgaacctgccgaagcaaatgtactgaatggtggcaagccagggcctcacctcatcactggaaatggagttggatttaagccagatattttggacatggatataatggaaaaggttctagaggtgaaaggcgaggacgccgttaagatggcgcaacagttggcactgcaggagggcctgctggtggggatatcatcaggagccaacacagtggcagcgatcgaactcgcaaagaggccagaaaacaaagggaagctcatcgtgactgttcatccgagcgcgggagagcgatacctatcgtcggcgctattcgagggcctgaggaaggaggccgaggcaatgcagccagtgccagtggactaacttggagctatacaacgcatgcagaataaattcactgccaaccatgttgcgagtgctagtcatgcctcatttgcagttcttcggtttgttagtcatgtggacctggtgtaaacaacagttgtaatggttgaaaaagggactttatacctctctggagatctatgatgcacatgtgtttgcgttgtagggatcatgggtcaagtgatactatgtgcttcgatcttgccaaagtcgaacagcctttgttctgtcagt

SEQ ID NO: 4603 - DNA, 1335 bp, Triticum aestivum
ctccactagctacgcaccttccgaccgaccagcgagagagatggagaggatggtgatgaggctgatgaggaacaagaaccagtccctccgccagctgcaaggggccgccgccggcgtgctagcgtcgtcgtcctccgcctcctcggccgccggcgccgccgcgtctcccttctccaccctgcagcagcaggaggaccatcccggggtgctcaacatcagggacaccgccgcccacctcatcggccggacgccgctggtgtacctgaacaaggtgacggaggggtgcggcgcccgcgtcgccgccaagctcgagttcctccagccttccttcagcgttaaggacaggccagcaatctccatgatcgaagatgcggagaagaaggggctgataaccccaggcaagacgacgctaatcgagcctacatccgggaacatgggcatcggcctggcgttcatggctgcactcaaagggtacgagctcgtgctgacgatgccatcatacaccagcctcgagaggagggtggtcatgaaggccttcggcgcgcagctcgtgctcacagacccggcgaaggggatgggaggcaccgtcaggaaagcaacccagctctatgagaaccatcccagcgccttcatgctccagcagttcgagaatcccgccaacgtccaggtgcactacgagaccaccggtccggagatatgggaggacacgctcgggcaggtcgacatcttcgtcatgggaatcggcagcggcggcaccgtcaccggcgtcggcaagtacctcaaggagaagaaccccaacgcaaagatctatggagttgaacctgccgaagcaaatgtactgaacggtggcaagccagggcctcacctcatcactggaaatggagttggatttaagccagatattttggacatggatataatggaaaaggttctggaggtgaaaggcgaagacgccgttaagatggcgaagcagttggcactgcaagagggcctgctggtggggatatcatcaggagccaacacagtggcagcgatcgaactcgcaaagaggccagaaaacaaagggaagctcatcgtgactgttcatccgagcgcgggagagcgatacttgtcgtcggcgctatttgagggtctgaggaaggaggctgaggcaatgcagccagtgccagtggactaagttggagctatacaacgcatgtagaataaattcactgcaaccatgttgcaagtgctagtcatacctccatttgcaattcttcagtttgttcatcatgtggaactcgtgtaaacaacagttgaaatggttgaaaaaaggactttacctctctggagatc

SEQ ID NO: 4604 - DNA, 1372 bp, Triticum aestivum
accacagcacaccaaccgcgcgccactgatccatcaactccactccactagctacgtaccttccgaccgagcagccagagagatggagaggatggtgatgaggctgatgaggaacaagaaccagtccctccgccagctgcaaggggccgccgccggcgggctagcgtcgtcgtcctccgcctcctcgaccgccggcgccgccgcgtctcccttctccaccctgcagcagcaggaggaccatcccggggtgctcaacatcagggacaccgccgcccacctcatcggccggacgccgctggtgtacctgaacaaggtgacggaggggtgcggcgcccgcgtcgccgccaagctcgagttcctccagccttccttcagcgttaaggacaggccagcaatctccatgatcgaagatgcggagaagaaggggctgataaccccaggcaagacgacgctgatcgagcctacatccgggaacatgggcatcggcctggcgttcatggctgcactcaaagggtacgagctcgtgctgacgatgccatcatacaccagcctcgagaggagggtggtcatgaaggccttcggtgcgcagctcgtgctcactgacccggcgaaggggatgggaggcaccgtcaggaaagcaacccagctctatgagaaccatcccagcgccttcatgctccagcagttcgagaatcccgccaacgtccaggtgcactacgagactaccggtccggagatatgggaggacacgctcgggcaggtcgacatcttcgtcatgggaatcggcagcggcggcaccgtcaccggcgtcggcaagtacctcaaggagaagaaccccaacgcaaagatctatggagttgaacctgccgaagcaaatgtactgaacggtggcaagccagggcctcacctcatcactggaaatggagttggatttaagccagatattttggacatggatataatggagaaggttctggaggtgaaaggcgaggacgccgttaagatggcgaagcagttggcactgcaggagggcctgctggtggggatatcatcaggagccaacacagtggcagcgatcgaactcgcaaagaggccagaaaacaaagggaagctcatcgtgactgttcatccgagcgcgggagagcgatacttatcgtcggcgctattcgagggtctgaggaaggaggctgaggcaatgcagccagtgccagtggactaagttggagctatacaacgcatgtagaataaattcactgcaaccatgttgcaagtgctagtcatacctcatttgcgattcttcagtttgttcatcatgtggaactcgtgtaaacaacagttgaaatggttgaaaaaaggactttacctctctgga

SEQ ID NO: 4605 - DNA, 1337 bp, Secale cereale
actccactccactagcaatcgtaccttccgcccgcccgaccgaccagccatggagaggatggtgatgaggctgatgaggaacaagaaccactccctccgccagctgcaaggggccaccgccggcgggctagcgccgtcgtcctccgcctccggcgccgccgcgtcctccttctccaccctgcagcagcagcagcaggaggaccatcccgctcccggggtgctcaacatcagggacaccgccgcccacctcatcggccggacgccgctggtgtacctcaacaaggtgacggaggggtgcggcgcccgcgtcgccgccaagctcgagttcctgcagccttccttcagcgttaaggacaggccagcaatctccatgattgaagatgcggagaagaaggggctgataaccccaggcaagacgacgctgatcgagcctacatccgggaacatgggcatcggcctggcgttcatggctgcactcaaagggtacgagctcgtgctgacaatgccatcatacaccagcctcgagaggagggtggtcatgaaggccttcggtgcgcagctcgtgctcactgacccggccaaggggatgggaggcaccgtcaggaaagcaacccagctctatgagaaccatcccagcgccttcatgctccagcagtttgagaatcccgccaacgtccaggtgcactacgagaccaccggtccggagatatgggaggacacgctcggtcaggtcgacatcttcgttatgggaatcggcagcggtggcaccgtcaccggcgtcggcaagtacctcaaggagaagaaccccaacgcaaagatctatggagttgaacctgccgaagcaaatgtactgaatggtggcaagccagggcctcacctcatcactggaaatggagttggatttaagccagatattttggacatggatataatggaaaaggttctagaggtgaaaggcgaggacgccgttaagatggcacaacagttggcactgcaggagggcctgctggtggggatatcatcaggagccaacacagtggcagcaatcgaactcgcaaagaggccagaaaacaaagggaagctcatcgtgactgttcatccgagcgcgggagagcgatacttatcgtcggcgctattcgagggcctgaggaaggaggccgaggcaatgcagccagtgccagtggactaacttggagctatacaacgcatgcagaataaattcactgccaaccatgttgcgagtgctagtcatacctcatttgcaattcttcagtttgttcatcatgtgggcctggtgtaaacaacagttgtagtggttgaaaaagggactttatacc

SEQ ID NO: 4606 - DNA, 1452 bp, Hordeum vulgare
gcttggacaccaaccgtcacaccacaccactggcacacatagacgaccatccagcagcggagagctagagccccaaaccaaaggagagagatggagaggatggtgatgaggctcatgaggaataagtctcttctcgccggagcctctagccgcggcggcggaggactagcctcctcctccattgtcgactcttcccccttctccaccctgcagcagcagcagcagcaggaagaccccggtgtgctcaacatcagggacaccgccgcccacctcatcgggcggacgccgctggtgtacctgaacaaggtgacggaggggtgcggcgcccgggtcgccgccaagctcgagttcctccagccctccttcagcgtcaaggacaggccggcaatctccatgattgaagatgcggagaagaagggattgatcaccccgggcaagacgacgctgatcgagcctacgtccggcaacatgggcatcggcctggcgttcatggcggcgctcaaagggtacgagctcgtgctgacgatgccgtcctacaccagcctcgagcggagggtggtcatgaaggccttcggcgcgcagctcgtgctcaccgacccggccaaagggatggggggcaccgtgaggaaggccacccagctctatgacaaccatcctagcgcattcatgctccagcagttcgagaaccctgccaacgtccaggtgcactacgagaccaccggtccagagatatgggaggacacgcttgggcaggtcgacatcttcgtcatgggcatcgggagcggcggtactgtcaccggcgtcggcaagtacctcaaggagaagaaccccaatgccaagatctatggagttgaacctgccgaagcaaatgttctcaatggtggcaagccagggcctcacctcatcactggaaatggagtgggattcaagccagacattttggacatggatataatggagaaggttcttgaggtgaaaggtgaggatgctgtcaagatggcacaacaattggcgctgcaagagggtctgctggtggggatatcatcaggagccaacacggtggcagcgattgaacttgcaaagaggcccgaaaacaaagggaagctcatcgtgactgttcatccaagcgcgggagagcgatacttatcgtcggcgctgttcgagggtctgaggaaggaggcggaggctatgcagccagtgccagtggactaacttggagccatataatgcatacggaataaattcactgcattaccatgttgcaagtgctagttgtatgtgcctcgttcgcaattcctcggtttgttccttcatgtggacattgtgtaaacaacagttgaaatggttgaaaaaaggacttttacctctctggagagtggagatgtatgatgtacatatatgtttgagttgtggggatcattcatgggtcaagtgatactatgtgcaccagtt

SEQ ID NO: 4607 - DNA, 1339 bp, Triticum aestivum
ctccactagctacgtaccttccgaccgagcagccagagagatggagaggatggtgatgaggctggtgaggaacaagcagtccctccgccagctgcaaggggccgccgccggcggcctagcgtcgtcgtcctccgcctcctcgaccgccggcgccgccgcgtcctccttctccaccctgcagcagcagcaggaggaccaccccggagtgctcaacatcagggacaccgccgcccacctcatcggccggacgccgctggtgtacctgaacaaggtgacggaggggtgcggcgcccgcgtcgccgccaagctcgagttcctccagccttccttcagcgtcaaggacaggccagcaatctccatgatcgaagacgcggagaagaaggggctgataaccccaggcaagacgacgctgatcgagcccacatccgggaacatgggcatcggcctggcgttcatggcagcactcaaagggtacgagctcgtgctgacgatgccatcatacaccagcctcgagaggagggtggtcatgaaggccttcggtgcgcagctcgtgctcactgacccggccaaggggatgggaggcaccgtcaggaaagcaacccagctctatgagaaccatcccagcgccttcatgctccagcagttcgagaatcccgccaacgtccaggtgcactacgagactaccggtccggagatatgggaggacacgctcgggcaggtcgacatcttcgtcatgggaatcggcagcggcggcaccgtcaccggcgtcggcaagtacctcaaggagaagaaccccaacgcaaagatctatggagttgaacctgccgaagcaaatgtcctgaacggtggcaagccagggcctcacctcatcactggaaatggagttggatttaagccagatattttggatatggatataatggagaaggttctagaggtgaaaagcgaggacgccgttaagatggcgcaacagttggcactgcaggagggcctgctggtggggatatcatcaggagccaacacagtggctgcgatcgaactcgcaaagaggccagaaaacaaagggaagctcatcgtgactgttcatccgagcgcgggagagcgatacttatcgtcggcgctattcgagggtctgaggaaggaggctgaggcaatgcagccagtgccagtggactaagttggagctatacaatgcatgtagaataaattcactgcaaccatgttgcaagtgctagtcatacctcatttgtgattcttcagtttgttcatcatgtggaagtcgtgtaaacaacagttcaaatggttgaaaaaaggactttacctctctggagatccatga

SEQ ID NO: 4608 - DNA, 1342 bp, Avena sativa
ggagtcagatatacagtgtagggagatggagaggatggtgatgaggctggccaggaggaacaggtctctcttccaagcaggaggaggaggaggcatcagggtcgtctccggcgccggcggctcgtccttcttctccacccagcagcagctggtggaggacccgccggcgctcaaaatcagggacactgccgcccatctgatcgggcggacgccgctggtgtacctgaacaaggtgacggaggggtgcggcgcccgggtcgccgccaagctcgagttcctccagccctcattcagcgtcaaggacaggcctgcaatttccatgattgaagatgcggagaagaaggggttgataaccccaggcaagacgacgctgattgagccaacatccgggaacatgggcatcggcctggccttcatggctgcgctcaaagggtacgagttgatattgacgatgccatcctacaccagcctcgagaggagggtggtcatgaaggcctttggcgcgcagctcgtgctcaccgacccagccaaagggatgggagggacggtaaggaaggcgacccagctctatgagaaccatcccagcgccttcatgctccagcaatttgagaaccctgccaatgtccaggtacactatgagacgaccggtccagagatatgggaggacacgctcgggcaggtcgacatcttcgtcatggggattggtagtggcggtaccgtcactggtgtcggcaagtacctcaaagagaagaaccccaatgcaaagatctacggagttgaaccagccgaagcaaatgttctcaatggtggcaagccagggcctcacctcatcactggaaatggagttggatttaagccagatattctggacatggatataatggagaaggttcttgaggtgaaaagtgaggacgccgttaagatggcgcaacagttggcactgaaagaaggtcttctggtagggatctcatcaggagccaacacggttgcagccatcgaactcgccaagaggccagaaaacaaagggaacctcatcgtgaccgttcatccgagcgcgggagagcgatacttgtcgtcggcgctgtttgagggtctgaggaaggaagccgaggccatgcagccagtgccagtggagtaagttgcaactgtggagtgaatgcatatacagaataaaagttcactggcttaccatgccgcaagtcctagttgtacctcatttgcaatcttcggtttgtgcctcatgtagttatgtaaacaaatgtcaaaatggttgaaacagtacttcacttttctagggatttatgatattgacgtgtttgagttatggggaattacataagcc

SEQ ID NO: 4609 - DNA, 1441 bp, Leymus cinereus x Leymus triticoides
  misc_feature (29)..(29): n is a, c, g, or t
  misc_feature (47)..(48): n is a, c, g, or t
  misc_feature (51)..(53): n is a, c, g, or t
  misc_feature (60)..(60): n is a, c, g, or t
  misc_feature (80)..(80): n is a, c, g, or t
  misc_feature (83)..(84): n is a, c, g, or t
  misc_feature (87)..(88): n is a, c, g, or t
  misc_feature (90)..(90): n is a, c, g, or t
  misc_feature (93)..(94): n is a, c, g, or t
  misc_feature (97)..(97): n is a, c, g, or t
  misc_feature (99)..(100): n is a, c, g, or t
  misc_feature (105)..(105): n is a, c, g, or t
  misc_feature (117)..(117): n is a, c, g, or t
  misc_feature (152)..(152): n is a, c, g, or t
  misc_feature (155)..(155): n is a, c, g, or t
  misc_feature (166)..(166): n is a, c, g, or t
  misc_feature (188)..(188): n is a, c, g, or t
  misc_feature (197)..(197): n is a, c, g, or t
  misc_feature (200)..(200): n is a, c, g, or t
  misc_feature (206)..(206): n is a, c, g, or t
  misc_feature (216)..(216): n is a, c, g, or t
  misc_feature (227)..(227): n is a, c, g, or t
  misc_feature (239)..(239): n is a, c, g, or t
  misc_feature (245)..(245): n is a, c, g, or t
  misc_feature (257)..(257): n is a, c, g, or t
  misc_feature (266)..(266): n is a, c, g, or t
  misc_feature (287)..(287): n is a, c, g, or t
  misc_feature (311)..(311): n is a, c, g, or t
  misc_feature (341)..(341): n is a, c, g, or t
  misc_feature (347)..(348): n is a, c, g, or t
  misc_feature (356)..(356): n is a, c, g, or t
  misc_feature (368)..(368): n is a, c, g, or t
  misc_feature (371)..(371): n is a, c, g, or t
  misc_feature (377)..(377): n is a, c, g, or t
  misc_feature (389)..(389): n is a, c, g, or t
  misc_feature (392)..(392): n is a, c, g, or t
  misc_feature (422)..(423): n is a, c, g, or t
  misc_feature (428)..(428): n is a, c, g, or t
  misc_feature (443)..(443): n is a, c, g, or t
  misc_feature (461)..(461): n is a, c, g, or t
  misc_feature (488)..(488): n is a, c, g, or t
  misc_feature (509)..(509): n is a, c, g, or t
  misc_feature (513)..(513): n is a, c, g, or t
  misc_feature (515)..(515): n is a, c, g, or t
  misc_feature (518)..(518): n is a, c, g, or t
  misc_feature (520)..(521): n is a, c, g, or t
  misc_feature (530)..(530): n is a, c, g, or t
  misc_feature (746)..(746): n is a, c, g, or t
  misc_feature (788)..(788): n is a, c, g, or t
  misc_feature (821)..(821): n is a, c, g, or t
  misc_feature (830)..(830): n is a, c, g, or t
  misc_feature (854)..(854): n is a, c, g, or t
  misc_feature (866)..(866): n is a, c, g, or t
  misc_feature (896)..(896): n is a, c, g, or t
  misc_feature (920)..(920): n is a, c, g, or t
  misc_feature (935)..(935): n is a, c, g, or t
  misc_feature (945)..(945): n is a, c, g, or t
  misc_feature (953)..(953): n is a, c, g, or t
  misc_feature (957)..(957): n is a, c, g, or t
  misc_feature (974)..(974): n is a, c, g, or t
  misc_feature (986)..(986): n is a, c, g, or t
  misc_feature (989)..(989): n is a, c, g, or t
  misc_feature (998)..(998): n is a, c, g, or t
  misc_feature (1001)..(1001): n is a, c, g, or t
  misc_feature (1055)..(1055): n is a, c, g, or t
  misc_feature (1061)..(1061): n is a, c, g, or t
  misc_feature (1065)..(1065): n is a, c, g, or t
  misc_feature (1076)..(1076): n is a, c, g, or t
  misc_feature (1085)..(1085): n is a, c, g, or t
  misc_feature (1095)..(1095): n is a, c, g, or t
  misc_feature (1106)..(1106): n is a, c, g, or t
  misc_feature (1146)..(1146): n is a, c, g, or t
  misc_feature (1152)..(1152): n is a, c, g, or t
  misc_feature (1156)..(1156): n is a, c, g, or t
  misc_feature (1159)..(1159): n is a, c, g, or t
  misc_feature (1171)..(1171): n is a, c, g, or t
  misc_feature (1174)..(1174): n is a, c, g, or t
  misc_feature (1177)..(1177): n is a, c, g, or t
  misc_feature (1194)..(1194): n is a, c, g, or t
  misc_feature (1197)..(1197): n is a, c, g, or t
  misc_feature (1199)..(1199): n is a, c, g, or t
  misc_feature (1281)..(1281): n is a, c, g, or t
  misc_feature (1408)..(1409): n is a, c, g, or t
gagagatggagaggatggtgatgaggctnatgaggaacaagtttctnntcnnnggagccngccgcggcggactagcctcntcnnccnncnccnncancnncggcnccgactcatctnccttctccaccctgcagcaacagcagcaggaagancancccagggccgngatgctcaacatcagggacacngccgcccanctnatcggncggacgccgntggtgtacctnaacaaggtgacngagggntgcggcgcccgngtcgccgcnaagctcgagttcctccagccntccttcagcgtcaaggacaggccngcaatctccatgattgaagatgcggagaanaagggnntgatcacnccaggcaagacnacnctgatngagcctacatcnggnaacatgggcatcggcctggcgttcatggcnncgctnaaagggtacgagctngtgctgacgatgccgtcntacaccagcctcgagaggagggtggtnatgaaggccttcggcgcgcanctcntnctnanngacccggcnaaagggatgggtggcaccgtgaggaaagcaacccagctctatgagaaccatcctagcgccttcatgctccagcagttcgagaaccctgccaacgtcaaggtgcactacgagaccacgggcccggagatatgggaggacacgcttgggcaggtcgacatcttcgtcatggggatcgggagcggcggcaccgtcaccggcgtcggcaagtacctcaangagaagaaccccaatgcaaagatctatggagttgaacctgcngaagcaaatgttctgaatggtggcaagccaggncctcacctnatcactggaaatggagtgggattnaagccagatatnttggacatggacataatggagaaggttctngaggtgaaaggtgaggatgccgtnaagatggcgcaacanttggcactgnaagagggnctgntggtagggatatcatcnggagccaacacngtngcagcgatnganctcgcaaagaggccagaaaacaaagggaagctcatcgtgactgttcatccgagngcaggngagnggtacctatcntcggcgctnttcgagggtntgaggaaggangctgaggcaatgcagccagtgccagtggactaacttgganctatanaatncanacacaataaatncantgnctaccatgttgcaagtnctngntgtacctcatttgcaattctttggtctgttcctcatgtggaccccgtgtaaacaacagatcagctgcagcatataaacatancagagggagattagtttcctcccattacaatctttttgtgctgcaaatgatttcttacttcttggttaaaaacaatgtgtaatgcaatgtaaactagtaatagtaactagtaagtgtaattgccaannagttcctctctgttctgaatgattaattacca

SEQ ID NO: 4610 - DNA, 2065 bp, Zea mays
cctccgcctccgcctccgcctcggtgttcaacgttcgaccaccactccgcgagctagaacggtgagcaaagccgtctccgcgcacgcaacggccggcgaccaccgcaggcggcatggacaggctcggcgcgaatccggccaactcctgcccgctcacgccgctgggcttcctggagcgcaccgccaccgtgtacggcgactgcccctccgtcgtctaccacgacaccgtctacacctggtcccagacgcaccggcgctgcctccgcctcgcctccgcgctcgtctccctcggcgtctcccgcggcgacatcgtgtccgtgctgctgcccaacgtgccggccatgtacgagatgcacttcggggtgcccatgagcggcgccgtgctcaacaccatcaacacgcgcctggacgcgcgcacggtctccgtcctgctccgccacgccggctccaagctcgtcttcgccgacccggcgagcatgccgctcgtccgggacgcgctgagtcagctcccgccggggcacccggcgccgcgcgtcgttcccgtcgaggacccgcacgagacggagttccccgcggcggcgcctggggcgctgacgtacgaggcgctcctcgacgggggtgacccggagttcgcgtgggtgcggccagccagcgagtgggacccgatgatactcaattacacctccggcacgacgtcggcgcccaagggcgtggtgcactgccaccgcggcatcttcctggtcaccgtcgacgcgctcgtggagtgggcggtgccgccgcggccgacgtacctgtggacgctgcccatgttccacgccaacgggtggtgcttcccgtgggggatggcggcggtaggtggcaccaacgtgtgcctgcgccgcgtggacgccgccgaggtgtacgacgccatcgcgcggcgcggggtcgaccacctctgcggcgcgcccgtcgtgctcaacatgctggccaacgccccggacgccgcccggcggccgctcccgggtaaggtgcgaatcctcaccgccggcgcgccgccacctgccgccgtgctgcaccgcaccgagtccatcggcttcgaggtcacccacgggtacgggctgaccgagacggcggggctggtggtatgctgcgcgtggaagcgggagtggaacaagctgcccgcgtcggagcgcgcgcggctcaaggcgaggcagggcgtgcgcacgcccggcatgaacgaggtcgacatcgtcgacggcgagaccggtcgcagcgtgcctcgcgacgggtccacgatgggcgagatcgtgctccgcggcggcggcgtcatgctcggctacctcaacgacgacaaggccacgagggcggcgatacgggacaacgggtggttctacaccggggacgttggcgtgatgcacccggacgggtacatggagatccgggaccggtccaaggacgtgatcatcagcggcggggagaacatcagcagcgtggaggtggagtccgtgctctacaaccacccggcggtgaacgaggcggcggtggtggcgcggccggacgagttctggggcgagacgccgtgcgcgttcgtgagcctcaaggaggggtcgggcgcggtgaccgcggcggatgtcatcgcctggtgccgggaccgcatgccgcactacatggtgcccaagacggtggttctccgcgctgagctgcccaagacctccactgggaagatccagaagtacgtgctgcggaaccttgccaaggagatgggacccacccgaaagggcgccagtagcagcagcaggatgtagggcactaacgctagtactagtgctgtgccgtcgtcttgcttggcatggtcgcatggacatgtcacatgtgtcctctctgcagcttgccgtcgcagcatggcgttggctggcatccattttcttgagatcagcgagccctcttaccgattcttggaaaggatttatgatagggatactaccgttacagcagatatgtctccgttttatcttgtagggagtgaataacaaagtgaatgggtgtcattgatagtttgatacagacgatatgtctatgggttctc

SEQ ID NO: 4611 - DNA, 2037 bp, Setaria italica
ctctgtttgtctccgtgtctcacttgctcactctccagtctcctcaaccaccccccgcgtgctgggtcggtccacgcaagccaggcctccaccggcgccggcgaccccgcggcggcatggacaggctcggcgctaacccggccaactcgtgcccgctcacgccgctgggcttcctggagcgctcggcgaccgtgttcggcgactgcccctccgtcgtataccacgacaccgtcttcacctggtcacagacgcaccggcgatgcctccgcctcgcctccgcgctcgtctccctcggcatctcccgcggcgacatcgtgtccgtgctgttgcccaacgtgcctgccatgtacgagatgcacttcggcgtgcccatgagcggcgccgtgctcaacaccatcaacacgcgcctcgacgcgcgcacggtcgccgtcctgctccaccactcgggttccaagctcgtcttcgccgacccggcctcgctcccgctcatccgagacgcgatgaagcagctcccgcccgggcacccggcgccgcgcgtcatccccgtcgaggacccccacgagaaggagttcccggccgccccgcccgggaccttgacgtacgagaggctcctcgagaagggcgatccggagttcgcgtgggtgcgaccggccagcgagtgggacccgatgatactgaactacacctccggcacgacgtcggcgcccaagggcgtggtgcactgccaccgcggcatcttcctggtcaccatggactcgctcgtggcgtgggcggtgccgccgcagccgacgtacctgtggacgctgcccatgttccacgccaacggctggagcttcccgtggggggtggccgtggtgggcggcaccaacgtgtgcctccgccgcgtcgacgccaccgaggtgtacgccaccatcgcgcgccgcggggtcaaccacctctgcggcgcgcccgtagtgctcaacatgctggccaacgcccccgacggtgtgcggcagccgctccagggaaaggtgcgcatcctcaccgccggcgcgccgccgccggcggccgtgctgaaccgcacggagtccatcggcttcgaggtcagccacggttacgggctgaccgagaccgcggggctcgtcatgagctgcgcgtggaagggcgagtggaacaagctcccggcgtcggagcgggctcggctcaaggcgaggcagggcgtgcgcacgccgggcatggccgaggtggacatcatcgacggcgagaccgggcgcagcgtgccccgggacgggtcgacgatgggcgagatcgtgctccgcggcgggtgcctcatgctcggctacctggacgacgacaaggcgaccagggcggcgatacgggacgacgggtggttctacacgggggacgtgggcgtgatgcacccggacgggtacatggagatccgggaccggtccaaggacgtgatcatcagcggcggggagaacatcagcagcgtggaggtggagtcggtgctgtacaaccacccggcggtgaacgaggcggcggtggtggcgcggccggacgagttctggggagagacgccgtgcgcgttcctgagcctcaaggagggatcgccgggcgcggtgaccgccagcgacgtcatggcgtggtgccgggagcgcatgccgcgctacatggtgcccaagacggtggtgttccgggccgagctgcccaagacatccacgggaaagatccagaagtacgtgctccggaaccttgccaaggagatggggccgacgcgcaagggcgccagtagcagcagcaagatgtagtgcgtggtgctgtcgtcttgcttggcaatttggcatggacatgtgctctgcagcatgggctcgacatgcatcttcttgggatcagcaaaaggcctccaatctctctctctcgccgatggatgattgcaaagggttgacgattgtgatataacagatttgtctccttttttcttgtggtgactcacaagtgaataactatgattgatacggccgatgtgaagttatccaagtccaaagaatgatcacg

SEQ ID NO: 4612 - DNA, 2206 bp, Zea mays
agcatcgcttttcctttgcaatcgcatcctacttagctctgttccgtagaaatgaaatccagattgctcttgtactctttccccatcttggccgactcaaccaaacgcctgcattcagataaagtctcacttccgccgcagccacctcgaccactcttcgagagtgcgagctagttgtagatcggcgaggccgtctccgttcgcacaagccagacctcttcgcgccggcaatggacaggctcggcgcgaatccggcgaactcgtgcccgctgacgccgcttggcttcctggagcgctcggccaccgtcttcggcgattgccactccgtcgtgtaccacgacacggtcttcacctggtcccagacacaccggcgatgcctccgcctcgcctccgcgctcgtctctctcggcatcaaccgcggcgacatcgtgtccgtgctgttgcccaacgtgccggccatgtacgagatgcagttcggagtgcccatgagcggcgccgtgctcaacaacatcaacatgcgcctggacgcgcgcacggtcgccgtcctgctccgccactccggctccaagctcgtcttcgtggacccggcgtctctaacgcttatcagagacgcgctgaagcagctcccgcaggggcacccggcaccgcgcgtcatccccgtcgaggatccccacgagaaggggctccctgccgccccgcccgggtcactgacgtacgaggggcttctcgagaagggcgacccggagttcgcgtgggttcggccggccagcgagtgggacccgatggtactcaactacacctccggcacgacgtcggagcccaagggggtggtgcactgccaccgcgggatcttcttgatcacgctcgactcgctcattgaatgggcggtcccgccgcagccgacgtacctgtggacgctgcccatgttccacgccaacggctggagcttcccatgggggatggccgtggtgggcggcaccaacgtctgcctgcgccgcgtcgacgccgccgaggtgtacgccaccatcgcgggccgcggcgtcagccacctctgcggcgcgcccgtcgtgctcaacatgctggccaacgccccggagggcgtgcggcggccgctcccggggaaggtgcgcatcctaactgccggcgcgccaccgccggctgccgtgctgcaccgcacggagtccatcgggttcgaggtcatccacgggtacgggctgaccgagacggcggggctggtggtctgctgcgcgtggaagggggagtggaacaagctccccgcgtcggagcgcgcgcggctcaaggcgaggcaaggcgtgcgcacgcctggcatggccgaggtggacatcgtcgacggcgagaccgggcgcagcgtcccccgcgacgggtccacgatgggcgagatcgtgctccgcggcggctgcgtcatgctcggctacctggacgacgacaaggccaccaaggcggcgatacgcgacaacgggtggttctacacgggggacgtcggcgtgatgcatcctgacgggtacatggagatccgcgaccggtccaaggacgtgatcatcagcggcggggagaacatcagcagcgtggaggtggagtccgtgctgtacagccacccagcggtgaacgaggccgcggtggtggcacggccggacgatttctggggagagacgccgtgcgcattcgtgagcctcaaggaggagggatcgacggctgccgatgtcatcgcgtggtgccgccagcgcatgccacactacatggtgccgagaacggtggtgtttcgcgacgagctgccaaagacctccaccggcaagatccaaaagtacgtgctccgcaaccttgccaaggagatggggtcaacccacaagggcgccagcagaattagcaagatgtagaggactgtcgtcttgcttggcgtgctttgctgcaagctgtagcatggggctgacacgcatctcaatctcattgagatcgacaactactcagaatagtatgattgatgcgcatggagtgtgatataaagatttttctccttttttttatcttatcgtgtcgtcactcacaagctaaagacaatgtagatagatatgatcgatacgggcaaagtccaaagtggatcaatgaccaagccggactccctccagcccaaattataacatcttaaaattaactaaatttatataataaaacaataatatttacaata

SEQ ID NO: 4613 - DNA, 2063 bp, Sorghum bicolor
agataaaattcttctcctacgccactctgcgagagtgcgagctagagtagatcgctgaggccgtctccgttcacgcaagccagacctccacctctcgcggtcgcgccgccggctacctcacggcaatggacaggctcggctcgaatccggcgaactcatgcccgctcacgccgctgggattcctggagcgtgcggccaccgtcttcggcgactgctcctccgtcgtctaccacgacacggtcttcacctggtcgcagacacaccggcgatgcctccgcctcgcctccgcgctcgtctccctcggcatcacccgcggcgatatcgtgtccgtgctgttgccgaacgtgccggccatgtacgagatgcagttcggagtgcccatgagcggcgccgtgctcaacaacatcaacacgcgcctggacgcgcgcacggtcgccgtcctgctccgccactccggctgcaagctcgtcttcgtcgacccggcgtctctaacgctcatcacagacgcgctcaagcagctcccgcacgggcacccggcgccgcgcgtcatcctcgtcgaggatccccacgagaagggtctccccgccgccccggccgggtcactgacgtacgagaggcttctcgagaatggcgacccggagttcgcgtgggtgcggccggccagcgagtgggagccgatgatactgaactacacctccggcacgacgtcggagcccaagggcgtggtgcactgccaccgggggctcttcctgatcacgctcgactcgctcatcgaatgggcggtcccgccgcaggcgacgtacctgtggacgctgcccatgttccacgccaacggctggagcttcccgtgggggatggccgtggtgggcggcaccaacgtctgcctgcgccgcgtcgacgccggcgaggtgtacgccaccatcgcggcccgcggggtcactcacctctgcggcgcgcccgtcgtgctcaacatgctggccaacgccccggaggtcgtgcggcggccgctcccggggaaggtgcgcatcctaaccgccggcgcgccgccgccggctgccgtgctgcaccgcacggagtccatcgggttcgaggtcagccacgggtacgggctgaccgagacggcggggctggtggtctgctgctcgtggaaacgggagtggaacaagctccccgcgtcggagcgggcacggctcaagtcgaggcagggtgtgcgcacgccgggcatggccgaggtcgacatcgtcgacggcgagaccggacgcagcgttccccgcgacgggtccacgatgggcgagatcgtgctccgcggcggctgcgtcatgctcggctacctcaacgacgataaggccaccggggcggcgatacgcgaagacgggtggttctacacgggggacgtcggcgtgatgcacccggacgggtacatggagatccgcgaccggtccaaggacgtgatcatcagcggcggggagaacatcagcagcgtggaggtggagtccgtgctctacagccacccggcggtgaacgaggccgcggtggtggcgcggccggacgacttctggggagagacgccgtgcgcgttcgtgggactcaaggagggagcgtcggcgggcgcggtgacggccgccgatgtcatcgcgtggtgccgccagcgcatgccgcactacatggtgccgagaacggtggtgtttcgcgacgagctgccaaagacctccaccggcaagatccaaaagtacgtgctccggaaccttgccaaggagatggggtcaacccggaagggaggcagcagcatcagcaagatgtagtagggatgtcctcttgtttggcgtgctcgctgcacgctgtagcatggcatggggttggcaacttggcatgcatctcctttggatcggcactactcaaagtagtataattgatgcggacctggacgcatggggtttcctgatacatcagatttgtctcatttttttttatcttatccgatcctgtggtgactcacaagctaaatgattgatagggacgaatgctcagactgtattcttaaacttctgattttattttgtgtt

SEQ ID NO: 4614 - DNA, 3146 bp, Sorghum bicolor
gctttattatcttcagtatctagctccttgtacagttgtacgtccaaaaacagagcagtgacttcagtgtcttgcacggataggggcaaatgaagatttttcaggtatagcggaagtgactgtgtgagcattccaacacggaactcacaacagcgatagagattagagattagagaatcgaggatacggttgctccgtgagcggtcctcatcctaatacgtggactgatcttttgggcaatatatactatataatatcacacacgatcagatcacgccaatgcccaatcaagagcaacaaaataggcccatgcccttgtccatcatcctactcatgatctgtatcatttgtcccggtgccgagaacgtctctcttttcttcgtttttctagatataaaaagataggcagaggagattgctccgtagcgaagtgacacagctccagctcgacatctgatcgattcaacacagggcacggaggtgaaccggtgaattctcggtcagctgctgtcatcctatagctgacttgaacagtttttgcataagcatctagtactgacctcaccgtgtgaagtctcggtcacagctgctttcatcctcctccgaatcttagaaaatttagaggtgacgatgaagagaggcaccggcactgcatgcattttctaatccgtatcttggattagcatcaactaacatggtcagtccgtagaatccagaatagtcttgcacttgcatttttatctgccgtctctcccatcgtgtagcaccagaattaagccgcctcagccaaacacctggcttcagataaaattcttctcctacgccactctgcgagagtgcgagctagagtagatcgctgaggccgtctccgttcacgcaagccagacctccacctctcgcggtcgcgccgccggctacctcacggcaatggacaggctcggctcgaatccggcgaactcatgcccgctcacgccgctgggattcctggagcgtgcggccaccgtcttcggcgactgctcctccgtcgtctaccacgacacggtcttcacctggtcgcagacacaccggcgatgcctccgcctcgcctccgcgctcgtctccctcggcatcacccgcggcgatatcgtgtccgtgctgttgccgaacgtgccggccatgtacgagatgcagttcggagtgcccatgagcggcgccgtgctcaacaacatcaacacgcgcctggacgcgcgcacggtcgccgtcctgctccgccactccggctgcaagctcgtcttcgtcgacccggcgtctctaacgctcatcacagacgcgctcaagcagctcccgcacgggcacccggcgccgcgcgtcatcctcgtcgaggatccccacgagaagggtctccccgccgccccggccgggtcactgacgtacgagaggcttctcgagaatggcgacccggagttcgcgtgggtgcggccggccagcgagtgggagccgatgatactgaactacacctccggcacgacgtcggagcccaagggcgtggtgcactgccaccgggggctcttcctgatcacgctcgactcgctcatcgaatgggcggtcccgccgcaggcgacgtacctgtggacgctgcccatgttccacgccaacggctggagcttcccgtgggggatggccgtggtgggcggcaccaacgtctgcctgcgccgcgtcgacgccggcgaggtgtacgccaccatcgcggcccgcggggtcactcacctctgcggcgcgcccgtcgtgctcaacatgctggccaacgccccggaggtcgtgcggcggccgctcccggggaaggtgcgcatcctaaccgccggcgcgccgccgccggctgccgtgctgcaccgcacggagtccatcgggttcgaggtcagccacgggtacgggctgaccgagacggcggggctggtggtctgctgctcgtggaaacgggagtggaacaagctccccgcgtcggagcgggcacggctcaagtcgaggcagggtgtgcgcacgccgggcatggccgaggtcgacatcgtcgacggcgagaccggacgcagcgttccccgcgacgggtccacgatgggcgagatcgtgctccgcggcggctgcgtcatgctcggctacctcaacgacgataaggccaccggggcggcgatacgcgaagacgggtggttctacacgggggacgtcggcgtgatgcacccggacgggtacatggagatccgcgaccggtccaaggacgtgatcatcagcggcggggagaacatcagcagcgtggaggtggagtccgtgctctacagccacccggcggtgaacgaggccgcggtggtggcgcggccggacgacttctggggagagacgccgtgcgcgttcgtgggactcaaggagggagcgtcggcgggcgcggtgacggccgccgatgtcatcgcgtggtgccgccagcgcatgccgcactacatggtgccgagaacggtggtgtttcgcgacgagctgccaaagacctccaccggcaagatccaaaagtacgtgctccggaaccttgccaaggagatggggtcaacccggaagggaggcagcagcatcagcaagatgtagtagggatgtcctcttgtttggcgtgctcgctgcacgctgtagcatggcatggggttggcaacttggcatgcatctcctttggatcggcactactcaaagtagtataattgatgcggacctggacgcatggggtttcctgatacatcagatttgtctcatttttttttatcttatccgatcctgtggtgactcacaagctaaatgattgatagggacgaatgctcagactgtattcttaaacttctgattttattttgtgttaagtttatgttgtgtagcactgtagctcgcaccttttaaaatcagaacccaaaagtaggggcgtattttttctactcttaagcgcatgtgctcccactctctgcaccactggattcatattgagatgtatatttgcacactttttaatgcaaatccagtagtggagagagtaagagcatatgttcttaagggtaaaaataactttaccccaaaagtagctcctgaaaatttttgaaatgttgtttgtgtcttggttgatgttttaagtcgctatatactgc

SEQ ID NO: 4615 - DNA, 2315 bp, Oryza sativa
ctttataaatgcaattggaaattagtactatatactgtactccatatattactactaaatccattcctccttatttgacatagttgaccagcgtaaatttcactcgctgttgccctatccttagccgttgatctcgatccaacgggcaggaatcaaggtgactgagattcggagaataagtcatctggtcaatagcaaactggttttatatcaccgcagcctcctcactcgctctttcctcgcctccactccaaccaccccgcgatagctggagtcaccggcgttcacacaggcgacagctcgtgctccggcgatcgacgcggcggccatggacaagctcggcgccaacccggccaactcgtgcgcgctcacgccgctgggcttcctggagcgcgccgccaccgtgttcggcgactgcccgtccgtcgtctaccacgacaccgtcttcacgtggtcgcagacccaccgccgctgcctccgcctcgcctccgcgctcgtctcctccctcggcatctcccgcggcgacgtcgtgtccgtgctcctgccgaacgtgccggcgatgtacgagatgcacttcgccgtgccgatgagcggcgccgtgctgaacagcatcaacacgcggctcgacgcgcgcacggtgtccgtcctgctccgccactccggctccaagctcatcttcgtcgacccggcgctgctccccgtcctccgcgacgcgctccgcctcctcccggcggggcacacggccccgcgcgtcgtcctcgtcgaggatccccatgagaaggagttccctcccgcccccgccgccgcgctgacgtacgagaggctcgtcgagaagggggacccggagttcgcgtgggtgcggccggcgagcgagtgggacccgatgatcctcaactacacctccggcaccacgtcggcgcccaagggggtggtgcactgccaccgggggatcttcctcatcaccgtcgactcgctggtcgactgggcggtgccgccgcggccgacgtacctgtggacgctccccatgttccacgccaatggctggagcttcccatgggggatggccgtggtgggcggcaccaacgtctgcctccgccgcgtcgacgccgccgaggtgttcgacacaatcgcgcgccgcggcgtcaaccacctgtgcggcgcgcccgtcgtgctcaacatgctggcgaacgcgcccgagggcgtgcggaagccgctcccggggaaggtgcggatcctcacggccggcgcgccgccgccggccgccgtgctgtaccgcacggaggcgatcggcttcgaggtcagccacgggtacgggctgacggagaccgcgggtctggtgctctcgtgcgcgtggaagggcgagtgggacaagctcccggcctccgagcgcgcgcggctcaaggcgaggcagggcgtgcgcacgccggggatggccgaggtggacgtcgtggacggcgagaccggccgcagcgtgccccgcgacgggtcgaccatgggcgagatcgtgctccgcggcggctgcatcacgctgggctacctcaacgacgaggcggcgacgaaggcggcgatccgggacaacgggtggttctacaccggcgacgtcggggtgatgcacccggacgggtacgtggagatccgggaccggtccaaggacgtgatcatcagcggcggggagaacatcagcagcgtggaggtggagtccgtgctgtacggccacccggcggtgaacgaggcggcggtggtggcgcggccggacgagttctggggggagacgccgtgcgcgttcgtcagcctcaagcagggcggcggcgcggtgacggcggcggacgtggtcgcgtggagccgggagcgcatgccgcggtacatggtcccaaagacggtgatcttccgcgacgagttaccgaagacgtccaccgggaagatccagaagtacgtgctccggaatatcgccaaggagatggggcccaccacgggcaccaacaccaaacgcaacagtaaaatgtagcggcatctagccagcagatgtgtcacttgctttttagcgtcgtcgtcgtcgtcgtcgtcttcttcactcggacagagtcacagagcagaaatgcctggtgcaggcagaggctgatgcattccgcattgtcatggcatggtatgttggcctgtttttttgggggggggggggtgtttagatgcaccgataattttttttaaagacatgtacgaagtattaaatattagacgaaaaaaactaattacatagtttgtgtgtaaattacgagacgaatcttttaaaccaaattgttccatgatttaacaatgtg

SEQ ID NO: 4616 - DNA, 2334 bp, Oryza sativa
ctttataaatgcaattggaaattagtactatatactgtactccatatattactactaaatccattcctccttatttgacatagttgaccagcgtaaatttcactcgctgttgccctatccttagccgttgatctcgatccaacgggcaggaatcaaggtgactgagattcggagaataagtcatctggtcaatagcaaactggttttatatcaccgcagcctcctcactcgctctttcctcgcctccactccaaccaccccgcgatagctggagtcaccggcgttcacacaggcgacagctcgtgctccggcgatcgacgcggcggccatggacaagctcggcgccaacccggccaactcgtgcgcgctcacgccgctgggcttcctggagcgcgccgccaccgtgttcggcgactgcccgtccgtcgtctaccacgacaccgtcttcacgtggtcgcagacccaccgccgctgcctccgcctcgcctccgcgctcgtctcctccctcggcatctcccgcggcgacgtcgtgtccgtgctcctgccgaacgtgccggcgatgtacgagatgcacttcgccgtgccgatgagcggcgccgtgctgaacagcatcaacacgcggctcgacgcgcgcacggtgtccgtcctgctccgccactccggctccaagctcatcttcgtcgacccggcgctgctccccgtcctccgcgacgcgctccgcctcctcccggcggggcacacggccccgcgcgtcgtcctcgtcgaggatccccatgagaaggagttccctcccgcccccgccgccgcgctgacgtacgagaggctcgtcgagaagggggacccggagttcgcgtgggtgcggccggcgagcgagtgggacccgatgatcctcaactacacctccggcaccacgtcggcgcccaagggggtggtgcactgccaccgggggatcttcctcatcaccgtcgactcgctggtcgactgggcggtgccgccgcggccgacgtacctgtggacgctccccatgttccacgccaatggctggagcttcccatgggggatggccgtggtgggcggcaccaacgtctgcctccgccgcgtcgacgccgccgaggtgttcgacacaatcgcgcgccgcggcgtcaaccacctgtgcggcgcgcccgtcgtgctcaacatgctggcgaacgcgcccgagggcgtgcggaagccgctcccggggaaggtgcggatcctcacggccggcgcgccgccgccggccgccgtgctgtaccgcacggaggcgatcggcttcgaggtcagccacgggtacgggctgacggagaccgcgggtctggtgctctcgtgcgcgtggaagggcgagtgggacaagctcccggcctccgagcgcgcgcggctcaaggcgaggcagggcgtgcgcacgccggggatggccgaggtggacgtcgtggacggcgagaccggccgcagcgtgccccgcgacgggtcgaccatgggcgagatcgtgctccgcggcggctgcatcacgctgggctacctcaacgacgaggcggcgacgaaggcggcgatccgggacaacgggtggttctacaccggcgacgtcggggtgatgcacccggacgggtacgtggagatccgggaccggtccaaggacgtgatcatcagcggcggggagaacatcagcagcgtggaggtggagtccgtgctgtacggccacccggcggtgaacgaggcggcggtggtggcgcggccggacgagttctggggggagacgccgtgcgcgttcgtcagcctcaagcagggcggcggcgcggtgacggcggcggacgtggtcgcgtggagccgggagcgcatgccgcggtacatggtcccaaagacggtgatcttccgcgacgagttaccgaagacgtccaccgggaagatccagaagtacgtgctccggaatatcgccaaggagatggggcccaccacgggcaccaacaccaaacgcaacagtaaaatgtagcggcatctagccagcagatgtggcacttgctttttagcgtcgtcgtcgtcttcttcactcggacagagtcacagagcagaaatgtctggtgcaggcagaggctgatgcattccgcattgtcatggcatggcatgtttctgtcgatatatcagcaccaccagccatggcctgtttgattgggggaagggggggggggggtgtttagatccaccgataaattttttttaaggcatgtacgaagtattaaatattagacgaaaaaaactaattacacagtttgtgtataaattgcgagacgaatcttttaaaccaaattgttccatgattta

SEQ ID NO: 4617 - DNA, 2057 bp, Hordeum vulgare
gtcacttgctctgctctgttctgttctgtttccccaacaaccacgagataggcgcccgtggtcgcaggtcactcaagctagccgccccgtccggtccggcggccatggagaagctcggcgccaacccggccaactcctgcccgctgacgccgctgggcttcatcgagcgcgccgccaccgtgtacggcgactgcccttccgtcgtctacggggacaccgtcttcacctggtcccagacccaccgccgctgcctccgcctcgcctccgcgctcgcctccctcggcgtctcccgccgcgacgtcgtatcggtgctgctgccgaacgtgccggccatgtacgaggcgcacttcggggtgcccatgagcggcgccgtgctcaacagcatcaacacccgcctcgacgcgcgcaccgtctccgtcctgctccgccactcggggtccaggctcatcctcgtcgacccggcgctggtgccggtgctcggcgaggcgctccgtctcctcccgccgggccacccggcgccgcgcgtggtgctcgtcgaggacccccaggagaaggacttctctcccgcgcccgccgcggccctgacgtacgagaagctgctggagatgggcgaccccgagttcaggtgggtccggccggccagcgagtgggaccccatgatactcaactacacctccggcaccacgtcggcgcccaagggggtcgtgcactgccaccgcggcatcttcgtggtcaccatggactcgctcgtctcctggtccgtgccggagcagccgacgtacctgtggacgctgcccatgttccacgccaacggctggagcttcccgtgggggatggccgtggtgggcggcaccaacgtctgcctccgccgcgtcgacgccgccgaggtctacgacaccatcgcccgccgcggggtcacgcacctctgcggcgcgccagtcgtgctcaacatgctggccaacgcgcccgagggcgtgcggaggccgctgccggggaaggtgcatatccttacggctggcgcgccgccgccggctgcggtgctgggccgcacggaggccatcgggttcgacgtcagccacgggtacgggctgacggagacggctgggctggtgctgttgtgcgcgtggaagggcgagtggaacaagctgccggcgtcggagcgcgcgcggctcaaggcgaggcagggcgttcgcacgcccggcatggccgaggtggacatcgtggacggcgagaccggccgcagcgtgccgcgggacggcgccaccatgggcgaaatcgtgctccgtggcgggtgcgtcaccatgggctacttcaaggacgaggacgccaccagggcggccatccgggacgacgggtggttctacacgggggacgtgggcgtgatgcacccggacgggtacctggagatccgcgaccggtccaaggacgtgatcatcagcggcggcgagaacatcagcagcgtggaggtggagtcgctgctctacggccaccctgcggtgaacgaggcggcggtggtagcacggccggacgagttctggggggagacgccgtgcgcgttcgtgagcctcaaggagggcgccggcggcgcggtgaccgcggcggaggtgatcgcgtggagccgggagcgcatgcccgggtacatggtgcccaagaccgtggtgttccgcgccgagctgcccaagacgtccaccggcaagattcagaagtacgtgctccggaacctcgccaaggagatgggcccaacccgcaggggcgtcagcagcaagatgtagtataattgctgtggaaattcagggttgtgtcgtcttgcctggcttgatctgcagcagcatggcaatgacattggcacgtctgctctggagatcagcattcagcaagcctgtctgctgcagctgcagctgcaagattgtattatgtggatgatgcatgtcgccctgctggttatgtgaagaaatgagagcacccttgtcccttgttaccttgtgataaacttgtttaatcgatcaactgataggaggatgccattgataaccactggaccgagaattcaatccagg

SEQ ID NO: 4618 - DNA, 1999 bp, Secale cereale
ccacggccacgagataggcgcccgcggtcacaggcgactgaagctcggcgcctcctcgtccgatccggcggccatggagaagctcggcgcgaacccggccaactcctgcccgctcacgccgctcggcttcctggagcgcgccgccaccgtgtacggcgactgcccctccgtcgtctacggcgacaccgtcttcacctggtcccagacccaccgccgctgcctccgcctcgcctccgccctcgcctccctcggcgtctcccgccgcgacgtcgtgtccgtgctgctgcccaacgtgccggccatgtacgaggcgcacttcggcgtgcccatgagcggcgccgtgcttaacagcatcaacacccgcctcgacgcgcgcacggtgtcggtcctgctccgccactcggggtccaggctcatcctcgtcgacccggcgctggtgccggtgcttgatgaggcgctccggctcctcccgccgggccacccggccccgcgcgtcgtgctcgtcgaggacccccaggagaaggacttctctcccgcgcccgccgcggccctgacgtacgagaagctgctcgagatgggcgacccggagttcaggtgggtccggccggtcagcgagtgggatccgatgatactcaactacacctccggcaccacgtcggcgcccaagggggtcgtgcactgccaccgcggcatcttcgtggtcaccatggactcgctcgtctcctggtcggtgccggagcagccgacgtacctgtggacgctgcccatgttccacgccaacggctggagcttcccgtgggggatggccgtggtgggcggcaccaacgtctgcctccgccgcgtggacgccggcgaggtctacgacaccatcgcccgccgcggggtcacgcacctctgcggcgcgcccgtcgtgctcaacatgctggccaacgcgcccgagggcgtgcggaggccgcttcctgggaaggtgcagatcctcacggccggcgcgccgccgccggccgcggtgctgggccgcacggaggccatcgggttcgacgtcagccacgggtacgggctgacagagacggcggggctggtgctgctgtgcgcgtggaagggcgagtggaacaagctgccggcgtcggagcgcgcgcggctcaaggcgaggcagggcgtgcgcacgcccggcatggccgaggtggacatcgtggacggcgagaccgggcgcagcgtggcccacgacggcgccaccatgggcgagatcgtgctccgcggcgggtgcgtcaccatgggctacttcaaggaggaggacgccacccgggcggcgatccgggacgacgggtggttctacacgggggacgtgggcgtgatgcacccggacgggtacctggagatccgggaccggtccaaggacgtgatcatcagcggcggcgagaacatcagcagcgtggaggtggagtcgctgctctacgggcacccggccgtgaacgaggcggcggtggtggcgcggccggacgagttctggggggagacgccgtgcgcgttcgtgagcctcaaggagggcgcggcgggcacggtgaccgcggcggaggtgatcgcgtggagccgggagcgcatgcccgggtacatggtgcccaagaccgtggtgttccgcgccgagctgcccaagacctccaccggcaagatccagaagtacgtgctccggaacctcgccaaggagatgggcccgacccgcaggggcgccagcaccaccaccagcaagatgtagaagtataactagatagtgtcgtggtcatcctcctccttggcttggatcgggtgcccttttaaattgctgtagaaattcagggttgtgtcgtcttgcttggcttgatctgcagtgccatgggagatgagcattcagcaagcctgtctgctgcagctgcaagattctattatgtgcattcgtgatgcatgtctccctgctgggtatgtgagaaatgagagcacccttgtgataaacttgttcaatcaatca

SEQ ID NO: 4619 - DNA, 1881 bp, Avena sativa
ccgctgagctgctctgctctgctctgctctgtcctccccaccagccacgagtaagtgcgcgtcgtcgcaggccaagtcgtcgctccgatccggcggccatggagaagctcggcgccaacccggccaactcgtgcccgctgacgccgctgggcttcctggagcgcgccgccaccgtctacggcgactgcccctccgtcgtctaccacggcaccgtcttcacctggtcccagacctaccgccgctgcctccgcctcgcctccgcgctcgtctccctcggcgtctcccgccgcgacatcgtgtccgtgctgctgccgaacgtgccggccatgtacgaggcgcacttcggggtgcccatgagcggcgccgtgctcaacagcatcaacacgcgcctcgacgcgcgcaccgtctccgtcctgctccgccactccggctccaagctcatcctcgtcgaccctgccctgctccctgtcctcgacgaagcgctccgcctcctcccgccgggccaccaggccccgcgcgtggtgctggtggaggacccgcacgagaaggagttccctccggcgcccgcggcggccctgacgtacgagaggctgctcgagacgaagggcgacccagagttcaggtgggtgcggccggccagcgagtgggacccgatgatcctgaactacacgtccggcaccacgtcggcgcccaagggggtggtgcactgccaccgcggcatcttcgtggtgaccctggactcgctggtgtcgtggtcggtgccggagcggccgacgtacctgtggacgctgcccatgttccacgccaacgggtggagcttcccgtgggggatggccgtggtgggcggcaccaacgtgtgcctgcgccgcgtcgacgcgggcgaggtgtacgacaccatcgcggaccgcggagtcacgcacctctgcggcgcgcccgtggtgctcaacatgctggcgaacgcgcccgagggcgtgcggagggcgctcccggggaaggtgcggatcctgacggcgggcgcgccgccgcctgccgccgtgctgggccgcacggaggccatcgggttcgacgtgagccacgggtacgggctgaccgagacggcgggtctagtgatctcgtgcgcgtggaagggggagtggaacaggctgcccgcgtccgagcgcgcgcggctgaagtcgaggcagggcgtgcgcacgccggggatggccgaggtggacatcgtggacggggagacgggccgcagcgtgccgcgtgacgggtcgacgatgggcgagatcgtgctgcgcggcgggtgcgtgacgatggggtacttcaaggacgaggaggccaccaaggcggcgatccgggaggacgggtggttctacacgggggacgtgggggtgatgcacccggacgggtacctggagatccgtgaccggtccaaggacgtgatcatcagcggcggggagaacatcagcagcgtggaggtggagtcggtgctgtacgggcacccggcggtgaacgaggcggcggtggtggcgcgtccggacgagttctggggcgagacgccgtgcgcgttcgtgagcctgaaggagggcgcggcggcgacgagcgcggcggaggtgatggcgtggagccgggagcgcatggccgggtacatggtgcccaagacggtggtgttccgcgcggagctgcccaagacgtccaccggcaagattcagaagtacgtgctccggaacctcgccaaggagatgggccccacacgccggggcgtcagcagcagcaagatgtagtccgtccgagactgatgactctccgagtgatgagtatattaagtaggttgtcgtctcgtcggtcggtcggtcgtcctctcagcttgcgattggatttacagttagtaccttg

SEQ ID NO: 4620 - DNA, 1689 bp, Sorghum bicolor
cggccaccccatggcatgggcaatctcgactcgaatccggcgaactcgtgcccgctcacgccgctgggcttcctggagcgtgcggccaccgtcttcggcgactgcccctccgtcgtctaccaagacacggtcttcacctggtcgcagacacaccggcgatgcctccgcctcgcctccgcgctcgtctccctcggcatcacccgcggcgacatcgtgtccgtgctgttgccgaacgtgccggccatgtacgagatgcagttcggagtgcccatgagcggcgccgtgctcaacaacatcaacacacgcctggacgcgcgcacggtcgccgtcctgctccgccactccggctccaagctcgtcttcgtcgacgcatcgtcgctccagctcatcagcgacgcgctccggctactcccgccggggcacccggccccgcgcgtgatccccgtcgaggatcctcacgaggaggacgagttccctgccgacacgttaacgtacgagaggcttctcgccgatggcgacccggagttcgcgtgggtgcagccggcgagcgagtgggatccgatggtgctgaactacacctccggcacgacgtcggagcccaagggcgtggtgcactgccaccgcgggctcttcttgatcaccgtcgactcgctcatggaatgggcggttccgacgaggccgacgtacctgtggacgctgcccatgttccacgccaacggctggagtttcccgtgggggatggccgtggtgggcggcaccaacgtctgcctccgccgcgtcaacgctgccaccgtgtacgccgccatcgcgagccgtggtgtcacccacctctgctgcgcgcccgtcgtgcttaacatgctggccaacgcccacgacggcgtgcgacggccgctcccgggaaaggtgcgcatccgcacggccggcgcgccaccgccggcggccgtgctacagcgcacggaggccattggcttcgagatcagccatgggtacgggctaaccgagaccgcgggcctgccggtgtcatgcacttggaagggtgagtgggacagcctcccggcgccggagcgcgcacggctgaaggcgaggcagggcgtgcgcacgccggccacgggcaaagtcgacgtcattgacagcgaaaccggccgcagcgtgccacgtgacggcgccaccatgggcgagatcgtggtccgcggcggctgcgtcatgctcggctatctgaacgacgacgaggcgaccaaggcggcgatacgcgaggacgggtggttctacacgggggacgtcggcgtgatgcatccggacggttacctggagatccgcgaccgttccaaggacgtgatcatcaacgccggcgagaacatcagcagcgtggaggtcgagtcggtgctttacgatcacccggcggtgaacgaggcagccgtggtggcgcggccggacgagttacgaggcgagacgccgtgcgcgttcgtcagcctcaaggaggacgcggcgggcacggtgaccgcggccgacgtcattgcgtggtgccgggagcgcatgccgcagtacatggtgcccagaacggttgtcttccacgccgagctgcccaagacctccactggcaaaattcagaagtacgtgcttcggaacctcgccatggagatgggacccgcccacaagggcgacggccgacggtagcagcaggcagcacct

SEQ ID NO: 4621 - DNA, 2384 bp, Sorghum bicolor
tctctctctctctctctctccatagtatatagcatctactgccacggcgtgctgcctcactccaacgtcgtcgagcttcctgccgaacgttcagccgagcgcgcgcggtgccacgagagcaccgccggcgctgagagagaaggcaccgcgcgcgccggccggccggccgtatcagcggtcagcgcgctcaagtagctagcgagccgtgggaataaaacattgtccgccatgctaaatactactgctgcctcgtggtctgcttctctctcgtcctcgtcacagtttagtctgaagttgacactgaaagagactggaggagtgccctcttttaactgtaagcatggaaaggggaacatgttcaccgtggtcaaccgtggaaacaaacctctgggttttagacaggtggtgaagacatcaccgctctcacaagctgacaaggccaaaccaagtcgcctccggccaccccatggcatgggcaatctcgactcgaatccggcgaactcgtgcccgctcacgccgctgggcttcctggagcgtgcggccaccgtcttcggcgactgcccctccgtcgtctaccaagacacggtcttcacctggtcgcagacacaccggcgatgcctccgcctcgcctccgcgctcgtctccctcggcatcacccgcggcgacatcgtgtccgtgctgttgccgaacgtgccggccatgtacgagatgcagttcggagtgcccatgagcggcgccgtgctcaacaacatcaacacacgcctggacgcgcgcacggtcgccgtcctgctccgccactccggctccaagctcgtcttcgtcgacgcatcgtcgctccagctcatcagcgacgcgctccggctactcccgccggggcacccggccccgcgcgtgatccccgtcgaggatcctcacgaggaggacgagttccctgccgacacgttaacgtacgagaggcttctcgccgatggcgacccggagttcgcgtgggtgcagccggcgagcgagtgggatccgatggtgctgaactacacctccggcacgacgtcggagcccaagggcgtggtgcactgccaccgcgggctcttcttgatcaccgtcgactcgctcatggaatgggcggttccgacgaggccgacgtacctgtggacgctgcccatgttccacgccaacggctggagtttcccgtgggggatggccgtggtgggcggcaccaacgtctgcctccgccgcgtcaacgctgccaccgtgtacgccgccatcgcgagccgtggtgtcacccacctctgctgcgcgcccgtcgtgcttaacatgctggccaacgcccacgacggcgtgcgacggccgctcccgggaaaggtgcgcatccgcacggccggcgcgccaccgccggcggccgtgctacagcgcacggaggccattggcttcgagatcagccatgggtacgggctaaccgagaccgcgggcctgccggtgtcatgcacttggaagggtgagtgggacagcctcccggcgccggagcgcgcacggctgaaggcgaggcagggcgtgcgcacgccggccacgggcaaagtcgacgtcattgacagcgaaaccggccgcagcgtgccacgtgacggcgccaccatgggcgagatcgtggtccgcggcggctgcgtcatgctcggctatctgaacgacgacgaggcgaccaaggcggcgatacgcgaggacgggtggttctacacgggggacgtcggcgtgatgcatccggacggttacctggagatccgcgaccgttccaaggacgtgatcatcaacgccggcgagaacatcagcagcgtggaggtcgagtcggtgctttacgatcacccggcggtgaacgaggcagccgtggtggcgcggccggacgagttacgaggcgagacgccgtgcgcgttcgtcagcctcaaggaggacgcggcgggcacggtgaccgcggccgacgtcattgcgtggtgccgggagcgcatgccgcagtacatggtgcccagaacggttgtcttccacgccgagctgcccaagacctccactggcaaaattcagaagtacgtgcttcggaacctcgccatggagatgggacccgcccacaagggcgacggccgacggtagcagcaggcagcacctatacgtacgtgttaaaaaaacaaaaaatggtaaataaatcaataaattgttgggttcgtctaacagtgtcagaatctaaattttttagggtctgtctacttaaaacttaggtgatttttatccttgtatcacccgtgtgaccaaacaataaatatcacccaaatcaaacaaaagcccaaaacgggtaattctaaggcttctgtcacacaaaatctaaaaccactagatctcaaatcaac

SEQ ID NO: 4622 - DNA, 1806 bp, Setaria italica
tggaaacatcaccgtttgcacaacgcaaggccgagccaggccgcatccggccaccccatgccacgggctatctcggggctaatccggccaactcgtgcccgctcacgccgctcggcttcctggaacgcgcggcgaccgtgttcggccactgcccctccgtcgtctaccacgacaccgtcttcacctggtcacagacgcaccggcgttgcctccgcctcgcctccgcgctcgcttccctcggcatctcccgcggcgacatcgtgtccgtgctgttgcccaacgtgccggccatgtacgaggtgcacttcggcgtgcccatgagcggcgccgtgctcaacaccatcaacacgcgcctcgacgcgcgcacggtcgccgtcctgctccgccactccggctccaagatcgtcttcgtcgacccggcgtcgctcccactcatccgagacgcgatgaagcagctcccgcccgggcacccggcgccgcgcgtcgtccccgtcgaggacccccacgaggaggagttcccggccgccccgcccgggaccttgacgtacgagaggctcctcgagaagggcgacccggagttcaagtgggtgcggccggcgagcgagtgggacccgatggtcctgaactacacctccggcacgacgtcggcgcccaagggcgtggtgcactgccaccgcgggctcttcctcatcacacttgactggctcgtggaatgggccatgccgccgcgggcgacgtacctgtggacgctgcccatgttccacgccaacggctggagcttcccgtgggggatggccgcggtgggcggcgccaacgtctgtctccgccgcgtcaacgccgccactgtgtacgccgccatcgcgatccgcggggtcacccacctctgctgcgcgcccgtcgtgctcaacatgctggccaacgcccccgagggcgtgcgacggccgctcccgggaaaggtgcgcgtcctcacggccggcgcgccacctcccgcggccgtgctacagcgcactgaggccatcggcttcgaggtcagccacgggtacgggctgaccgagacggcggggctgccggtgtcctgcacttggaagcgtgagtgggacaagctccccgcgccggagcgcgcacggctcaaggcgaggcagggcgtgcgcttgcctggcatggcggaggtcgacgtcatcgacggcgagaccgggctcagcgtaccccacgacggatccacgatgggcgagatcgtgctccgcggcggctgcgtcatgctaggctacctgaacgatgacgaggcaaccagggcggcgatacgcgacgacgggtggttctacacgggggacgtcggcgtggtgcacccggacggctacctggagatccgggaccgttccaaggacgtgatcatcaacgccggggagaacatcagcagcgtggaggtcgagtcggtgctttacgggcatccggcggtgaacgaggcggcggtggtggcgcggcccgacgagttacggggcgagacgccgtgcgcgttcgtcagcctcaaggaggacgcggcgggggcggtgaccgcggccgacctcatggcgtggtgccgggagcgcatgccgcagtacatggtgcccagaacggtcgtcttccgcgcagagctgcccaagacctccaccggcaagatccagaagtacgtgctgcggaacctcgccatggagatggggcccgcacgcaagggcggcggtaccgcggtagcataagctaacaaagtaatgattggattgtttgacattatcaattacccgatcaagaattcaagatccaagacatccg

SEQ ID NO: 4623 - DNA, 1632 bp, Zea mays
ccgtgaccccgctggcgtgcacacgtactagcgttttccggcgctaaagcagggagggctaatcgcgtccgtgatcaaacccccgccccagcagttgctttttattcacccgcctcccccttgtcgctcctccacaccgcacacgcacgcacgaacgcgctcccaccccctcccgccgccaccgccgccaaaaccccggcccgactcggcgtcctccgccaacctcctcctgggcagcgcgggcggggggatatggcatcggaggacgtggtgggcaagagcaggggcgacacggccgtcaccaccatcgtcaacctggcggaggaggccaagctcgcgcgcgagggggtcaaggcgcccggccaccagatcctcaccatctgcaagtcgctcgtcgccggcggcgtagcaggcggagtgtctcgtactgctgttgctccacttgaacgattgaaaatattgcttcaggttcaaaatccgcacagcatcaagtacaatggtactgttcagggtctcaagtatatctggagaacagagggcctccgtggacttttcaagggcaatggtaccaattgtgcaaggattgttccaaattctgccgtgaagttttttagctacgagcaggcgtcaaagggaattctgtgggcctaccgtcaacagactggtgaagaggatgctcagcttactccgctcttgcgccttggagctggagcatgtgctggtatcatagctatgtctgctacttacccgatggatatggttaggggaaggatcactgttcagacagacaaatctccctaccagtaccgtggtatgtttcatgcactgggtacagtctaccgtgaagaaggctttcgtgctctatacaaagggtggcttccatctgtaatcggagttgttccatatgttggtctcaacttcgctgtatatgagtccctcaaagactggctactccagacaaattcatttggccttgcaaatgacaacgagctgcacgtagttacaaggcttgggtgtggagctgtggcgggaaccattgggcagactgttgcataccctcttgatgtcatcaggagaagaatgcagatggttggttggagccatgctgactctattgttactgggcaaggcaaagaagcactccagtacaatggcatgatcgatgcattcaggaagactgttcgtcatgaaggcgttggtgctctgtacaagggtcttgtgccgaactcagtcaaggtggtgccctcaattgccattgcatttgtgacttacgaggttgtgaaggatgtgctaggagtagagatgaggatatcagactgaggatggtcgttttcaactgctatttttgtaggctttgggaagttgtgttttttttttgtaggcagggcgggtagaagggtatgaccgcggctccattcagcatcaggccctctcagcccattcaggtcctagaattgttgctgggtcgtgcaaaaagtaataagtcggctgtaaagcttattaagcatctgcctaactcatcaaaagaaatctattccttattgatgatgtaccgagatttttgaacttaaagcggtactacgtgctgctaacagttgattaatgatttttctttgttgctggtgatttttc

SEQ ID NO: 4624 - DNA, 1533 bp, Saccharum officinarum
ctctcgctcatcaccgcacgcgcgcacgaacgctcccacccccctcccgccgccgccaccgccgccaaaaccccagcgcgagccgagcacgactcggcgtcctcaacctcctcctcctcctcggcggcgggggcgagccgggcggggagagatggcgtcggaggacgtggtggggaagagcaggggcgacacggccgtcaccaccatcgtcaacctggcggaggaggccaagctcgcgcgcgagggggtcaaggcgcccggccaccagatcctcaccatcggcaagtcgctcgtcgccggtggcgtcgcgggaggagtgtcacgtactgctgttgctccgctcgaacgattgaaaatcttgcttcaggttcaaaatccacacagcatcaagtacaacggaacagttcagggtctcaagtatatctggagaactgagggcctccgtggacttttcaagggcaatggtaccaattgcgcaaggatcgttccaaattctgccgtgaagttttttagctacgagcaggcgtcaaagggaattctgtgggcttaccgtcaacagactggggaagaggatgctcagcttactccactcttgcgccttggagctggagcctgtgctggtatcatagccatgtctgctacttacccaatggatatggttaggggtaggatcactgttcagacagacaagtctccctaccaataccgtggtatgtttcatgcactgggtacagtctaccgtgaagaaggctttcgtgctttatacagagggtggcttcatctgtatcggaattgttccgtacgttggcctcaactttgctgtatatgagtccctcaaagactgggtactccagacaaatccacttggcctgcaaatgacaacgagctgcatgtgttacaaggctggggtgtggagctgtggctgggactattggccagactgttgcataccctcttgatgtcatcaggagaagaatgcagatggttggttggaaccatgctgactctattattactggaaaaggcaaagaagcactccagtacaatggcatgatcgatgcattcaggaagactgttcgtcatgaaggcattggtgctctgtacaagggtcttgttcctaattcagtcaaggtggtgccctcaattgccattgcatttgtcacttacgaggttgtgaaggatgtgctaggagtagagatgaggatatcagactaaggaagcgggggtagtgctggtcgttatcaactgctatttttgtaggttttggggagttctgtttttgtaggcagggcgagtaggaggatatgactgcggccccattcagcatcaggccctctcagcccatgttgatatatcctgctactggcttcgggtcctagaattgttgctggatcatgcgaaaagtaataagttggctgtaaagctttaagcatttgcctaactcataaaaaatctattccttgttgatgtaccgagattgaacttaaaagcggtattgcgtgctgctaatagttgattctaatgatttttctc

SEQ ID NO: 4625 - DNA, 1590 bp, Pennisetum glaucum
ccaccaaaaaccccagcccgtgcagaccccgcctcggccaccacctcctcctcctcggcggcgcggcgcggcgagccgcgggcgatccgggcggtgagggcggcgcgcggggggcgggggcacagatggcatcggaggacgtggtggggaagagcaggggcgacacggccgtcaccaccatcgtcaacctggcggaggaggccaagctcgcgcgcgagggggtcaaggggcccggccaccagctcctcaccatctgcaagtctctcgtcgccggcggcgtcgcggggggagtgtcgcgtactgctgttgctccacttgaacgattgaaaatcttgctccaggttcaaaatccacacagtatcaagtacaatggtacaattcaaggtctcaagtatatatggagaaccgagggcctccgtggacttttcaagggcaatggtaccaattgtgcaaggatcgttccaaactctgctgtgaagttttttagctacgagcaggcatcaaagggaattttgtgggcttatcgtcagcagaccggggatgaggatgctcagcttagtccactcttgcgccttggagctggagcctgtgctggtatcatagccatgtctgctacttatccgatggatatggttaggggtaggattactgttcagacagacaagtctccctaccagtaccgtggtatgttccatgcactgggcacagtctaccgtgaggaaggcttccgtgctttatacagagggtggcttccatctgttatcggagttgttccatacgttggcctcaactttgctgtttatgagtctctcaaggactggctgctccaaacaaatccttttgggcttgcaaatgataatgagctgcatgtatttacaaggcttgggtgtggagctgtggctggaactattggccagactgttgcgtaccctcttgatgtgatcaggagaagaatgcagatggtgggttggagccatgctgactctattgttactggacaaggcaaagaagcactccagtacaatggtatgatagatgcattcaggaaaactgttcgtcatgaaggcgtcggtgctctgtacaagggtcttgtaccaaattcagtgaaggtggtgccctcaattgccattgcatttgtcacttacgaggttgtgaaggatgtgctaggagtagagatgaggatatcagactgagggtttggagtagtgctgggcgttatcgactgctatttttgtaggtgttgggagttctgtttttgtaggcagggcaggtagaaggatatgactgcggctcccttcagcatcagggcctctcagccccgctagaaggatatcctgctactggcttcaggtcctaaaattgttgctggatcgtggaaaattaataagttggctgtaaagctttaaagcatttgcctaactcaaaaaaagtctattccttgttgatgtatggagattgaacttaaagcggtattgcttgctgctaatagttggttctaatgatttttctttacctccattgcgtttagcgtggttgaacggaaaaaaaaaaaaaacaaaaaagtactactagcgttagataccactgctt

SEQ ID NO: 4626 - DNA, 1763 bp, Setaria italica
atgctccacgcactcaccccaccccggtcctgtatccctgccaggtggtccccatctcaccaacattccttcgatggccctacacgcacgaacagtctaggcctcacccgcgtgcaccttaatacccatcgcctattctgttcatcggccccctcacgcccctcactgcacacgcacgcaccctcgctccacaccccccccccctccaccgccgccgccgccgccgccgccaaaaccccagcccgtgccgagcccgtctcggccaccacctcctccccaccctcctcctcggcagcgcggcgagctgcgggcgatccgggcggtgaggggggcgcgcgcggggcgggggcagagatggcatcggaggacgtggtggggaagagcaggggcgacacggccgtcaccaccatcgtcaacctggcggaggaggccaagctcgcgcgcgagggggtcaaggggcccggccaccaggtcctcaccatctgcaagtcgctcgtcgccggcggcgtcgcggggggagtgtcacgtactgctgttgctccgctcgaacgattgaaaatcttgctccaggttcaaaatccacacagtatcaagtacaacggtacaattcaaggtctcaagtatatatggagaaccgagggcctccgtggacttttcaagggcaatggtaccaattgtgcaaggatcgttccaaactctgctgtgaagttttttagctacgagcaggcatcaaagggaattttgtgggcttatcgtcagcggaccggggatgaggatgctcagcttagtccactcttgcgccttggagctggagcctgtgctggtatcatagccatgtctgctacttacccgatggatatggttaggggtaggatcaccgttcagacagacaagtctccctaccagtaccgtggtatgttccatgcactgggcacagtctaccgtgaggaaggcttccgtgctttatatagagggtggcttccatctgtaatcggagttgttccttacgttggcctcaactttgctgtttatgagtctctcaaggactggctgctccagacaaatccttttgggcttgcaaatggtaacgagctgcatgtagttacaaggcttgggtgtggagctgtggctggaactattggccagactgttgcgtaccctcttgatgtcatcaggagaagaatgcagatggtcggttggagccatgctgattctattgttactggacaaggcaaagaagcactccagtacaatggtatgatcgatgcattcaggaaaactgttcgtcatgaaggcgtcggtgctctgtacaagggtcttgtgccaaattcagtgaaggtggtgccctcgattgccattgcatttgtcacttacgaggttgtgaaggatgtgctaggagtagagatgaggatatcagactgagggattggagtagtgctggtgggcgttatcgactgctatttttgtaggtgttgggagttctgtttttgtaggcagggcaggtagaaggatatgactgcggctctattcagcatcagggcctcttagcccatgttgatatatcctgctactggcttccggtcctaaaattgttgctggatcgtggaaaattaataagttggctgtaaagcgttaaagcatttgcctaactcataaaaagtctattccttgttgatgtatggagattgaacttaaaagcggtattgcttgctgctaatagttgattctaatgatttttctttgcctctgttgcgtttcttgcg

SEQ ID NO: 4627 - DNA, 1443 bp, Festuca arundinacea
  misc_feature (179)..(179): n is a, c, g, or t
  misc_feature (225)..(225): n is a, c, g, or t
ggcacgaggcctcggcggggcgagcgggcgctgccgtcgcgcgcgatccggccggcggtgatggcatcggaggacgtggtgggcaagagcaggggcgacacggccgtcaacaccatcgtcaacctggcggaggaggccaagctcgcgcgcgagggggtcaagggccccggacaccaggncctcaccgtctgcaagtcgctcttcgccggaggcgtcgccggcggnctatcaaggactgctgttgctcctcttgagcgattgaagatcctgcttcaggttcaaaatcctcacagtatcaagtacaatggtacagttcaagggctgaagtatatatggagaaccgaaggccttcgtggactctttaagggcaatgggacgaattgtgctaggattgtcccaaattctgctgtcaagttcttcagttatgagcaagcatcaaggggtgttttgtatctgtaccgacaacagactggggatgagaatgctcagcttactccagtactgcgccttggggctggagcctgtgctggtatcatagccatgtctgctacttatcccatggatatggttaggggtaggattactgttcagacagataagtctccttaccagtaccgtggtatgtttcatgcattgggcacagtttaccgtgaagaaggcttccgtgctttatacagagggtggcttccatcagtgattggagttgtcccttatgttggccttaactttgctgtatacgagtctctgaaggactggatcctccggacaaatgcatttggactagcagataataatgagttgcatgtagtcacaaggcttggatgtggagctgtggccggaaccataggccagactgtggcataccctcttgatgttgtcaggagaagaatgcagatggtcggttggaaccatgctgcctctattattactggagaaggcaaagaggcactgcagtacaatggaatgatcgatgcattcaggaaaactgtccgccacgaaggatttggtgctttgtacaagggccttgtgcccaactcagtgaaggtggtgccttccatcgccatcgctttcgtcacgtacgaggctgtgaaggatgttctaggagtagagatgaggatagactgaagaaccgggcttagttatccgtcctggtcgttatcaacttctatttttgtaggtgttgagagttctttttttgttaggcagggcgagtagaaggacaataggacccgaggctccattcagcataaggccctctcagcccttgtcgatatatcctactactggttccagatcctaattgttgccgcactccctcgaggaaataataagttggctgtaaagcattaaaggcatttgcctaactcataaaatcttattcagtgaggaacgatgtattgagattgaaacataagcttgcatgctgtgtgctgctaataaata

SEQ ID NO: 4628 - DNA, 1992 bp, Oryza sativa
aaacgaaataggttaattagcaaccagtcgcctctccccgccgcacgcacgcacacctctcccctcctctcctcctcccgccgccgccgccgccgccgccgcaaaaacccgaggccgagaggaggagacgggcgcgggggctgatctcgtcggcgaggcgagcgggcgatccggtgcggtgcgggccgggtggacatggcatcggaggacgtggtggggaagagcaggggggacaccgcggtcaccaccatcgtcaacctggcggaggaggccaagctcgcgcgggagggggtcaaggggcctggttaccaggtgctctccatctgcaagtctctcttcgccggtggcgtcgccggtggagtatcacgtactgctgttgctccgctcgaacgaatgaagattctgcttcaggtccaaaaccctcacagtatcaagtacaacggtacaattcaaggtcttaagtacatatggagaacagagggtctccgtggactttttaagggcaatggtaccaattgtgccagaattgttccaaattctgccgtgaagttttttagctatgagcaagcatcaagtggaattttatggctttatcggcaacaaacagggaatgaggatgctcagcttagtccactattgcgccttggagctggtgcttgtgctggtatcatagccatgtctgctacttacccgatggatatggttaggggtaggattaccgtgcagacggaaaagtctccttatcagtaccgtggtatgtttcatgcattgggttcagtataccgtgaagaaggcttccgtgctctatacagagggtggcttccatctgttatcggagtggttccgtatgttggcctcaactttgctgtgtacgagtctctgaaggactggctgcttcagacaaatccatatgatcttggcaaggacaatgagttgcatgtagttacaaggcttggatgtggagctgtggctggaaccataggccagactgttgcttaccctcttgatgtcatcaggaggagaatgcagatggttggttggaataatgcagcatctattgttactggagaaggcaaagaggcgctccagtacaatggtatgatcgatgcattcaggaaaactgttcgctatgaaggtgttggtgctttgtacaagggtcttgtgcccaattcagtgaaggtggtgccttctatcgctattgcattcgtgacatacgagtttgtgcaaaaagttctaggagtagagatgaggatatcagactgaagaaattggagttagtgctggtcattatcaactgctatttttgtagggtggtgagttctgtttttgtaggaagggcaggtagaaggatcatagcactgaggctcccattcagcataaggccctctcagcccatgttggtatatcctactactgtttccagatcctaattgttgctggacccgtgggaaaaattaataagttggctgtaaagcatgaagcatttgcctaactcataaagtctattcagtcgtgatggtgtattgagattgaaaactcatgcagtatgctgtgtgctgctaatagttgattttcatcattttcttctctttgtctaagattgtttctgctgataaatactctacttaaaccgagtaatgttggtgcgttttataccagcatttccttttcccattcctgaagtatctgtagtattacattacatccatccattcgtttgcttattatttacaagagtgaaatttttttcattgttgacgttttgatactgtatttctgaaacaagtgaaaacctctcatcatatgagaaagaaggctacccaacattttgctaagctaactccgagtctgaagcgttcccgccggatttacgccgtcgggtaggcggaattgccgccctattgaggtggccgtcggacttaatcctcggcgttcggcgggccacgaccggcggcggcctcaccgtgcccatcgacctcgacttctgcggcg

SEQ ID NO: 4629 - DNA, 2284 bp, Oryza sativa
gaaataggttaattagcaaccagtcgcctctccccgccgcacgcacgcacacctctcccctcctctcctcctcccgccgccgccgccgccgccgccgcaaaaacccgaggccgagaggaggagacgggcgcgggggctgatctcgtcggcgaggcgagcgggcgatccggtgcggtgcgggccgggtggacatggcatcggaggacgtggtggggaagagcaggggggacaccgcggtcaccaccatcgtcaacctggcggaggaggccaagctcgcgcgggagggggtcaaggggcctggttaccaggtgctctccatctgcaagtctctcttcgccggtggcgtcgccggtggagtatcacgtactgctgttgctccgctcgaacgaatgaagattctgcttcaggtccaaaaccctcacagtatcaagtacaacggtacaattcaaggtcttaagtacatatggagaacagagggtctccgtggactttttaagggcaatggtaccaattgtgccagaattgttccaaattctgccgtgaagttttttagctatgagcaagcatcaagtggaattttatggctttatcggcaacaaacagggaatgaggatgctcagcttagtccactattgcgccttggagctggtgcttgtgctggtatcatagccatgtctgctacttacccgatggatatggttaggggtaggattaccgtgcagacggaaaagtctccttatcagtaccgtggtatgtttcatgcattgggttcagtataccgtgaagaaggcttccgtgctctatacagagggtggcttccatctgttatcggagtggttccgtatgttggcctcaactttgctgtgtacgagtctctgaaggactggctgcttcagacaaatccatatgatcttggcaaggacaatgagttgcatgtagttacaaggcttggatgtggagctgtggctggaaccataggccagactgttgcttaccctcttgatgtcatcaggaggagaatgcagatggttggttggaataatgcagcatctattgttactggagaaggcaaagaggcgctccagtacaatggtatgatcgatgcattcaggaaaactgttcgctatgaaggtgttggtgctttgtacaagggtcttgtgcccaattcagtgaaggtggtgccttctatcgctattgcattcgtgacatacgagtttgtgcaaaaagttctaggagtagagatgaggatatcagactgaagaaattggagttagtgctggtcattatcaactgctatttttgtagggtggtgagttctgtttttgtaggaagggcaggtagaaggatcatagcactgaggctcccattcagcataaggccctctcagcccatgttggtatatcctactactgtttccagatcctaattgttgctggacccgtgggaaaaattaataagttggctgtaaagcatgaagcatttgcctaactcataaagtctattcagtcgtgatggtgtattgagattgaaaactcatgcagtatgctgtgtgctgctaatagttgattttcatcattttcttctctttgtctaagattgtttctgctgataaatactctacttaaaccgagtaatgttggtgcgttttataccagcatttccttttcccattcctgaagtatctgtagtattacattacatccatccattcgtttgcttattatttacaagagtgaaatttttttcattgttgacgttttgatactgtatttctgaaacaagtgaaaacctctcatcatatgagaaagaaggctacccaacattttgctaagctaactccgagtctgaagcgttcccgccggatttacgccgtcgggtaggcggaattgccgccctattgaggtggccgtcggacttaatcctcggcgttcggcgggccacgaccggcggcggcctcaccgtgcccatcgacctcgacttctgcggcggccctgcacacgtcacggacatggagctagctgtaatcttggaggaaggctttagacgagtaacaatgccgctgcgacacttgcctgccttggcggcggcgatggccaccttgcgcggcggcgacgacctcgtgctgccgctccggtcaagcagcggccggctcgacgccgacgcgtccgtcgccgtcgtgctggacccgccgctggcgctgtcatctccccacagcgagttgccgtcgctgccggagtcggagctcctgtccctgcacgcgttgctcatcttgtccctctccatc

SEQ ID NO: 4630 - DNA, 1618 bp, Hordeum vulgare
gccgccgccgccaaaaccccaggccagggcgcttgcttcccgctcggcgcggcgaggggaggtcgtcgtcgtcgcgcgcgcgatccgggagggcgagaggggaggcgggcgaccggacgagggagatggcttcggaggacgtggtggggaagagcaggggcgacacggccgtcaacaccatcgtcaacctggccgaggaggccaagctcgcgcgcgagggcgtcaagggccccggccaccaggtcctcaccatctgcaagtccctcttcgccggaggcgtagccggtggcctatcgaggactgctgttgctccgcttgagcgattgaagatcctgcttcaggttcaaaatcctcacagtatcaagtacaatggcaccgttcaagggcttaagtatatatggagaaccgaaggccttcgtggactgtttaaaggcaatggaaccaactgtgcaaggattgtcccaaattctgctgtgaaattcttcagctatgagcaagcatcaaggggtattttgtatctttaccggcaacagactggggatgagaatgctcagcttagtccaatcttgcgccttggagctggagccacagctggtatcatagccatgtctgctacttatcccatggatatggttaggggtaggattactgttcagacagagaagtctccctaccagtaccgtggtatgtttcatgcattgggcacagtgtaccgtgaagaaggcttccgtgctttatacagaggctggcttccatcagtgattggagttgttccttatgttggccttaactttgctgtgtacgagtctctgaaggactggctcctccagtcaaatgcattcgatcttgcaaaggacaatgagctgcacgtagtaacaaggcttggatgcggagctgtggctggaaccatagggcagactgtggcataccctcttgatgttgtcaggagaaggatgcagatggtcggctggagtcatgctgcttctattgttactggagaaggcaaagaggcactccagtacaatggtatggttgatgcattcaggaaaactgttcgccacgaaggttttggtgctctgtacaagggtcttgttcccaactcagtgaaggtggtgccttctatcgccatcgcgttcgtcacgtacgaggccgtgaaggatgttctaggagtagagatgaggatagactgaagaatcggacctagcgctgtccgtgtcatcaacttctatttttgtaggtgtttgagttccctttttttgttaggcagggcgagtagaaggacaataggaccgaggctccattcagcataaggccctctcagcccatgtcgatatatcctactactggttccggaaccctaattgctgccgcactctcgcttcggaaagtaataagttggctgtaaagcattaaagcatttgcctgactcataaagtcttattcagtgaggaaccttgtattgagattgaaacataagctgcatgctgtgtgctgctgctaatagttgattttcaccattctcttcttttctgcgctctttgctgcatctttgttgtgactggcatttctcatttgctgagtgctgatgtattgatatgtgcttaaagggaaactcttg

SEQ ID NO: 4631 - DNA, 1497 bp, Secale cereale
cccaggcatctaccaccgaggcgcggcgaggggaggggttgccgtcgccgccgcgcgcgcgatccgggagggcgcgagaggggagggaagccggcgaggcggacgcggggaggagatggcatcggaggacgtggtggggaagagcaggggcgacacggccgtcaacaccatcgtcaacctggccgaggaggccaagctcgcgcgcgagggcgtcaagggccccggccaccaggtcctcaccgtctgcaagtccctcttcgccggaggcgtcgccggcggcctatcgaggactgctgttgctccgcttgagcgattgaagatcctgctgcaggttcaaaatcctcacagtatcaagtacaatggtaccgttcaagggcttaagtatatatggagaaccgaaggccttcgtgggctgtttaagggcaatggaactaactgtgcaaggattgtcccaaattctgctgtgaaattcttcagctatgagcaagcatcaaggggtattttgtatctttaccggcaacagactggggatgagaatgctcagcttagtccaatcttgcgccttggagctggagcgacagctggtatcatagccatgtctgctacttatcccatggatatggttaggggtaggattactgttcagacagagaagtctccctaccagtaccgtggtatgtttcatgcattgggcacagtgtaccgtgaagaaggcttccgtgctttatacagaggctggcttccatcagtgattggagttgtcccttatgttggccttaactttgctgtgtacgagtctctgaaggactggctcctccagtcaaatgcatttgatcttgcaaaggacaatgagctgcacgtagtaacaaggcttggatgcggagctgtggctggaaccataggccagactgtggcataccctcttgatgttgtcaggagaaggatgcagatggtcggctggagtcacgctgcctctattgttactggagaaggcaaagaagccctccagtacaatggtatgattgatgcattcaggaaaactgtccgccacgaaggatttggtgctctgtacaagggtcttgtgcccaactcggtgaaggtggtgccttccatcgccattgcgtttgtgacgtacgaggccgtgaaggatgttctaggagtagagatgaggatagactgaagaatcggacctagcgctgtccgtgttatcaacttctatttttgtaggtgttgagttccttttttttgttaggcagggcgagtagaaggacaatataggacccgaggctccattcagcataaggccctctcagcccttgtcgatatatcctactactggttccggaaccctaattgctgccgcactctcgcttcagaaagtaataagttggctgtaaagcattaaagcatttgcctgactcataaagtcttattcagtgaggaaaccttgtattgagattgagacataagctgcatgctgtgtgctgctaatagttg

SEQ ID NO: 4632 - DNA, 1730 bp, Secale cereale
tcagggttaatagagagggggaggcagccaccagcgcctctcgtcccccaccgcacgcccacgcccacgcccacgcacgcgctccctcctcgcgccgccgccgcaaaagccccaggcatcttcctccgaggcgcggcgaggggaggggttgccgtcgccgccgcgcgcgcgatccgggagggcgcgagaggggagggaagccggcgaggcggacgcggggaggagatggcatcggaggacgtggtggggaagagcaggggcgacacggccgtcaacaccatcgtcaacctggccgaggaggccaagctcgcgcgcgagggcgtcaagggccccggccaccaggtcctcaccgtctgcaagtccctcttcgccggaggcgtcgccggcggcctatcgaggactgctgttgctccgcttgagcgattgaagatcctgctgcaggttcaaaatcctcacagtatcaagtacaatggtaccgttcaagggcttaagtatatatggagaaccgaaggccttcgtgggctgtttaagggcaatggaactaactgtgcaaggattgtcccaaattctgctgtgaaattcttcagctatgagcaagcatcaaggggtattttgtatctttaccggcaacagactggggatgagaatgctcaacttagtccaatcttgcgccttggagctggagccacagctggtatcatagccatgtctgctacttatcccatggatatggttaggggcaggattactgttcagacagagaagtctccctaccagtaccgtggtatgtttcatgcattgggcacagtgtaccgtgaagaaggcttccgtgctttatacagaggctggcttccatcagtgattggagttgtcccttatgttggccttaactttgctgtgtacgagtctctgaaggactggctcctccagtcaaatgcatttgatcttgcaaaggacaatgagctgcacgtagtaacaaggcttggatgcggagctgtggctggaaccataggccagactgtggcataccctcttgatgttgtcaggagaaggatgcagatggtcggctggagtcacgctgcctctattgttactggagaaggcaaagaagccctccagtacaatggtatgattgatgcattcaggaaaactgtccgccacgaaggatttggtgctctgtacaagggtcttgtgcccaactcggtgaaggtggtgccttccatcgccattgcgtttgtgacgtacgaggccgtgaaggatgttctaggagtagagatgaggatagactgaagaatcggacctagcgctgtccgtgttatcaacttctatttttgtaggtgttgagtttccctttttttgttaggcagggcgagtagaaggacaatataggacccgaggctccattcagcataaggccctctcagcccttgtcgatatatcctactactggttccggaaccctaattgctgccgcactctcgcttcagaaagtaataagttggctgtaaagcattaaagcatttgcctgactcataaagtcttattcagtgaggaaaccttgtattgagattgagacataagctgcatgctgtgtgctgctaatagttgattttcatgattctcttcttttacttaaacaaaaaaaaaaaaaaagaaaaaaaaaaaagaaaaaaaaaaagaaaaaaaaaacaaagtaagacagacgacgacacaacgaggtagagtagggg

SEQ ID NO: 4633 - DNA, 1560 bp, Hordeum vulgare
cagcacgcccgcgcccacgccccctccctcctcgcgccgccgccgccgccgccgccaaaaccccaggccagggcgcttgcttcccgctcggcgcggcgaggggaggtcgtcgtcgtcgcgcgcgcgatccgggagggcgagaggggaggcgggcgaccggacgagggagatggcttcggaggacgtggtggggaagagcaggggcgacacggccgtcaacaccatcgtcaacctggccgaggaggccaagctcgcgcgcgagggcgtcaagggccccggccaccaggtcctcaccatctgcaagtccctcttcgccggaggcgtagccggtggcctatcgaggactgctgttgctccgcttgagcgattgaagatcctgcttcaggttcaaaatcctcacagtatcaagtacaatggcaccgttcaagggcttaagtatatatggagaaccgaaggccttcgtggactgtttaaaggcaatggaaccaactgtgcaaggattgtcccaaattctgctgtgaaattcttcagctatgagcaagcatcaaggggtattttgtatctttaccggcaacagactggggatgagaatgctcagcttagtccaatcttgcgccttggagctggagccacagctggtatcatagccatgtctgctacttatcccatggatatggttaggggtaggattactgttcagacagagaagtctccctaccagtaccgtggtatgtttcatgcattgggcacagtgtaccgtgaagaaggcttccgtgctttatacagaggctggcttccatcagtgattggagttgttccttatgttggccttaactttgctgtgtacgagtctctgaaggactggctcctccagtcaaatgcattcgatcttgcaaaggacaatgagctgcacgtagtaacaaggcttggatgcggagctgtggctggaaccatagggcagactgtggcataccctcttgatgttgtcaggagaaggatgcagatggtcggctggagtcatgctgcttctattgttactggagaaggcaaagaggcactccagtacaatggtatggttgatgcattcaggaaaactgttcgccacgaaggttttggtgctctgtacaagggtcttgttcccaactcagtgaaggtggtgccttctatcgccatcgcgttcgtcacgtacgaggccgtgaaggatgttctaggagtagagatgaggatagactgaagaatcggacctagcgctgtccgtgtcatcaacttctatttttgtaggtgtttgagttccctttttttgttaggcagggcgagtagaaggacaataggaccgaggctccattcagcataaggccctctcagcccatgtcgatatatcctactactggttccggaaccctaattgctgccgcactctcgcttcggaaagtaataagttggctgtaaagcattaaagcatttgcctgactcataaagtcttattcagtgaggaaccttgtattgagattgaaacataagctgcatgctgtgtgctgctgctaatagttgattttcacc

SEQ ID NO: 4634 - DNA, 1500 bp, Avena sativa
aggacaacgaacccgctgccgccgcctcctcctcctcctcggcgcggcgagcgggcgcgatccgggtcggcggcgagaggggagtttagttagcgcgcgggcaggggaggggagatggcatcggaggacgtggtgggcaagagcaggggcgacacggccgtcaacaccatcgtcaacctggcggaggaggccaagctcgcgcgcgagggggtcaaggggcccggacaccaggtcctcaccgtctgcaagtcgctcttcgccggaggcgtcgccggtggactatcaaggactgctgttgctccacttgagcgattgaagatcctgcttcaggttcaaaatcctcacagtatcaagtacaatggtacagttcaagggctgaagtatatatggagaaccgaaggccttcgtggactctttaagggcaatgggacgaattgtgctaggatcgtcccaaattctgctgtgaagttcttcagctatgaacaagcatcaaggggtgttctttatctttaccgacaacagactggggatgagaatgctcagcttagtccagtcttgcgccttggagccggagcctgtgctggcatcatagccatgtctgccacttatcccatggatatggttaggggtaggattactgttcagacagataagtctccttaccagtaccgtggtatgttccatgcattgggcacagtgtaccgtgaagaaggcttccgtgctttatacagagggtggcttccatcagtgattggagttgtcccttatgtgggccttaactttgctgtatacgagtctctgaaggactggatcctccgtacaaatgcatttggacttgcagataataatgagttgcatgtagtcacaaggcttggatgtggagctgtggctggaaccatagggcagaccgtggcataccctcttgatgttgtcaggagaaggatgcagatggttggttggaatcatgctgcttctattgttactggagaaggcaaagcggctctccagtacaatggtatgattgatgcatttaggaaaactgttcgccacgaaggatttggtgctttgtacaagggtcttgtgcccaactcagtgaaggttgtgccttccatcgccattgcttttgtcacgtacgaggctgtgaaggatgttctaggagtagagatgaggatagactaaagaagtggacttagtcgtcctggccgttatcaacttctatttttgtaggtgttgagagttgtttttttgttaggcaggggagtagaaggacaataggaccgaggctccattcagcataaggccctctcagcccttgtcgatatatcctactactggttccagatcctaattgtttgccgcactctcggggaaataataagttggctgtaaagcattaagcatttgcctaactcataaagtcttattcagtgaggaaccatgtattgagattgaaacataagcttgcatgctgtgtgctgctaatagttgattttctaaaaa

SEQ ID NO: 4635 - DNA, 1429 bp, Triticum aestivum
ggcatcttcctccgaggcgcggcgaggggaggtcgtcgccgccgcgcgcgatccgggagggcgagaggggaggcggacgcgggagaggagatggcatcggaggacgtggtggggaagagcaggggcgacacggccgtcaacaccatcgtcaacctggccgaggaggccaagctcgcgcgcgagggcgtcaagggccccggccaccaggtcctcaccgtctgcaagtccctcttcgccggaggcgtcgccgggggcctatcgaggactgctgttgctccgcttgagcgattgaagatcctgcttcaggttcaaaatcctcacagtatcaagtacaatggtaccgttcaagggcttaagtatatatggagaacagaaggccttcgtggactgtttaagggcaatggaactaactgtgcaaggattgtcccaaattctgctgtgaaattcttcagctatgagcaagcatcaaggggtattttgtatctgtaccggcaacagactggggatgagaatgctcagcttagtccaatcttgcgccttggagctggagccacagctggtatcatagccatgtctgctacttatcccatggatatggttaggggtaggattactgttcagacagagaagtctccctaccagtaccgtggtatgtttcatgcattgggcactgtgtaccgtgaagaaggcttccgtgctttatacagaggctggcttccatcagtgattggagttgtcccttatgttggccttaactttgctgtgtacgagtctctgaaggactggctcctccagtcaaatgcattcgatcttgcaaaggacaatgagctgcacgtagtaacaaggcttggatgcggagctgtggctggaaccataggccagactgtggcataccctcttgatgttgtgaggagaaggatgcagatggtcggctggagtcacgctgcttctattgttactggagaaggcaaagaggcactccagtacaatggtatgattgatgcattcaggaaaactgttcgccacgaaggatttggtgctctgtacaagggtcttgtgcccaactcggtcaaggtggtgccttccatcgccatcgcgtttgtgacgtacgaggccgtgaaggatgttctaggagtagagatgaggatagactgaagaatcggacctagcgctgtccgtgttatcaacttctatttttgtaggtgttggagttccctttttttgttgttaggcagggcgagtagaaggacaatataggacccgaggctccattcagcataaggccctctcagcccttgtcgatatatcctactactggctccggaaccctaattgctctcgcttcggaaagtaataagttggctgtaaagcatttaaaagcatttgcctgactcataaagtcttattcagtgaggaaccttgtattgag

SEQ ID NO: 4636 - DNA, 1656 bp, Triticum aestivum
cgccgccgccgcaaaaaccccgggcaggcatcttcctccgaggcgcggcgaggggaggtagtcgccgtcgtcgccgccgcgcgcgatccgggagggcgagaggggaggcggacgcgggagaggagatggcatcggaggacgtggtggggaagagcaggggcgacacggccgtcaacaccatcgtcaacctggccgaggaggccaagctcgcgcgcgagggcgtcaagggccccggccaccaggtcctcaccgtctgcaagtccctcttcgccggaggcgtcgccgggggcctatcgaggactgctgttgctccgcttgagcgattgaagatcctgcttcaggttcaaaatcctcacagtatcaagtacaatggtaccgttcaagggcttaagtatatatggagaacagaaggccttcgtggactgtttaagggcaatggaactaactgtgcaaggattgtcccaaattctgctgtgaaattcttcagctatgagcaagcatcaaggggtattttgtatctgtaccggcaacagactggggatgagaatgctcagcttagtccaatcttgcgccttggagctggagccacagctggtatcatagccatgtctgctacttatcccatggatatggttaggggtaggattactgttcagacagagaagtctccctaccagtaccgtggtatgtttcatgcattgggcacagtgtaccgtgaagaaggcttccgtgctttatacagaggctggcttccatcagtgattggagttgtcccttatgttggccttaactttgctgtgtacgagtctctgaaggactggctcctccagtcaaatgcattcgatcttgcaaaggacaatgagctgcacgtagtaacaaggcttggatgcggagctgtggctggaaccataggccagactgtggcataccctcttgatgttgtcaggagaaggatgcagatggtcggctggagtcacgctgcttctattgttactggagaaggcaaagaggcactccagtacaatggtatgattgatgcattcaggaaaactgttcgccacgaaggatttggtgctctgtacaagggtcttgtgcccaactcggtgaaggtggtgccttccatcgccattgcgtttgtcacgtacgaggccgtgaaggatgttctaggagtagagatgaggatagactgaagaatcggacctagcgctgtccgtgttatcaacttctatttttgtaggtgttgagttccctttttttgttaggcagggcgagtagaaggacaataggaccgaggctccattcagcataaggccctctcagcccttgtcgatatatcctactactggctccggaaccctaattgctctcgcttcggaaagtaataagttggctgtaaagcattaaagcatttgcctgactcataaagtcttattcagtgaggaaccctgtattgagattgattgaaacataagctgcatgctgtgtgctgctaatagttgattttcatgattctcttcttttcttcactctttgttgcacgtctcatttctatcccttttgtgactggcatgtctcatttgttgagtgttgctgcttatatgtgtctgaataaaactctttgacatcaatgctgctatctgaacatgcatttgcatt

SEQ ID NO: 4637 - DNA, 1582 bp, Brachypodium distachyon
aaaagccccgggccgggccgacacgccgacgccgccgtctcctctcctccttccccttggcgcggctccgttgttgttgtcgcgggcaggcgatccgggcggggttctagcgcgcggaggaggggcgcagggaaggagatggcatcggaggacgtggtggggaagagcaggggcgacacggccgtcaacaccatcgtcaacctggcggaggaggccaagctcgcgcgggagggggtcaagggccccggccaccaggtcctcaccatctgcaagtcgctcttcgccggcggcgtcgccggtggcctgtcgcgtaccgctgttgctccgcttgaacgactgaagatcctgcttcaggtccaaaatccacatagtatcaagtacaatggtactgttcaagggcttaagtacatatggggtaccgaaggttttcgtggactttttaagggcaatggaacaaactgtgcaaggattgtcccgaattctgctgtgaagttcttcagctatgaacaggcatcaaggggtatattgtatctataccggcaacaaagtggggatgaggatgctcagcttagtccagtcttgcgccttggagctggagccactgctggtatcatagccatgtctgctacttatcccatggatatggttaggggtaggataactgttcagacagagcagtctccctatcagtaccgtggtatgtttcatgcattgggcacggtgtaccgtgaagaaggcttccgtgctttatacagagggtggcttccatcagtgattggagttgtcccttatgttggcctcaacttcgctgtatatgagtctctgaaggactggcttctccagacaaatactcttggacttgcaaaggataacgagttgcatatcgtaacaaggcttggatgtggagctgtggctggaaccataggccagactgttgcataccctcttgatgttgtcaggagaagaatgcagatggttggttggaatcatgctgcttctattgttactggagaaggcaaggaggcactccagtacaatggtatgatcgatgcattcaggaaaactgttcgccatgaaggatttggtgctttgtacaagggtcttgtgccgaattcagtgaaggtggtgccatctatcgccattgcattcgtgacgtacgaggctgtgaaggatgttctaggagtagagatgaggatagactgaaggattgggcttagtcttggccgttatcaacttctatttttgtaggtgttgagtcgtttttgttaggcagggcgagtagaaggacaataggactgaggctccattcagcataaggccctctcagcccatgtcgatatatcctactaccgcttccagatcttaattgttgctgcactcttggggggaaataataaggtggctgtaaagcattaagcatttgcctaactcataaagtcttattcagtaagcatttatgatgtattgagattgaaacataatcagcatatgctgtgtgctgctaatagttcattttcgtgattttcctatccttttgttggactgagattgtgtctaatatccattacatgttcaatttggc

SEQ ID NO: 4638 - DNA, 1703 bp, Brachypodium distachyon
aaatgggttaatagtagccaccacctctctcgctgcgtcctctaccacttgcctcttgcacgccctctcctcctcccgccgccgccgcaaaagccccgggccgggccgacacgccgacgccgccgtctcctctcctccttccccttggcgcggctccgttgttgttgtcgcgggcaggcgatccgggcggggttctagcgcgcggaggaggggcgcagggaaggagatggcatcggaggacgtggtggggaagagcaggggcgacacggccgtcaacaccatcgtcaacctggcggaggaggccaagctcgcgcgggagggggtcaagggccccggccaccaggtcctcaccatctgcaagtcgctcttcgccggcggcgtcgccggtggcctgtcgcgtaccgctgttgctccgcttgaacgactgaagatcctgcttcaggtccaaaatccacatagtatcaagtacaatggtactgttcaagggcttaagtacatatggggtaccgaaggttttcgtggactttttaagggcaatggaacaaactgtgcaaggattgtcccgaattctgctgtgaagttcttcagctatgaacaggcatcaaggggtatattgtatctataccggcaacaaagtggggatgaggatgctcagcttagtccagtcttgcgccttggagctggagccactgctggtatcatagccatgtctgctacttatcccatggatatggttaggggtaggataactgttcagacagagcagtctccctatcagtaccgtggtatgtttcatgcattgggcacggtgtaccgtgaagaaggcttccgtgctttatacagagggtggcttccatcagtgattggagttgtcccttatgttggcctcaacttcgctgtatatgagtctctgaaggactggcttctccagacaaatactcttggacttgcaaaggataacgagttgcatatcgtaacaaggcttggatgtggagctgtggctggaaccataggccagactgttgcataccctcttgatgttgtcaggagaagaatgcagatggttggttggaatcatgctgcttctattgttactggagaaggcaaggaggcactccagtacaatggtatgatcgatgcattcaggaaaactgttcgccatgaaggatttggtgctttgtacaagggtcttgtgccgaattcagtgaaggtggtgccatctatcgccattgcattcgtgacgtacgaggctgtgaaggatgttctaggagtagagatgaggatagactgaaggattgggcttagtcttggccgttatcaacttctatttttgtaggtgttgagtcgtttttgttaggcagggcgagtagaaggacaataggactgaggctccattcagcataaggccctctcagcccatgtcgatatatcctactaccgcttccagatcttaattgttgctgcactcttggggggaaataataaggtggctgtaaagcattaagcatttgcctaactcataaagtcttattcagtaagcatttatgatgtattgagattgaaacataatcagcatatgctgtgtgctgctaatagttcattttcgtgattttcctatccttttgttggactgagattgtgtctaatatccattacatgttcaatttggcacaaatcatgagtattatcttgagatgcatttc

SEQ ID NO: 4639 - DNA, 1818 bp, Elaeis guineensis
cccctatataagcaataccctcgccgtcaccgatacaaatccgggaacaacctcactcgcctcctcttccatccgctgttgccgagcagcggcaagaggaagaaagaatccctgaacaagaagtggaggcggctgccgtgtgatccttcgatctgatcgtttgctagccggagattcgatcacctcctcctcgtcctccgccgccgccgccgccgccgcctgtggaactgggcttttggaagggtttgttcacctccgccgctgggtcttgcttagggtttggtagagtttcatggcgtcggaggatgtcgtggggaagagcacgagtgagtcggcggtcactacgatcgtgaatcttgcggaggaggcgaagctcgccagggagggcgttaaggcccccgggcacgagctcctcagcatctgcaagtccctcgtggctggcggcgtcgccggtggagtgtcacggactgctgttgctccacttgagcggttaaaaatcttgcttcaggtccaaaatcctcacaacataaagtataatgggacgatgcaaggccttaagtatatttggagatctgagggtgttcgaggactattcaaaggcaatggtactaactgtgcacgcattgtcccaaactcggcagtcaagttctttagctatgagcaagcagccagtggaattttgtggctttaccggcgacaatcaggcaatgaagatgctcaactcactcctgtattgcgccttggagctggagcatgtgctggaatcattgctatgtctgctacttatcctatggacatggttcggggcaggataacagttcagactgagaagtccccttaccagtatagaggaatgtttcatgcactaggtacggtctaccgagaggaaggctttcgtgctctgtacaagggctggcttccatcagtaataggagtgattccgtatgtcggcctcaactttgctgtctatgaatccttaaaggattggttagtcaaatccaatccactgggtcttgtagaagactcagagttgagtgtggtgacaaggcttgcttgtggagctgttgccggaactattggccagactgttgcctaccctcttgatgtcattcggagaagaatgcagatggtgggttggaaccatgctgcttccattgtggcaggccaagggggaagcaaagcgccattggaatatactggaatggttgatgcatttaggaagacagtgcgtagtgaaggctttggggcactgtacaagggccttgttcccaattcagtaaaggtcgtgccatccattgcaattgcatttgtgacatacgaggttgtgaaggatgttcttggagtagaaatgagaatatcagattgaagccaaaaaaaaagggggcccgactgttattttgctaggggcatcgactgctatttttgtaggtggatggtagaagataggaaatgtgttcagtattaaggcctcaacccatgttgatatccaaccaacacttcagaacctgttgccagacatctagctttgacctcctcaacttaaagaataaattggctatagggcagggagaatttgtgtagcttccgtgatatctgtcaactctatatttagattgtatcatgttcggttgctgtttaatattctgcttgtccatgtagcatggccatctagcattttgcttcttttgacagagccttccgattaatcctgaagaaagccaagttaccaataaaataaaaatgctggcctttttgttgttctgttttctgttttggtagaatattgtttctttatcatacaataatcaaataaataaa

SEQ ID NO: 4640 - DNA, 1609 bp, Musa acuminata
aaaggaggcgttgcgactggaaccccgaaggaacggaaccgtgcgactggagaagcacagtctcctgtcctccacccccatcgcttccgcctccgactcttctcttctagccgagccgaactgtctgtagggtttgatggcgtcggaagatgtggtggggaagagcacgggagagtcggcggtgacgaggatagtgaacctcgcggaggaggcgaagcttgcgagggagggcgtcaaggctcccggccacgcgatcctcagcatctgcaagtcgcttgtggccggaggcgtcgcgggaggagtatctagaacagctgttgctccacttgagcgcctaaaaatcctgcttcaggttcaaaatcctcatagtattcagtataatggaactatccaagggctcaagtatatatggaaaagtgagggttttcgaggactgtttagaggcaatggtactaactgtgctcggattgtccccaattcagcggtcaagttctttagctatgaacaagcatcaagtggaattttgtggctttaccgtcggcaatctggcaatgaagatgctcaactcactcccgtattacgtcttggggctggagcatgtgctggaattattgctatgtctgctacttatcctatggacatggtccgtggaaggatcacagttcagactgagaagtcgccttaccagtacaggggcatgtttcatgcgttgggcactgtctaccgtgaagaaggctttcgtgctttgtacaaaggctggctaccatctgtcataggagttattccttatgtgggcctcaattttgccgtttatgaatctttgaaagattggttaattaaatctaacccatatggtctcgttgaagattcggagttgagtgtagtcacaagacttgcatgtggtgctgttgctggaactattggccagacagttgcctaccctcttgatgtcattcgcaggaggatgcagatggtggggtggaataatgctgcctcagttgtggcaggtgaaggtagaagtaagggttccttggagtatactggaatgattgatgcattcaggaaaacagtgcatcatgaaggctttggggcattatacaagggtctcgttcccaattcagtaaaggtggttccatccattgcaatcgcatttgtgacttacgaggttgtaaaggacattcttggagtagagatgagaatatctgattgaagccagaataaatggtggagctgctatagttttgtgggcactttggctgctgcttatcatagtttcattcggagctcaagataggaaagctgttccctcgcaattcctgtgttggtatccaactagtacttggagtactgctggactctcttgtgttccaccgcgtatcaaaataaattaaatggtctacaaggggcatggaaggaacatgtagctctctcaagaaacatgttttgaattgttatgctgtgctggttgatgttgtgccaggtttctgcttttgtttttcttttaggtgcttaattttgtgatggttgggctatctagctatttaaaacatggaattcactggctgtttctttagtaattttagtaataacataagctagtttgctcggt

SEQ ID NO: 4641 - DNA, 1088 bp, Musa acuminata
gtttgatggcgtcggaggatgtggtggggaagagcacgggggattcggcggtgacgacgatcgtgaaccttgccgaggaggcgaagctcgcgagggagggcgtcaaggctcccgggcacgcgatcctcagcatctgcaagtccctcgtcgccggaggcgtcgcgggaggagtatcaaggacagctgttgctccacttgagaggttaaaaatcttgcttcaggttcaaaatcctcatagcattcagtataatggaactatccaaggccttaagtatatatggaagtctgagggttttcgaggactatttagaggaaatggtaccaactgtgcacggattgtccccaactcagcagtcaagttctttagctatgaacaagcatcaagtggaattttatggctttaccgtcggcagtctggcaatgaagatgctcaaatcactcctgtactacgtcttggtgctggagcatgtgctggaattattgctatgtctgctacttatccaatggacatggtccgtggaagaattacagttcagactgaaaagtcaccttaccagtacagagggatgtttaatgcattgggcactgtttaccgtgaagaaggttttcgtgctttgtacaaagggtggcttccatctgtcataggagtaattccttatgtaggcctcaattttgctgtttatgaatcactgaaggattggttagttaaatctaaaccatatggtcttgttgaagactcggagttgagtgttgtcacaaggcttgcatgtggcgctgtagctggaaccattggccagactgttgcctaccctcttgatgtcatacgcagaagaatgcagatggtgggttggaaggatgctgcctcagtcgtgacaggtgaaggcaggagcaaagcccctttggaatatgccggaatgattgatgcattcaggaaaacagtgcatcatgagggctttggggccttgtacaagggtcttgtccccaattcagtaaaggtggtaccatccattgcgattgcctttgtgacatatgaggtcgtgaaggatattctcggagtagaaatgagaatatctgactgaagccagaaa

SEQ ID NO: 4642 - DNA, 1764 bp, Aristolochia fimbriata
aacacgagacgccgttactgcgctccgcggaaccttgttatttcgcggcgcatcctagccacctcactgcttgccttccctgctgtgctcgctcgcatttttcgccgccgccgacaggagggaaagccgaggggtcatgcagatttctgctcaaagataagccgttggaccgatcggtagcctcacacaagtcacctcgatactccactcttgatcgtcttcggcccatttcctttgtgagggtttttatggcttcggaagatgttgtggggaaaacaaccggagagtccgccgtttcaactttcgtgaatcttgccgaagaggccaagcttgctagtgaaggtgtcaaggctcccggccacgcgatccttaccatctgtaaatcgcttgttgccggaggcgtcgccggaggagtatcacggactgcagttgctccattggagaggttaaaaattctgcttcaggttcaaaacccacacagcataaagtataatggaaccattcaaggcttgaagtatatatggagaacagagggtgtccgaggcttatttaagggtaacggtactaattgtgcccgtattgttccaaactctgctgtcaagtttttcagctacgagcaggcatccaggggaattttatggctgcaccggcagcaacctggcaacgaggatgctcagctcactcctctattgcggcttgaagctggagcatgtgctggaattattgccatgtcagcaacttatcccatggacatggtgagaggcaggcttactgtacagacggacaagtcgccttaccagtaccgaggaatgttccatgctctatcaactgttctccgggaagaaggcccgagggctctttataaaggctggctaccttctgttattggagttattccttatgtgggcctcaactttgctgtgtatgagtctctgaaagattggttactcaaaacaaaaccatttggcctggttgaaaatgatgagttgggggttgcaacaaggcttgcatgcggtgcggcagcaggaactgtggggcagactgttgcttaccctcttgatgtgattcgaagacgtatgcagatggtaggctggaaggatgcttcgtctgttgtgactggtgatggtagagggaaagcaccgctggagtatacaggcatgatcgatgctttcagaaaaacagtccggcatgaaggagttggagctttatacaagggtttggtacctaattccgtgaaggttgtcccatccatcgctattgcctttgtgacgtatgaggttgtgaaggatgtccttggggtggagatgagaatatctgactaaaccaactagctgaatatttgtaagaacctggatccgatttttgtaggcgaaagggaagctatataaacttaggaaagagaaagtgaataggccccgtgtttatatcatgcgatctcttctctatctttaagacaggacaaccgcttggtccttgccgcagtttgcatgcagtcaataagtgtttgagggaaagcagccttattagatttctcgtaatgattcttgattgattgaaattgattgtcattatgtgagttagaacgttcagtttagtattcgatatatagccatgcaatgacggagttatatttaccattagcggttcatggaaacgtactgctccaggttacttgtgacgttaatttgttctatatctatagacttagacgcgtgctggattgccttaatttgtgacagtgagctttttggccggtgaacatga

SEQ ID NO: 4643 - DNA, 1608 bp, Musa acuminata
gaggtggtcgctcctcttcataccgtataaatagagagcgagagggatcgccgccgcaaagcccgaaccccttcgccgccctccgcccactctcttccccgagaagaccccgacgggagtgagacggccgcggtctgactttaccccttcgatccgatccggtccaaccggcggtcgtctcgccgagggtttcgagccggcccgacctggttcttgagctagtccggagattccatggcgtcggagaatgtggtggggaagaacacgggggagtcggcggtcacgacgatcgtcaacctcgcggcggaggaggccaagctcgcgagggagggcgtcaaggcccccggccacgcgatcctcagcatttgcaagtctctcgtcgctggtggtgtcgccggaggagtatcaagaactgctgttgctccacttgagcggttgaaaattctacttcaggttcaaaatcctcacagtattcagtataatggaaccatacaaggcctcaagtacatatggaaatctgagggttttcgaggactattcaaaggcaacggaactaactgcgcacgcatcattccaaattctgcagtcaaattttttagctacgaacaagcatcaagtggaattttgtggctttaccgacgacactctggcaaagaagatgctcagcttactcctgttttgcgtcttggagcgggagcatgtgctggaataattgcaatgtctgcgacttatcccatggacatggttcgtggcaggatcactgtgcagactgaaaagtctccgtaccagtacagaggaatgtttcatgcattgcgcacggtctattgtgaggaaggttttcgtgctctgtacaagggctggcttccatcagttataggagtaattccatacgtgggcctcaactttgctgtctatgaatctctaaaggactggttgatcaaaaccaacccatacgggctcgttgaagactcggaattgagcatcgtcacaaggctcggctgcggagcggttgctggaacggttggccagactgttgcctaccctctcgatgtaatccggagaagaatgcaaatggtgggttggaaggatgctgcttctattgtgaccggacatggaaggagcaaagcacctttagaatacaatggcatggtagatgccttcaggaaaactgtccgtaacgaaggcttcggtgcattatacaaaggtcttgtccccaattcagtaaaggtggtgccatcaattgcaattgcttttgtgacgtacgaggtggtaaaggatgttcttggtgtagaaatgaggatatcggattgatggtgtcgatgctgcgcccactgttgtcgtgaggagggttggcttcgtctttactgcgtacgtagatgttccatgttaatgactgctgctgaacattttggtttcctctgttggcttgaagaataaatcggctgtaccgcagtaggaagcctaaacttaatgttgggacccataatgacgttggacgcgttttatgagctgacctggacccgacatggtcacctctcgggttccgtgttgcgtggcgtgcgggtcacgtgcgagttccgctccgctgctcagggttgacactaggcg

SEQ ID NO: 4644 - DNA, 1638 bp, Populus trichocarpa
gtcacacacgtacgcccccactcgctctaagctcgggacctcagctctctcacttttctcaagagccgtcattccagagagagatgcagagtctggctattcgttaaattaataaagcaaaattaagatccgacccggcacccgattgattgccggagaatccgagatctttttaattcacagagttgattaattagggttctcttttggtgattgaacgatggcatcggaggatgtgaagacgagcgaatcggctgtgactaccattgtcaatttggcggaggaagctaagcttgctagagaaggagtcaaagctcctagccatgcaattctcagtatctgcaagtctcttgtcgccggtggtgtagctggtggagtgtctcgcactgctgttgctcccctggagaggttgaaaatattgctacaggttcaaaatccacacaacataaaatacaatggaacaattcaagggttaaaatacatatggagaactgagggttttcgtggattgttcaaaggaaacggtaccaactgtgctcgtatagtcccaaattcagcagtcaagttcttcagctatgagcaagcttctaagggaatattgtctctctatcaacagcaaactggcaacgaggatgctcagctcactcctcttttacgccttggagctggagcatgtgcaggaattatagccatgtctgcaacttatcccatggatatggtacgcggcaggctaactgtacagactgataaatctccttatcaatacagaggaatgtttcacgcactttcaaccgtgctccggcaagaaggcccacgggctctgtacaagggctggcttccttctgtcattggagttgttccatatgtgggtctcaactttgcagtgtatgaatctctaaaggactggttggttaaagctagaccatttggactagtggaagattctgaattgagtgtgactacaaggctagcttgtggggctgctgcggggaccattggccaaactgttgcttatcctcttgatgttattcgccgacggatgcaaatggtgggatggaaagatgctgcttccattgtcactggtgatgggaggagcaaggccccacttgagtataatggcatgattgacacattcaggaaaactgttcggcatgagggctttggagcattatacaagggtttggtacccaattcagtgaaggtagtcccatctatagcaattgcatttgtgacatacgagatggtgaaagacgttttaggagttgaaatcagaatatcagactaaagtcttggggtcctgcctgatatttgttgaaccagtgtggtatttttgtaggcaagggcatacagagaaggtaaactaggaatttttttttcagctctcttacaaacaagcgagtttagaaacatgtatgaacctgtgtttatgtatcattttccctcctttcctttctttgtttccttgagaacaagcttagccttgagcttctcattcatatgatgtgtcaataaagcatgttgatgggacaactcatgattttcaattgtacgccgcttcataagagctgaaagcatcttctgaggcttgctctgcactcactggctattaattgaactcccccctatcttttgtgtgca

SEQ ID NO: 4645 - DNA, 1910 bp, Amorphophallus konjac
tccccggacacatataactgagaagaagagacaccgccaactcgtgtccacagagctcattcccccggcgcattttgtaggcagccttggccctccccccgctcggctctgcctccccctctcgtctctctccgccgccatcggccaggggaaaagggaacagaagactggaaatggaggcggccctggtataattggcggcctctgaccgctcgtcgccaggggatctttccccgctctcggacgcggccttcttcccgcctctccttcggctccgtccgttccctcctctggggaattcctctcctagggtttttccgggaggtcgatggcatccgaagatgtggtgggaaagaccacgggggagtcggcggtgaccacgatcgtgaacctggctgaggaggcgaagttggcgagggagggagtcaaggcccctggccacgcgatccttacgatctgcaagtctctcgcggccggtggtatcgccgggggagtgtctcgtaccgctgttgctccattggaacggttgaaaattttacttcaggttcagaatccacacaatatcaagtacaatgggacaattcaaggactgaaatatatatggagaactgagggcttccgaggattgtttaaaggcaatggcaccaattgtgctcgcattgttccgaattcttctgtcaagttttttagctacgagcaagcatcaagtggtattttgtggctttatcggcagcagactggaaatgaggatgcagagcttacccctgttttgcgccttggtgccggagcatgtgctggaattattgctatgtctgctacatatcctctggacatggttcgaggcaggataactgtccagactgagaagtcaccctaccagtacagaggcatgttccatgcattaacaacagtatatcgacaagaaggattccgagcactgtacaaaggctggcttccttctgtaattggagtcgttccttacgtgggcctcaattttgccgtttatgaatccttaaaagactggctcgtcaagtctaggccatttggactcgtccaagacagtgagttgagtgtgacaacgaggcttgcgtgcggagctgccgcaggaaccgtggggcagactgttgcgtaccctctcgacgtcattcgcagaaggatgcagatggtggggtggaaggacgctgccccggttgtggcaggtcaggggagcaaggcatcactccagtacaatggaatggtcgatgcattcaggcagactgtcaggaacgaaggtttcggagcattgtacaagggtctggttcctaactcagtgaaggtggtgccatccatcgcgattgcatttgtgacgtatgaagttgttaaggatgttcttggggtagagatgagaatctctgactgacggctggcgcagggtttggatttttgcgattcttggtaggcgaatgggtaggacggagatttagataaaaaaggggtccaggagaacacaaggggctcgccccccgagcccgtgtgtccgtcggaagcatttttttgctcgtttgtgactggaggtttcctggattcaccattcactttgtgttaataataaatggctacagagcaaataagcttgggatccattcagaataatcgtatttaactcgagtgctgatgatgttgatatagtttaattattatcagtcgcctctcagatgatctcgttttaacagttctctcatccttgtgggatatttcattgggggggcgtaaaaaaggggttttgcagttgctgtgtgtgggattgaacgatgcaaaaccctcgtgatgtgtaatctaggcatttcttgatgggggatttgcgactctttctctttttgtaggctgggacatttcaagccttttactggtattaattataaataaattgt

SEQ ID NO: 4646 - DNA, 1514 bp, Musa acuminata
ttcctcactcgctcacttgtttatgtgttcgaaagagagtgacgccattcgaacacgaaccctaccgccgccaccgcctccccccttcccgctccgctgcctctcaccgcggaaggagaagagtcggaggaatcggagacagaccgcctttgtttgtttcctcgtctcccgtcgatcgctgaacaagccacgtgctctcccccaggtccagtttagtttagggtttaggccgcttcgatcctgttgtagggttttatggcgtcggaggatgtggtggggaagagcacgggggagtcggcggtgacgacgatcgtgaatctcgcggaggaggcgaagctcgcgagggagggagtcaaggcccccggctacgcggtcgtcagcatctgcaagtccctcgtggccggaggcgtcgcgggaggagtatcaaggactgctgttgctccacttgaacgtttaaaaatcctgcttcaggttcaaaatcctcatagcattcaatataatggaactatccaaggcctcaagtatatatggaaatctgagggtttacgaggactattcagaggcaatggtactaactgtgcacggattgtccccaattcggcagtcaagttttttagctacgaacaagcatcaagtggaattttgtggctttatcgtcagcaatcaggcaatgaagaagctcagctcactcctgtattacgtcttggggctggagcatgtgctggaattattgctatgtccgccacttacccaatggatatggtccgtggaagaattacagttcagactgaaaagtcgccttaccagtacagaggaatgttccatgcattgggcactgtctaccgtgaagaaggctttcgagctctgtacaaagggtggcttccatctgtcataggagtaatcccttatgtaggcctcaattttgcggtatacgaatcgcttaaggattggctaattaaatctaacccatatggtcttgttgaagattcggagttgagtgtggtcacaaggcttggatgcggtgctgttgctggaactgttgggcagacggttgcgtaccctctcgatgtcattcgcagaagaatgcaaatggtgggttggaaagatgcagcctcggttgtgacaggtcaaggtaggagtagtgctcccttggaatacacaggaatggttgatgcattcaggaaaacggtgcatcatgaaggctttggggcattatacaagggtctcgtccccaatttggtcaaggtggttccatccattgcgattgcattcgtgacatacgaggttgtgaaggatcttctcgaagtagaaatgagaatatcggactgaagcccctgaatcgatggggtggttgtgccacttttgtgtgcactttggctgctgttttttctttcccccatccccccaggtttcataagaggggcaaaagatccagttctctctctctctctctctcatcccaacccaaagtgcttcgcggtgaaataaatggtttctgtaagttgcggcgagaa

SEQ ID NO: 4647 - DNA, 1688 bp, Actinidia deliciosa
tcaaaacgcactcactctgtgccgcatttcatctgccacaccctcactccctctccctctccctctccctctccgccgcctgagatcaccggagaggagagagaaacatgcaagctctcgcgctcccttaaaccgcagatttgcgatcggtcgccggaaagccaagatcgacctcgatcttcgatcttgactcgactgagcctttttcgatggcgtcggaggatgtgaagacaggcgaatctgcggtttccgcgatcgttaatctcgctgaagaggcgaagctcgcgagagaaggagttaaggccccgagctatgcggttctcagtatctgcaagtctctcgtcgccggaggtgtcgccggaggcgtgtcccgcactgctgtggctccattggaacgacttaaaattttgcttcaggtacaaaacccgcataacataaagtacaatggtactgttcaaggcctgaaatacatatggagaaccgagggctttaggggattatttaaaggcaatggtacaaattgtgctcgtattgtcccaaactcagccgtcaagttttttagctatgagcaagcttctaagggtatcttgtggtattacaggcagcaaactggaaatgaagatgctcagctcactcctctattacgccttggagctggagcctgtgctggaataattgccatgtctgcaacttaccctatggacatggttcgtggcaggctgactgtacagacagagaagtctccttatcagtacagaggaatgttccatgctttatcaactgtgctccgggaggaaggcccacgggctttgtacaagggctggcttccttctgtcattggagtggttccgtatgtgggtctcaactttgctgtgtatgaatctttgaaggattggttgattaaaagtaggccttttggactcgttgaagattctgaattaagtgtgactacaaggcttgcatgtggagctgcagcaggcactattggccaaactgttgcttaccctcttgatgtcattcgtcgtaggatgcaaatggtgggatggagcaatgctgcttctgttatcacaggtgatgggaggagcaaggcgccacttgaatatcgaggcatgattgatgctttcaggaaaactgttcggcatgagggttttagagcactgtacaagggtttggtccccaattcagtgaaggtggtcccatccatagctattgcttttgttacgtacgagcaggtgaaggacatcttaggagttgagataaggatatcagactgagcatgccggtaaccctcatatctgttcaacgagcgtgctatttttgtaggcaagggggaggagagagacgaggtcaactaatgcacacattgagacctgttcgagcctgtggttatgtattttccttccccatttttagctctatattgttcctcttggacttttttagagttcagctgtctgattcatatgccaatgtcagtaataagcatttgtcaaggaacaatgcaacaaatgcatttgcatgccttgtaatttaagtgaaggaggattgttgatttgtcttgtttggtcgaaagatcctctttttttaaggtgaaatgcaaaaataatgtttcgaaagcacacaacattatgaatcttcgaaaccgatggttttgttgtgatctaagaatacttttgtgaaaaaaaaaa

SEQ ID NO: 4648 - DNA, 1579 bp, Aquilegia formosa
actcccttggcgcattttagcttttctatctcactcactcactctctctctcttccgagatcgtagggaaatgcagatttattgatcaagaacttgtttgtgatctttcgtaaaaagattcaggtgaagtttttgattaaattgtttgttgaattgaatcttaaatggcttcagaagatgtagtagggaaatcaagaagtgattctgcagtttcaacgatcgttaatcttgctgaagaagcaaagttagctagtgaaggagttaaagctcctagtcatgctgcgatctttagcatctgcaagtctcttgtcgccggaggagtcgccggaggattatcccgtactgctgttgctccattggaacgattgaaaattttgcttcaggtgcaaaatcctcacaatatcaagtacaatggaacccttcaaggcttaaagtacatatggaggactgagggtttccgaggattgttcaaaggcaatggtactaactgtgcacgaattgtcccaaactcggctgtcaaattctttagctatgagcaagcttctagggggattttgtggttatacagacaacaacctggaaacgaagatgcatctttaactcctcttttgcgacttggagctggagcatgtgctggaataattgccatgtcagcaacttatcctatggacatggtccggggaagacttactgtgcagacagataaatccccttaccagtacaggggcatgtttcatgctctatcaactgttctccgcgaagaaggcgctagagctctatacaaaggctggcttccttctgtcattggtgttgttccatatgttggcctcaactttgctgtctatgaatctctgaaggactggttggtgaagtctagaccgtttggactagttgaagatgctgaattgagtgtgccaataaggcttgcatgtggagctgccgcaggaactgttggccagacagttgcttaccctcttgatgttattcgccgaagaatgcagatggtaggatggagcaacgcttcttcagttgttactggtgatgggagggctaaagcatcacttgaatataatggaatgattgatgcgtttaggaaaactgttcgaaatgagggttttcgagcactgtacaagggtttggtgccaaactcagtgaaggtggttccatccatagccattgcatttgtgacgtacgagtctgtgaaggatgtccttggagtcgagatgagaatatcagactgataggagtaaagttagctctcatgctatttttgtaggcgaaaaggaagatagagtgaggaaggggaattatatatattttttctcctgagaatgtagacagctctgtcgatgttgtcaattctgtcttccgatgcctctgatccaaacacggcctgattatttgtgagtcgtgtcaataaaggtatgtatgtggtttgtgttgaaaaaatttcccatgccatttgtggtggctagctctgtttgtggaagggtattctctctatttttccgccattattttacataccttcatttgcttattgttctctcttgatgtatctttctgcttctagaattat

SEQ ID NO: 4649 - DNA, 1668 bp, Beta vulgaris
ctcactcgactcttctcctcgaaaaggccgttttttcatcgacgatcggaacttcagattgattcattcagagtagagatttttctactttctctctcctccgaaagaacggaatttatcgatcattttcgaaatatctgtttttcaatctccgatctcgaattctagggttccggcgactccatttttaaaaaccttcatttcttttgctattttaatggcgtcggaagatgtgaagacgactgaatcagctgtttcgacgatcgttaatctggcggaagaggcgaagattgctagagagggcgttaaagctccgagtcatgcgattcttagtatctgcaagtctctagttgctggtggtgtcgccggtggagtgtcacgtactgctgtagctcccttagaacgcctgaagatattgctccaggttcaaaatccacatagcattaaatacaatggaactattcagggattaaagtatatatatcagactgagggattccgaggattgttcaagggtaatggaactaattgtgcacgtatcgtgccaaactctgccgtcaagtttttcagctatgagcaagcttctaagggaatactatggttatatcagcgacagactggcaacgagaatgctcaactcactcctgtattgcgccttggcgctggtgcatgtgctggcattatagcaatgtcagcaacttacccaatggacatggtacggggcagaattaccgttcagactgagaagtctcctttccagtacagaggcatggtccatgcactgtcaacaattcttcgcgaggaaggtccacgagctttgtacaagggctggcttccctctgtgattggtgttgttccatacgttggtctcaattttgccgtatacgagtcattgaaggattggttggcgaaagcaaggccatttggattaatacaagatggtgagctgagtgtgacaacaaggcttgcatgtggagctgttgcgggaactattggtcaaactgttgcctatcctcttgatgttattcgcagaagaatgcagatggtgggttggaatcatgcttcatctatagtcactggtgatggaaggggaaaggtccccttagaatacaatggaatggtcgatgcatttagaaaaactgtcagacatgagggattcggagctctgtacaaaggcctggtccctaattcagtaaaggttgtgccatccatagctattgcattcgtgacttatgagatggtgaaagatgtcttgggagttgaaatgagaatatcagactgaggcggatggatgatttgaagaactcttaagactgtgtgataattttttcttctttttggtaggcaattggaagaagataggtaaattttggttgatgtatttttacctaattagaacaaagtaagctagtaccaggttgctagcctgatttattatatgttgtttctatgtttcctgtcttgggggtccttcagataatcctttttggctttgtcagttcttcattcgaatacttataatttaataagtagttgctaataataaattgatggatccatttacatactttgaacagatagtcagattttacgtctgctatatagccctctgtacccgaaattcttcggttgtcattgtaattatgatcatgaaaatttagttgctag

SEQ ID NO: 4650 - DNA, 1659 bp, Eucalyptus grandis
cttacgcctccatctcccccttctaggcggacgcgcaatctcctctccgagccagcgcgcgcgcgctctgcctcgcgtaacggccatccgcgatcgccggggactgcgtcgccggccggtcagcctcgggttccggcggtccccctccctcccccgctctctcactctctccgtccttccctccttccctcggctctcgcgcgcggcggggcgcgcgggcggtgttggtgcttttttgatggcgtcggaggacgtggtcagcgagaggagggagtccgccgtgtcgacgatcgtcaacctggcggaggaggccagcgagggcgtgaaggcgcccagccacgctcttctcagcatttgcaagtcgctcgtggccggcggagtggccggcggagtgtcacgtactgctgttgctccattggagagattaaaaatattgctgcaggttcagaatcctcatagcataaagtacaacggaacaatgcaaggcctaaaatacatatggagaactgagggtttaaggggattgttcaaaggcaatggcactaattgtgctcgtattgttcccaattcagccgtcaagttcttcagctatgagcaggcatctcacggcattttatggctttatcggcagcaacctgggaaagaagatgcacagctaactcctcttttacgcctgggagctggtgcatgtgctggaattattgccatgtctgcgacatatccaatggacatggtacgcggtcggctgactgtccagacagagaagtctcctcgacagtatagaggaatttatcatgctctttcaactgtcttcaaggaagaaggccctagggcattgtacagaggctggcttccttctgtaataggagttgttccttatgtaggtctgaacttcgctgtgtatgaatccttgaaagactatttacttcaaaccaacccatttggactggttgaggacaacgagctaagtgtgacaacgaggcttgcatgcggtgctgctgcggggactattggtcagacggtagcttaccctcttgatgtcatcaggcgaagaatgcaaatggttggctggaaaggtgcttcttcagttatagttggtgaagggaggagtaaggcaccactcgaatacactggcatggttgatgcatttaggaagactgttcgttatgagggatttggagcattatacaagggtttggtccccaattcagtaaaggtcgttccatcgatagctattgccttcgtcacatatgaagtggttaaggacgttcttggagtggagatgaggatatccgactgaagggagaagcattcaagtaattcttttctttgacttatggcttatttccaaggcaaaaggttgagaggcttgatgggagtacattccgagattatttatgatcaggtagagaggaatctagagatccgttgatatatgtagtccatattttgtccctccatcttaggcttttttttttctccctcttttccttttctctcttcttacgtggaaataaattgttcgccaggggcttttgagaaaattctgtagaactgaatcctgggttttatgtttgtgattaaaatttatggccatgctctacgcgtactgtttcagtctgtcactggatggttatgtattttatgtgcttttgattt

SEQ ID NO: 4651 - DNA, 1692 bp, Phalaenopsis aphrodite
cccaacgccgccaataagccgcactctgattccccgctctttggttcatcccagccgtattcgttattcctcctcgctctccagtcgccgtcatcaccgtatcgcgaagtggaggctgcttccatataaatcgccgggtttggatcttttctaggacactcgccggctgctccgatctctttcccttttgccgcccagctcgaaggtttttgagcttttaccgcgctttccggtattctctggaagtgcttggtgatttctagggctttccatggcaacagaggatgttgtgggaaagagcacgggcgagaccgctgtgacgacaatcgtgaacctggcggaggaggcgaagcttgctagggaaggagttaaggccccgagccacgcgatcctgagcgtctgcaaatcgcttgtggctggaggcgtcgccggaggagtatcaaggactgctgttgctccacttgagaggcttaaaattttactacaggttcaaaattctctcaacatcaagtataatggaacaattcaaggcttgaaatatatttggagaaccgagggtttccgtggattatttaaaggaaatggtacaaactgtgcacgtattattccaaattcagctgtaaagttcttcagctacgagcaggcatccagagggattctgtggctttaccggcagcaaactggcaacgaggatgcacaacttactcctgtattgcgccttggtgctggagcatgtgctgggattattgctatgtctgccacttatcctatggacatggtcagaggcaggatcacagtccagactgagaaatccccttaccactatcgggggatgttccatgcattaggaacagtctacaaggaagagggcttccgggcactgtacaagggctggcttccgtctgtcataggagttattccatatgtaggcctcaactttgctgtatatgaatctctgaaggaatggttagttgtatctaagccatttggtattgctgatgatgaagagctgggtgtggttacaaagcttgcttgtggagctgctgctggaactgttggccaaactgtagcttatccgctggatgtcattcgcagaagaatgcagatggtgggttggaaggatgctgcttatattgtgagaagtgatggaaggactaaaggaccactggaatactctggaatgattgatgctttcaggaaaacagttcgccacgagggcttcaaagctctgtacaagggcctcgttccaaactcggtgaaggtggtgccatcaattgctatagccttcgtgacatatgaggtcgtgaaggatgttcttggtgttgaaatgagaatttcagactgagattggggttttgtattaactgctaccacgataaaagacgggagtctcttatttttgttggcggatgactcttggggctaaggtggagttgctgtcattcaaatagctttgttgatatcgcaatttgttgtaattagatatccagagcttcaaaatttccatctttgacctgaagaaataaatattaaattctgtagaatgcagataagggtgaatttatgtacattcctcacatccctaactctgtttattctgtttttatatgttgctgtttcacgccaattatatattacgattgctgttgctgctgcatgacaatgcccggatgtgagatccgacttgaaatc

SEQ ID NO: 4652 - DNA, 1864 bp, Elaeis guineensis
gccggaccgcctggatccatctctgttcccatatctgtatataaaagaatacccccgccgccaccgataactccgagaagaacaaccttactccccactctcctcttcttcttctctccgccgccgccaagcagcggaaagagaaagaaagaaagaaaccaggaacaagaaaatggaggctgccgccgtgtgattcttccgatctgatcgctcgctcgttcgtggacgattcgaccgccgccgccgccatcgcctgtgggactgggccttgggagggttcgttcttctccgcctctgggtcttggttagggtttggttgggtctgatggcgtcggaggatgtgaagagcacgagcgagtccgcggtcaagacgatcgtgaatctggcggaggaggcgaagctcgccagagagggtgtcagggctcccgggcacgcgctcctcagcatctgcaagtctctggtggccggtggcgtcgccggtggagtgtcacggactgctgtcgctcctctcgagcggttaaaaatcttgcttcaggtccaaaatcctcacaatataaagtataatggaacaattcaaggccttaaatatatatggaggactgaaggttttcgaggactattcaaaggcaatggtactaactgtgcacgcattgtcccaaactcagcagtcaagttctttagctatgagcaagcatccagtggaattttgtggctttaccgacggcaatcaggcaatgaagatgctaaactcactcctgtattgcgccttggagctggagcatgtgctggaatcattgctatgtctgccacttatcctatggacatggtccggggcaggataaccgttcagactgaaaagtctccttatcaatacagaggaatgtttcatgcactaggtacggtctatcgagaggaaggctttcgtgctctgtataaaggctggcttccatcagtaataggagtgattccatatgtgggcctcaattttgcagtctatgaatccttaaaagattggttaatcaaatccaggccattgggtcttgttgaagactcagagctgagtgtggtgacaaagcttgcttgtggtgctgttgctggaaccgttggccaaactgttgcctaccctctagatgttattcggagaagaatgcagatggtgggttggaaccatgctgcttctgttgtggcaggccaaggaagaagcaaggcaccattggagtatactggaatggttgatgcatttaggaaaacagtgcataatgaaggctttggggcattatacaagggcctcgttcccaattcagtaaaggtggtgccgtccattgcgattgcatttgtaacatatgaggttgtgaaggatattcttggagtagaaatgagaatatcagattgaagcaagaaaatggggtccaacactcccaactgctattttgtaggtgctttgactaccttttttgtaggtggatggtagaagataggaaaggtgttcagtattaaggcctcaatccgtgttgatatccaaccagtatttcagtacctgttgccagacatctagatttcatctcgtcaacttgaagaataaattggctgtatggcagggagagtatgtgtcgcttccatgatatctattgactcaatattgaggttgttatatcagttgttttgcttctctgattgtccatgcagtatgggccatcttgtctttttcttctttaacaaagccttcctgttaatccagatgaaagccataggtgttcccacccttaaataaaagctactattataatgagaaatggcctatttatttatttattttggtagactcatgtttcttcctatatgtagtgtaagcatgatggttcaa

SEQ ID NO: 4653 - DNA, 1607 bp, Cajanus cajan
tgcgttggttgtagtagttggcattggtgtgagctcactctctcgttcgaagctcccgcagccaccagtgagagccagcgagcgagcgagttccgatcgcttcgctgcacgagttcgccgttgcctcgccggaaaatccgagatctcttattctccgacgacgacgactcagataactctattattctcttttgttaggttaggttatatacagttttcaacgcatggcttcggagaatgtgaagaccggcgaatccgccgtgacgacgatcgtcaatctcgccgaggaagccaagctcgccagagaaggcgtcgtcaaggctcccagctacgcgctcggtagcatctgcaagtcactcgtagccggtggagtcgccggaggagtgtcacgtacggcagttgctccgctggaacggttgaaaattttgctacaggtccagaatcctcataacattaaatacaatggaacaattcaaggcctaaaatatatatggagaactgaaggtttccgtggacttttcaaaggaaatggtactaattgtgctcgaattgtccctaattctgctgtgaagttcttcagttacgagcaagcttctaagggtatactgtatctgtatcagcagcaaactggaaatgaggatgctcagctgactcctcttttacgactgggagctggagcatgtgctggaataattgctatgtcagcaacttatccaatggatatggttcgaggcaggattactgtgcagactgaggcatccccataccagtacagaggaatgtttcatgctttgtctactgtgcttagggaagaaggtccccgtgctttatataagggttggcttccttcggttattggagttattccttatgtaggtctcaactttgctgtgtacgagtctctaaaagattggttacttaaatccaatccatttggtctagttgaaaattctgagctgagtgtgacaacacgcctggcttgtggtgctgctgctggaactgttggacaaactgttgcttaccctcttgatgttattcgtcgaagaatgcagatggttggttggaaccatgctgcttctgttctaactgctgatggaagaagcaaagtcccacttgaatacactggaatgattgatgcatttagaaaaactgttcagcacgagggatttggtgcattatacaagggtttggtgcctaactctgtaaaggttgttccatcaatagcaattgcatttgtaacatatgaggtggtgaaggacgttttaggagttgagatcagaatatcagactaaagtttgataaccacatggtatctgttcacctggtgtggtttctttgtttttgttttctttttttgtaggcaaggggatgcagagatggtaacttacagttatttcttgtttttcatctcttcaaggatgagcttagaaactcgtagagctagtgtccataaatttattcccttgttctatttgtttaccttgttctatttgtccataataagtgttgtggaaaaacaatgcaaggacatatttgcctagctttctgcattagttgagaaagcatttttcttagtggaatttgcattaactagaaaaaaaaaaaaa

SEQ ID NO: 4654 - DNA, 1716 bp, Cajanus cajan
gagaatataaatagcataaccgtgtcttaacggcgtgactgtgcgttggttgtagtagttggcattggtgtgagctcactctctcgttcgaagctcccgcagccaccagtgagagccagcgagcgagcgagttccgatcgcttcgctgcacgagttcgccgttgcctcgccggaaaatccgagatctcttattctccgacgacgacgactcagataactctattattctcttttgttaggttaggttatatacagttttcaacgcatggcttcggagaatgtgaagaccggcgaatccgccgtgacgacgatcgtcaatctcgccgaggaagccaagctcgccagagaaggcgtcgtcaaggctcccagctacgcgctcggtagcatctgcaagtcactcgtagccggtggagtcgccggaggagtgtcacgtacggcagttgctccgctggaacggttgaaaattttgctacaggtccagaatcctcataacattaaatacaatggaacaattcaaggcctaaaatatatatggagaactgaaggtttccgtggacttttcaaaggaaatggtactaattgtgctcgaattgtccctaattctgctgtgaagttcttcagttacgagcaagcttctaagggtatactgtatctgtatcagcagcaaactggaaatgaggatgctcagctgactcctcttttacgactgggagctggagcatgtgctggaataattgctatgtcagcaacttatccaatggatatggttcgaggcaggattactgtgcagactgaggcatccccataccagtacagaggaatgtttcatgctttgtctactgtgcttagggaagaaggtccccgtgctttatataagggttggcttccttcggttattggagttattccttatgtaggtctcaactttgctgtgtacgagtctctaaaagattggttacttaaatccaatccatttggtctagttgaaaattctgagctgagtgtgacaacacgcctggcttgtggtgctgctgctggaactgttggacaaactgttgcttaccctcttgatgttattcgtcgaagaatgcagatggttggttggaaccatgctgcttctgttctaactgctgatggaagaagcaaagtcccacttgaatacactggaatgattgatgcatttagaaaaactgttcagcacgagggatttggtgcattatacaagggtttggtgcctaactctgtaaaggttgttccatcaatagcaattgcatttgtaacatatgaggtggtgaaggacgttttaggagttgagatcagaatatcagactaaagtttgataaccacatggtatctgttcacctggtgtggtttctttgtttttgttttctttttttgtaggcaaggggatgcagagatggtaacttacagttatttcttgtttttcatctcttcaaggatgagcttagaaactcgtagagctagtgtccataaatttattcccttgttctatttgtttaccttgttctatttgtccataataagtgttgtggaaaaacaatgcaaggacatatttgcctagctttctgcattagttgagaaagcatttttcttagtggaatttgcattaactgaaatttgcttgccccctctctaccctctcccatccatagataattatacgttttgaatgattgtgttacaacgtttgctgct

SEQ ID NO: 4655 - DNA, 1834 bp, Glycine max
ggcgtgagtctgcagtgggtgtagtgtagtagttggcattactgtgagctcccgcaggcagcagcagcactcatagagcttgcgagcgagtggtcacttggccacagttatcgccgtttccccgccgagatctctcaatctccgacgactcagatacctctattaatttttgttcctccggttaggttaggctataatacgtagtttttccttatttatggcttcggagaatgtgaagaccggggattcggccgtgacgacgatcgtcaatctcgccgaggaggccaagctcgccagggaaggcgtcgtcaaggctcccagctacgccctcgccagcatctgcaagtcgctcgtcgccggtggcgtcgccggaggagtgtcacgtactgcagttgctcctctggaacgattgaaaattttgctgcaggtccagaatcctcataacattaaatacaacggaacagtacaaggcctaaaatatatatggagaactgaaggattccgtggacttttcaaagggaatggtactaattgtgctagaattgtccctaattctgctgtgaagttcttcagttatgagcaagcttctaaaggtatactgcatctgtataagcagcaaactggaaatgaggatgctcagctgactcctcttttacgccttggagctggagcttgtgctggaataattgctatgtctgcaacttatccaatggatatggttcgaggcaggattactgtgcagactgaggcatccccatatcagtacagaggaatgtttcatgctttgtctactgtgctcagggaagaaggtgctcgtgctttatataagggttggcttccttcagttattggagttattccttatgtaggtctcaactttgctgtctatgagtctctgaaagattatttaattaaatccaacccatttgatctagttgaaaattctgagttgagtgtgacaacacgcctggcttgtggtgctgctgctggaactgttggacaaactgttgcttaccctcttgatgttattcgtcgaagaatgcagatggttggttggaaccacgctgcttctgttctaactggtgatggaagaggcaaagtcccacttgaatacactggaatgattgatgcattcagaaaaactgttcagcacgagggatttggtgcattatacaagggtctggtgcccaactctgtaaaggtggtcccatcgatagcaattgcattcgtaacatatgaggttgtgaaagacgttttaggagttgagatcagaatatccgactaaagtttgataaccacacatctgttcacctggtgtggtttttcattttttttcttttttgtaggcaaggggatgcagagatggttacttacagttattttcttgtttttcatctctccaaggatgagtttagaaactcttagagatagtgtccataaatttattcccttgttctattcgttttccttgttctatttgtccataataagtgttgtggaaaaacaatgcaaggacatatcttcctagctttctgcactagttgagaaagcatttttcttagtggattttgcatcaacttaaattttttagtggaattattagttttgaatgatttcattacagcgtatgctgctgtgacaatgtttattactcttcttttgggagtcaattagaaatagcagggttggacgaacactttatttctgttttgtgttagcctttgaagtgtagcgaacaccttatctgtccattcatgttcaaactgaattttgtttcccaaactattcagcattctaagtcaaagctagaatatcaagttgaaactatttagcc

SEQ ID NO: 4656 - DNA, 1569 bp, Fagus grandifolia
ctggaccttggctgtcactcagttactgcttcgagagccgtcactaccacacacagagagacagagaacaacgcagaggctcgcctttttatataatcctcccccggagatccgacccgattgatcgccgcgaaaaccgagatcgagcgccaacaacgacgtagcgttccggcgaagacttggtttggcttttcacacaaatggcatcggaggatgtgaagacgagtgaatcggcggtgtcgacgatcgtgaacctggcagaggaagcgaagttggcgagagagggcgttaaggctcctagctacgctgttctcagtatttgcaagtctctcgttgctggtggagtcgctggaggagtgtcgcgcacagctgttgctccattggaaaggttgaaaatattgctgcaggtccagaatccccataacataaaatacaatggaacaattcaaggcttgaaatatatatggagaactgagggttttcgtggactgttcaaaggaaatggtactaattgtgcacgtattgtcccaaactctgcagtcaagttcttcagctatgaacaggcttcaaagggaatcttgcatctgtatcagcagcaaactggcaatgaggatgctcagctcactcctcttttgcggcttggggctggggcatgtgctggaataattgccatgtccgcaacttacccaatggacatggtacggggcaggttaactgtacagacagagaactctccatatcagtatagaggaattttccatgctctatcaaccgtgctccgggaagaaggcccacgggcattgtacaggggctggcttccttctgttattggagttgttccatatgtgggtctcaactttgctgtgtatgaatctttaaaggattggttagttaaagctagaccatttggactagttcaagactctgagctgagtgtgacaacacggctggcatgtggagctgctgctggaactgttggacaaactattgcttatcctcttgatgtcatacgtcgacgaatgcagatggttgggtggaataatgcagcttctgttatcaccggtgatgggaggagcaaggccccactcgaatatactggtatggttgatgcattcaggaaaaccgttcgacacgagggctttggggcattgtataagggtttggtccccaattctgtgaaggtagtcccatctatagcaattgcatttgtgacatacgaggtggtgaaggacatactgggagttgagatcagaatatcagattgaagcgtggaactccatgataattattggacaagtgtgctatttttgtaggccaatggatagagagatggtaaaactagggataatttcttccttctggtttttccaggaatgagttagaagcacttttcagcctgtgtttataaattgttttccccgttttctttctatgtttccatgttcacatgctgtaggtttcagcttctcattgatatctgtgtcaataaatgatttgacaatgcaagaacacatatgcatgcctgccataagaactcatagagcttttttctcgagtatattgcaataa

SEQ ID NO: 4657 - DNA, 1468 bp, Solanum tuberosum
aggaaagcaccaataaaatccagtgctccccttccctcctctttcgatcgccggcgaacactgacgagcaccgagactagtttttctctagggttccggcgagttggaggttttttgaatggcgtcggaggatgtggtaggtaagagaagcgaaagtgctgttactacaatcgtcaatctggctgaagaagctaaaatggcgagcgaaggtgttaaagctccgagtcatgctgctattttcagtgtatgcaagtctctcgctgctggtggaatcgctggtggagtgtcacgcactgcagttgctccattggaaaggcttaaaattctgctccaggttcagaattctcacagtataaaatacaatggcacagttcaggggttgaaatatatatggagaactgagggtctccggggaatgttcaaaggaaatggaactaattgtgcccgcattgttccaaactctgccgtcaagttcttcagctatgaggaagcatccaagggaatcttatggttttaccggcagcaaactggaaacgaggatgctgaacttactcctcttctacgccttggtgctggagcatgtgcaggcatcattgccatgtcagcaacctacccaatggacttggtacgaggtcgaattactgtccagacagataaatctcctagccagtacagagggatatttcatgcacttagaacagtttttgttgaagaaggcccacgtgccctgtacaaaggatggctcccttctgtgataggtgtgattccttatgtaggtttaaactttgctgtatatgaatctttaaaagattggttggtcaaaactcgaccattcggactagctcaagacactgaattgagtgttatgacaaagcttggttgtggtgctgttgctggaaccattgggcaaacggttgcttaccctcttgatgtcattcgtcgaagaatgcagatgggcggctggaaaaatgctgcttcagttgttattggtgatgggaagagcaacgcacctatagagtatagtggtatgatagatgcgttcaggaaaacagttcgtcatgagggagttggagctttatataagggtttggtcccaaattcagtcaaggtggtcccttctatagcaattgcatttgtgacatatgaggtggtaaaagacattcttggtgtggaaatgaggatatctgattgaattgtttgaggaaactcaggttattttctgtacttagatgttaatttactcggagcagcgaggaagttatttattggtaagtgttatcttgttgacttggaaagggagagatcctgagcagcgttatgtattttattggagagatatattaacaataaagagtggttcagaagtagcagtaggtgcacttcacattataggaattaaaattactcatttggccagtatttttacagaaacgtttattgaatagaaatctgggtctgttgatgttcc

SEQ ID NO: 4658 - DNA, 1520 bp, Prunus persica
ctctccactcgcgttctcgtacgcaacgacacgccgtacatgcggccgcatactcgccgataaatcgccggaaaagctcccgagaaaatcaatcggcggcggatttgggccgggagtcctagggttccggcgagtggttgagattgtgtgtgtctttgtgtgtggggtttaatggcgtcggaagacgtgaagaggacgagcgagactgcggtatcgacgatcgtgaacctggcggaggaggcgaagctcgcgagcgaaggagtgaaggcgccgacgagccatgccttactgagcatcgccaagtctctcgtcgctggtggagtcgccggtggagtgtcacgaactgctgttgctccattggaaagattaaaaattttgctgcaggttcaaaatcctcatagcattaaatacagtgggacaattcagggcttgaagtatatatggagaactgagggtctcagaggcttgtttaagggcaatggaactaattgtgctcgcatagtcccaaattcagcagtcaaattctttagctatgaggaagcttctaagggtattctatggttctaccgacagcaaactggaaatgaagatgctcaactcacacctcttttacgccttggagctggtgcttgtgctggaattattgccatgtcagcaacttaccctatggacatggtacgaggtcgtctaactgtccagacagaaaggtctcctcggcagtataggggaatcgctcatgctctttcaaccgtttttcgggaagaaggcccccgggctctgtacagaggctggctaccttctgtcataggagttgtaccttatgttggtctcaattttgctgtttatgaatctctgaaagactggttgatcaaaactagaccttttggtttagtcgaggactctgagttgagtgtaacaacaaggcttgcatgtggggccgctgctggaactgttggccagacagttgcttatcctcttgatgtcatccggagaaggatgcagatggtaggctggaaggatgctgcgtcggttgtcgttggtgatgggaagagcaaggcacccctcgaatatactggaatggttgatgcattcaggaaaacagttcgtcatgaggggtttggagcactgtacaagggtttggtccctaattctgttaaggtggtgccgtccatagcaattgcgtttgtcacatacgaggtagtgaaggacgttcttggagttgagatgaggatatctgactaaaagcaaagagaaccttgagttgagtcacatgtttagcgtttgctcgtaatttcagaagtgaaacgattagtggactgctaggagaaggtaaaatgtcaggattttttaataagtagcaggaagtttagaaatagccctatcctatgttgatactccttcccatcccatcaatacacatatctgtcatcagccaaacgctatagttttagctatcctattattcttatgctcttggcattgtgacaataagtattttgtttcaaggaaacgatgcattt

SEQ ID NO: 4659 - DNA, 1564 bp, Solanum phureja
tgtatttgcccatttctcaaggaaagcaccaataaaatccagtgctccccttccctcctctttcgatcgccggcgaacactgacgagcaccgagactagtttttctctagggttccggcgagttggaggttttttgaatggcgtcggaggatgtggtaggtaagagaagcgaaagtgctgttactacaatcgtcaatctggctgaagaagctaaaatggcgagcgaaggtgttaaagctccgagtcatgctgctattttcagtgtatgcaagtctctcgctgctggtggaatcgctggtggagtgtcacgcactgcagttgctccattggaaaggcttaaaattctgctccaggttcagaattctcacagtataaaatacaatggcacagttcaggggttgaaatatatatggagaactgagggtctccggggaatgttcaaaggaaatggaactaattgtgcccgcattgttccaaactctgccgtcaagttcttcagctatgaggaagcatccaagggaatcttatggttttaccggcagcaaactggaaacgaggatgctgaacttactcctcttctacgccttggtgctggagcatgtgcaggcatcattgccatgtcagcaacctacccaatggacttggtacgaggtcgaattactgtccagacagataaatctcctagccagtacagagggatatttcatgcacttagaacagtttttgttgaagaaggcccacgtgccctgtacaaaggatggctcccttctgtgataggtgtgattccttatgtaggtttaaactttgctgtatatgaatctttaaaagattggttggtcaaaactcgaccattcggactagctcaagacactgaattgagtgttatgacaaagcttggttgtggtgctgttgctggaaccattgggcaaacggttgcttaccctcttgatgtcattcgtcgaagaatgcagatgggcggctggaaaaatgctgcttcagttgttattggtgatgggaagagcaacgcacctatagagtatagtggtatgatagatgcgttcaggaaaacagttcgtcatgagggagttggagctttatataagggtttggtcccaaattcagtcaaggtggtcccttctatagcaattgcatttgtgacatatgaggtggtaaaagacattcttggtgtggaaatgaggatatctgattgaattgtttgaggaaactcaggttattttctgtacttagatgttaatttactcggagcagcgaggaagttatttattggtaagtgttatcttgttgacttggaaagggagagatcctgagcagcgttatgtattttattggagagatatattaacaataaagagtggttcagaagtagcagtaggtgcacttcacattataggaattaaaattactcatttggccagtatttttacagaaacgtttattgaatagaaatctgggtctgttgatgttccatttgttttgtttggtacactttatcactgtttatttctgccatattttgtggcatattggctcttgctacatgctg

SEQ ID NO: 4660 - DNA, 2275 bp, Glycine max
gtagaagttggcatttgtgtgagctcactctctattctaagtttccgcagccaccactcagagccagcgagtgatgatcgcttcgccgcagtaatcgccggaaacgaattcgccgtttccctgccgagatctctcaatctccgacgactcagatacctctattaattttcctccggttaggttgttagggtataaatagtacgtagtttttccttatttatggcttcggagaatgtgaagaccggggattccgccgtcaccaccatcgtcaatctcgccgaggaggccaagctcgccagagaaggcgtcgtcaaagctcccagctacgccctcgccagcatctgcaagtcgctcgtcgccggtggcgtcgccggaggagtgtcacgtactgcagttgctcctctggaacgattgaaaattttgctgcaggtccagaatcctcataacattaaatacaatggaacagtacaaggcctaaaatatatatggaggactgaaggatttcgtggacttttcaaagggaatggtactaattgtgctagaattgtccctaattctgctgttaagttcttcagttatgagcaagcttctaaaggtatactgcatctgtatcagcagcaaactggaaatgaggatgctcagctgactcctcttttacgtcttggagctggagcatgtgctggaataattgctatgtctgcaacttatccaatggatatggttcgaggcaggattactgtgcagactgaggcatccccatatcagtacagaggaatgttccatgctttgtctactgtgcttagggaagaaggtcctcgtgctttatataagggctggcttccttcagttattggagttattccttatgtaggtctcaactttgctgtctatgagtctctaaaagattatttaattaaatccaacccatttggtctagttgaaaattctgagttgagtgtgacaacacgcctggcttgtggtgctgctgctggaactgttggacaaactgttgcttaccctcttgacgttatccgtcgaagaatgcagatggtcggttggaaccatgctgcttctgttctaactggcgatggaagaggcaaagttccactggaatacactggaatggtcgatgcattcagaaaaactgttcagcatgagggatttggtgcattatacaagggtctggtgcccaactctgtaaaggtggtcccatcaatagcaattgcattcgtaacatatgaggtggtgaaggacattttaggagttgagatcagaatatcggactaaagtttgataacctcagatatctgttcacctggtgtggtttttctttgttttcttttttgtaggcaaggggatgcagagatggtaacttacagatattttcttgtttttcatctctccaaggatgagtttagaaactcttagagatagtgtccataaatttattcccttgttctatttgttttccttgttctatttgtccataataagtgttgtggaaaaacaatgcaaggacatatcttcctagctttctgcactagttgagaaatcatttttcttagtggaatttgcatttaactgaaatttgctcgcctctacccccttcctatccatggattattatatggttttgaatgattaacgtttgctgctgtgacaatgttttttactcttcttttgggagtcaattagaaatagcagggttggacgaacactctatttctgttttgctagcccattgaaatgtagcgaacaccttttctgtccatttatgctcaactgaattttgtttcccaaactattcagcattccaagtcaaagctagaaccatcaagttgaaactatttagccatatattataatactttatttagggttacaaacactataattagtaactaggtaatagggacaagtagtcaatttctctctttcatttctagtctaatacttgtgcattgtttggttactttggtattttaattgcgtgatgaataacaactgaaatgcacgatggcagatgacaccgtgggcacaggagttaactttttggtgctggcgttgtccccatcctcttcactctgatgaaccacagcttctgatgctattgggataacttgatgtagaccaacttttcaaaacaaattttgtaggaacatcctttttcctctttatgttgatttgtaatcctccgtggtagaaagatattacatttttcttccgtggctgatcataatggatgagtacgcaacgcttaattagatgtcaataa

SEQ ID NO: 4661 - DNA, 1630 bp, Mesembryanthemum crystallinum
  misc_feature (535)..(535): n is a, c, g, or t
  misc_feature (560)..(560): n is a, c, g, or t
  misc_feature (571)..(571): n is a, c, g, or t
  misc_feature (587)..(587): n is a, c, g, or t
  misc_feature (1410)..(1410): n is a, c, g, or t
  misc_feature (1415)..(1415): n is a, c, g, or t
  misc_feature (1422)..(1422): n is a, c, g, or t
  misc_feature (1474)..(1474): n is a, c, g, or t
  misc_feature (1478)..(1478): n is a, c, g, or t
  misc_feature (1510)..(1510): n is a, c, g, or t
ccacttgaaaacacctctcactcactctctcccatgaaaagccgtatttcagctttcaaccaaactccagtcgtagagagagagaaaaagagagagttagggagtgggagcgccattttctctctcttccccttcaaatctccaatcactatcatcatcatccaccgatcaacaaccgaatcatcaagatctctgatctccgaaaagctagggttccgacgatctcgagttcttttagggttccggcgagttaggggtttttaattttggggattcagttaatggcatcggaggatgtgaagacgagtgaatcagcggtttcgacgatcgttaatctggctgaagaggcgaagattgctagggaaggcgttaaggctcccagttatgctattcttagcatctgcaagtctctcgttgccggcggtgttgccggtggagtgtctcgcactgctgttgctccgttggaacgcatgaagatattgctccaggtgcaaaattcacatagcattaaatacaatggaacaattcaaggctngaaatatatatggagcactgaaggngttagaggatngttcaagggtaatggnacaaactgtgcacgtattgtgccaaactcagcggttaaatttttcagctatgagcaagcctccaagggtatattatggctgtatcggcaacagacaggcaatgaggacgctgagctcactcctttattacgtcttggggctggggcatgtgctggcatcattgcgatgtctgctacttacccaatggacttggcacgaggcaggataactgtacagactgagaagtctgcttaccagtacagaggcatgttccatgcgctttcaacagtacttcgcgaggaaggtgcccgagctttgtacaaggggtggcttccctctgtcattggagttattccatatgtgggtctcaatttcgctgtgtatgagtcattgaaggattggttggtcaaagccaggccatttggattagttgaagatactgagttgagcgtaacaacaaggcttggatgtggtgctgtagcaggaaccattggccaaactgttgcttaccctctcgatgttattcgccgaagaatgcagatgggaggctggaaagatgcttcctctatagtaactggtggcaaggccccagtacagtacgagggcatgattgatgcattcagacaaacagtgagacatgatggctttggcgcattgtataaaggacttgtccctaattctgtgaaggtggtaccgtcaattgcaattgcatttgtgacgtacgaggtggtgaaagacgtcttgggagttgagatgagaatatcagactgaagctgatggaatcatgttaggcgagtgtgataacttttcttttttgtaggcaaatggaagaagataggtaaantttgnttcttgnattgtgtctacttagaataagctcagccagtatcaggtgctagcctgtctanttgntgctcttatatttcatatctagggttcctcangtactttctatgtggcttgtcaggtctcaggtcattcaaatgctttccaatgaataattgtaataaatattttcatgattcatttgcacatttttgatgtgccatttcagagcctgatgt

SEQ ID NO: 4662 - DNA, 1777 bp, Cannabis sativa
aacaagtccctatcgaaacgacacttggcaaagtataaaaggctcacccaacaaaatttaattttttatttattattttcgttgaaaccaataaaacggtgccgtatctccctacaaatgggagaacacattctccgataaattccccgaaaactccgccgatcgccggcggaatctgcccggtgagggttccggcgacgttattgacttgctgctgaaattaagtcacatcattgttatttatataggtttcggaagaaatggcgtcggaagatgcggtgactaaaacgacgagtgagtctgccgtcaccaccatcgttaacctagccgaagaggcaaagcacgctagcgaaggagtcaaggctcctagccatgcttttattagcgttggaaagtctctcatcgctggaggtgtcgctggtggagtgtcacgcactgctgttgctccattggaaagattaaaaattttgctccaggtacaaaatcctcacagtatcaaatacaatggaacagttcaggggttgaagtatatatggagaactgaaggactcagaggattgtttaaaggcaatggtactaattgtgctcgcattgttccaaactctgctgtaaaattctatagctacgagcaggcatctaagagcattctgtggttttaccggcagcaaactgggaatgaagaggctcaactgacacctcttttacggcttggagctggtgcctgtgctggaattatagccatgtcggcaacttacccaatggatatggtacgaggtcgactgactgtccagacagaaaaatcacctcaccagtacagaggaatcttccacgctctttcaacagttcttcgggaagaaggttttcgggcattatataggggctggctaccttctgtcataggagttgtaccatatgttggtctcaactttgctgtctatgaatccttaaaagattatctggtcaaaactaaaccatttggattagttaatgactctggggaactgagcgtgacaacgagactcgcttgtggggctgcagctggaaccgttggccagacaattgcttaccctctagatgttattcggcgaagaatgcagatggtgggttggaaagatgcatcttcaatcgtaactggtgatgggaaaggcaagccctcacttgaatacaccgggatggtcgatgcattcaggaaaacagttcggtatgaaggatttggagctctgtacaagggcttggtccccaattccgtgaaggtggtcccatctatagcaattgcatttgttacttatgaggtggttaaggacattcttggagttgaaatgaggatatctgactgatctaactatccatctattttgataatctctttctcatagggaaggtaatttggtctattcttttaccataaataataagtaatggtttggaaattatccactgtgagatgcatttgtgttgtggatggatgtaagagaattcttagttgaaaacactttgggggctatggtttataaatatgatttactttgtttctctatcgttatggtgtttttatttattttttattggagtccataaattttgaagttcagatgttgataatgattttccttgtgatgagcaatttgagtaacattgcatcaaccatgttgttaggcaatctacatttcagtttcgttttgaaaatttcaatgttgggtgaaaattttcaattgaactcattataactaaaatgaaatacaacattgtgtaaaaatgtgtaatttgattatgcttg

SEQ ID NO: 4663 - DNA, 1901 bp, Phaseolus coccineus
cggcgtagttctgacctcgttgctgcattgtagtagttgttggcattggtgtgagctcactcttctctcttttctcttcgaagctcccgcagccaccaccactcactctcagcgagcgagcgagtaatgatcgcttcgccgcaataatcaccggaacaatctgccgtatccctgccgagatttctcactccgacaattccgataccccgattttgttccggttaggttaggttatagaatagttttccatatatggcttcggagaatgtgaagactggggaatccgccgtcaccaccatcgttaacctggccgaggaagccaagctggcccgagaaggcgttgtcaaggctcctagctacgcgttcgccaccatctgcaagtcactcgtcgctggtggtgtcgccggaggagtgtcacgtactgcagttgctcctctggaacggttgaaaattttgctacaggtccaaaaccctcataacattaaatacaatggaacaatacaaggcctaaaatatatatggagaactgaaggtctccgtggacttttcaaagggaatggtactaattgtgctcgaattgtccctaattctgctgtgaagttcttcagttatgagcaagcttctaaaggtatactgtacatgtatcagcagcaaactggaaatgaggatgctcaactgactcctcttctacgtcttggagctggagcttgtgctggaataattgctatgtctgcaacttatccaatggacatggttcgaggccggattactgtgcagactgaggcatcaccgtatcagtacagaggaatgtttcatgctttgtctactgtgcttagggaagaaggtcctcgtgctttatataagggctggcttccttcagttattggagttattccttatgtaggtctcaactttgctgtgtatgagtctctaaaagattggttagtgaaatccaacgcatttggtcttgctgataattctgagttgagtgtgacaacacgcctggcttgtggtgctgctgctggaactgttggacaaactgttgcttaccctctcgacgttattcgtcgtagaatgcagatggttggttggaaccatgctgcttctgttctaactggtgatggaagaggcaaagtcccacttgaatacactggaatggttgatgcattcaggaaaactgttcagcatgaaggattcggtgcattatacaagggtcttgtgcccaactctgtaaaggtggtcccatcgatagcaattgcatttgtatcatacgagatggtgaaggacattttaggagttgagatcagaatatcagactaaagtttgataaccagatgagatatatctgtttcactggtgtggtttttctttgtatttttttggtaggcaagggatactgagatggtaacttaaagttattttctttattttcctctcttaaaggatgagtttagaaactcttagagttaggattcataaatttattcccttgttctatttgttttccttgttctatttgtccataataagtgttgtggaaaaacaatgcaaggacataacttcatagctttctgcactggttgagaaagcatttttcttagtggatttttgcattaactaaaattttcctgccctccctaccccctcccttctgtatatcgaatgattatgttacaatgttttctgctgcgtgctgagaaagtaggacttgttcaccgtctctctctctggtattactcttcttttgcgagtcggttagaaacatgagtgttggacgaccaacatcatattaaatattttttagccattgaagtgtaacgaacatcttatctccgattcattcttaactgaattgtgtttcccaaactattgagagttttaaaacgaagctggaacatcaa

SEQ ID NO: 4664 - DNA, 2381 bp, Gossypium raimondii
gacaaataataataataatttcaattaattaattgacgaaatttaaaaaattcatatttggagaaaaaaaacaacttataactgggtcaacaatttaaaaaaaatcaccttcggtgactgtacgctgttgtgtagtttacactgcatattatcctcttcaaaaagaaaatagaaaaacctttaccaaatccacgcgctcttaaagcaacgacattacacgcactcaaatagttcatctcaagctctcgaaccagccgccaccaccagtccaccacacctctctcaaaaacgaacacaaaaactagaaaaaaaaataggaaaaagagagaaatgtggaacctctttttactataaattgcttcggagatccgatcctttcgatcgccggattatcctcctcgataatccgtgatcccttcaatcctaccgggaaaaaagaaccttcttagggttttccgtcgagagagaaggacttcgaagagtttttcagtgtgtttttgtgttttttttctggttttcgatggcttcggaggatgtgaagactagcgaatcggcggtttcgacgatcgttaatttagccgaggaagcgaagcttgcgagagagggcgtcaaggcacctagctatgctattcttagcatctgcaagtctctcgttgccggcggcgtggccggtggactgtcacgaactgccgttgctcctttggaacgtttaaagattttacttcaggttcagaatccacatagtataaaatacaacggaacggttcaaggcttgaagtacatttggagaacggaaggttttcgtggattattcaagggcaatggtactaattgtgcacgcattgttccaaactctgcggtcaaattcttcagctatgagcaagcttcaaagggaatcctgtatctatatcaacagcaaactggcaatgaagatgctcaactcactcctcttctacgccttggagctggagcatgtgctggaataattgccatgtctgcaacttacccaatggacatggtacgaggcaggcttactgtacagacagacagctctccttttcagtacagaggaatgttccatgctctgtcaactgtgttgcggcaagaaggcccacgggcattgtacaagggttggcttccttcagtcattggagttataccatatgtgggtttgaattttgctgtgtacgagtctctaaaagattggttaataaaaaataaacaattcggatttgctgaggactctgagttgagtgtgacaaccaggcttgcttgtggggctgctgctggaactgttgggcaaactgttgcttaccctctcgatgtcatccgcagaagaatgcaaatggtaggatggaaagatgctgcatcagttgtcactggtgatgggaggaataaggctcctcttgagtatactggcatgatcgatgcattcaggaaaactgttaggcacgagggctttggagcattatacaagggtctggtccctaattctgtgaaggttgtaccttcaatagctattgcgttcgtgacatatgaggtggtgaaagacattttaggagttgaaatcagaatatcagactaaaccggtaccaattctactcaatgtttttagggatgtgtgctatttttgtaggtaaaggggatatagagtaagataaactagggaacaaccttttaacctttttcttttcgtctcatcacacaaaaatgagtttagaaacttatacgagcctgcccataatttgttcccatggtttcctatgttttccttgtgaactctgtagcttttcagctcccccattcatgttctgtatcaataaaagactgaactagcatcaatgcgagtctcgcattcgccttcccttctcgataaaactcgagaaggcaatttctaagccatctctgctagattaattgtgttatttctgtggcttagcaaacattttatctctcaataagtagattgattgggcttagtgtgaagtgaaaattcaactttataagttgattgcaatgggtaaaggtcgaggcatgttgtaatggcaataactctggcatacattatgttttttcttcaatcatcttcgggatgatgacatcgtagtgctctatattgttagatggttgttttggcaaactatttttaaatctatgaacaatgcgtatggtgttgtattgctgccatagactatgttactcggactcgtgttagatatttttatcttattgttccgtgtatgtagaaaatctttagaagattatatattctcaatacctcagtttggatgtatgttggatatgggtatttcaagaaaaaaaaaaaaacagagtcctccgaagcattatagagcaacaggtccaagtaacttatgaaaagt

SEQ ID NO: 4665 - DNA, 1624 bp, Citrullus lanatus
gacttcgcaacagcagcagccgcaacgcgccccttccctcccgactaacactgacgaaagagagaaatgcaaaaccttgctctccgataatcaccggaatcattattcggaggctgagatcaggcttccaattacggcgacttagggtttcggtgagcctcgacttcgctttctgcatcgtttatctcttttatggcttcggaggacgtcaaacgaagcgaatcggctgtttctacgatcgtaaacctggcagaggaggcgaagcttgcgagagaaggcgtcaaagcacccagttatgccgttcttagcatctgcaaatctctggttgctggtggagttgccggcggagtgtctcgaactgctgttgcccctttggagcgtttgaagatattattacaggtccagaatcctcatagcataaaatataatggaacgatacaaggcctgaaatatatttggagaactgagggctttcgaggactatttaagggcaatggtactaattgtgctcgtatagtaccaaattcagcagttaaattcttcagctacgagcaagcttctcggggaatactatacttttacagggagcaaactggtgaacaagatgctcaactcactcctcttctacgtcttggtgctggggcttgtgctggaataattgccatgtcagcaacttaccccatggacatggtgcgaggcagactaaccgtgcagacagataagtctccgtaccagtacagaggaatattccatgctctttcaacagtgctccgggaagaaggtccaagggctttgtacaagggttggcttccttctgtcattggagtcgttccttacgtgggtcttaactttgctgtgtatgaatcacttaaagattggttaattaaaaacaaaccattcggaattgttgaagattcagagctcagtgtaacaacacggctagcatgtggagctgctgctggaacagtaggtcaaactgttgcctatcctcttgatgtcattcgtagaagaatgcagatggtgggctggaataatgctgcttctgtagtcactggtgatggaagaagtaaggcagccctagagtacactggcatggttgatgcttttagaaaaacagttcgttatgaaggctttagagcattgtataagggtttggttcccaactcagtgaaggtcgtcccatcaatcgcaatcgcatttgtgacatacgaaatggtgaaggacgttttgggagtcgagattaggatctcagactgattattgggtactaacttacatttgttgaacggttgaacggtctgctatttttgtaggcaagggggggatggtaaactaggatgttttaattatcctctcctattactagtttaaggcagtattgagtgtgtttgtaatttgcttccctgattttaaatatctttctgcaaacttgtgctagcataagcttttattcttatgctatgtcaataaatgttttgacgatagaataagcacatttggatgcctccgttagatttgggagagcagagcttttattgaatctagtttttcagttttcgtgctattcctttcactctttgctcgtatgtgaatcgactttttaattgaaatgggtagatactga

SEQ ID NO: 4666 - DNA, 1553 bp, Amorphophallus konjac
ggggaagaggacgggggagtcggcggtgacgacgatcgtgaacctggcggaggaggcgaagctggcgagggagggggtcaaggcccccggccacgcgatctttagcgtttgcaagtctctcgtggccggcggtgtcgccgggggagtgtcacgaacagctgtagcaccattggagcggttgaaaattttgcttcaggttcaaaatccacacagtattaagtacaatggaacaatccaaggattgaagtgtatatggaaaactgaaggctttcgaggattatttaaagggaatggaaccaactgtgctcgtattgtcccaaattcagctgttaagttttttagttatgaacaagcagcaagtgggattttgttgctttatcggcagcagactggaaatgaagatgcacaacttacccccattctacgccttggtgcgggagcttgtgctggaattattgcaatgtctgctacgtatcccatggacatggttcgaggccggataactgtccagactgagaagtcgccctaccagtacagaggaatgttccatgcattaacaacagtctatcgacaagaaggatttagggcattgtacaaaggctggcttccttctgtaattggagtcattccgtacgtgggtcttaattttgcagtttatgaatctttgaaagactggcttatcaaatgtaatccgtatggacttgtcgaagataatgagctgagtgtgaccactaggcttgcatgtggagctgctgctggaacggtggggcaaactgttgcgtacccacttgacgtcatacgtagaagaatgcagatggttgggtggaaggatgctgcttcgattgtaacaggtcagggaaggagcaaagtaccacttgagtactctggaatgattgatgctttcaagaagaccatccgggatgaaggttttggagcactgtacaaaggcctggttcctaattcagtgaaggtggtgccgtctattgcaatcgcatttgtgacatatgaggttgtgaaagacgttcttggtgtagaagttagaatatcagattgagagacatggaaggggaagactatctggacgcgattttttgtagacaaatggatacgatgaggttaaaaagaaagggtctgctctcccaagccgtgtttatatgagcagttgttgattttactatgactgcgcatcttggtttccgatgattcgatcatgccaataaacgggcccctaagccagagctgtctcctgcgaccctcccaagccccaagaggctggtgattgaggtagaccatgcgagttatttcttgataacattctgtttgtatttactaccgtaagcaaggtgataattatttgtcaagagtagcttgttgatggaaaatgatattttattcgtatgttcttgagatccaagttcacatgggaattgtcggtggaaatgtgaattgcctctccaatttgaactcgtatgatgcgattcacatggttagtgtgcatgtaagagtggtatatgtagcaattatacatataagaaggctaattaactaaaagt

SEQ ID NO: 4667 - DNA, 2184 bp, Gossypium hirsutum
ggcacgagcttaaagcaacgacattccacgcactcaaatagttcatctcaagctctcgaaccagccgccacaaccagtccaccacacctctctcaaaaacgaacacaaaaactagaaaaaagaattggaaaaagagagaaatgtggaacctctttttactataaattgcttcggagatccgatcctttcgatcgccggattatcctcctcgataatccgtgatcccttcaatcctaccgggaaaaaagaaccttcttagggttttccgtcgagagagaaggacttcgaagagtttttcagtgtgtttttgtgttttttttctggttttcgatggcttcggaggatgtgaagactagcgaatcggcggtttcgacgatcgttaatttagccgaggaagcgaagcttgcgagagagggcgtcaaggcacctagctatgctattcttagcatctgcaagtctctcgttgccggcggcgtggccggtggactgtcacgaactgccgttgctcctttggaacgtttaaagattttacttcaggttcagaatccacatagtataaaatacaacggaacggttcaaggcttgaagtatatttggagaacggaaggttttcgtggattattcaagggcaatggtactaattgtgcacgcattgttccaaactctgcggtcaaattcttcagctatgagcaagcttcaaagggaatcctgtatctatatcaacagcaaactggcaatgaagatgctcaactcactcctcttctacgccttggagctggagcatgtgctggaataattgccatgtctgcaacttacccaatggacatggtacgaggcaggcttactgtacagacagacagctctccttttcagtacagaggaatgtttcatgctctgtcaactgtgttgcggcaagaaggcccacgggcattgtacaagggttggcttccttcagtcattggagttataccatatgtgggtttgaattttgctgtgtacgagtctctaaaagattggttaataaaaaataaacaattcggatttgctgaggactctgagttgagtgtgacaaccaggcttgcttgtggggctgctgctggaactgttgggcaaactgttgcttaccctctcgatgtcatccgcagaagaatgcaaatggtaggatggaaagatgctgcatcagttgtcactggtgatgggaggaataaggctcctcttgagtatactggcatgatcgatgcattcaggaaaactgttaggcacgagggctttggagcattatacaagggtctggtccctaattctgtgaaggttgtaccttcaatagctattgcgttcgtgacatatgaggtggtgaaagacattttaggagttgaaatcagaatatcagactaaaccggtaccaattctactcaatgtttttagggatgtgtgctatttttgtaggtaaaggggatatagagtaagataaactagggaacaaccttttaacctttttcttttcgtctcatcacacaaaaatgagtttagaaacttatacgagcctgcccataatttgttcccatggtttcctatgttttccttgtgaactctgtagctttgcagctcccccattcatgttctgtatcaataaaagactgaactagcatcaatgcgagtttcgcattcgccttcccttctcgataaaactcgagaaggcaatttctaagccatctctgctagattaattgtgttatttctgtggcttagcaaacattttatctctcaataagtagattgattgggcttagtgtgaagtgaaaattcaactttataagttgattgcaatgggtaaaggtcgaggcatgttgtaatggcaataactctggcatacattatgttttttcttcaatcatcttcgggatgatgacatcgtagtgctctatattgttagatggttgttttggcaaactatttttaaatctatgaacaatgcgtatggtgttgtattgctgccatagactatgttactcggactcgtgttagattatttttatttttattgttccgtgtatgtagagaatctttagaagattatatatctcaatacctcagtttggatgtatgttggatatgggtatttcaagaaaaaaaaacagtcctccgaagcattatagagcaacaggtccaagtaacttatgaaaa

SEQ ID NO: 4668 - DNA, 2027 bp, Gossypium hirsutum
ggcacgagcttaaagcaacgacattccacgcactcaaatagttcatctcaagctctcgaaccagccgccacaaccagtccaccacacctctctcaaaaacgaacacaaaaactagaaaaaagaattggaaaaagagagaaatgtggaacctctttttactataaattgcttcggagatccgatcctttcgatcgccggattatcctcctcgataatccgtgatcccttcaatcctaccgggaaaaaagaaccttcttagggttttccgtcgagagagaaggacttcgaagagtttttcagtgtgtttttgtgttttttttctggttttcgatggcttcggaggatgtgaagactagcgaatcggcggtttcgacgatcgttaatttagccgaggaagcgaagcttgcgagagagggcgtcaaggcacctagctatgctattcttagcatctgcaagtctctcgttgccggcggcgtggccggtggactgtcacgaactgccgttgctcctttggaacgtttaaagattttacttcaggttcagaatccacatagtataaaatacaacggaacggttcaaggcttgaagtatatttggagaacggaaggttttcgtggattattcaagggcaatggtactaattgtgcacgcattgttccaaactctgcggtcaaattcttcagctatgagcaagcttcaaagggaatcctgtatctatatcaacagcaaactggcaatgaagatgctcaactcactcctcttctacgccttggagctggagcatgtgctggaataattgccatgtctgcaacttacccaatggacatggtacgaggcaggcttactgtacagacagacagctctccttttcagtacagaggaatgtttcatgctctgtcaactgtgttgcggcaagaaggcccacgggcattgtacaagggttggcttccttcagtcattggagttataccatatgtgggtttgaattttgctgtgtacgagtctctaaaagattggttaataaaaaataaacaattcggatttgctgaggactctgagttgagtgtgacaaccaggcttgcttgtggggctgctgctggaactgttgggcaaactgttgcttaccctctcgatgtcatccgcagaagaatgcaaatggtaggatggaaagatgctgcatcagttgtcactggtgatgggaggaataaggctcctcttgagtatactggcatgatcgatgcattcaggaaaactgttaggcacgagggctttggagcattatacaagggtctggtccctaattctgtgaaggttgtaccttcaatagctattgcgttcgtgacatatgaggtggtgaaagacattttaggagttgaaatcagaatatcagactaaaccggtaccaattctactcaatgtttttagggatgtgtgctatttttgtaggtaaaggggatatagagtaagataaactagggaacaaccttttaacctttttcttttcgtctcatcacacaaaaatgagtttagaaacttatacgagcctgcccataatttgttcccatggtttcctatgttttccttgtgaactctgtagctttgcagctcccccattcatgttctgtatcaataaaagactgaactagcatcaatgcgagtttcgcattcgccttcccttctcgataaaactcgagaaggcaatttctaagccatctctgctagattaattgtgttatttctgtggcttagcaaacattttatctctcaataagtagattgattgggcttagtgtgaagtgaaaattcaactttataagttgattgcaatgggtaaaggtcgaggcatgttgtaatggcaataactctggcatacattatgttttttcttcaatcatcttcgggatgatgacatcgtagtgctctatattgttagatggttgttttggcaaactatttttaaatctatgaacaatgcgtatggtgttgtattgctgccatagactatgttactcggactcgtgttagat

SEQ ID NO: 4669 - DNA, 1590 bp, Populus trichocarpa
gcgaaccctgtctcctctctctctcaaaacagacgcctccatctctctctttgttagcatatgcaaaagcaaaccaaaccttccccaaattaatcaatcaatcaatcttaataatcacaccagtcaacgccggaattctgaccgctttcctagggttccggtgatggcttcagaggacgtgaaaacaagcgagtctgctgtttctacgattgtgaatttcgctgaagaggctaaactcgctcgtgaaggcgttaaagcaccgggacccgctcttcttagtatctgcaagtctcttgtagccgggggtgtagctggtggcgtgtcacgtacagctgttgctcctttagaaagactaaaaatacttctacaggttcaaaatcctcacagtataaaatacaatggaaccattcaaggtttgaaatacatatggagaactgagggcttaagagggatgtttaaaggcaatggaactaattgtgctcgaattgtcccaaattcagcagtcaagttcttcagttatgaggaagcatcaaagagaatattatggttttataggcagcaaactggaaatgatgatgctcagcttactcctcttctacgtcttggagctggtgcatgtgctggaattattgccatgtcagcaacttacccaatggacatggttcgtggtcggctaaccgtccagacagacaagtctcctcgtcagtatagaggaattgctcatgctctctcgacagtccttaaggaggaaggtcctcgggctttatacaaaggctggctgccttctgtaataggagttataccatatgtgggtctgaacttttctgtatatgaatctcttaaagactggttactcaaaactaatccatttggactagttgaggacaatgagttgggcgtgacaacaaggcttgcttgtggggctgctgcggggactgtcggccagacagtggcttatcctcttgatgttatccgacgaagaatgcagatggttggctggaaggatgctgcttcagttgtcactggtgatggaaggagcaaagcacctcgtgaatattctggtatggttgatgccttcaggaaaacagttcgccatgagggatttggagcattgtacaagggattggtccccaattcagtgaaggtggtcccttcgatagcaattgcatttgtgacatacgagatggtgaaggacgttcttggagttgagatgaggatatctgactgaagtaatgagaagaataaatcatcagagttttgttactttcattgcgagggaaacgaaagtactgttagagggtcagttttagccttttagggattatctacttcgagcgagcaagaaagtttagaagccaatctttagccagtgttgatatttctcccgtcttatacacaactgtctccatttaaacccatctttagtttctagatttcttattcttactcctatggcaataattatttgtcgaaatgatgcatatcgggtgcctttctactagattatttgaagccagttctatttgtgacaagcttgttcaattgatatccgcgagttctttggtgcttcatttcactatctggttttgt

SEQ ID NO: 4670 - DNA, 1476 bp, Allium cepa
tttcgctcagtgatccctattcttcttcgatcccgtgcctgacctaaattacatctagatataaaatttagacccttaaaactagaaatagttagattctaatggcatctgaagatgtagcggggaagagcactggcgaatcggcggtgaacaccatagttagtctggccgaagacgcaaaaatggtgagagaaggcgttaaggctcctggacatgcgctcttgtccatttgcaaatctctagttgcgggcggagttgctggcggagtgtcacgcactgcagttgcaccacttgagcgattgaagattttactccaggtacagaaccctcataacatccaatataatggaactattcaaggtctaaaatatatatggcgaactgagggtttgagaggactgttcaaaggcaatggtacgaactgtgcacgaattgtcccaaattcagctgtcaagtttttcagctacgagcaggcatcaagtgcaattctatggctttatcggcaacaatctggcaatgaggatgctcagctttccccagtattacgacttggagctggagcttgtgccggaattattgctatgtctgcaacttaccctatggacatggttcggggaagaatcactgtccagacggcaaattctccatatcagtatacaggaatgttcaatgcattaggcacagtatatcgtcaagaaggcttccgtgctctttacaaaggctggcttccgtctgttatttggagttgtaccatatgttggccttaattttgccgtctatgaatccttgaaggactggctaataaaatcaaggccgtttgggctagttgaagactcagaattgggtgttgtgactaggcttgcttgtggtgcagcagccggaacagttggtcaaacagttgcataccctcttgatgtcattcgcagaagaatgcaaatggttggatggaaggatgcttctactgtagttggtgggaaagggaaatctcttgaatattcagggatgatcgatgcttttaggaaaaccgtccgcaatgaaggttttggagccttgtacaaaggccttgttccaaattctgttaaggtagttccatcgattgcacttgcatttgtcacatacgagcaagtaaaagatatccttggagtggaaatgagaatttctgactaaagagccttgtgttatcattcgaagaataggagttttaaccgatatttttgcacgtggctgggtagagatttttctaaattatctacatttaaaaataagtttgacatatcgtttgccaagggagatgattttccctgttctatgttttaatttatagacaagtttagattgttttctttttagctattttggtttaagagcaaatgtttgcatctttcccattgtataatgatataataattttgccaaataagtaacattgcttatgtataaattctacacagcaagatttatagatgtgtatgtttt

SEQ ID NO: 4671 - DNA, 1685 bp, Catharanthus roseus
gctcgttccctaagaaaaggacttaccaatattctctcttccctctttcgctctagctctcgctgtccgctgcggctgcttctttgtccttcgatcgccggaggacataaacgacggttgcttagggttccggaaaggttacagttcgtctgctggttttatttaccagtatcgagatggcatcggaagatgtggtagggaagagaggagagagtgcagtgacgacgattgttaatttggcggaagaagcaaagattgctagcgaaggagttaaggctcctagtaagcttgctgttctcagcatctgcaaatctcttgctgctggtggaatcgccggtggagtgtctcgtacagcagttgccccgctagaacggttaaaaatcttgctacaggtccaaaatcctcataatataaaatacaatggcacagttcaaggcctaaaatacatatggagaacagagggttttcgaggattattcaaaggaaatggcactaattgcgctcgaatcgttccaaactcagctgtcaagttcttcagttatgaggaggcatccaagggtatcttatggctatataggagacaaactggaaatgttgatgctgaacttactccacttctgcgtcttggagcgggggcatgtgctggaataattgcaatgtccgcgacctacccaatggatatggtgcgaggtcggcttactgtccagacagataagtctcctacccagtacagaggaattttccatgctttgagaacagttttagctgaggaagggccccgtgcattatacagaggatggcttccttctgttataggagttgtaccttatgtgggtctgaacttcgctgtatatgaatcattgaaagattggttggtcaaaagtagaccttttggactagataaagactctgagttgagtgtaacaacaaaacttgcatgtggggccgctgctggaactgttggccagactgtggcttatccccttgatgttatccgccggagaatgcagatggtgggctggaaagatgctgcttcagtagtcacaggagatgggaagagcaaggcaccccttgaatatactggtatggtagatgcattcagaaaaacagtccgccatgagggctttggagctctatacaagggtttggtcccgaattcagtgaaggtggttccatctatagcaattgcattcgtgacatatgaagttgtgaaagatattcttggagttgagatgagaatatctgattgaaaataccccgaggatttatcaaatgttgaataatcatactaactttccgagagttcgaagcattagagaaggtaatctttcaatggggatggtagcgtatcccattttctccttttctttttctttttccctccttcgcttcccagctagaatccttcttccgtataagaattagggacgtcctaggatatgttgatatagttccagcttatacacaaatctttttgcattccttgtagcttattttgtgtgctccagcatttaccaataaagatttgtctagataggagaatagatgtatttgtgcatactccaataatttaacttttcctttcgagttaatttatgtgactgcttacgacattagattatgtgtctattcatttatatttgctattgttttgtggaatgaaataatatagttttcaaaaaaaa

SEQ ID NO: 4672 - DNA, 1590 bp, Trifolium pratense
  misc_feature (304)..(304): n is a, c, g, or t
gcagccaccaccatcaccaccaaatgatcgcttaacctcgccgtattaattcaccggaaaatctaagatctctcaatctccgacaacctagattaattaattactctttttctttcgattttttcagttccggttaggttagggtttattaattttatcataaattattatattattgattattgattatggcttcggaagatgtgaaaactggtgaatcagctgtaacgaagatcgtgaatttggcggaagaagctaagctcgctagagaaggtgttgttaaagctcctaattatgcaatcgntagcatctgcaagtctctcgttgctggtggagtcgccggaggagtatcacgaacagcggttgctccgctggaacgaatgaaaattttgctgcaggtccagaatcctcataacataaaatacaatggaacaatacaaggcctaaaatatatttggagaactgaagggttccgtggactgtttaagggaaatggtactaattgtgctcgaattgtcccaaattctgcagtgaagttcttcagttatgagcaagcttctaaaggcatacttcatctgtatcagcagcaaactggaaatgaggatgctcaactgactcctgtgttacgtcttggagctggagcatgtgctggcataattgctatgtctgcaacttatcctatggatatggtccgaggcaggataactgtacagactgagaaatccccttatcagtacagaggaatgttccatgctttgactactgtgcttaaggaagaaggtccacgtgctttatataagggctggcttccttcagtaattggagttgttccttatgtgggtctcaactttgctgtctatgagtctctaaaagattggttgattaaatccagaccatttggtctagtccaggattctgagttgagtgtgacaacacgcctggcttgtggtgctgctgctggaaccattggacaaactgtcgcttacccacttgatgtcattcgtcgaagaatgcagatgaccggttggagccatgctgcttctgttataactggagatggaagaggcaaagtcccacttgaatatactggaatgattgatgcatttaggaaaactgttcgtcacgagggatttggtgcattatacaagggtctggttcccaattctgtaaaggtggtcccatccatagcacttgcgtttgtatcatacgagatggtgaaggacattttaggagtggagatcagaatatcagactaaagttcgatagccccatattatctgtttacgttttgtcctttttttttttgataggcaagggaatgtagagatggcaaaacataaaattattttcttgtttttcatctcactgaggataagtttagaactctagagttagtgtccataaatttattcccttgttccttcctatttgttttctttgcaaacgtgctgtagttttcagcttcttattcatctgccatgtcaataagtgttgtggaaaaacaatgcagagacatatctgcctagctttctgaagaaagcatttttttagtggaaataatatgtttggaatgaatgtttttaagtattt

SEQ ID NO: 4673 - DNA, 1531 bp, Solanum lycopersicum
aattcaccacataataatacaaattccattatttttttttttttgtatttgcccatttctcaaggaaagcaccaataaaatccactgcttcccttccctcctcttctctctcgatcgccggcgcacactgacgagtactgagactagcgtttctctagggttccggcgagttataggatggcgtcggaggatgtggtaggtaagagaagcgaaagtgctgttactacaatcgtcaatctggctgaagaagctaaaatggcgagcgaaggtgttaaagctccgagtcatgctgctattttcagtgtatgcaagtctctcgctgctggtggaatcgccggtggagtgtcacgcactgcagttgctccattggaaaggcttaaaattctgctccaggttcagaattctcacagtataaaatacaatggaacagttcaggggttgaaatatatatggagaactgagggtctccggggcatgttcaaaggaaatggtactaattgtgcccgcattgttccaaactctgccgtcaagttcttcagctatgaggaagcatccaagggaatcttatggttttaccggcagcaaactggaaatgaggatgctgaacttactcctcttctacgccttggtgctggagcatgtgctggcatcattgcaatgtcagcaacttacccaatggacttggtacgaggccgaattactgtccagacagataaatctcctagtcagtacagagggatatttcatgctcttagaacagtttttgttgaagaaggcccgcgtgccctgtacaaaggatggctcccttctgtaataggtgttattccttatgtaggtttaaactttgctgtatatgaatctttaaaagattggttggtcaaaactcgaccatttggactagctcaagacactgaattgagtgttatgaccaagcttggttgcggtgctgttgctggaaccattggacaaacagttgcttaccctcttgatgtcattcgtcgaagaatgcagatgggtggctggaaaaatgctgcttcagttgttattggtgatgggaagaccaacgcacctgtagagtatagtggtatggtagatgcattcaggaaaacagttcgtcatgagggagttggagctttatataagggtttggtcccaaattcagtcaaggtggtcccgtctatagcaattgcatttgtttcatatgaggttgtaaaagacattcttggtgtggaaatgaggatatctgattgaattgttcgagtaaactcaggttattttctgtacttagatgttaatttactcggagaagcgagtaaagttatttattggtaagtgttatcttgttgacttggaaaaggagagatcctgagcagtgatatgtattttattggagagatatattaacaataaagagtggtccagaagtagcagtaggtgcacttcacattataggaatcaaaatttactcatttggccagtatttttacagaaacgtttatttgaatagaattctgggtctgttgatgttcca

SEQ ID NO: 4674 - DNA, 1516 bp, Phaseolus coccineus
agcgagcgagcgagtaatgatcgcttcgccgcaataatcaccggaacaatctgccgtatccctgccgagatttctcactccgacaattccgataccccgattttgttccggttaggttaggttatagaatagttttccatatatggcttcggagaatgtgaagactggggaatccgccgtcaccaccatcgttaacctggccgaggaagccaagctggcccgagaaggcgttgtcaaggctcctagctacgcgttcgccaccatctgcaagtcactcgtcgctggtggtgtcgccggaggagtgtcacgtactgcagttgctcctctggaacggttgaaaattttgctacaggtccaaaaccctcataacattaaatacaatggaacaaatacaaggcctaaaatatatatggagaactgaaggtctccgtggacttttcaaagggaatggtactaattgtgctcgaattgtccctaattctgctgtgaagttcttcagttatgagcaagcttctaaaggtatactgtacatgtatcagcagcaaactggaaatgaggatgctcaactgactcctcttctacgtcttggagctggagcttgtgctggaataattgctatgtctgcaacttatccaatggacatggttcgaggccggattactgtgcagactgaggcatcaccatatcagtacagaggaatgtttcatgctttgtctactgtgcttagggaagaaggtcctcgtgctttatataagggctggcttccttcagttattggagttattccttatgtaggtctcaactttgctgtgtatgagtctctaaaagattggttagtgaaatccaacgcatttggtcttgctgataattctgagttgagtgtgacaacacgcctggcttgtggtgctgctgctggaactgttggacaaactgttgcttaccctctcgacgttattcgtcgtagaatgcagatggttggttggaaccatgctgcttctgttctaactggtgatggaagaggcaaagtcccacttgaatacactggaatggttgatgcattcaggaaaactgttcagcatgaaggattcggtgcattatacaagggtcttgtgcccaactctgtaaaggtggtcccatcgatagcaattgcatttgtatcatacgagatggtgaaggacattttaggagttgagatcagaatatcagactaaagtttgataaccacatgagatatatctgtttcactggtgtggtttttctttgtatttttttggtaggcaagggatactgagatggtaacttaaagttattttctttattttcctctcttaaaggatgagtttagaaactcttagagttaggattcataaatttattcccttgttctatttgttttccttgttctatttgtccataataagtgttgtggaaaaacaatgcaaggacataacttcatagctttctgcactggttgagaaagcatttttcttagtggatttttgcattaactaaaaaa

SEQ ID NO: 4675 - DNA, 1882 bp, Gossypium raimondii
ccaaaagggttcctccttttcctcgcacaggaaaaactttacaggatccacgagctcaaaatagttgacgtgtcactctctcatgctcccaaaagccagccgtcactactacacctctttcaacaaacctctctttaacattttccaacgcaaaaaactagaaaagaagcgccgcatgagagaaatgcggagcctcttttgactataatatatatcgcctcggagatcggacccttgagtcgccggataatcatcgacgactgtccgagactccgccggagccaccggaaaagtacttcttaccgtttctacggcgagagagtggatttgaatatattggccgtgttttggttttcgatggcttcggaggatgtgaagactagtgaatcagctgtttcgacgatcgtgaatctagctgaagaagcgaagctcgctagagaaggcgttaaagctcccagttatgctgttcttagtatctgcaagtctctcgttgccggcggcgttgctggtggagtgtcacgaactgccgttgctcctttggaacgtttaaaaatcttacttcaggttcagaatccacatagtataaaatacaatggaacaattcaaggcttgaagtacatttggagaacagaaggttttcgcggattattcaaaggcaacggtactaattgcgctcgcattgttccaaattctgccgtcaagttcttcagctatgagcaagcgtcaaagggaatcctatatttgtatcgacagcaaactggtgatgatgatgctcagctcactcctcttttacgccttggagctggagcatgtgctggaataattgccatgtctgcaacttatccaatggacatggtacgaggcaggcttactgtacagacagacagctctccttttcagtataggggaatgttccatgctctgtcaactgtgttgcgtgaagaaggcccacgagcattgtacaagggttggcttccttcagtcatcggagttataccatatgtgggcctgaactttgccgtgtacgaatctctaaaagattggttaatcaaaagtaaagcattcggattggttgaagactctgagttgagcgtgacgaccaggcttgcttgcggggctgctgctggaactgttggccaaaccgtagcttaccctcttgacgtgattcgaagaagaatgcaaatggtaggatggaaagaggcagcctctgttgtcactggtgatgggaggaacaaggcctctctcgagtataccggcatgatcgatgcattcaggaaaactgttaggcatgagggctttggagcattatacaagggtctggtccccaattctgttaaggttgtaccatcaatagcactcgcgtttgtgacatatgaagtggtgaaggacattttaggggttgagattagaatatcagactgaaatcgggccccattcaggttgaaatgtttatgaggtgtgttgctattctttttttgtaggcaatggaacagatagaaaggtgaactagggactgttttcttagtactcttatttggtttctcataaatgagttttagaaacttgtacacagagagctgcaccgactcggaccgagaccgagtctcggctcatgacactgcctgcctgtatgatgtcttataatggcttcaaatgtttcctatgtgaacactgtactcattcacgtgttgcgccaataaggatgaaggaacaatgcgaataaccatttgtttgtaattatcgagccgagcttaggctgaattcgagcactgcaatattcaaatgtcttgcgagtttaatcgagttttttttttactttaatatatatttttattattatgaattaacatcttttcttattatataaaaggttaattacgaa

SEQ ID NO: 4676 - DNA, 1989 bp, Gossypium raimondii
ctttaacacggttaacccgtttctatttaacccaaacgcacccattagtcttgcacgaatctcacctaacaaaaagcactatgtatgagctgcctccacgtgacacaccaaatgcctttctccttccgcataataaaacttcaccaaacccacgcgctgttaatgcaacattcccacacgctctctaatagttgaggtctcacttcctccagccgtcaccaccacacctctctcacaaactaaccaacacaaacactaggatacaagggcaactgtggaatgcggagcctctttttactgtaaatcgcttcacagatctgattctcttgaccgccggataatccttctcgactttccgatatacttcgtcgggtttttgtggcgagagacggactttcaaagttttcttcccccgtttttgtttttccatggcttcagaggatgtgaagactagcgaatcggcggtgtccacgatcgtgaatctggccgaggaagcaaagctcgcgagagagggtgttaaggcccctagctatgctattcttagcatctgcaagtctctcgctgctggcggcgtcgccggtggagtgtcacgaactgctgttgctcctttggaacgtttaaaaatcttacttcaggttcaaaatccacatagtattaaatacaatggaacaattcaaggcttgaagtacatttggagaacagaaggttttcgcggattattcaaaggcaatggtactaattgtgcgcgcattgttccaaactcggcggtcaagttcttcagctacgagcaagcttcaaagggaatcctatatctgtatcaacagcaaactggcaatgaagatgctcaactcactcctcttttacgccttggagctggagcatgtgctggaataattgccatgtctgcaacttaccctatggacatggtacgaggcaggatcaccgtacagacagagagttctccttatcagtatagaggaatgttccatgctctatccactgtgttgcgggaagaaggtccacgagcattgtataagggttggcttccttcagtcattggagttataccatacgtgggtctgaacttttctgtgtatgaatctctaaaagattggttaatcaaaagtagaccatttggattggttgaagactctgagttgagtgtgacgaccaggcttgcttgtggtgctgctgctggaactgtaggccaaactgttgcttaccctcttgatgtgattcgcagaagaatgcaaatggtaggatggaaagatgcagcgtcagttgtatctggtgatgggaggaacaaggcctctcttgaatatactggcatgattgatgctttcaggaaaactgttaggcatgaaggctttggagcattgtacaagggtctggtccctaattccgtgaaggttgtaccatcaatagctattgcatttgtgtcatacgaggtggtgaaggacattttaggagttgagattagaatatcagactgaaatggtgccaactcaacttaatgtttatgaggtgtgtggtatttttgtaggcaaggggatagagagaaaggtaaagtagggatgatcttcttaacctttttgtctgggaaacgggcttagaaactcacacaagcctgtccatagttccttcccatgttatcctaggtaacgctgtagctttaaactcattcatgttctgtgtcaataaagatgaaggaacggtccaaataacatgatttgtgtacttctgcataaaagtcgagaagcaatttctaagccttctctgcagtattgattgtgttgtttctgtggtgtagtagaacattttgatctcaataagttgtttgattgagctttagcatgaaatgaaattcagctttactagttaaagaaagggtcacgttagttgatagatttcctactacgttatggatcagcatgcatctggttgttcatctgccgctccaattcaacttgtttgcatttgatgtttggg

SEQ ID NO: 4677 - DNA, 2187 bp, Theobroma cacao
aaaaaaataaataaaaaaaacgaaagaccaaacagataaaaacagtaacaacaggaaccttactgaacccaaacacggccatttaccttgcatgaatcctacctaacaaaacccttctcacacctccacgtgaccgccgaaggcccttttttccagccacaagaactttttcaaccccacgcgctctcagagcaacggcgcgcacgctctcaaagagttgaggtctcactttcccaagcacccaaggcagccgtcaccaccacagctttctttaaaccaacgacacaaaaactagacaaaagagaagaaagaaatgcggagcctttttttgctttaaatcgcttcggagatccgagccgatcgaccgccgggtaatccttcgcgatagtccgagatcccctgaagctaccagaaaacactagttagggttttgcggcgagagaggacttaaaaggatttttgagtgtgtttttggttttcgatggcttcggaggatgtgaagactagcgaatccgcggtttcgacgatcgtgaatctagccgaggaagcgaagctcgcgagagagggcgttaaggcccctagctatgctgttcttagcatctgcaagtctctcgtcgccggcggcgtcgccggtggagtgtcacgaactgccgttgctcccttggaacgtttaaaaatattacttcaggtccagaatccacatagtataaaatacaacggaacaattcaaggtttgaagtacatttggagaacggaaggctttcgcggacttttcaaaggcaatggtactaattgtgcgcgcattgttccaaactctgcggtcaagttcttcagctatgagcaagcttcaaagggaatactgtatctgtatcaacagcaaactggcaatgaagatgctcaactcactccccttttacgccttggagctggagcatgtgctggaataattgccatgtctgcaacttacccaatggacatggtacgaggcaggctcactgtacagacagagaggtctccttatcagtatagaggaatgatccatgctctgtcaactgtgttgcgggaagaaggcccacgggcattgtacaagggttggcttccttcagtcattggagttataccatatgtgggtctgaactttgctgtgtatgaatctctaaaagattggttaatcaaaagtaaaccatttggattggttgaagactctgagttgagtgtgacaacaaggcttgcttgtggggctgctgctggaactgttggccaaactgttgcttaccctcttgatgtgattcgccgaagaatgcaaatggtcggatggaaagatgctgcctctgttgtcactggtgatggtaggaacaagggccctcttgagtatactggcatgattgatgcattcaggaaaactgttcgacatgagggctttggagcattatacaagggtctggtccctaattttgtcaaggttgtaccatcaatagctattgcatttgtgacatacgaggtggtgaaggacattttaggagttgagattagaatatcggactgaaatgggggccaattcaacttggtagttattggatgtgtgctatttttgtagggcaaggggatatagagaaggtaaattaggatggtctttttaacctttttgtctcacaaaatttgagttgagacacatgtacgagcctgtccataatttcttcccatggtttcctatgtttccttgtgaacgctgtagctttcagctcctcctcattcatgtgctgtgtcaataaggatgaaggaacaatgcaagaaaacacatttgcctgcctctgcataaaagctgagaaagcaatttctaagccttctctgcaatattgattgtgttctttctgccgcgttgtagacattttgctcaataagtagattggtgagctttaatatgaagtgaaatttttaactttacaagttagatgcagtcagttaaggtcaagtattgttgctagggtaaatatccggtgatggattttgatttcgtactatttcaaggacaacaattcagcatgcatgccgtttattcatcagtatgtgcaacttgggatgaaccgtcaagcactataccgcaggccttaatttctatatgtgattgttgctctatgttgtgaatgcatccatgcataatcattatggtgtcgtagctcgtaatgt

SEQ ID NO: 4678 - DNA, 1235 bp, Manihot esculenta
gagagccgccacccgccaccaccgctgccacttgtttttggttgttgctgacagtaatgcagagacttgttctcccataaaagctcttgataaggccttacctgatcgatcgacggagaaaccgagatctcctttctagttttcttccccacttactattttgctgatccatggcatcggaggatgtgaagacgaccgaatcggctgttacgactatcgttaatctagcggaggaggcaaagttggctagagggggagttaaggccccgagctatgctgttcttagtatttgcaagtctctcgttgccggaggtgtcgctggtggagtgtcacgaacggctgttgctccattggaaaggttgaagatattactgcaggttcaaaatccccacaatataaaatacaatggaacaattcaagggttaaaatatatttggagaactgagggttttcggggactgtttaaaggaaatggtactaactgtgctcgaattgtcccaaactcagcagtgaagttctttagctatgaggaagcttccaagggaatattgtggctgtatcgacagcaacctggcaatgaagatgcacggctcactcctcttctacgccttggagctggagcatgtgcaggaataattgccatgtctgcaacttatcccatggatatggtgcgaggcaggctaactgtacagactgagaaatcaccttatcaatatagaggaatgttccatgctttatcaactgtgcttcgggaagaaggtccgcgggctttgtacaagggttggcttccttctgtcattggagttatcccatatgtgggtctcaactttgctgtatatgagtcgctaaaggattggttaattaaagctaaaccatttggactagttcaagattccgacttgagtgtaaccacaaggcttgcttgtggggctgctgctggaactgttggccaaactgtcgcttatcctcttgatgttattcgccggcgaatgcagatggttggatggaaagatgctgcttctattgtcactggtgatgggaggagcaaggcctcccttgagtataatggcatggttgatgcattccggaaaactgttcggtatgagggctttggagcattgtacaagggtttggtacccaattctgtaaaggttgtcccatccatagcaattgcgttcgtgacatatgaggtggtgaaggacattttaggagttgagattagaatatcagactga

SEQ ID NO: 4679 - DNA, 1680 bp, Ricinus communis
ccatttccttctgttattttcctaatttaatatctcccagacgcagtacaagcgtaatgataattaaagtaacccgcgggttatataagccattaaaccctcgattaacaattaaaacctcatttccttggactgccctttctctcttgcaaatgcgaactcttctcttcactgaataacaagagccgccgtaataattataatacaaacgccggaggtttattcctagagttccggcgatggcatcggaggatgtgaagacaagaagcgaggctgcagtttcgaagatcgtcaatctggcggaagaagcgaagttagcgagagaagagattaaagcgccaagccacgctctttttagtatctgcaagtccttaatcgccggtggtgttgccggtggagtgtcacgtactgctgttgctcccttagaaagattaaaaattctgctccaggttcaaaatccgcatagtataaagtacaatggtactattcaaggcttgaaatatatatggagaactgagggtttcagaggattatttaaaggcaatggcactaattgtgctcgcatagttccaaattcagcagtcaagttctttagttatgaggaagcttccaagggtatattatggatgtacaggcagcaaactggaaatgatgatgctcagcttactccacttttacgtcttggagctggtgcatgtgctggaattattgccatgtcagcgacttacccaatggatatggtccggggtcggctaactgtccagacggaagcgtctcctcgccagtacaaaggaatttttcatgctctttcaacagtcctcaaggaagaaggtccccgggctttatacagaggctggctgccttctgttataggagtagttccatatgtgggtctaaactttgcagtgtatgaatctctaaaagactggttactcaaaagcaaaccttttggattagttcaagacaatgagttgggtgtggcaacaaggcttgcatgtggagctgctgctggaactgtcggccagacagttgcttaccctcttgatgttattcggagaagaatgcaaatggttggctggaaggatgctgcttcagttatcactggcgatgggaagactaaagcaccacttgaatatactggcatggttgatgccttcaggaaaacagttcggcacgagggatttggagcattgtacaaggggttggttcccaattcagtgaaggtggttccatctatagcaattgcatttgtgacatatgagttggtgaaggatgttcttggagttgaggtgaggatatctgactgaagcaggaagaattctaaaagattaaacttccgtgcttcatttgcaagaggagaaaggagcgttgggtgaaggtcagcaaattggaatatctcaactccagctagcaaggaaatttagaagcccgacttttaacctatgttaatatattcctctatcccatcttattctcatttctatatgtaaacccatcttagtttttagatgtcttattcatatatgtcatgccaataagtatttgtgaggaaatgatgcaccccgtgcattccattagcttcttagagagttttaaagttactctttttacctagttctatctgtgatcattacgagtttatttaatagaatttgacatttttctaggtatttactgttg

SEQ ID NO: 4680 - DNA, 1594 bp, Cleome gynandra
actgatctcaagcgtgattagtcggcgagactttataactgctaccgcgacgggagattgcgttcgagtaatgcgctgatctcttcttgagataatttgaccggagattccaaacctccgacgaattcttagggctcgtacggtgttactgcatcctcggtgattgtttttttctctcttttgttgaagtaatttattgcgttcgtggtggttcattgatggcgtcagaggatgtgaagacgagcgaatcggcagcggtttctacgatcgtcaatctggcggaagaggcaaagttggcgagggagggagtcaaggctccgggctacgcatttctcagtgtctgcaagtctctcgtcgccggtggcgtcgctggtggagtgtcgcgcactgcagttgcacccctggagaggttaaagattctcttacaggtccaaaatccccatagcattaaatataatggaacaattcaaggattgaagtatatttggagaactgagggctttcgtggactgttcaaaggaaatggtactaactgtgctcgtatagttccaaactcagccgtcaagttcttcagctatgaacaagcttctaagggaatcctgtacatgtaccggaagcagaccggagatgagaacgcacaactcactccagttttacgccttggagctggtgcaactgctggaataatagctatgtcttcagtatatccaatggatatggtacggggaaggctaactgtccagactgcgaactcgccttaccaatatagaggaatgttccatgctttgtcaactgttctgcgagaggaaggtcctcgtgcattgtatcgtggttggcttccatcagtgatcggagtggttccatatgtgggcttgaactttgcagtgtatgaatctctaaaggactggctagtaaaagctaatccatatggactggtacaagattctgaattgagcgtgacaacaaggcttgcatgtggtgctgttgctggaacagttggccaaacaattgcttatcctcttgatgttattcgtagaagaatgcagatggttgggtggaaggatgcttcctcgattgttactggtgatggaagaagcaaggcttctcttgaatacaatggcatgattgatgcattcagaaaaaccgttcgtcatgagggctttggagcattgtacaagggattggttcccaattcagtcaaggttgtaccatcgattgcacttgcatttgtgacatatgaggtggtgaaggacctgttgggagttgagtttaggatatcagactgaagtttggtttttcacccgtatttcttcaacatgagttctattttggtaggcctctggggaagaagagaagataaaaattaggcaaattcatccccctctgcgccgttaaaggacaagctaggccaaattattaaatcttgttgtttatgtattgggtttattttgccagttctcggttctgttttcccttgttatcatattgtagcttctagctgctgaattaataagtattggcttgcactatatgaacctatttgttaggattttagggaaaaaaaagcttcttgtttgaaggattaatatttgac

SEQ ID NO: 4681 - DNA, 1584 bp, Gossypium hirsutum
aaagaagcgccgcatgagagaaatgcggagcctcttttgactataatatatatcgcctcggagatcggacccttgagtcgccggataatcatcgacgactgtccgagactccgccggagccaccggaaaagtacttcttaccgtttctacggcgagagagtggatttgaatatattggccgtgttttggttttcgatggcttcggaggatgtgaagactagtgaatcagctgtttcgacgatcgtgaatctagctgaagaagcgaagctcgctagagaaggcgttaaagctcccagttatgctgttcttagtatctgcaagtctctcgttgccggcggcgttgctggtggagtgtcacgaactgccgttgctcctttggaacgtttaaaaatcttacttcaggttcagaatccacatagtataaaatacaatggaacaattcaaggcttgaagtacatttggagaacagaaggttttcgcggattattcaaaggcaacggtactaattgcgctcgcattgttccaaattctgccgtcaagttcttcagctatgagcaagcgtcaaagggaatcctatatttgtatcgacagcaaactggtgataatgatgctcagctcactcctcttttacgccttggagctggagcatgtgctggaataattgccatgtctgcaacttatccaatggacatggtacgaggcaggcttactgtacagacagacaactctccttttcagtataggggaatgttccatgctctgtcaactgtgttgcgtgaagaaggcccacgagcattgtacaagggttggcttccttcagtcatcggagttataccatatgtgggcctgaactttgccgtgtacgaatctctaaaagattggttaatcaaaagtaaagcattcggattggttgaagactctgagttgagcgtgacgaccaggcttgcttgcggggctgctgctggaactgttggccaaaccgtagcttaccctcttgacgtgattcgaagaagaatgcaaatggtaggatggaaagaggcagcctctgttgtcactggtgatgggaggaacaaggcctctctcgagtataccggcatgatcgatgcattcaggaaaactgttaggcatgagggctttggagcattatacaagggtctggtccccaattctgttaaggttgtaccatcaatagcactcgcgtttgtgacatatgaagtggtgaaggacattttaggggttgagattagaatatcagactgaaatcgggccccattcaggttgaaatgtttatgaggtgtgttgctattctttttttgtaggcaatggaacagatagaaaggtgaactagggactgttttcttagtactcttatttggtttctcataaatgagttttagaaacttgtacacagagagctgcaccgactcggacctagaccgagtctcggctcatgacactgcctgcctgtatgatgtcttataatggcttcaaatgtttcctatgtgaacactgtactcattcacgtgttgcgccaataaggatgaaggaacaatgcgaataaccatttgtttgtaattatcgagc

SEQ ID NO: 4682 - DNA, 1661 bp, Gossypium hirsutum
aaagaagcgccgcatgagagaaatgcggagcctcttttgactataatatatatcgcctcggagatcggacccttgagtcgccggataatcatcgacgactgtccgagactccgccggagccaccggaaaagtacttcttaccgtttctacggcgagagagtggatttgaatatattggccgtgttttggttttcgatggcttcggaggatgtgaagactagtgaatcagctgtttcgacgatcgtgaatctagctgaagaagcgaagctcgctagagaaggcgttaaagctcccagttatgctgttcttagtatctgcaagtctctcgttgccggcggcgttgctggtggagtgtcacgaactgccgttgctcctttggaacgtttaaaaatcttacttcaggttcagaatccacatagtataaaatacaatggaacaattcaaggcttgaagtacatttggagaacagaaggttttcgcggattattcaaaggcaacggtactaattgcgctcgcattgttccaaattctgccgtcaagttcttcagctatgagcaagcgtcaaagggaatcctatatttgtatcgacagcaaactggtgataatgatgctcagctcactcctcttttacgccttggagctggagcatgtgctggaataattgccatgtctgcaacttatccaatggacatggtacgaggcaggcttactgtacagacagacaactctccttttcagtataggggaatgttccatgctctgtcaactgtgttgcgtgaagaaggcccacgagcattgtacaagggttggcttccttcagtcatcggagttataccatatgtgggcctgaactttgccgtgtacgaatctctaaaagattggttaatcaaaagtaaagcattcggattggttgaagactctgagttgagcgtgacgaccaggcttgcttgcggggctgctgctggaactgttggccaaaccgtagcttaccctcttgacgtgattcgaagaagaatgcaaatggtaggatggaaagaggcagcctctgttgtcactggtgatgggaggaacaaggcctctctcgagtataccggcatgatcgatgcattcaggaaaactgttaggcatgagggctttggagcattatacaagggtctggtccccaattctgttaaggttgtaccatcaatagcactcgcgtttgtgacatatgaagtggtgaaggacattttaggggttgagattagaatatcagactgaaatcgggccccattcaggttgaaatgtttatgaggtgtgttgctattctttttttgtaggcaatggaacagatagaaaggtgaactagggactgttttcttagtactcttatttggtttctcataaatgagttttagaaacttgtacacagagagctgcaccgactcggacctagaccgagtctcggctcatgacactgcctgcctgtatgatgtcttataatggcttcaaatgtttcctatgtgaacactgtactcattcacgtgttgcgccaataaggatgaaggaacaatgcgaataaccatttgtttgtaattatcgagcagagccgagctgagttcgaacagcttaggctgcattcgagcactgcaatattcgaatgtcttgcgagtttaatcgag

SEQ ID NO: 4683 - DNA, 1802 bp, Gossypium hirsutum
cactatgtatgagatgcctccacgtgacacaccaaatgcctttctccttccgcataataaaacttcaccaaacccacgcgctgttaatgcaacatcccacacgctctctaatagttgaggtctcactttctccagccgtcaccaccacacctctctcacaaactaaccaacacaaacactaggatacaagggcaactgtggaatgcggagcctctttttactgtaaatcgcttcacagatctgattctcttgaccgccggataatccttctcgactttccgatatacttcgtcgggtttttgtggcgagagacggactttcaaagttttcttcccccgttttgtttttccatggcttcagaggatgtgaagactagcgaatcggcggtgtccacgatcgtgaatctggccgaggaagcaaagctcgcgagagagggtgttaaggcccctagctatgctattcttagcatctgcaagtctctcgcggctggcggcgtcgccggtggagtgtcacgaactgctgttgctcctttggaacgtttaaaaatcttacttcaggttcaaaatccacatagtattaaatacaatggaacaattcaaggcttgaagtacatttggagaacagaaggttttcgcggattattcaaaggcaatggtactaattgtgcacgcattgttccaaactcggcggtcaagttcttcagctacgagcaagcttcaaagggaatcctatatctgtatcaacagcaaactggcaatgaagatgctcaactcactcctcttttacgccttggagctggagcatgtgctggaataattgccatgtctgcaacttaccctatggacatggtacgaggcaggatcactgtacagacagagagttctccttatcagtatagaggaatgttccatgctctatccactgtgttgcgggaagaaggtccacgagcattgtataagggttggcttccttcagtcattggagttataccatacgtgggtctgaacttttctgtgtatgaatctctaaaagattggttaatcaaaagtagaccatttggattggttgaagactctgagttgagtgtgacgaccaggcttgcttgtggtgctgctgctggaactgtaggccaaactgttgcttaccctcttgatgtgattcgcagaagaatgcaaatggtaggatggaaagatgcagcgtcagttgtatctggtgatgggaggaacaaggcctctcttgaatatactggcatgattgatgctttcaggaaaactgttaggcatgaaggctttggagcattgtacaagggtctggtccctaattccgtgaaggttgtaccatcaatagctattgcatttgtgtcatacgaggtggtgaaggacattttaggagttgagattagaatatcagactgaaatggtgccaattcaacttaatgtttatgaggtgtgtggtatttttgtaggcaaggggatagagagaaaggtaaagtagggatgatcttcttaacctttttgtctgggaaacgggcttagaaactcacacaagcctgtccatagttccttcccatgttatcctaggtaacgctgtagctttaaactcattcatgttctgtgtcaataaagatgaaggaacggtccaaataacatgatttgtgtacttctgcataaaagtcgagaagcaatttctaagccttctctgcagtattgattgtgttgtttctgtggtgtagtagaacattttgatctcaataagttgtttgattaagctttagcatgaaatgaaattcagctttactagtt

SEQ ID NO: 4684 - DNA, 1641 bp, Cucumis sativus
aacgccactcctttcctccccgactaaaacactgacgaaagcgaggagtgcaaaaccctgcccttcgataatcaccggaatatttttgttcggaggcagagatcaggcttccttttacggcgactcagggtgtcggtgagcctctacttcgttttctgtgtcgccgatcttttttatggcttcggaggacgtcaaacgaagcgaatcggctgtttctacgatcgtaaacctggcagaggaggcgaagcttgcgagagaaggtgtcaaagcacccagttacgctgtgcttagcatctgcaaatctctggttgctggtggagtcgctggcggagtgtctcgaactgctgttgcgcctttggagcgtttaaagatattgttacaggtccagaatcctcatagcataaaatataatggaacgatacaaggcttgaaatatatttggagaacagagggctttcgaggactattcaaaggcaatggtactaattgtgctcgtatagtaccaaattcagcagtaaaattcttcagctatgagcaagcttctcgggggatactgtacttttacagggagcagactggtgaccaagatgcacaactcactcctcttctacgtcttggtgctggggcttgtgctggaataattgctatgtcagcaacttaccctatggacatggtgcgaggcagactaactgtgcagacagataagtctccttatcagtacagaggaatattccatgctctttcaacggtgctccgggaagaaggtccgagggctttgtacaagggttggcttccttctgtcatcggagttgttccatacgtaggtcttaactttgccgtgtatgaatcacttaaagattggttaattaaaaataaaccattcggacttgttgacgattcagagctcagtgtgacaacacgcttagcatgtggagctgctgctggaacagttggtcaaactgttgcctatcctcttgatgtcattcgtagaagaatgcagatggtgggctggaataatgctgcttctgtagtcactggtgatggaagaagtaaggcatcccttgagtacactggcatggtcgacgcttttagaaaaacagttcgttatgaaggctttagagcattgtataagggcttggttcccaactcagtgaaggtcgtcccgtcaattgcaattgcatttgtgacgtacgaaatggtgaaggacgttttaggtgtcgagattaggatctcagactgattattgggtactaacttacatttgttgaacggtctgctatttttgtaggcaagggggggatggcaaactaggatgttttaattatcctctctccaagaactagtttaaggcaatattgagtgtgttttagaatttgcttccctgactttaaatatatctctctacaaacttgtgctggcacaagcttttattcttgtgctatgtcaataaatgttttgacgatagaataagcacatttggattcctcctccattagatttgggagagcagagcttttattggatctagttttcagttttcttgctattattcatcaccattatactaagtttgtcttgcatattcttcagtgaacaatgcttataatcgagatagctgaattttcaatgtcagtgttttat

SEQ ID NO: 4685 - DNA, 1721 bp, Eucalyptus grandis
ggcgtcaacactcccagtcgcgcacacacaccgagctcgaaaagctgtttgctgttgaggcctcgctttcgccgccgccgccgccgccgccgccgccgccggatcctctaactgatgcggccgcgccgccctcagtgatcgcccggagatccccgatccagatcgttcagttccccccggagccgcgttccctttttctccgttcggcagggcgtttctagagcgttcttttgccccggtcgggtgcgtcggggttccggtgaattcaaatggcttccgaggacgtgaaggcgagcgagaaggcggtgtcgacgatcgtgaacctcgcggaggaggcgaagctggccagggaaggcgtgaaggcccccagctacgccgtcctcagcatctgcaagtccctcgtcgccggtggcgtcgccggaggagtgtcacgcactgccgttgctccattagaaaggttgaagatattgctgcaggttcaaaatccccatagcataaagtacaacggtacagttcaaggcttaaaatatatatggagaactgagggcttccgtggactgttcaaaggcaatggtaccaattgtgctcgtattgttccaaactctgcagtcaagttcttcagctatgagcaagcttccaagggaatattgttgttgtatcagcagcagactggcaatgaagatgctcaactcactccccctctacgtcttggggctggggcatgcgctggaataattgcaatgtctgccacttaccccatggacttggtacgaggcaggctaactgtacagacagagaattccccttatcagtatagaggaatgtttcatgcactgtcatcagtgctccgtgaagaaggtccgcgggccttatacaaggggtggctgccttctgtcattggagtgattccttacgtaggtctcaactttgctgtatacgaatctctgaaggaatggttaataaagaacagaccatttggactaatggaggactctgagttgagtgtcactacaaggcttgcctgtggagctgttgcaggaactgttggtcaaacagtggcttaccctctggatgtgatacgcagaagaatgcaaatggtggggtggaataatgcttcttccatagtaacaggtgacggaagagctaaggctgctcttgaatacaatggcatggttgatgcattcaggaaaactgtgaagtatgagggctttggagcattgtataagggtttggttccaaattctgtcaaggtagttccatccatcgccatcgcatttgtgacgtatgagatggtcaaggatatattaggagttgaaatcagaatatcagattgaactttggagcattctctggtgtccgtcaaaagtgtggtatttttgtagggcagggttagaaaaaagggtggaggttgctctattcttctctctaaaagtaagtctagaatatgtaatccagctctgataattgctccccctttgttctcgtattgatgtcttgttgtgaacttgctgtagctgttggcttctcattcatgtgctgtgtcaataagtatgtaggaggaataaggcaagaaatacagttcaatggcttttgatgctgtgtgaaagctatttttttcccttctgagattatactggagggctgttcactgcacttttcattttttaataactcactggatgcagtttaatataagaagaaagagtccaatcactgtcgca

SEQ ID NO: 4686 - DNA, 1521 bp, Euphorbia peplus
gagagacactatagtggcgacctcacctttcacttctcccaagacccgccgccgcgccgccgccgtacatcgccggaggcaaatgcagagagtcgttctccgataatcccactagattcccatccgatccgatcgatagatcgcagcggaaaccaatagctatttgtagtgttgttttagtgatcgatggcgtcggaagatgtgaaagctacggaatcagcggtgacgaagatcgtgaatctagcagaggaagctaagcttgctagagaaggagttaaggctcctagctatgcttttcttactatctgcaagtctctttttgctggcggcgtcgctggaggagtgtcacgtacagctgttgctccattggaaaggctgaaaatattactacaggttcaaaatccccacaacataaagtataatggaacgattcagggtttgaagtatatatggagaactgagggtttccgtggactcttcaaaggcaatggcacaaactgtgcccgtattgttccaaactcggcggtgaagttcttcagttatgagcaggcgtccaagggaattttgttgctatatcaacagcaaactggaaatgatgatgctcagctcactccccttctgcgccttggggctggagcatgtgcagggataattgcaatgtcagcgacttatcctatggatatggtacgagggaggctaactgtacagactgataagtcaccttatcaatatagaggaatgtttcacgctctatcaacagtgcttcgacaagaaggtcctcgggctttatacaagggttggcttccttctgtcattggagttgttccatatgtgggtctcaactttgctgtgtatgaatctctaaaggattggttgatcaaatctcgaccatttggactagttcaagattctgaactaagtgtgactacaagacttgcttgtggggctgctgctggcaccttgggacaaacagttgcttatcctcttgacgttatccgccgacgaatgcagatggttggatggaaagatgctgcatcagttgtgactggtgatgggaggagcaagactccccttcagtatactggtatgattgatgcattcaggaaaactgttcaatatgagggctttggagcactgtacaagggtttagtacccaattccgtaaaggtagttccatccatagcgatcgcgttcgtgacgtacgagatggtgaaagatgttttaggtgttcagatcaggatatcggactgaagcaggggctcgtcctctccgcctgctttgtcgaacaagtgtgctatttttgtaggcaaggatttaggagaaggtaaactagggaagttttagttatttctcatctcttgagtgaggtcaatggtgctttaagcccatgcttatattacttttgtcactcttatttgtttccttgagaacatgctgtagagtgtagatttcttcagcctagcgttcgtgtgctgtgtcaataaatattgaccgaataagagcaattcggattgttttgat

SEQ ID NO: 4687 - DNA, 1628 bp, Cucumis melo
aacgccactcctttccctccccgactaaaacactgacgaaagcgaggagtgcaaaaccttgccccttccgataatcaccggaatatttttgtttggaggcagagatcaggcttccttttacggcgacttagggttttggtgagcctctacttcgttttctgtgtcgccgatctcttttatggcttcggaggacgtcaaacgaagcgaatcggctgtttctacgatcgtaaacctggcagaggaggcgaagcttgcgcgagaaggtgtcaaagcacccagttacgctgtgcttagcatctgcaaatctcttgttgctggtggagtcgctggcggagtgtctcgaactgctgttgctcctttggagcgtttaaagatattattacaggtccagaatcctcatagcataaaatataatggaacgatacaaggcttgaaatatatttggagaacagagggctttcgaggactattcaaaggcaatggtactaattgtgctcgtatagtaccaaattcagcagtaaaattcttcagctacgagcaagcttctcgggggatactgtacttttacagggagcagactggtgaccatgatgctcaactcactcctcttctacgtcttggtgctggggcttgtgctggaataattgccatgtcagcaacttaccctatggacatggtgcgaggcagactaactgtgcagacagacaagtctccttatcaatacagaggaatattccatgctctttcaacggtgctccgggaagaaggtccaagggctttgtacaagggttggcttccttctgtcatcggagttgttccatacgtaggtcttaactttgctgtgtatgaatcacttaaagattggttaattaaaaataaaccattcggacttgttgaagattcagagctcagtgtgacaacacgcctagcatgtggagctgctgctggaacagttggtcaaactgttgcctatcctcttgatgtcattcgtagaagaatgcagatggtgggctggaataatgctgcttctgtagtcactggtgatggaagaagtaaggcacccctcgagtacactggcatggttgacgcttttagaaaaacagttcgttatgaaggctttagtgcattgtataagggcttggttcccaactcagtgaaggtcgtcccatcaatcgcaattgcatttgtgacgtacgaaatggtgaaggacgttttaggagtcgagattaggatctcagactgattattgggtactaacttacatttgttggacggtctgctatttttgtaggcaagggggggatggcaaactaggatgttttaattatcctctctccaagaactagtttaaggctgtattgagtgtgttttagaatttgcttccctgactttaaatatctttctacaaacctgtgctggcataagcttttattcttgtgctatgtcaataaatgttttgacgatagaataagcacatttggattcctcctttagatttgggagagcagagcttttattggatctagttttcatttttcttgctattcatcaccattatataccaagtttgtcttgcatattcttcagtgaacaatgcttataatcgagatagctgaatttttcgtgta

SEQ ID NO: 4688 - DNA, 1359 bp, Populus trichocarpa
gtctcctctctcactcaaaacagtcgcctccatctctctctctctccttctctaatagcaaatgcaggctgattaaatctccaaattaatcaatatcaataatcacactagtcaacgctgtaattttgatcacttttctagggttcgggtgatggcatcagaggatgtgaaagcaagcgagtctgctgtttctacgatcgtgaatctcgcagaagaggctaaacttgctcgtgaaggcgttaaagcaccgggaactgcccttcttaatatctgcaagtcccttttcgctggtggtgttgccggtggagtgtcacgtacagctgttgctcccttagaaagactaaaaattctattgcaggttcaaaatcctcacagtataaaatacaatggaacgattcagggtttgaaatacatatggagaactgagggcttaagagggatgtttaaaggaaacggcactaattgtgctcgaattgtcccaaattcagcagtcaagttctttagttacgaggaagcatccaagggaatattatggttttataggcggcaaactggaaacgatgatgcacagcttactcctcttttacgtcttggagctggtgcatgtgctggaattattgccatgtcagcaacttacccaatggacatggttcgtggtcggctaactgtccagacagacaagtctcctcgccagtatagaggaatcgctcatgctctctcaacagtccttaaggaggaaggtccccgggctttatacaaaggctggctgccttctgtaataggagttataccatatgtgggtctgaactttgctgtttatgaatctttaaaagactggttgctcaaaacgaaaccgtttggactagttgaggacaatgaattgggtgtggcgacaaggcttgcatgtggggctgctgctggaacttttggccagacagttgcttatcctctcgatgtaatccgacgaagaatgcagatggttggctggaaggatgctgcttcagttgtcactggtgatgggaggggcaaaacagcccttgaatatactggtatggttgatgccttcaggaaaacagttcgtcatgaggggtttggagcattgtacaagggtttggtccccaattcagtgaaggtgatcccttcgatagcaattgcttttgtgacatacgagatggtgaaggacgttcttcgagttgagacgaggatatctgactgaactaatgagaggaataaattatccgacttgcaagggaaataaaaggaaatacaaggacagggtcagttttcggggattatcttacttcgaggtagcggggaagtttagaagtttatttttagatagtgtgatagatattgtgt

SEQ ID NO: 4689 - DNA, 1610 bp, Gossypium hirsutum
ttcaagttttctccccgttttgttttccatggcttcagaggatgtgaagactagcgaatcggcggtgtccacgatcgtgaatctggccgaggaagcaaagctcgcgagagagggtgttaaggcccctagctatgctattcttagcatctgcaagtctctcgctgctggcggcgtcgccggtggagtgtcacgaactgctgttgctcctttggaacgtttaaaaatcttacttcaggttcaaaatccacatagtattaaatacaatggaacaattcaaggcttgaagtacatttggagaacagaaggttttcgcggattattcaaaggcaatggtactaattgtgcgcgcattgttccaaactcggcggtcaagttcttcagctacgagcaagcttcaaagggaatcctatatctgtatcaacggcaaactggcaatgaagatgctcaactcactcctcttttacgccttggagctggagcatgtgctggaataattgccatgtctgcaacttaccctatggacatggtacgaggcaggatcaccgtacagacagagagttctccttatcagtatagaggaatgttccatgctctatccactgtgttgcgggaagaaggtccacgagcattgtataagggttggcttccttcagtcattggagttataccatacgtgggtctgaacttttctgtgtatgaatctctaaaagattggttaatcaaaagtagaccatttggattggttgaagactctgagttgagtgtgacgaccaggcttgcttgtggtgctgctgctggaactgtaggccaaactgttgcttaccctcttgatgtgattcgcagaagaatgcaaatggtaggatggaaagatgcagcgtcagttgtatctggtgatgggaggaacaaggcctctcttgaatatactggcatgattgatgctttcaggaaaactgttaggcatgaaggctttggagcattgtacaagggtctggtccctaattccgtgaaggttgtaccatcaatagctattgcatttgtgtcatacgaggtggtgaaggacattttaggagttgagattagaatatcagactgaaatggtgccaactcaacttaatgtttatgaggtgtgtggtatttttgtaggcaaggggatagagagaaaggtaaagtagggatgatcttcttaacctttttgtctgggaaacgggcttagaaactcacacaagcctgtccttccttcccatgttatcctaggtaacgctgtagctttaaactcattcatgttctgtgtcaataaagatgaaggaacggtccaaataacatgatttgtgtacttctgcataaaagtcgagaagcaatttctaagccttctctgcagtattgattgtgttgtttctgtggtgtagtagaacattttgatctcaataagttgtttgattaagctttagcatgaaatgaaattcagctttactagttaaagaaagggtcacgttagttgatagatttcctactacgttatggatcagcatgcatctggttgttcatctgtcgctccaattcaacttgcttgcatttgatgtttagggaaaaaagaaaaagtaccgactgcg

SEQ ID NO: 4690 - DNA, 1547 bp, Eschscholzia californica
aaaatctcacactctctctctctataagacgataatgccataagtcgccgtcaccgaacataacaaaataacaccggaatcgatcattttcccccgaagctccgcgaaaaccttaactttttcgccggaaactgagagaaatgatgagttttgtggtcggataaaagttcccataattaaacaagtaatccatactcagagattcagcgggaaaaactgtgttaattttttttctttttctagggtttcgtttgtttaggtcttttaggtgtcttatggcgtcagaggatgttaaaacaacgagtgaaacagcagtttcaacgatcgttaatcttgctgaagaagcgagtgaaggtgttaaggctccgagtcacgcgatcctcagtatttgcaaatctcttgttgctggtggagtcgccggaggagtgtcacgcacagctgttgctccattagaacgaatgaagattttgcttcaggtccaaaatccccacaacatcaaatacaatgggacaattcaaggtctgaaatatatatggaaaaccgagggttttagaggattattcaagggcaatggtactaactgtgctcgtatagttccaaactcagcagtcaagtttttcagctacgagcaagcatctcaggggattttatggctttatcgacagcaaacaggcaatgaagatgcaccactcactcctctattacggcttggagctggggcatgtgctggcattattgctatgtcagcaacttacccaatggacatggtacgtgggaggatcactgtgcagacagaaaaatctccttcccagtacagaggaatgtttcatgcactgtcaacagtcctccgagaagaaggcccacgagctctgtacaaaggctggcttccttctgtcattggtgttgttccatacgtgggcctcaactttgcagtttatgaatctctcaaagactggttgatcaagacccgacctttcggattagttgaggacacagaattgagcgtgacaacaaggcttgcatgtggagctgctgcaggaacggttggccagacggttgcataccctctagatgtcattcgtagaagaatgcagatggtaggatggcacaatgcttcgtcaattgttgctggggatgggaggaccaagtcggcacttgaatatactggtatggtggatgcattcagaaaaacagttcgaaatgagggcttaagagcattatacaagggtttgattcccaactctgtcaaggtggttccgtccatagctattgcatttgtgacgtacgagcaggtgaaggatgttcttggtgttgagatgagaatatcagactaaatatgattttatttagaaaaccagggtattttggtgggaatcgtcgattgctattttggcaggcgaagaaagggtagattatttcaagagtaagggaagagaagtcgaaaacttaattagtaattgctatgttgataaatcttctagtctctcagtgtttagaatatgccattgttttaacttatttatatatgctgttatgaaataaaaggt

SEQ ID NO: 4691 - DNA, 1442 bp, Ricinus communis
aaaaagaaaaaaaaaaacatatacacaaacaaaccagacgccgtcacattactcactcacctatgcacacacttgaggaaaagccagtttgatacctcactttcgcctctcccaagagccatcgctcaccaccaaatcgacacctttttggcacagagagagagagagagagagagagagacagacagacggagagatgcagagactcgcttttcaataaacgagctagatacgatcgatcgccggagaaagcgagatctcgtttcttgacttaatttagggacttgttttggtgatccatggcatcggaggatgtgaagacgactgaatcggctgttacgacgatcgttaatctagcagaggaggctaagctcgctagagaaggagttaaggctccaagctatgctgttctcagtatctgcaagtctcttgttgccggaggtgtcgccggtggagtgtcacgtacagcggttgctccattggaaaggttgaagatattgctacaggttcaaaatccccacaacataaagtataatggcacaattcaagggttgagatatatatggaaaactgagggttttcgtggactgtttaaaggcaatggcactaactgtgctcgcattgtcccaaactcagcagtgaagttcttcagctatgaggaagcttctaagggaatattgtatttatatcgacagcaaactggcaatgaagatgctcagctcactcctcttctacgccttggagctggagcatgtgcaggaataattgccatgtctgcaacttatcccatggatatggtacgagggaggctaactgtacagacggataaatcaccttatcaatatagaggaatgttccatgctctatcaactgtgcttagagaagaaggcccacgggctctgtacaagggttggcttccttctgtaattggagttattccatatgtgggtctcaactttgctgtgtatgaatctctgaaggaatggttgattaaagctaaaccctttggactcgttcaagattctgacttaagtgtgactacaaggcttgcttgtggggccgctgctggaaccgttggccaaactgttgcttatcctcttgatgttattcgtcggcgtatgcagatggtgggatggaaagatgcttcgtcaattgtcattggtgatgggaggagcaagtcctccctcgagtacactggcatgattgatgcattcaggaaaactgttcggtacgagggctttggagcactgtacaagggtctggtaccgaattctgtaaaggtagtcccttcaatagcaattgcatttgtgacatacgaggtggtgaaagacattttaggagttgagatcagaatatcagactaaacatgggcttcgccatgacgtttgtcaaaccagtgtgctatttttgtaggcaggagaatagggagaaggtaaaatagg

SEQ ID NO: 4692 - DNA, 1579 bp, Catharanthus roseus
ctctctctctctctgcggcttttccccacttctgtttccgccatagccaccaccagtccaccaccgactccggcgaagagatgttcgctttttgatcactcttcaacctgccgatcatcgatcgtgcctggtgctttgagccagattcggatcgccgtcaattgatttgatttgatttaatttaatttctatggcttcggaagatgtaaagactagcgaatcggcagtgtcgaagattgtgaatctagctgaagaagctaagcttgcgagagaagaaattaaacctactagccatgctgtaattagtatttgcaagtctcttgtagctggcggcgtcgccggtggcgtatcacgtacagctgtggccccattggaacgtctcaaaatactgctgcaggtccaaaatccacataacataaagtataatggtacagttcagggcttgaaatatatttggagaactgagggtttcaggggtttattcaaaggcaatggcacaaattgtgcccgcattgtcccaaattcagcagttaagttcttcagctacgagcaagcttcaaagggtatactatggctacaccggcagcaaactggcaatgaggatgctgaacttactcctctattgcggcttggagctggtgcttgtgctggaataattgccatgtctgcaacttacccaatggacatggttcggggaagactgactgtgcagacagagaagtctccttatcagtacaggggaatgtttcacgctttatccactgttcttcgtgaagaaggtccaagggcattgtataagggttggcttccgtcggttataggagttattccatatgtcggtctcaattttgctgtttacgaatcacttaaggattggttggttaaaaccaattcttttgggcttgctgaagactcagagttgggtgtaacaacaaggcttgcatgtggagctgttgcagggactgtgggacaaactgttgcttaccctcttgatgtcattcgaagaaggatgcagatggtgggatggaaggatgctgatgccattgttactggtgatgggaggagcagagcacctttggagtacaatggcatggttgatgctttcaggaaaactgtaaggcacgagggattcagagctttgtacaagggtttggtcccgaattctgtgaaggttgtcccatcaatagctattgctttcgtgacatatgagcaagtgaaggacttgcttggggttgagattcgaatatcagactgatgatgccgaaagtttccttagatatttttcttttaatttggcgtgctgagatgatttgtaggtgaagagcagagagagagagagagagagatcatagtactgtggccattctctctccatccggaagagagaatttagagacctaatttaccgtgtttatatatttgcttctcagtttaaatggatgtatctctgggatgctttagcattttagatcgcgatttagatgatatcccaataatttactctcttgaaaagaaaaaaaaataagtaataagcgcgctgattatttgattagcatgagccagtggttctcttttatgt

SEQ ID NO: 4693 - DNA, 1599 bp, Vigna unguiculata
tttgtgttgtcagcagtagttgttggcattggtttgtgagctcactctcctctattcgaagctcccgcagccaccacagcactcactcttcgagcgagcgagtagtgatcgcttcgccgcaataatcgccggaacaatttgccgtttccctgccgagatctctcactcttcgacgattccgatacctcgattttgttccggttaggttaggttatagaatagttttttcatatatgggttcggagaatgtgaagactggggaatccgccgtcaccaccatcgtcaacctcgccgaggaggccaagctcgcacgagaaggcgtagtcaaggctcccaactacgcgctcgccagcatctgcaagtcactcgtcgcgggaggcgtcgccggaggagtgtcacgtactgcagttgctcctctggaacggttgaaaattttgctacaggtccaaaaccctcataacattaagtacaatggaactatacaaggcctaaaatatatatggagaactgaaggtctccgtggacttttcaaagggaatggtactaactgtgctcgaattgtccctaactctgctgtgaagttcttcagttatgagcaagcttctaaaggtatactgtacatgtatcagcagcaaactggaaatgaggatgctcaactgactcctgtcttacgtcttggagctggagcttgtgctggaataattgctatgtctgcaacttatccaatggacatggttcgtggccggattactgtgcagactgaggcatccccatatcagtacagaggaatgtttcatgctttgtctactgtgcttagggaagaaggtccacgtgctttatataagggctggcttccttcagttattggagttattccttatgtaggtctcaactttgctgtgtatgagtctctaaaagattggttagttaaatctaacgcatttggtcttgctgataattctgagttgagtgtgacaacacgcctggcttgtggtgctgctgctggaactgttggacaaactgttgcttaccctcttgacgttattcgtagaagaatgcagatggttggttggaaccatgctgcttctgttctaactggtgatggaagaggcaaagtgccacttgaatacactggaatggttgatgcattcaggaaaactgttcagcatgaaggattcggtgcattatacaagggtcttgtgcccaactctgtaaaggtggtcccatcgatagcaatcgcttttgtgacatacgagatggtgaaggacattttaggagttgagatcagaatatctgactgaaatttgataaccacatgagataaatctgttcaattggtgtggtttttctttgaattatttttcgtaggcaaggggatactgagatggtaacctaaagttattttctttattttcctctcaaaggatgagtttagaaactcttagaactaggattcataaatttattcccttgttctatttgttttcgttgttctatttgtccataataagtgttgtggaaaaacaatgcaaggacataacttcgtagctttctccactggttgagaaagcatttttcttagtggattttgcatcaact

SEQ ID NO: 4694 - DNA, 1600 bp, Vigna unguiculata
  misc_feature (22)..(23): n is a, c, g, or t
tttgtgttgtcagcagtagttnntggcattggtttgtgagctcactctcctctattcgaagctcccgcagccaccacagcactcactcttcgagcgagcgagtagtgatcgcttcgccgcaataatcgccggaacaatttgccgtttccctgccgagatctctcactcttcgacgattccgatacctcgattttgttccggttaggttaggttatagaatagttttttcatatatgggttcggagaatgtgaagactggggaatccgccgtcaccaccatcgtcaacctcgccgaggaggccaagctcgcacgagaaggcgtagtcaaggctcccaactacgcgctcgccagcatctgcaagtcactcgtcgcgggaggcgtcgccggaggagtgtcacgtactgcagttgctcctctggaacggttgaaaattttgctacaggtccaaaaccctcataacattaagtacaatggaactatacaaggcctaaaatatatatggagaactgaaggtctccgtggacttttcaaagggaatggtactaactgtgctcgaattgtccctaactctgctgtgaagttcttcagttatgagcaagcttctaaaggtatactgtacatgtatcagcagcaaactggaaatgaggatgctcaactgactcctgtcttacgtcttggagctggagcttgtgctggaataattgctatgtctgcaacttatccaatggacatggttcgtggccggattactgtgcagactgaggcatccccatatcagtacagaggaatgtttcatgctttgtctactgtgcttagggaagaaggtccacgtgctttatataagggctggcttccttcagttattggagttattccttatgtaggtctcaactttgctgtgtatgagtctctaaaagattggttagttaaatctaacgcatttggtcttgctgataattctgagttgagtgtgacaacacgcctggcttgtggtgctgctgctggaactgttggacaaactgttgcttaccctcttgacgttattcgtagaagaatgcagatggttggttggaaccatgctgcttctgttctaactggtgatggaagaggcaaagtgccacttgaatacactggaatggttgatgcattcaggaaaactgttcagcatgaaggattcggtgcattatacaagggtcttgtgcccaactctgtaaaggtggtcccatcgatagcaatcgcttttgtgacatacgagatggtgaaggacattttaggagttgagatcagaatatctgactgaaatttgataaccacatgagataaatctgttcaattggtgtggtttttctttgaattatttttcgtaggcaaggggatactgagatggtaacctaaagttattttctttattttcctctcaaaggatgagtttagaaactcttagaactaggattcataaatttattcccttgttctatttgttttcgttgttctatttgtccataataagtgttgtggaaaaacaatgcaaggacataacttcgtagctttctccactggttgagaaagcatttttcttagtggattttgcatcaacta

SEQ ID NO: 4695 - DNA, 1533 bp, Lotus japonicus
gagaaatgatcaccgtttcgctgcactaatcgccgccggaggaattcgtcgtttcttgccggagaatccaagatctctcaatctccgacgacctagataactaactaactctcttcttcttcttcttcgcgattattaggttagggtttttattatagcttctatggcttcggaggatgtgaagaccaccggcgaatccgccgtaacgaagatcgtcagtttggcggaggaggcaaagctcgccagagaaggcgttgttaaggctcccaactatgccttagctagcatctgcaagtccctcgttgccggtggagtcgccggaggagtatcacgtacggcagttgctccgctggagcggttgaaaattttgctgcaggtccagaatcctcataatataaaatacaatggaacaatacaaggcctaaaatatatatggagaactgaaggtttccgtggactgttcaaagggaacggaactaattgtgctcgaattgtccctaattctgctgtgaagttcttcagttatgagcaagcttccaaaggtatactgtatatgtatcagcagcaaactggaaatgaggatgctcagctgactcctgttttacgtcttggagctggagcatgtgctggaataattgctatgtctgcaacctacccaatggatatggttcgaggcaggatcactgtgcagactgagaaatccccttatcagtacaggggaatgtttcatgctctgagtactgtgctcagagaagaaggtccacgtgctttatataagggctggctgccttcagtaattggagttattccttatgtgggtctcaactttgctgtctatgagtctctaaaagaatggttaattgaatccaaaccatttggtctagttcaagattctgagttgagtgtgacaacacgcctggcttgtggtgctgctgctggaactgttggacaaactgttgcttatcctcttgatgtcattcgccgaagaatgcagatggttggttggaaccatgctgcttctgttcttaccggagatggaagaggcaaagtcccgcttgaatacactggaatggttgatgcatttaggaaaaccgttaggcatgaaggatttggtgcattatacaagggtctggtgcccaattctgttaaggtggtcccatccattgcacttgcatttgtaacatatgaggtggtgaaggacattttaggagttgagatcagaatatcagactaaagttcgataaccacatgatatttatttacctggtgtggcttttttgggtaggcaaggggatgcaagatggtaacttagagttattttcttgtttttcatctctccaaggatgagtttagaaactctagagctagtgtctataaatttattcccttgttcttattgttttccttgtgaaagtgcctagtttttggcttcttattcatcttgtatgtcaataagtgttattgtggcaaaacaatgcaaggacatatctgccttagcgttctgcactagttaataaaacatttttcttagtg

SEQ ID NO: 4696 - DNA, 1538 bp, Quercus alba
aagccctcatcacatcatactaagctcttttttctgctgcagcagccgtcactaccacactctctgcaactttcacacagtaccgcacagtacggtacagtagtagagagagtctcgcatttcggtattatcgccggagatccgacccgattcatatcgacgaggccgagatcaggcgaaaactttggtttgctctcactagtccgtagaaaatggcttcggaggacgtgaagacgagcgaatcggcggtgtcgaccatcgtgaacttagcggaggaggcgaagcttgcgagagaaggcgtcgtgaaggctcgcagccaagctgttctcagtatttgcaagtctctcgtcgctggtggagtcgccggaggattgtcacgcacagctgttgctccattggaaaggttgaagatactgctacaggtccagaatccccataacataaaatacaatggaacaattcaaggcttgaaatatatatggagaactgagggttttcgtggactgttcaaaggaaatggtactaactgtgcacgtattgtcccaaactctgcagtcaagttcttcagctatgagcaggcttcaaagggaatcttgtatatgtatcagcagcaaactggcaatgaggatgctcagctcactcctcttttgcgtcttggggctggggcatgtgctggaataattgccatgtctgcaacttacccaatggacatggtacggggccggctaactgtacagacagagaattctccttatcggtatagaggaatgttccatgctctatcaaccgtgctccgggaagaaggcccacgggcattgtacaagggatggcttccttctgttattggagttattccatatgtgggtctcaactttgctgtgtatgaatctctaaaggattggttggttaaagctaaaccgtttggactaattgaagactctgagctgagtgtgacaacacggctggcatgtggagctgctgctggcactgttggacaaactgttgcttatcctcttgatgtcatacgtcgacgaatgcagatggtggggtggaataatgctgcttctgttatcactggtgatgggaggagtgcagccccgcttgaatacactggtatgattgatgcattcaggaaaaccgttcgacatgagggctttggtgcattgtacaagggtttggtccccaattctgttaaggtagtcccatctatagcaattgcatttgtgacatacgaggtggtgaaggacattctgggagttgagatcagaatatcagactgaagtgcagggaactcaatgataattattggacaagtctgctatttttgtaggcaaggggatagagagacggtaaactaggtaatttcttcctcctggttattccaggaatgagttagaagcacgtttgagcctgtatttataatttgttttcccctgttttcctttctatgttttcctatgaatatgctgtagctttcagcttcccattgatatgctgtgtcaataaatgttttgacaatgcaagaacacatttgcatg

SEQ ID NO: 4697 - DNA, 1724 bp, Brassica napus
ggccgccgggacagtgaaagagaagagaagtagatttctctctctcgacaagtgctttgatctctcttctcctcaatctcaaaacgaagatttctgcaggggtttcaggtcctcgtcgagagatcgaagatcgttagaaaacttctgaagagatcatttgagatcgttcgtaatcgtaggggagtgatttcgatttctctgtatcgatggcatcagaggatgtgaagagcaccgagtcggcagctgtatcaacgatcgtaaacctggcggaggaagcgaagttggcgagagaaggagtcaaagctccgagccatgctgtcctcagcatctgcaagtctctcttcgccggtggcgtcgctggtggagtgtcacgaactgcagttgcacctctggaaaggatgaagatattgcttcaggtccaaaatccacataacataaagtatagtgggacagtccaaggattgaagtatatttggagaaccgagggggttcgtggactgttcaaaggaaacggcaccaactgtgctcgtattgttcctaactcggctgtcaaatttttcagctatgagcaggcttcaaagggtatactgtacatgtatcgtcagcagacaggaaatgagaacgcccaactcactcctgttttacggcttggagctggtgcaactgctggaataatagccatgtctgcaacgtacccaatggatatggttcgtggaaggctaactgtccagactgcaaactctccttatcaatatagaggaattgcacatgctttatcaactgtcctgagagaggaaggtccaagggccctgtaccgtggttggcttccatcagtgattggagttgttccatatgtgggcttgaactttgcggtctatgagtcccttaaggactggctagtcaaagacaatccatttggactagtggagaacaatgagctgaccatcataacgagactctcgtgcggtgctatagctggaacagttggtcaaacgattgcttacccactggatgtgattcgtaggagaatgcaaatggttgggtggaaagatgcttcctctgttgttacaggcgaagggagaagcaagcttgaatacaacggtatggttgatgcatttaggaagacagttcgtcatgaagggtttggagctttgtacaagggtttggtccccaattcagtgaaggttgtaccatcaattgcgattgcatttgtgacatatgagatggtgaaagacgttttaggagtggagtttaggatatcagactaagtccatttgatgatatcttcaagaagagggggagagagagagaggacacttctatttttgtggcggatgagacagaagagaagttcgacattttaggggcttttatttgaatctccgttcagcatcgttggaagggataaagggctatagagctttagccaaacttctattttttttctttagattgaattttcttttgaatcaaaataagccaagaggccaactataaaaaccctatttggtactggagcttgtgttttacaggttttggttgggtcttttggtattgagttatcacttttattggtaacttgtggattagtttgaataattaaattcatgttgtgtgctgctagtcagtgttttatgttctttttgtgtatgcattgtggaacagacaacaaacttgttttgttgtacctcaagattactccatgcgctatggttgtgtagcga

SEQ ID NO: 4698 - DNA, 1497 bp, Flaveria ramosissima
gttctactcttatttattattaattctattccttttactacacaccatccactgagatcgccggaggcccctttgcgacggcgaatcattattaaactccagtagggttccgcccatttcactctttccatttctagggtttaggccgtgcacatggcgtcggaggatgtcgtagggaagaccagcgccaccatcgctaatctcgccgaagaagccaagatcgccagtgaaggcgttaaggctcccagccgtcacgctctcctcaccatctgcaagtctctcgtcgccggaggcgtcgccggtggagtatcaagaactgctgttgctcctctagaacgactgaagattttgctccaggttcaaaatcctcatgcgatcaaatataatggtaccattcaggggttgaaatatatatggagaacagagggtttccgtggactgtttaaaggaaatggcactaattgtgctcgtattgttccaaactctgctgtcaagttctttagctatgaagaagcatcaaagggaatcttgtggctctaccgacagcaacctggaaatgaggatgctgaactcacccctgtcttgcgccttggagctggtgcttgtgctggaataatcgccatgtcagctacctacccgatggatttggttcgaggccggcttactgtgcagactgataaatctccaagccaataccgaggaattgcacatgctcttggaaccgtactacgcgaagaaggtccacgtgcattgtataaagggtggcttccttctgtcattggtgttataccatacgtgggtctaaattttgctgtgtatgaatctttaaaagattggttgattaaatcaaaaccatttgggctagccgaggacgctgagttgagtgtgacaacaaagcttgcatgtggggctgcagctggaaccgtgggtcaaactgttgcttatcctctcgatgtcatccgaagaagaatgcaaatggttggttggaaacatgcagcttcagttgtcactgcagatgggaaatcagcacttgagtacaatggtatggttgatgctttcaggaaaaccgttcgttatgaaggctttggagccttgtataaaggcttggtccccaactcagtcaaggtggttccttcaatagcaattgcgtttgtgtcatacgaggtggttaaggatctacttggggtagagatgaggatatctgattgaaaagaacactctaattataataataatgttgttgaatgaatattatttttgcatgcagaagagaaagtaggaggtataactataagctaaggaggtcataatttttttgttgtcttctctctttcggttgtctttcagttactgggagatttagaagttagtgttgatatagagacccctatgcatacccgatactttctctttctggtgtggtattttggtgtttgactttcgcgccacaccaacaccacccaataaggatatctcatagagatgatgagttgttcg

SEQ ID NO: 4699 - DNA, 1516 bp, Flaveria ramosissima
tgagatcgccggaggcccctttgcgacggcgaatcattatttaactccagtagggttccgcccatttcactccttgcatttctagggttttggccgtgcacatggcgtcggaggatgtcgtagggaagaccagcgccaccatcgctaatctcgccgaagaagccaagatcgccagtgaaggcgttaaggctcccagccgtcacgctctcctcaccatctgcaagtctctcgtcgccggcggcgtcgccggtggagtatcaagaactgctgttgctcctctagaacgattgaagattttgctccaggttcaaaatcctcatgcgatcaaatataatggtaccattcaggggttgaaatatatatggagaacagagggttttcgtggactgtttaaaggaaatggcactaattgtgctcgtattgttccaaactctgctgtcaagttctttagctatgaagaagcatcaaagggaatcttgtggctctaccgacagcaacctggaaatgaggacgctgaactcacccctgtcttgcgccttggagctggtgcttgtgctggaataatcgccatgtcagctacctacccgatggatttggttcgaggccggcttactgtgcagactgataaatctccaagccaataccgaggaattgcacatgctcttggaaccgtactacgtgaagaaggtccacgtgcattgtataaagggtggcttccttctgtcattggtgttataccatacgtgggtcttaattttgctgtgtatgaatctttaaaagattggttgattaaatcaaaaccatttgggctagccgaggacgctgagttgagtgtgacaacaaagcttgcatgtggggctgcagctggaactgtgggtcaaactgttgcttatcctcttgatgtaatccgaagaagaatgcaaatggttggttggaagcatgcagcttcagttgtcactgcagatggcaaatcagcacttgagtacaatggtatggttgatgctttcaggaaaactgttcgttatgaaggttttggagccttgtataaaggcttggtccccaactcagtcaaggtggtcccttcgatagcaattgcatttgtgtcgtacgaggtggttaaggatctacttggggtagagatgaggatatctgattgaaaaaaaaaaacactctaattaaaataataatgttgttgaatgaatattattttgcatgcagaagagaaagtaggaggtataactataagctacggaggtcataattttgttgttgtcttctctctttcggttgtctttcagttactgggagatttagaagttagtgttgatatagagaccccgatgcatacccgatactttctctttctgctgtggtattttggtgtttgactttcacgtcacgccatcgccacccaataaggatatttcatagagctggtaagttgcttgatctgtattattggttatgcttatgtataacttgtttactttaaacctcttagtttattttgtaggtt

SEQ ID NO: 4700 - DNA, 1764 bp, Medicago truncatula
aagcagtggtatcaacgcagagtgcccatacgcctccttcactcacacactccagtattagtggtctctgtgagctctcacacactctctctctaaacctttccgcagccaccactccctttctctctctagaaatgatcgcataatcaccggagcaattcaccatcaccggaaaatcggagatctctcaatctccgacaacctaaattactctctttttcttaatttattcacttccgattagtttagggtttattgattttatcataaattattgattttgattatggcttcggaaagcatggcttcggaggatgtgaagagtggcgaatcagcggtgacgaagatcgtgaatttggcggaggaagctaagctcgctagagaaggtgttgttaaagcgaagcctaactatgcgtttggtagcatctgcaaatctctcgttgctggtggtgtcgccggaggagtatcacgaactgctgttgctccgctcgaacgaatgaaaattttgctacaggtccagaatcctcataacataaaatacagtggaacaatacaaggcctgaaatatatatggagaactgaaggattccgtggacttttcaagggaaatggtactaattgtgctagaattgtcccaaattctgctgtgaagttcttcagttatgagcaagcttctaaaggtatactgcatttgtatcggcagcaaactggaaatgaggatgctcagctgactcctgttttacgtcttggagctggagcatgtgctggaataattgctatgtctgcaacttatccgatggatatggtccgaggcaggataaccgttcagactgagaaatccccttatcagtacagaggaatgttccatgctttgagtactgtgctcagggaagaaggaccacgtgctttatataagggctggcttccttcagtaattggagttattccttatgtaggtctcaactttgctgtctatgagtctctgaaagattatttgattaaaactaaaccatttggtctagcccaagattctgagttgagtgtgacaacacgccttgcctgtggtgctgctgccggaactattggacaaactgttgcttaccctcttgatgtcattcgtcgaagaatgcagatgaccggttggcacaatgctgcttctgttataactggggatggagtaggcaaagtcccacttgaatatactggaatggttgatgcatttaggaaaactgttcggcacgagggattcggtgcattatacaagggtctggtgcccaattctgttaaggtggttccatccatagcgcttgcatttgtatcatatgagatggtgaaggacattttaggagtggagatcagaatatcagactaaagcttgatagccgccccatattatctgtttacctggtggtgtggttttctcctctcttttttgataggcaaggggacatagagatggcaacttcaaattattttcttgtttttcatctcactgaggatgagtttagaactctagagttagtgtctataaatttattcccttgttcctatttgttttctttgcaaacgtgctgtagttttcagcttcttattcatactccatgtcaataagtgttgtggaaaaacaatgcaatgacacatctgcctagctttctgcactagttaagaaagcatttttcttagtggaatttgatgtgcttgatatttccattctatgccttccatacactatccctaaaataatatgtttggaatgattgtgtt

SEQ ID NO: 4701 - DNA, 1811 bp, Medicago truncatula
ggcttctctctctaaagctccatataaatagcttaacaataaccaaacgccgtcacctctccttcactcacacactccagtattagtggtctctgtgagctctcacacactctctctctaaacctttccgcagccaccactccctttctctctctagaaatgatcgcataatcaccggagcaattcaccatcaccggaaaatcggagatctctcaatctccgacaacctaaattactctctttttcttaatttattcacttccgattagtttagggtttattgattttatcataaattattgattttgattatggcttcggaaagcatggcttcggaggatgtgaagagtggcgaatcagcggtgacgaagatcgtgaatttggcggaggaagctaagctcgctagagaaggtgttgttaaagcgaagcctaactatgcgtttggtagcatctgcaaatctctcgttgctggtggtgtcgccggaggagtatcacgaactgctgttgctccgctcgaacgaatgaaaattttgctacaggtccagaatcctcataacataaaatacagtggaacaatacaaggcctgaaatatatatggagaactgaaggattccgtggacttttcaagggaaatggtactaattgtgctagaattgtcccaaattctgctgtgaagttcttcagttatgagcaagcttctaaaggtatactgcatttgtatcggcagcaaactggaaatgaggatgctcagctgactcctgttttacgtcttggagctggagcatgtgctggaataattgctatgtctgcaacttatccgatggatatggtccgaggcaggataaccgttcagactgagaaatccccttatcagtacagaggaatgttccatgctttgagtactgtgctcagggaagaaggaccacgtgctttatataagggctggcttccttcagtaattggagttattccttatgtaggtctcaactttgctgtctatgagtctctgaaagattatttgattaaaactaaaccatttggtctagcccaagattctgagttgagtgtgacaacacgccttgcctgtggtgctgctgccggaactattggacaaactgttgcttaccctcttgatgtcattcgtcgaagaatgcagatgaccggttggcacaatgctgcttctgttataactggggatggagtaggcaaagtcccacttgaatatactggaatggttgatgcatttaggaaaactgttcggcacgagggattcggtgcattatacaagggtctggtgcccaattctgttaaggtggttccatccatagcgcttgcatttgtatcatatgagatggtgaaggacattttaggagtggagatcagaatatcagactaaagcttgatagccgccccatattatctgtttacctggtggtgtggttttctcctctcttttttgataggcaaggggacatagagatggcaacttcaaattattttcttgtttttcatctcactgaggatgagtttagaactctagagttagtgtctataaatttattcccttgttcctatttgttttctttgcaaacgtgctgtagttttcagcttcttattcatactccatgtcaataagtgttgtggaaaaacaatgcaatgacacatctgcctagctttctgcactagttaagaaagcatttttcttagtggaatttgatgtgcttgatatttccattctatgccttccatacactatccctaaaataatatgtttggaatgattgtgttaaatatttgagttgaagtgtgt

SEQ ID NO: 4702 - DNA, 1464 bp, Gossypium hirsutum
caaagtttcgtttccctgttttgttttccatggcttcagaggatgtgaagactagcgaatcggcggtgtccacgatcgtgaatctggccgaggaagcaaagctcgcgagagagggtgttaaggcccctagctatgctattcttagcatctgcaagtctctcgcggctggcggcgtcgccggtggagtgtcacgaactgctgttgctcctttggaacgtttaaaaatcttacttcaggttcaaaatccacatagtattaaatacaatggaacaattcaaggcttgaagtacatttggagaacagaaggttttcgcggattattcaaaggcaatggtactaattgtgcacgcattgttccaaactcggcggtcaagttcttcagctacgagcaagcttcaaagggaatcctatatctgcatcaacggcaaactggcaatgaagatgctcaactcactcctcttttacgccttggagctggagcatgtgctggaataattgccatgtctgcaacttaccctatggacatggtacgaggcaggatcactgtacagacagagagttctccttatcagtatagaggaatgttccatgctctatccactgtgttgcgggaagaaggtccacgagcattgtataagggttggcttccttcagtcattggagttataccatacgtgggtctgaacttttctgtgtatgaatctctaaaagattggttaatcaaaagtagaccatttggattggttgaagactctgagttgagtgtgacgaccaggcttgcttgtggtgctgctgctggaactgtaggccaaactgttgcttaccctcttgatgtgattcgcagaagaatgcaaatggtaggatggaaagatgcagcgtcagttgtatctggtgatgggaggaacaaggcctctcttgaatatactggcatgattgatgctttcaggaaaactgttaggcatgaaggctttggagcattgtacaagggtctggtccctaattccgtgaaggttgtaccatcaatagctattgcatttgtgtcatacgaggtggtgaaggacattttaggagttgagattagaatatcagactgaaatggtgccaattcaacttaatgtttatgaggtgtgtggtatttttgtaggcaaggggatagagagaaaggtaaagtagggatgatcttcttaacctttttgtctgggaaacgggcttagaaactcacacaagcctgtccatagttccttcccatgttatcctagggaacgctgtagctttaaactcattcatgttctgtgtcaataaagatgaaggaacggtccaaataacatgatttatgtacttctgcataaaagttgagaagcaatttctaagccttctctgcgatattgattgcgttatttctgtggtgtagtagaacattttgatctcaataagttgtttgattgagctttagcatgaaatgaa

SEQ ID NO: 4703 - DNA, 1542 bp, Cucurbita pepo
caacgttccctcttccctccgcgattaacactgacgaaagagagaaaagcaaaaccttgctctctgataatcaccggaatctttgtttggaggctgagatcacgcttccaattacggcgacttaggtttcggtgatcttcgacttcattttctgtttcgttgatttcttgtatggcttcggaggacgtcaaacgaagcgaatcggctgtttctacgatcgtaaacctggcagaggaggcgaaacttgcgagagaaggcgtcaaagcacctagttatgctctgcttagcatctgcaaatctctggttgctggtggagtcgccggtggagtgtctcgaactgctgttgcccctttggagcgtttgaagatattattacaggtccagaatcctcatagcataaaatataatgggacgatacaaggcttgaaatatatttggagaactgagggttttcgaggattattcaaaggcaatggtacaaattgtgctcgtatagtaccaaattcagcagtaaaattcttcagctatgagcaagcttctcggggaatactggccttttacagggagaagactggtgaccaagatgctcaactcactcctcttctacgtcttggtgctggagcttgtgctggaattattgccatgtcagcaacttaccctatggacatggtgcgaggcagattaaccgtgcagacagataagtctccttaccagtacagaggaatattccatgctctttcaacggtgcttcgggaagaaggtccaagggccttgtacaagggctggcttccttctgtcatcggagttattccatacgtgggacttaactttgccgtgtatgaatcacttaaagattggttaattaaaaagagaccgttcggacttgttgaagattcagagcttagtgtgacaacacgcctagcatgtggagctgctgctggaactgtaggtcaaactattgcctatcctcttgatgtcattcgtagaagaatgcagatggtgggctggaataatgctgcatctgtagtcactggtgatggaagaagtaaggcagcccttgaatacactggcatgatcgatgcttttagaaaaacagttcgttatgaaggctttagggcattgtacaagggtttggttcccaactcagtgaaggttgtcccgtcgatcgccatcgcatttgtgtcgtacgaaatggtgaaggacgttttgggagtcgagattagaatctcagactgattattgggcactaacttacatttgttgaacggttgaacggtctgctatttttgtagacaaggggcgatggtaaactaggttgttttgattatcatctctccaagaactagtttaaggcagtattgggtgtgtttgtaatttgcttccctgattttaaatatctttctacaaactcgtgctagcataagcttatcttcttatgctatgtcaataaatgttttgacgatagaataagcacatttgaatgcctccgttagttcaggagagctgagcttttattgaatctagtattcagttttcgttgcc

SEQ ID NO: 4704 - DNA, 1775 bp, Mimulus guttatus
gaagcaaaacaagctcacactctttcgcgcatacacgagccgtcatttataaaccccaaacacacacacactcactgcgtgccgcatttccccctttctctccgcagccgtcgaccgccgtgccgaggagtaagagatagtggcgcgtggattgttttcgtattgttgatcgctgacttagggtttttgaaattaatttttagaccatttttttttttaattttattttttggggattttttttgggggatttgatggcgtcggaggatgtgaagacgagtgaatcggcggtgtcgaagattgtgaatttcgcggaggaggcgaagcttgcgaaggaagaaatcaaacctactaaacatcaagtttacagtatttgcaaatctctggtcgccggtggtgttgctggaggagtgtcacgaactgccgtagctcctctggagcgtctaaaaattttgcttcaggttcaaaatcctcacaatataaaatataatggtactgttcaaggcttgaagtacatatatagaactgagggcttaagggggttgttcaaaggcaacggcactaattgtgctcgcattgttccaaattcagcagtaaagttcttcagctacgagcaagcatccaagggtatattatacatgtaccggcaacaaactggcaatgaggatgctcagctgactcctctactacgtttgggggccggagcttgtgctggaataattgctatgtctgctacatacccaatggatatggttcgaggcagacttactgtacagacggataagtctccgtatcagtacagaggaatgtttcatgccttatcaactgtgctccgcgaagagggctttcgtgcactatacaaaggctggcttccttctgttattggagtcgttccttatgtaggtctcaactttgctgtgtatgaatctctcaaggattatttaatcaaatctaaaccctatgggattgttgaagataatgaattgggtgttgtaacaaggctcggatgtggtgctgcagcgggaacagttgggcaaactatcgcctaccctcttgatgtaattcgtagaagaatgcagatggttggttggaataatgcttcttcaattatcactggcgatggaagaagcaaagccccccttgaatatactggcatggtcgatgctttcaggaaaactgtcaggcatgagggcttcagagcattgtacaagggcatagtccccaattcggtcaaggttgtgccatcaatagctattgcttttgtgacgtacgaacaagtgaaggaattgctcggggtagagattagaatatctgactgaaagcatgtgcaccgagagctgtgacgtgtgctcgttgtgtgtattttttgtctgaggagaggaagaacaaattaatgttaaaaacactcttgtgcatagagttggagactctgttctaacctgtgttcatacatatgtttcttcacctatttatatgtttcgttatgggttcgttcaccgttagctgctccagtagaaatgctgtcttaataaagtagtagcaaagaatgatgcaataatagcttttcgatattttttctttttaatttttaaatccaggtttgcttgttaagttaactagctttcgtatggctttttattgtcagcggacaaaacctccccggtttttggatgaatctttttctatgccatatttggaaacaattgtgcttagcttcgcgttttttaaactatgtaatgtgaaaggatattcaacagctcgaaaattcggtctcg

SEQ ID NO: 4705 - DNA, 1711 bp, Quercus alba
tccgtctctcgcagatatgctcactcactctcgctaaaaaacgacgtcgtcggacgccggtcaacagagccgttttgaccgtgaaaccctagggtttgctgcgcttgttttttgatggcttctgaggacgcgatgagcaaaacgacgggcgagtctgccgtttcgacgatcgtaaacctcgccgaggaagccaaactcgctagcgaaggtgtcaaagcccctagccatgccttactcagcatctgcaagtctctcatcgccggaggcgtcgccggcggagtctcacgtagtgctgttgctccactagaaagattaaaaattttgctccaggttcaaaatcctcatagtatcaaatacaatggaacgattcaaggcttaaaatatatatggagaactgagggtataagaggaatgtttaaaggaaatggaactaactgtgctcgtattgtcccaaactcagctgtcaagttctttagttatgagcaagcatctaatggaattttatggcttcatcgtcgacaatctgggaatgaagaggcacaacttactcctcttttacgacttggagctggtgcatgtgctggaattattgccatgtcagcaacttacccaatggacatggtacggggtcggctgactgtccagacagaaaattctcctcgccaatataggggaatcttccatgctctttctacagtcttccgggaagaaggccctcgggctctttacagaggctggctaccttctgtcataggagttattccatatgtgggtctcaactttgccgtgtatgaatctttgaaagactggttgattcaaactaaaccatttggactggctgaaaactctgagctgagtgtgacaacaagacttgcatgtggtgctgctgctggaactgttggtcagactgttgcttaccctcttgatgtcattcgacgaagaatgcagatggtaggctggaaagatgcttcatctgtcctgactgctgatgggaagagcaaggcatctcttgaatatactggcatggttgatgctttcaggaaaacagttcggcacgagggatttggagcgttgtacaagggtttggtccccaattcagtgaaggtggtcccatccatagcaattgcattcgtgacatacgaggtggtcaaggacgttcttggagttgagatgaggatatctgactgaagcaagggaaacttaaagctatttcttccaacatttgtgctaattttgccagcagaaagaaatggttattaggagaaggtattttatcgggaattgtgttctttccagttaggaggaatctttagaaacccacttttaacatcatgttgatattccttccagatattgcccatttgtctctatccaaacccaccttagtttttagcattcatattcttatgctattgcaataagtatgatgcactagatgcattctgatatcttcccagtgaagttaatttattactcatttgtatttatggtgaccggtttataaaatagaattgccatcttagatcttttggttatttcccgtcttttttctatttatgcaggcattgatttgatactattctgctgaatctgctttgttggttatgtgaattaaatgattttgtataatatgatggatgtattgtaagttgtaacagcttcttatgggggctaaatgaatgcattaagtcaagaaaaattccaaccaagc

SEQ ID NO: 4706 - DNA, 1555 bp, Nicotiana tabacum
  misc_feature (68)..(69): n is a, c, g, or t
  misc_feature (107)..(107): n is a, c, g, or t
  misc_feature (136)..(136): n is a, c, g, or t
  misc_feature (150)..(150): n is a, c, g, or t
  misc_feature (232)..(232): n is a, c, g, or t
  misc_feature (809)..(809): n is a, c, g, or t
  misc_feature (953)..(953): n is a, c, g, or t
  misc_feature (971)..(971): n is a, c, g, or t
  misc_feature (976)..(976): n is a, c, g, or t
  misc_feature (1367)..(1367): n is a, c, g, or t
  misc_feature (1384)..(1384): n is a, c, g, or t
  misc_feature (1389)..(1389): n is a, c, g, or t
cactttcaatcgccgtcgtataaaaagctggtcttttgcaccttcatttctccttcgcattttccatnnaactctcgccgtcgctgccaccaccaaccaccgcaacngctaactgaaacagtcactgtaaaatgtnctgtttctcataanctttttctaattctgatccgtaaattgaaaagcagcggagttttttcagcgaacgatttgctgttaggttaagctttttttnatcttattatatggcttcggaggatgtgaaggcggcgagagattcggcggtggagaaaattgtgaacctagctgaagaagctaagcttgctagagaagaaattaagcctacaagccatgccgtcctcagtatctgcaagtcacttgttgccggaggtgtcgccggaggcgtgtcacgaactgctgtggctccactagaacggctgaagatattgctgcaggttcaaaatccacatagcattaaatacaatggcaccattcaaggcttgaaatatatctggagaactgaagggttcaaaggactgtttaagggcaacggcaccaactgcgcacgcattgtcccaaactccgcagtcaagttcttcagctatgagcaagcttccaagggtatattatatttataccggcaacaaactggaaatgaggatgctgagctcactccactattacgtcttggagctggagcttgtgctggcataattgccatgtctgcaacttacccgatggacatggtgcgaggaagaatcactgtgcagacagagaagtctccttatcaatacagaggaatgttccatgcnttgtcaactgtgcttcgtgaggaaggtccacgtgctttgtataaaggatggactccttctgtcataggagttgttccatatgtggggcttaattttgctgtatatgagtctttaaaagactggttgatcaaaacaaaaccattnggtcttgttgatgatgancttgntgttgttacaaggctggcatgtggagctgctgcaggaacagttggacaaactgttgcctaccctcttgatgttattcgcagaaggatgcagatggtggggtggaatcatgctgcatctattgttgctggtgatgggaggagcaaggttcccctcgaatatactggaatgattgatgctttcaggaaaactgtaaagtatgagggtgtcagagccttgtacaagggtttagtgcccaattcagtgaaggttgttccttcaatatctattgcttttgtggcatatgagcaagtgaaggacctattgggagttgagatcagaatatctgactaatgaagagaagctccagtatttttttcatgcatatgataattttgtaggcaaggatacaanggttacaataacatggnggttncatagtctagatggagaatttagagtcctgttctagcctgtgtttagaacttccttactgtatctgcttattgctatcttagtgttgtcaataagaaattatcaagaatagtctaatgaataatttgagtgcccatgttagtgagagaatacaagtattcatgtgc

SEQ ID NO: 4707 - DNA, 1695 bp, Brassica napus
gaaagagaagagaagtagatttctctctctctctctcgacaagtgctttgatctctcttctcgacaatctcaaaacggagatttctgctagggttctgggtgcgtcgttgagagatcgaagaaacgtctgaagagatcatttgagatcgtaatcgtaatcgtagctgagtgatttcgatttctgtgtatcgatggcatcagaggatgtgaagagcaccgagtcggcagctgtatcaacgatcgtgaacctggcggaggaagcgaagttggcgagagaaggagtcaaagctccgagccatgctgtcctcagcatctgcaagtctctcttcgccggtggcgtcgctggtggagtgtcacgaactgcagttgcacctctggaaaggatgaagatattgcttcaggtccaaaatccacataacataaagtatagtgggacagtccaaggattgaagtatatttggagaaccgagggggttcgtggactgttcaaaggaaacggcaccaactgtgctcgtattgttcctaactcggctgtcaaatttttcagctatgagcaagcttcaaagggtatactttacatgtatcgtcagcagacaggaaatgagaatgcacaactcactcctgttttacggcttggagctggtgcaactgctggaataatagccatgtctgcaacatacccaatggatatggttcgtggaaggctaactgtccagactgcaaactctccttatcaatatagaggaattgcacatgctttatcaactgtcctgagagaggaaggtccaagggccctgtaccgtggttggcttccatcagttattggagttgttccatatgtgggcttgaactttgcggtctatgagtcccttaaggactggctagtcaaagacaatccatttggactagtggagaacaatgagctgaccatcataacgagactctcgtgcggtgctatagctggaactgttggtcaaacaattgcatatccactggatgtgattcgtaggagaatgcaaatggttgggtggaaagatgcttcctctgttgttacaggcgaggggagaagcaagcttgaatacaccggcatggttgatgcatttaggaagacagttcgtcatgaaggctttggagctttgtacaagggtttggtccccaactcagtgaaggttgtaccatcaattgcgattgcatttgtgacatatgagatggtgaaagatgttttaggagtggagtttaggatatcagactaagtctatttgatggtatctacaagaagagagagagagagatgacacttctatttttgtagcggatgagacagaagagaagttcaacattttaggggcttttatttgaatctcctttcagcatccttggaagggataaaaggctatagagctttagccaaacttctttttttttttttctttagatttgagttttcttctgaatcaaaataagccaagaggccaactatgaaaaacctatttggtactggagcttgtgttttacaggttttggttgggtcttttggtattgagttatcacttctattggtaacttgtggattagtttgaataattaaattcatgctgtgtgctgctagtcggtgtttcatgttctctttgtgtatgcattgtggaacagacaacaaacttgttttgttgtacctcaagattactccatgcacca

SEQ ID NO: 4708 - DNA, 1189 bp, Cirsium arvense
ttcccgttaattcctcacaacagttgagatcgccggaggatactaacgacggcgaatctacctgaattttggctagggtttcggtcaatttcatttcatttcattatatcgtgtttagaactccgttgttgacatggcgtcggaggacgtagtagggaagacgagtgctacgatcgctaatatcgctgaagaagcaaagattgcgagtgaaggtgtcaaggctccgagtcgtcaaactttacttggaatctgcaaatctctcgtcgccggtggcgttgccggtggagtatcacgtactgctgttgctcctctagaacgaatgaaaattcttctccaggttcaaaatccgcatgcaatcaaatacaatggaaccatccagggactaaaatatatatggagaacagagggtttgcggggaatgtttaaaggcaatggtaccaactgtgctcgcattgttccaaactctgctgtgaagttctttagctatgaggaggcatccaagggaatcctgtggctctatcggcagcaacctggaaatgaggatgctgaactcacccctctcttacgccttggagctggtgcttgtgctggaataattgccatgtcagctacctatccaatggacttggttcgagggcggcttactgtccagactgataaatctcctagccagtatagaggaattgctcacgctcttagaacggtgctccgtgaagaaggcccgcgagcattatacaaaggatggcttccttctgtgattggtgtggtaccatacgttgggcttaattttgcggtatatgaatctttaaaagattggttggtgaaatcacgaccatttggattagtcgaggacactgagttgagtgtgacaacaaaacttgcatgtggggctgtggctggaaccattggccaaacggttgcatatccgcttgatgttatacggagaagaatgcaaatggttgggtggaaggatgcagcttcggttgttaccgggggcggaaagtcggcagttgaatacacgggaatgattgatgcattcaggaaaaccgttcgttatgagggcgttggtgctttatacaagggtttggtccctaactcggtgaaggtggttccatcgatagccattgcatttgtgacgtacgaggtggttaaggacgtactgaaggtagaaatgaggatatctgattaa

SEQ ID NO: 4709 - DNA, 1643 bp, Raphanus sativus
  misc_feature (44)..(45): n is a, c, g, or t
  misc_feature (48)..(50): n is a, c, g, or t
  misc_feature (84)..(84): n is a, c, g, or t
  misc_feature (87)..(87): n is a, c, g, or t
  misc_feature (92)..(92): n is a, c, g, or t
  misc_feature (94)..(94): n is a, c, g, or t
  misc_feature (111)..(111): n is a, c, g, or t
  misc_feature (137)..(137): n is a, c, g, or t
  misc_feature (144)..(144): n is a, c, g, or t
  misc_feature (146)..(146): n is a, c, g, or t
  misc_feature (148)..(149): n is a, c, g, or t
  misc_feature (152)..(152): n is a, c, g, or t
  misc_feature (159)..(159): n is a, c, g, or t
  misc_feature (163)..(166): n is a, c, g, or t
  misc_feature (168)..(168): n is a, c, g, or t
  misc_feature (174)..(175): n is a, c, g, or t
  misc_feature (177)..(177): n is a, c, g, or t
  misc_feature (182)..(182): n is a, c, g, or t
  misc_feature (185)..(186): n is a, c, g, or t
  misc_feature (189)..(189): n is a, c, g, or t
  misc_feature (193)..(193): n is a, c, g, or t
  misc_feature (415)..(415): n is a, c, g, or t
  misc_feature (484)..(484): n is a, c, g, or t
  misc_feature (511)..(511): n is a, c, g, or t
  misc_feature (514)..(514): n is a, c, g, or t
  misc_feature (517)..(517): n is a, c, g, or t
  misc_feature (547)..(547): n is a, c, g, or t
  misc_feature (550)..(550): n is a, c, g, or t
  misc_feature (910)..(910): n is a, c, g, or t
  misc_feature (1501)..(1501): n is a, c, g, or t
ggaggttgttgtctcttggcgttttataatcgccgccggtgganngannnaagagaagtgcgttcgttcgatctctcttctcantanaatcntnaacggagatttctgtantagggttttcgtcgagagatcgaagntcgtgtnananntcnaagatcntaannnngnagtganngngattnctnnctntctntcttaataggatggcatcagaggatgtgaaaagcacggaatcggcagctgtttcgacgatcgtaaacctggcggaggaagcgaattggcgagagaaggagtcaaagctccgagctatgctgtcctcagcatctgcaagtctctcttcgccggtggcgtcgctggtggagtgtcacgaactgcagttgcacctctggaaaggatgaagatattgcttcaggtncaaaatccacataacataaagtatagtgggacagtccaagggttgaagtatatttggagaaccgagggncttcgtggactgttcaaaggaaacggnacnaantgtgctcgtattgttcctaactccgctgtnaantttttcagctatgagcaagcttctaagggtatactgtatatgtatcgccagcagacaggaaatgagaatgcgcaactcactcctgttttacggcttggagctggtgcaactgctggaataatagccatgtctgcaacataccctatggatatggttcgtggaaggctaactgtccagactgcaaactctccttatcaatatagaggaattgctcatgctttgtcaactgtcctgcgagaggaaggtccacgtgccttgtaccgtggttggcttccatcagtcattggagttgttccatatgtgggtttgaactttgcggtctatgagtctctaaaggactggctagtcaaagacaatccnttcggactagtggagaacaacgagctgaccattataacgagactctcatgtggtgctatagctggaacagttggtcaaaccattgcttatccgctcgatgtgattcgtaggagaatgcaaatggtggggtggaaagatgcttcctctgttgttacaggcgaggggagaagcaagcttgaatacaacggtatggttgatgcatttaggaagacagttcgtcatgaaggctttggagctttgtacaagggtttggtccccaactcagtgaaggttgtaccatcaattgcgattgcatttgtgacatatgagatggtgaaagacgttttaggagtggagtttaggatatcagactgagtccatttgatgatatcttcagagagagagagagagagagaggacacttctatttttgtagccagaggagacagaagagaagtacaacattttagggtcttttatttgatctcctttcagcatccatggaagagataaaaggctatagagctttagccaaacttctatttttttttctttctacttatagattgagttttcttctgaatcaaaataagccaagaggccaactatatnaaacctatttggtactggagcttgtgtgttttacaagtttttgttgggtcttttggtattaagttattattattgttatcactcttattggtactttgtggattagtttgaataattatgctgtttatgtagttttcttaca

SEQ ID NO: 4710 - DNA, 1701 bp, Tropaeolum majus
ataaaacctaataacgtcgtaataataaatagacacctcaacataacaagccaaaccatttcggcttccttcagtcctccgtgccgtaagagcccccagcgcctccacgctttgatcgctccggcaaatgcgagcaccgtctctcttgtagtcgccggacagaaacttgctcgatcggaggaggttgcgagattcggtggattttggcagagaggccgccgagggttttgactaggttcacttaatggcgtcggaagatgtgaagcctagcgaggcagcagttacaacaatcgtgaatctcgcagaggaagcaaagctagcaagggagggtgtagaagcgcctagtcgtgcgttcctcactatctgcaagtctctcgtcgccggaggagtggctggtggagtgtctcgctctgctgttgctcccttagaaagattgaaaattttgcttcaggttcagaatcctcatagcataaaatacaatggaaccattcagggattgaaatatatttggagaacagaaggtttaagagggatgtttaagggaaatggtactaattgtgctcgcatagtcccaaactcagcagtgaagtttttcagttacgaggaagcatcaaagggtatactgtggctctatcggcagcaaactggaaatgaggatgctcagctcacccctgttctacgccttggagctggtgcatgtgctggaattattgccatgtcggctacttacccaatggatttggtccgtggcaggttgactgtgcagacggctaattccccacgccagtatagtggaatcttcaatgctctttctacagtgctccgagaagaaggttttcgggcattgtacaaaggttggcttccatctgttataggagtggtaccatacgtgggtctcaactttgctgtttatgaatctctgaaagattggttggttaaaagtaaaccatttgggataacagaggacaatgagttgagtgtgacaacaaggcttggatgtggagccgttgcaggaactttcgggcaaactgttgcttatccgcttgatgtaattcgacggagaatgcagatggtaggttggaaaggtgctgcgtcagttgttactggtgatgggagaagcacatcatcccttcaatataccggcatggtcgatgccttcaagaaaacagttcgtcacgagggctttggtgctttgtacaagggtttagttcccaactcagtcaaggtggttccatccatcgcaatagcatttgtcacgtacgagatggtgaaggatgttcttggagtcgagttaaagatatctgactgaagaatgtagaaaaccttgaaggttttatttatctatatttatttggaagcggaaagtaatacacggacggacaaaggcatacttacgtagcgaggtatttagaaaatttataacttttgaccagtgttgatattctgttcccacatatataagagaaaaaaaaactagtttatagttgaaagttatgttgtggcaataagttagcacttagttatttagtgcaccttaatttttattttatttatccccagtattcatgtaattttgttttgtgactcaagattctgtatttgtgaaaccgttttagtttgggagaatttcttgtaggatttgagagaatgtggaactggaactattacacatttattgattgataaaagtgcagtttttgt

SEQ ID NO: 4711 - DNA, 1504 bp, Amsonia hubrichtii
ccgcacgcagaggctgaacaaacatgttcgctttttgatcattgttaaggctgccgattgatcgtggctgggaatagagacagattcggatcgtcgtcgacttatggttccgacgagtattcggagactatttgatttttcttttttgtttctatggcttcggaagatgtcaagactagcgaatcggcagtttcgaagattgtgaatctagctgaagaagccaagcttgctagagaagaaattaagcctgctagccatgctgtactcagtatctgcaagtctcttgtagctggtggtgttgctggtggcgtatcgcgtactgctgttgccccattggaacgacttaaaatattgctgcaggttcaaaatccacataacataaagtataatgggacagttcaaggcttgaaatatatttggagaaccgagggtttcaggggattgttcaaaggcaatggtactaattgtgctcgcattgtcccaaattcagcagtaaagttcttcagctatgagcaagcttcgaagggtatattatcgctataccagcagcaaactggcaatgaggatgctgaacttactcctctattgcggcttggagctggtgcttgtgctggaataattgccatgtctgcaacttacccaatggacatggtgcggggtagactgactgtgcagacagagaagtctccttatcagtacaggggaatgttccatgctttgtccactgttcttcgtgaggaaggtccaagggcgttgtataagggttggcttccttctgttataggagtgattccatatgtcggtctcaattttgctgtgtacgaatcacttaaggattggttggttaagtctaggccttttgggcttgttgaagacacagagttgggtgttacaacaaggcttgcatgcggggctgttgctgggactgtgggacaaactgttgcttaccctcttgatgtcattcgaagaagaatgcagatggtgggatggaaagatgcttcttcaattgtcactggtgatgggaggagcaaagcacctctggaatacaatggcatggttgatactttcaggaaaactgtaaggcatgagggatttagagctttgtacaagggtttggtccccaattccgtgaaggttgtcccgtcaatagctattgcttttgtgacatatgagcaagtgaaggacttacttggagtggagattagaatatcagactgatgcaggaaggcccctatacattttttgatggcgggtgagattttgtaggcaaggagaagagagatcgtagcatggtgcctagtatgtgggatggcataagcttcaagtcttgcatgcaaacttgtgtatcgtcactattgtctcacgaaatgctagcctaatggtattgcatgggttccgtaaatgctctcaaatttgtgacaaattaactatttttctaatatgatatgatacatatacagttcaattcttgtattacatcataagatattataaagtttgaagt

SEQ ID NO: 4712 - DNA, 1462 bp, Chelidonium majus
aaatgctataaagcgccggaaagaaaatcgatcgccggaatatataccggccttgaaaacagagatcttcaatctccttctttcttagggttccagagagaggttttccttatagttttttctagggtttttaatggcatcagaggatgttgttgggaaatcaactggtgagacggcggtttcgacgatcgttaatctagctgaagaggcaaagttagcgagtgaaggtgttaaggctcctgctggtcacgcgcttcttagtgtctgcaagtctctcgttgccggaggagttgccggaggagtatcacgtactgctgttgctccattggaacgtctgaaaatattgctccaggttcaaaatcctcacagtataaagtacaacggaacgattgaaggtctgaagtatatttggagaactgagggttttcgagggctcttcaaaggcaatggtacaaactgtgcacgtattgtcccaaactccgcagtcaagttctttagctacgaagaagcatccaggggaattttatggatttatcgtcgacaatctggcaacgaagatgcaactcttactcctcttctacgccttggagctggtgcatgtgctggaataattgccatgtcagcaacttaccccatggatatggtacgagggaggataactgtccagacagagagttccccttaccagtacaggggtatgtaccatgccttctcaactattcttcgggaagaaggaccacgtgctttatatagaggctggcttccttctgtcattggagttgtgccatatgttggcctcaactttgccgtctatgaatcccttaaagattggctgatcaagtccaagtctgaggactcctctgagttgggcatcacgacaaggctcatgtgcggagctgctgcaggaactgttggccagacagtagcgtaccctcttgatgtcattcgccgaaggatgcagatggtgggctggaataatgcttcttcaattgtcactggtggtgggtcgagcaaagcgccacttgagtatactggcatggttgatgctttccggaaaacagttcgaaatgagggttttggagcattatataaaggcttagtacctaactcagtgaaggtggttccatccatagctattgcattcgtgacttacgagatggtaaaggatgttcttggagttgagatgaggatatcagactgaacttgattgaatggatggatcattgagagggaggacatctattgactttatgatgctctactctatttttgtaggtgaaagggaagagaaaaaggtagagtagggggggatggggtaagggtgagagtatttatctttcactgagaaagaaatgaagttgctaatattgttagttattcgtcttctcagtgggaacctaaacctatattttagcttctcatttgtatgcagtcaaataaggggttttgcataaaagggatg

SEQ ID NO: 4713 - DNA, 1160 bp, Cleome gynandra
gatggcatcggaggatgtgaagacaagcgaatctgcggtttcgacgatcgtgaatctggcggaggaggcgaagcttgcgagggagggcgtcaaggctccgagctacgccgttctcagtatctgcaagtctctcgtcgccggtggagttgccggtggagtgtcaaggactgcggtggctcctctggagagactgaagattttacttcaggttcaaaatccccacaatataaaatacaatggaacaattcaaggattgaagtatatatggagaactgaagggtttcgtggattgttcaaaggaaatggtactaactgtgctcgcattgttccaaactcagcagtcaagttcttcagctatgagcaggcttcaaaggggatactctacctctatcaacagcaaacagggaatgatgaagctgagcttactcctcttttacgccttggagctggagcttgtgctggaatagttgccatgtctgctacttacccgatggacatggtgcgggggaggcttactgtccagacagataaatctccttatcagtacaggggaatggtccatgcattgtcaactgtgctgcgtgaggaaggaccaagagctttgtacagaggctggcttccatctgttattggagttattccctatgtaggccttaattttgcagtctatgaatctcttaaagattggctggtaaaaacaagaccttttgggattgttgacgactcgggtttgacggtaacaacaaggcttgcatgtggagccattgctggaacaatcggtcaaaccattgcttaccctcttgatgttgttcgaagaagaatgcaaatggttggatggaaagaggcttcctcggttatcacaggcgatgggagagccaaagctccccttgaatattctggaatgattgatgcatttaggaaaactgttcgacacgagggtgttggagcactgtacaagggtctggtccctaactccgtcaaggttgtcccatccatagcaattgcctttgtgacttatgagaaggtgaaggaccttcttggcgttgagttcagaatatcagattgaaaaggttctcgtcagcccctccatattcatccttgtttgacgtctctgagcatatattagggttttcttttactgtgtacgcctgaccaaactg

SEQ ID NO: 4714 - DNA, 1536 bp, Euphorbia peplus
tattccgtctccggcgagaaaatatcagctgtaatcggaaaatactctcaatattcgccggaaacttgagatattgctccggcgatggcatcggaggacgtgaagacaggcgagtcagctgtatcgactatcgtgaatctggcggaggaggctaagttagcgagagaaggagttaaggctccgagtcatgcgatttttagtatttgcaagtctttgattgccggcggagtcgccggaggagtgtcacgtactgctgttgctcccttagaaagattaaaaattctcctccaggttcagaatccacacaatataaaatacaatggtacaattcagggattgaaatacatatggagaacagagggtttcagaggattgtttaaaggcaatggcaccaattgtgctcgcattgttccaaattcagcagtcaaattctttagttatgaggaagcatccaagggtatactgtggttttacagacagaagactggaaatgatgatgctcagcttactcctgttttacgacttggagctggcgcatgcgctggaatcattgccatgtcagctacttaccctatggacatggttaggggtcggctaactgttcagacagaaaactctccacgccagtacagaggaatagctcatgctctatcgacagttttcaaggaagaaggtccccgtgctttatataagggatggctgccttctgtcataggagttgtaccatatgtgggtctaaactttgcagtatatgaatcactgaaagactatttgctcaagcacaatacttttggactagttcaagacaatgagttgagcgtgacaacaaggcttgcatgtggagctgcagctggaaccgttggccagacagttgcctaccctctggatgttatcagaagaagaatgcaaatggttggctggaaggatgctgcttcggttgtcaccggtgaaggaaaatctaaagcacctcttcagtataatggtatggttgataccttcaagaaaacagttcggcacgaggggtttggagcattgtacaagggtttggtccccaattcagtgaaggtggttccatccatagcaatcgcatttgtaacatacgagatggtgaaggatgttctcggagtcgaagtaaggatatctgactgaaccaagcaaccaaaagttcttcgaggtatgaacttttgaatagagcttttgcaaagagaagaaaggaataaaaaatatttaggagagggtcaagcggttttgagtaatcatctatctaatcttggagctttattagcaaggaaaaattatttagaagccccaaaatatttaacctttttgtgttaatatttattttctccactctcatatgatatttttctcgttctcttgtgtaaaaacccattttagcttttagatttatgattcttatggcaataaggtaatttgtgaggagatgaaacactttggtgcatccaaaataggttttttagagtttctatctgtgatgattgattactagtttattgaataaaatagagtatgatg

SEQ ID NO: 4715 - DNA, 1675 bp, Tropaeolum majus
tagacacctcaacataacaagccaaaccatttcggcttccttcagtcctccgtgccgtaagagcccccagcgcctccacgctttgatcgctccggcaaatgcgagcaccgtctctcttgtagtcgccggacagaaacttgctcgatcggaggaggttgcgagattcggtggattttggcagagaggccgccgagggttttgactaggttcacttaatggcgtcggaagatgtgaagcctagcgaggcagcagttacaacaatcgtgaatctcgcagaggaagcaaagctagcaagggagggtgtagaagcgcctagtcgtgcgttcctcactatctgcaagtctctcgtcgccggaggagtggctggtggagtgtctcgctctgctgttgctcccttagaaagattgaaaattttgcttcaggttcagaatcctcatagcataaaatacaatggaaccattcagggattgaaatatatttggagaacagaaggtttaagagggatgtttaagggaaatggtactaattgtgctcgcatagtcccaaactcagcagtgaagtttttcagttacgaggaagcatcaaagggtatactgtggctctatcggcagcaaactggaaatgaggatgctcagctcacccctgttctacgccttggagctggtgcatgtgctggaattattgccatgtcggctacttacccaatggatttggtccgtggcaggttgactgtgcagacggctaattccccacgccagtatagtggaatcttcaatgctctttctacagtgctccgagaagaaggttttcgggcattgtacaaaggttggcttccatctgttataggagtggtaccatacgtgggtctcaactttgctgtttatgaatctctgaaagattggttggttaaaagtaaaccatttgggataacagaggacaatgagttgagtgtgacaacaaggcttggatgtggagccgttgcaggaactttcgggcaaactgttgcttatccgcttgatgtaattcgacggagaatgcagatggtaggttggaaaggtgctgcgtcagttgttactggtgatgggagaagcacatcatcccttcaatataccggcatggtcgatgccttcaagaaaacagttcgtcacgagggctttggtgctttgtacaagggtttagttcccaactcagtcaaggtggttccatccatcgcaatagcatttgtcacgtacgagatggtgaaggatgttcttggagtcgagttaaagatatctgactgaagaatgtagaaaaccttgaaggttttatttatctatatttatttggaagcggaaagtaatacacggacggacaaaggcatacttacgtagcgaggtatttagaaaatttataacttttgaccagtgttgatattctgttcccacatatataagagaaaaaaaaactagtttatagttgaaagttatgttgtggcaataagttagcacttagttatttagtgcaccttaatttttattttatttatccccagtattcatgtaattttgttttgtgactcaagattctgtatttgtgaaaccgttttagtttgggagaatttcttgtaggatttgagagaatgtggaactggaactattacacatttattgattgataaaagtgcagtttttgttgg

SEQ ID NO: 4716 - DNA, 1574 bp, Vinca minor
ccaatcccaaacccgatgctctaataattacggcacccaactttcattaaacgccgttactcacagtcacagtcacacagtcacagtctctctatccgccatgttcgctttctgattactcttcaggcttccgatcgaccgtctccgaggatctatagactgactcggatcgtctccggcgattattttaattttttctggtttcaatggcttcggaagatgtcaaagctagcgaatcggcagtatcgaagattgtaaatctagctgaagaggctaagcttgctagagaagaaattaagcctactagtcaaactgtgctcagtatatgcaaatctcttgtagctggcggcgttgctggtggcgtatcgcgtactgctgtggccccattggaacgacttaagatattgttgcaggtccaaaatccgcataacataaagtataatggtacagttcaaggcttgaaatacatttggagaactgagggattcaggggattgttcaaaggcaatggcactaattgtgctcgcattgtcccaaattcagcagtaaagttctttagttacgagcaagcttcaaagtgtatcttatggctataccagcagcaaactggcaatgaggatgctgaacttactcctctattgcggcttggagctggtgcttgtgctggaataattgccatgtctgcaacttacccattggacatggttcgtggaagactaactgtacagacagagaagtctccttatcagtacaggggaatgtttcatgctttatccaccgttcttcgtgaggaaggtacaagggcgttatataagggctggcttccttctgttataggagttattccatatgttggtcttaattttgctgtatacgaatcacttaaggattggttggttaaagctaggccttttgggctcgctgaagaccaagagttgggtgttacaacacggcttgcatgcggcgctgttgctggaactatgggacaaactgttgcttaccctcttgatgtcatccggaggaggatgcagatggtggggtggaaagatgctgatgccattgttactggtgatgggaggatcaaagcacctctgcaatacaatggaatggttgatgcgttcaggacaactgtgaggcatgaaggattcagagctctgtacaagggtttggtacccaattccgtgaaggtcgtcccatcaatagctattgcattcgtgacatatgagcaagtgaaggacttacttggcgttgagattagaatatcagactgatgtggaacctctgctatattttttttttattgcatgcgagattttgtaggcaaggagaagaaatatcatagtagcatggttgccgtgtcactctctgcccgagagagaaaaattagagacctcatgtaccctgtgtttatatgatgcttctcggttaagtaatttatctctgtgatgccttagcttctagatcgcaatttaaattatgtcccaataatgactttgcagaagaaaattgtaataagtgcttgattgtttccactgattatttgataagcgtgagccagtggatctcttttatgt

SEQ ID NO: 4717 - DNA, 2904 bp, Brassica rapa
ttttggcgttttattatcatcgccgccgggacagtgaaagagaagagaagtagatttctctctctctcgacaagtgctttgatctctcttctcctcaatctcaaaacgaagatttctgctagggttctgggtgcgtcgttgagagatcgaagatcgttagaaaacgtctgaagagatcatttgagatcgtaatcgtaatcgtagctgagtgtttcgatttctgtgtatcgatggcatcagaggatgtgaagagcaccgaatcggcagctgtatcaacgatcgtaaacctggcggaggaagcgaagttggcgagagaaggagtcaaagctccgagccatgctgtcctcagcatctgcaagtctctcttcgccggtggcgtcgctggtggagtgtcacgaactgcagttgcacctctggaaaggatgaagatattgcttcaggtccaaaatccacataacataaagtatagtgggacagtgcaaggattgaagtatatttggagaaccgagggggttcgtggactgttcaaaggaaacggcaccaactgtgctcgtattgttcctaactcggctgtcaaatttttcagctatgagcaagcttcaaggggtatactgtacatgtatcgtcagcagacaggaaatgagaatgcacaactcactcctgttttacggcttggagctggtgcaactgctggaataatagccatgtctgcaacgtacccaatggatatggttcgtggaaggctaactgtccagactgcaaactctccttatcaatatagaggaattgcacatgctttatcaactgtcctgagagaggaaggtccaagggccctgtaccgtggttggcttccatcagttattggagttgttccatatgtgggcttgaactttgcggtctatgagtcccttaaggactggctagtcaaagacaatccatttggactagtggagaacaatgagctgaccatcataacgagactctcgtgcggtgctatagctggaactgttggtcaaacaattgcatatccactggatgtgattcgtaggagaatgcaaatggttgggtggaaagatgcttcctctgttgttacaggcgaggggagaagcaagcttgaatataccggcatggttgatgcatttaggaagacagttcgtcatgaaggctttggagctttgtacaagggtttggtccccaactcagtgaaggttgtaccatcaattgcgattgcatttgtgacatatgagatggtgaaagatgttttaggagtggagtttaggatatcagactaagtctatttgatggtatctacaagaagagagagagagagatgacacttctatttttgtagcggatgagacagaagagaagttcgacattttaggggcttttatttgaatctcctttcagcatccttggaagggataaaaggctatagagctttagccaaacttctattttttttttctttagattgagttttcttctgaatcaaaataagccaagaggccaactataaaaaacctatttggtactggagcttgtgttttacaggtttttgttgggtcttttggtattgagttatcacttttattggtaacttgtggattagtttgaataattaagttcatgttgtgtgctgctagtcggtgtttcatgttctctttgtgtatgcattgtgccactgtgggatagacaacaaacatggtttattgtacctcaagattactccatgcgctatggttgtgtagcaaaatcatttctctatatccattacaagaaaacaaatacgtggagaaccactaactctaagatactatttataaataaatagtattcaaaatggttgaatattggatcacaatcaaatgcttaaagcatgacaaaaaataaaatcatatgcttaaaagtaaaaataaggaggataaaaagaatacagagtggtcatttgtgaaactgagactttggcgacgtacagcgcttgaaacgtcgatgaaaatgatacacatccatcatcattactatgagtgcaatgtaatcctgcaatttaaataattttatttgtcactaatcaaagcttattaacactaatcattaattgaatgaacgtaccatttaagcattgtgatggtgcatttagccatctgtttatcaagcgtctgtaatgtaacgccaccgcaacagagactaatccccactgtaacaatcgtacgccttcccacagccaaccccaccttcgtcttaactgtcactttcaccaccaacgtcttactcttcatctccgctcgaagcctcttaaccgtcagatcatccacctgctgtcccttcacgttgatcggaacgatcacgaccgtccgattccccggcttctccacaaagcctttgactttcattgaccctaagctcgtctcaaaatcgccgtctcctacagtcaccgccacgtcagcgtctccgtagtagtaccttagcttcccgttcgggtttctgaagtcgagcttcgccgtggtcttcgccgtgagttgcgataatccgtcgtcggctttcccgcgggaaaagttgaagtccgtgacgcggaaggaggcgaggcgtacgacggggagtctcgggctgtacctgaggaagaagacggagacggtgaggaccaagaggaggatgacgattgcgacggtgatgcagcagctgcagcagaagacgcggcagcgactccatcgtctcttcttctccgggtaaaaagacggcgggatcatatgcttaggcgggcggcgacgtgatgatgtgttaggagtttcaagaggcgcgtgaggctcacggtagccaggtggtttctgaagcaccggttttagaaacttctccgcttccatctcttcgttgccggtagggcttgttgtgtggtctctgttcttc

SEQ ID NO: 4718 - DNA, 1490 bp, Centaurea maculosa
cggcgaatctagctcaatttccctagggttccggtgaaattccattccatcatatacatatacatacatatatctatatctatatctatatctatatatacatatatcgtgtttaggtatacgcagctgattatggcgtcggaggacgtggtagggaagacgagcgctacgatcgctaacatcgctgaagaagcgaagattgcgagtgaaggtgtgaaggctccgagtcgtcagactttgctcggaatctgcaaatcgctcgtcgccggtggcgttgccggtggagtatcacgtactgctgttgctcctttagaacgaatgaaaattcttctccaggttcaaaatccgcatgcaataaagtacaatggaaccatccaggggctaaaatacatatggagaacagagggtttgcgaggaatgtttaaaggcaatgggaccaactgtgctcgaattgtcccaaactccgctgtcaagttctttagctatgaagaggcatccaagggaatcctgtggctctatcgacagcaacctggaaatgaggatgctgaactcagtcctctattacgccttggagctggtgcttgtgccggaataattgccatgtcagctacttatccaatggacttggttcgagggcggcttactgttcagactgataaatctcctagtcagtatagaggaattgctcacgctcttagaacagtactccgtgaagaaggcccacgtgcgttatacaaaggatggcttccttctgtgattggtgtggtaccatacgtggggcttaatttcgcggtatacgaatctttaaaagattggttggtgaaaacacggccgttcggattagtcaaagacaccgagttaagcgtgacaacaaagcttgcatgcggggctgcggctggaaccgttggccaaacggttgcgtatccgctcgatgtgatacgcagaagaatgcaaatggttgggtggaaagatgcagcttcggttgtcacgggggacggcaagtcggcacttgaatacaccggaatgattgatgcatttaggaaaaccgttcgatacgagggctttggcgctttgtacaagggtttggtcccgaactcggtgaaggtggtcccatcgatagccattgcatttgtgacgtacgaggtggttaaggacgtactgaaggtagaaatgaggatatctgattaaacaaccgtttgttgaacgctgggcgttattagtttgcgtgcaaaaaggggtagaaaattttgttctcgtatctctttgatttatcgttggctttatgataacaaagagatttatagaactaggtcatgttgatatagtcgacccctatcttcttatacacacctagagcacgtagtagttcgtgttttaagttgcttgttattcgtatgtgacaacattaaacttaataaggataggctcagagagtcaaggctcccagtttccgaactgggaactgaaaatcttatttgatcagtatttta

SEQ ID NO: 4719 - DNA, 1670 bp, Brassica rapa
  misc_feature (16)..(16): n is a, c, g, or t
  misc_feature (79)..(80): n is a, c, g, or t
  misc_feature (94)..(94): n is a, c, g, or t
  misc_feature (236)..(236): n is a, c, g, or t
  misc_feature (260)..(260): n is a, c, g, or t
  misc_feature (424)..(424): n is a, c, g, or t
atcatcgccgccgggncagtgaaagagaagagaagtagatttctctctctctcgacaagtgctttgatctctcttctcnncaatctcaaaacgnagatttctgctagggttctgggtgcgtcgttgagagatcgaagaaacgtctgaagagatcatttgagatcgtaatcgtaatcgtagctgagtgtttcgatttctgtgtatcgatggcatcagaggatgtgaagagcaccgantcggcagctgtatcaacgatcgtnaacctggcggaggaagcgaagttggcgagagaaggagtcaaagctccgagccatgctgtcctcagcatctgcaagtctctcttcgccggtggcgtcgctggtggagtgtcacgaactgcagttgcacctctggaaaggatgaagatattgcttcaggtccaaantccacataacataaagtatagtgggacagtgcaaggattgaagtatatttggagaaccgagggggttcgtggactgttcaaaggaaacggcaccaactgtgctcgtattgttcctaactcggctgtcaaatttttcagctatgagcaagcttcaaagggtatactgtacatgtatcgtcagcagacaggaaatgagaatgcacaactcactcctgttttacggcttggagctggtgcaactgctggaataatagccatgtctgcaacgtacccaatggatatggttcgtggaaggctaactgtccagactgcaaactctccttatcaatatagaggaattgcacatgctttatcaactgtcctgagagaggaaggtccaagggccctgtaccgtggttggcttccatcagttattggagttgttccatatgtgggcttgaactttgcggtctatgagtcccttaaggactggctagtcaaagacaatccatttggactagtggagaacaatgagctgaccatcataacgagactctcgtgcggtgctatagctggaactgttggtcaaacaattgcatatccactggatgtgattcgtaggagaatgcaaatggttgggtggaaagatgcttcctctgttgttacaggcgaggggagaagcaagcttgaatataccggcatggttgatgcatttaggaagacagttcgtcatgaaggctttggagctttgtacaagggtttggtccccaactcagtgaaggttgtaccatcaattgcgattgcatttgtgacatatgagatggtgaaagatgttttaggagtggagtttaggatatcagactaagtctatttgatggtatctacaagaagagagagagagagatgacacttctatttttgtagcggatgagacagaagagaagttcgacattttaggggcttttatttgaatctcctttcagcatccttggaagggataaaaggctatagagctttagccaaacttctattttttttttctttagattgagttttcttctgaatcaaaataagccaagaggccaactataaaaaacctatttggtactggagcttgtgttttacaggtttttgttgggtcttttggtattgagttatcacttttattggtaacttgtggattagtttgaataattaagttcatgttgtgtgctgctagtcggtgtttcaagggctctttgtgtatgcattgtgccactgtgggata

SEQ ID NO: 4720 - DNA, 1408 bp, Flaveria ramosissima
tcatttcatttcatttcacttttatttaattctattccttttagttttatacacacatccactgagatcgccggaggcccccttgcgacggcgaatctttatttaattccagtagggttccgcccatttctcacttccaatttctagggtttaggccgtgcacatggcgtcggaggatgtcgtagggaagaccagcgccaccatcgctaatctcgccgaagaagccaagatcgccagtgaaggcgttaaggctcccagccgtcacgctctgctcagcatctgcaagtctctcgttgccggcggcgtcgccggtggagtatcaagaactgctgttgctcctctagaacgattgaagattttgctccaggttcaaaatcctcatgcgatcaaatataatggtaccattcaggggttgaaatatatatggagaacagaaggttttcgtggactgtttaaaggaaatggcactaattgtgctcgtattgttccaaactctgctgtcaagttctttagctatgaagaagcatcaaagggaatcttgtggctctaccgacaacaacctggaaatgaggatgctgaactcacccctgtcttgcgccttggagctggtgcttgtgctggaataatcgccatgtcagctacctacccgatggatttggttcgaggccggcttactgtgcagactgataaatctccaagccaataccgaggaattgcacatgctcttagaaccgtactacgtgaagaaggtccacgtgcattgtataaagggtggcttccttctgtcattggtgttataccatacgtgggtcttaattttgctgtgtatgaatctttaaaagattggttgattaaatcaaaaccatttgggcttgccgaggacgctgagttgagtgtgacaacaaagcttgcatgtggggctgcagctggaaccgtgggtcaaactgttgcttatcctcttgatgtcatccgaagaagaatgcaaatggttggttggaaacatgcagcttcagttgtcactgcagatgggaaatcagcacttgagtacaatggtatggttgatgctttcaggaaaaccgttcgttatgaaggatttggagccttgtataaaggcttggtccccaactcagttaaggtggttccttcaatagcaattgcgtttgtgtcgtacgaggtggttaaggatctacttggggtagagatgaggatatctgattgaaaagaacactctaattataataataatgttgttgaatgaatattatttttgcatgcagaagagaaagtaggaggtataactataagctaaggaggtcataatttttttgttgtcttctctctttcagttgtctttcagttactgggagatttagaagttagtgttgatatagagacccctatgcatacc

SEQ ID NO: 4721 - DNA, 1725 bp, Trigonella foenum-graecum
actctccttcactcttactccagtattagtggtctctgtgagctctctctctctagaacattccgcagccaccactttctctttctagaaatgatcgtataatcaccggagcaattcaccggagcaattcaccgtcacctgaaatcggagatctctcaatctccgacgacctaaattactctatttttcttaatttattcacttctgattaggttagggttcatagattttatcataaattattgttaattttgattatggcttcggaagatgtgaagagtggagaatcagcggtgacgaagatcgtgaatttggcggaagaagcgaagcacgctagagaaggtgttgttaaagcgaagcctaactatgctattggtagcatctgcaaatctctcgtcgccggtggtgtcgctggaggagtatcacgaaccgcagttgctccgctcgagcgaatgaaaattttgcttcaggtccagaatcctcataacataaaatacagtggaacaatacaaggcctgaaatatatatggagaactgaaggattacgtggactgttcaagggaaatggtactaattgtgctagaattgtcccaaattctgctgtgaagttcttcagttatgagcaagcttctaaaggcatactgcatttgtataagcagcaaactggaaatgaggatgctcagctgactcctgttttacgtcttggagctggtgcatgtgctggaataattgctatgtctgcaacttatccgatggatatggtccgaggcaggataaccgttcagactgagaattccccttatcagtacagagggatgttccatgctttgagtactgtgctcagggaagaaggaccacgtgctttatataagggctggcttccttcagtaattggagtgattccttatgtaggtctcaactttgctgtctatgagtctctgaaagattatttgattaaatctaaaccatttggtctagcccaagattctgagctgagtgtgacaacacgccttgcttgtggtgctgctgccggaaccattggtcaaactgttgcttatcctcttgatgtcattcgtcgacgaatgcagatgaccggttggcacaatgctgcttctgttataactggggatggagtaggcaaagtcccacttgaatatactggaatggttgatgcatttaggaaaactgttcgccacgagggattcggtgcattatacaagggtctggtgcccaattccgttaaggtggtcccatccatagcacttgcgtttgtatcatatgagatggtgaaggacattttaggagtggagatcagaatatcagactaaagttggatagccccaatatcattgtttagctggtgtggttttctcctctttttttgataggcaaggggatgcagagatggcaacataaaattattttcttgtttttcatctcactgaggatgagtttagaactctagagttagtgtctataaatttattcccttgttcctatttgttttatttgcaaacgtgctgtagttttcagcttcttattcatatgccatgtcaataagtgttgtggaaaaacaatgcaatgacacatctgcctagctttctgcactaattaagaaagcatttttcttaatggaatttgatgtgcttgatatttgtattgcatgcccaccctactatatcctcagaaataatacgtttggaataaatgtgttaaatatttgcg

SEQ ID NO: 4722 - DNA, 1343 bp, Vinca minor
gtaagaaaaggacgaaatccaccactctctctcagtgtcccgctgtcgctgctttcttcgatcgccgccgtaccggaaagacgtaaaaaaggagaccgtacttaggttttcggtaaggttacacttcgattccgtcagtttagctgtttcatttttaggtatatattcagaagatatggcgtcggaggatgtggtagggaagagaagaggtgatagtgcggtgacgacgattgtgaatttggcggaggaagctaagattgctagcgaaggtgttaaagctccgagtaaactcgccgttcttagcatctgcaaatctctcgctgccggcggcatcgccggtggagtgtcacgtactgcagttgctccattagaacggttaaaaattttgctacaggtccaaaatccgcatagcataaaatacaatggcacagttcaaggcttgaattatatttggagaactgagggtctccggggattattcaaaggaaatggcactaattgtgctcgcattgttccaaattcagctgttaagttcttcagttatgaggaggcatccaagggtatcttatggctacataggagacaagcaggaaatgaggatgctgaacttactccacttctgcgccttggagctggagcatgtgctgggataattgctatgtctgcaacttacccaatggatatggtgcgaggtcggcttactgtccagacggagaattctcctacccagtacagaggaattttccatgctttgagaacagtttttgttgaagaagggcctcgtgcattatacaagggatgggttccttctgtaataggagtagtaccttatgttggcctgaactttgctgtatatgaatctttaaaagattatttggtcaaaaatagaccttttggactagagaaaaacactgagttgagtgtaacaacaaagctcgcgtgtggggctgctgctggaacagttggtcagacagtggcttatcctcttgacgtcatccgccggagaatgcagatggtgggctggaaagacgctgcttcagtagtcactggagatgggaagggcaaggcgccccttgaatatactggtatggtagatgcattcaggaaaacggtccgccatgagggatttggagctctgtataagggtttggtccccaattcagtgaaggtggttccatctatagcaattgcatttgtgacatatgaggttgtgaaagatattcttggagttgagatgagaatttctgattgaaacacccaggaccaggaggattatcatttgttgaaaagccatactaaatttctgagaattggagcagtagacaaggtaaccgttgggggtg

SEQ ID NO: 4723 - DNA, 1589 bp, Vaccinium corymbosum
catccgccgccgccacctgcgatcgtcggagagagaaatgcagactctctctcttccgtaatagccgtaaatcgtgatcgtgctctgggaaaaaatcaagatcggaccttgtttgattaattgatcattttgaccaagaaagggtttcgttcgatggcttcagaggatgtgaagacgagtgaatcggctgtttcgacgattgttaatctggctgaagaggctaagcttgctagagaaggagttaagccgagttatgctgtactcagtatctgcaagtctctcatcgccggtggagtcgctggaggcttgtcacgcactgctgtagcccccttggaacggttgaaaatattgctgcaggtacaaaatgcgcacaacattaagtacaatggtactgttcaaggcctgaagtatatatggagaacggagggccttaaaggttattcaaaggcaatggtacaaattgtgctcgtattgtaccgaactcagcggtcaagttcttcagctatgagcaagcttctaaggctatcttattgttttaccagcagcaaactggcaatgaagatgctcagctcactcctgtattacgcctaggagctggagcctgtgctggaataattgccatgtcggcaacttaccctatggacatggttcgtggcaggctgactgtacagacagataagtctccttatcagtacagaggaatgttccatgctttatcgactgtgctgcgggaggaaggcccacgtgctttgtacaagggctggcttccttctgttattggagttgttccatacgttggtctcaactttgctgtgtatgaatctttgaaggattggttgattaaaagcagaccctttggacttgttgaagattctgagctgagtgtgaccacaaggcttgcatgtggagctgcagcaggaactgttggccaaaccgttgcctaccctcttgatgtcattcgtcgaaggatgcaaatggtgggatggaacaatgctgcgtctgttatcacaggggatgggagtagcaaggctgcacttgaatataaaggcatgattgatacattcagaaaaactgttcggaatgagggttttagggcactgtacaagggtttggtccccaattcagtgaaggttgtcccatccatagctattgctttcgtgacctacgaacaggtgaaggacatcttaggagttgaggtaaggatatcggactgatgatgctggaaacactggtgtctgttcaacagatgcggtatttttgcagacaagggggaagagggggaggaagatatggatggtgacgacaatgacatcaaaggtgaagaaggtattgtgtatgtggaggactatattgaagggtatagagggaatagaaagagtaataaaatgagtaagtttagtagaatggggagaaagaaattgagacctaagaaaataggtagatactagatagaattcttcatctattttcgaaatacatatgctttaaactagtggtttgctaaattttgggcagatgaagtgtgctctaatttattttttgcgaaattgtactgttgtttgatgatccagcaacaatgatttttgtga

SEQ ID NO: 4724 - DNA, 1841 bp, Beta vulgaris
aaaaaataatgctactaaaaagttagtacagtcgtaccctagcaagcgcttcttcctcgcgctaattagcgccggaacgttgcaaccgtaaaaccaccatcttacgatccatattatttctgtatattttactctccaatttctttccctctctatatatgtatacacttctcctacaaactttctctgtttttcctcctctgataactacatgttcgattcttccgcgtaaaaaactctaattctctcgtcgagagaaagaagaggaggaacaaaacatcttcatcttcttcgattatcatcttctaggggttcttcttcgaaatcgtcgttgattttacagaaaaccttgaagagagagaaaaaatggcgtcggaagatgtgaaacaacgaggcgaagcagctgcagtttcgacgatcgtaaatttggcggaagaagcgaaagctgctactgaaggcgttaaatctccaagtcatgctcttattagtatttctaaatctcttgctgctggcggtattgctggtggagtgtcacgtacagcagttgctcctctagaacggttgaaaattttgctgcaggttcaaaatcctcacagcatcaaatacaacggaacagttcagggtttgaaatatatatggcagactgaaggacttcgtggtctattcaaagggaacggcactaactgtgctcgtattgttccaaattcagcagtcaagttttttagttacgagcaggcatcaaagggaattctgtggctttatcggcagcaaactggaaatgaggatgctgaactcactcctgtgctacgtctcggagcgggagcatgtgctggaattattgccatgtcagcaacttaccctatggatttggtcagaggcaggctgactgttcagaccgataaatctcctcaacagtacagagggatataccatgctcttacaactgttttccgtgaagagggtgcccgggccttgtacaaggggtggctcccttccgtgattggtgtgataccatatgtgggtctcaattttgctgtatatgaatctctgaaggactatttggtcaaagaaaacccatttgggcttgtccaggacaaagaattgagtgtgactacgaggcttgcatgtggtgctgttgctggaactattggccagactgttgcttatcctcttgatgttgtacgccgaagaatgcagatggtcggctggaaagatgcatctacagttattaccggcgatggaaaaaaggttgcacttgagtatacaggcatggttgatgccttccggaagacagttcggtatgaaggttttcgagccttgtacaagggtttggtccctaattcagtaaaggtggttccatccatttcaattgcatttgtcacatatgaagtcgtgaaagatttactcggggtggagatgagaatttcagattgattcggaggagaatattcagtttctctattagagcttgagtacacacagtaaaaggtaaataatcacgaagaatattcttttgtggttcatgagtagtctagactcatgtgacatcaagtgctggtatttgccaagtgatcatctaaattacccttagtgattttaccccttcagtaatctgaataaaaatagcttgtaccactagcctagattttctaggatattatgatacctcgacccctttctaataatttatagtttgtttcacttctgtttaattatttattttgttgcccatatttaatggagatcttttgtggattagagtaacatttgttaaacaactattggattttgcacctgtaaaatagtgattgcaagtcacataatgaactgtttggattaaa

SEQ ID NO: 4725 - DNA, 1764 bp, Tropaeolum majus
gtctgcctcactttcagttgctatatagccgccgccgccgccaccaccaccaccagcacatcgacgcatccctcagggaaaacccccattaaaagaggcgacagagaaaatcgcaaagtacatctgcaggagtaaattgcgcgaagatctgaattttggacattttcaccggaaacctcttttgaaattagagatcccgagccctatcaatccaggatttcgggaatacatctgctaacttgttttttggtcgcagcttcgttgtattttcattttttttttgtgtccgtgcaattttgttgtaattcatggcatcggaggacgtgaagacgagcgaatcggcggtgtcaacgattgtgaatctagccgaggaggcgaagctggctagggagggcgttaaggccccaagctatgctgttctcagtatttgcaaatctctcgtagctggtggagtcgctggtggagtgtcccgaactgctgtcgctccgttggaaaggttgaagatattgctgcaggttcagaatcctcacagtataaagtacaatggaacagttcaagggctaaaatatatatggaggactgaagggtttcgtggattgtttaaaggaaatggtgctaattgtgctcggatagttccaaactcagcagtcaagttcttcagctatgaacaagcatcaaagggaatactgtggctatatcaacaacaaaccggaaacaaggatgctcaactcactcctgttttacgacttggagctggggcctgtgctggaataattgccatgtctgctacgtaccctttggatttagtgcggggaaggctcacagtgcagacagaaaattctccttatcagtatagaggaatgtaccatgctctaacatctgtgttgcggcaagaaggtccacgagctttgtacaagggctggcttccatctgtcattggagtcgttccatatgtggggttaaactttgctgtatacgagtctttaaaggattggttaattaaagcaaaaccatttggactgctccaagattctgagttgagtgtgacgactaggcttgcgtgtggggctgctgctggaactgttggacaaacggttgcttacccacttgatgtcattcgtcgaagaatgcaaatggttggctggaaggatgcctcctcaattgtcactggcggtggaggaagcgctgctgctcatgaatatactggcatgattgatgcatttagaaaaaccgttcgtcatgagggttttggagccttatacaagggtttggtccccaattctgtgaaggttgtcccatcaattgccatcgcgtttgtgtcgtacgaggtggtgaaagacattttgggagttgagattagaatatcggactgaatttcgggagaacttgttatgtttcttcaaagagcgctctatttttgtagccaagtcgataagagagaaggcaaactaggggtaaatttttcttgttcctgtcttccgagaacgagttttttttagatatatcagtgccctttttgtttatatatctatttcccttgtttcctcatcagttttcttgttaacaaactttaaactttcagcatctaatttatgtgctgatctaatttaagagttgagaaagcagttttctttagctgtaagtttttgcaccagctttcttttgattgcaccatggtatgcgtacctacctctgttaacaatcttacgatgatatgattcgtatagtaaaaaaaaaaaagacactagtagacgtgtccaacgg

SEQ ID NO: 4726 - DNA, 1142 bp, Sesamum indicum
tttgtgggtatttttattttggggggatttgatggcttcggaggatgtgaagacgagcgaatcggcggtgtcgaagattgttaatttcgcggaggaggcgaagctggcgaaggaagaaatcaagccgactaaatatcaagtttacagtatttgcaaatctctggtcgccggtggtgttgctggaggagtgtcacggactgctgtagctcctttggaacggcttaaaattttgcttcaggttcaaaatccacacaatataaaatacaatggaactgttcaaggcttgaagtacatatggagaacggaagggttcagggggttattcaagggcaacggcactaattgtgctcgaattgtcccaaattcagcggtcaagttcttcagctatgagcaagcatccaagggtatattgtatatgtaccagcaacaaaccggcaatgaggatgctcagttaactcctgtattgcgtctggcggcgggagcttgtgctggaataattgctatgtcagctacatacccaatggacatggttcgtggtagacttactgtacagacagagaagtctccttaccagtacagagggatgtttcatgctttatcaactgtgcttcgtgaggaaggcttccgtgcactatacaagggttggcttccttctgtcattggagttgttccatatgtaggtctcaactttgccgtgtatgaatcccttaaagattggctactaaaatctaacccctatgggcttgtcgaggataatgaattgggtgttgtaacaagacttgcatgtggggctgcagcaggcacagttggacaaaccgttgcctacccccttgatgtcattcggagaagaatgcagatggtaggatggagtaatgcttcttcaattgtagctggtgatgggagaaccaaaggccctcttgaatatactggcatgattgatgctttcaggaaaactgtgaggcatgagggctttagagcattatacaagggtttggtccccaattcagtgaaggttgtcccatcaatagctattgctttcgtgacgtacgaacaagtgaaggagttactcggggtagagattagaatatctgactgatgcatttgttgcagagagagctgtgacgttcgctcattctatgtaa

SEQ ID NO: 4727 - DNA, 2865 bp, Eutrema parvulum
aatcagtaggttgtcttttggcgtttattatcgccgccgggacagtgaaagaggggtagatttctttcgagactttgatctctcttctcgatagtctttaacggagatttctgttagggtttggatcgtcgttgagagatcggagattgtgaaaacttctgaagaaatctctgggatcgtaatcgtagtggagtgattgcgattttctgttggtggtgattctcaatcgatggcatcagaggatgtgaaaaggaccgaatcggcagctgtttctacgatcgttaatctggcggaggaagcgaagttggcgagggaaggagtcaaagctccgagttatgctgtcctcagcatctgcaagtctctcttcgccggtggcgtcgctggtggagtgtcacgaactgcagttgcacccctggaaaggatgaagatattgcttcaggtccaaaaccctcataacattaagtatagtggtacagttcaaggattgaagtatatttggagaaccgagggccttcgtggactgttcaaaggaaatggcaccaactgtgctcgcattgttcctaattcggctgtgaaatttttcagctatgagcaagcttcaaagggaatactgtacatgtatcgtcagcagacaggaaatgaaaatgcccaacttactcctgttttacggcttggagctggtgcaactgctggaataatagccatgtctgcaacatacccgatggatatggttcgtggaaggctaactgtccagaccgcaaactctccttatcagtacagaggaattgcacatgctttgtcaactgtcctgcgagaggaaggtccacgggctttgtaccgtggttggcttccatcggtgattggagttgttccatatgtgggcttgaactttgcggtctatgagtctctaaaggactggctagtcaaagacaatccatttggactagtggagaacaatgagctgaccattataacgagactctcttgcggtgctatagctggaacagttggtcaaacaattgcttatccactcgatgtgattcgtaggagaatgcagatggttgggtggaaagatgcttcctctgttgttacaggcgacagaagcaagggttcgcttgaatacactggtatggttgatgcgtttaggaaaacagttcgtcatgaaggctttggagcattgtacaagggtttggtcccaaactcagtgaaggttgtaccatcaattgcgattgcatttgtgacatatgagatggtgaaagacgttttaggagtggaatttaggatatcagactgagtgatttgatatcttcaagaagagagcacacttctatttttgtagccgaggagacagaagagaagttcgaaatttaggggctttttatttaatctcctttcagcatccgtggaaggataaaaaaggctataggggctttagccaaactcttttttttcttttccttctttctttctacttatagatttggttttcttctgaatcaaataagtcagaggccaactatatcaaacctgttggttctggagtttgtgtttggttaggtcttttggcattaagtttatcattattgttatgactcttattggtaacttgtggattattagttgaataattccgcgtttctgtagttcttcttaagaatacgtattgtgcaattcatctgtgctactaatacatggagaattactagctctgaacacgaatgtttcaatacatttttgttttccctaagatacagatttataatcaatcgtagttaaaatgataaaaatggttggatattggatcataatcatatgaaagctttacgtaaaaacaaagaagggagaaaaaacagatacaatgatcttccgtgaagctgaacttttgcgacgtataacgcaaaaatgacacatccatcatcgttgcttatgagtgcaattcaatcctgcatttaaataagtttatttgccaatgttaaacactaatggagttttaatcatttacattttacactaatcaaagtacgtaccatttaagcattttgatggtacatttagccatctttttatcgagcgtctgtaatctcacgccaccgcagctgagagtaatccccaccgtagcaatcttgtgccttcccacagccaatcctaccttcgtcttagccgtcaccttcaccaccaacttcttactcttcatctctgctcgaagcctcttcaccgtcggatcattcacctcttgtctcttcacttttatcggaacgatcaccaccgtccgattccccggcttctggacaaactctttgactttctttgaccctaggctcgtctcgaaatctccatctcctacgctcgcctccacgtcagcgtcgccgtaatagtaccgtagctttccgtttgggtttttgaaaacgagcttggccgaggcctccgccgtcaaatgcgacaaaccatcgcccggttttccgccggaaaagttgaagttgctgacgcggaaggaggcgaggcgtacgacggggagtctcgggctgtaccagaggaagaagacgcagacggtgagggttaggaggaggatgaagatcgcgacggtaatgcagacgcagcagcaacagacacggcaacggctccactttttcttcttctgcgggtaaaacgaaggcgggatcatatgcttaggtggccggcgacgaagcttcgaagatgatgacacgtttggagtttccggagacgcgtgaagctcatggtaacctggtggtttctgaagcaccggtttaagaaacatctccgccgccatttcttcgtcgccggaggagggattcttaggacttgtgtgatctctattattcctctccatgtatattatcaagtgta

SEQ ID NO: 4728 - DNA, 1462 bp, Ambrosia trifida
ggagcacatatataaaaacataacggcggatctttattattcattttccgttagggttccgctgcagtttagggtttaggccgttcacataacatggcgtcagaggatgtggtagggaagacaagtgctacgatcgctaatctcgctgaagaagcaaagatcgctagtgaaggtgttaaggctcctagccgtcacgctttgctctccatctgcaagtctctcgtcgccggcggtgtcgccggaggagtatcaagaaccgctgttgctcctctagaacgactgaaaatcttgctccaggtacaaaatcctcatgccatcaagtataatggtaccattcaggggttgaaatatatatggagaacagagggttttcgtggactgtttaaaggaaatggcactaattgtgctcggattgttccaaactctgctgtcaagttcttcagctatgaagaagcatcaaagggaattttgtggctttaccggcaacaacctggaaatgaggatgctgaactcacccctgtcttacgccttggagctggtgcttgtgctggaataatcgccatgtcagctacctacccaatggacttggttcgtggtcggattactgttcagacggataaatcttcaacccaatatcgaggaatcacacatgctcttagaactgtactgcgtgaagaaggtccacgcgcattgtacaaagggtggcttccttctgtcattggtgttatcccatacgtgggtcttaattttgcggtgtatgaatctttaaaagattggttgattaaatcaagaccatatgggctagccgaggatgctgagttgagcgtggtaacaaagcttgcatgtggggctgcagctggaaccgtgggtcaaaccgttgcttatcctcttgatgtcatccgcagaagaatgcaaatggttggttggaaacatgcagcttcagttgtcactgcagatggcaaatcagcacttgagtacaccggtatggttgatgctttcaggaaaaccgtccgttatgaaggttttggagccttgtacaaaggcttggtccccaactcagtcaaggtggttccttcaatagcaattgcattcgtgtcatacgaggtggttaaggatctacttggggtagagatgaggatatctgattgaaaaccatcctagttaagataataatgttgttggatgaataatattatttttgctcgcagaagagaaagtaggaggtataaactatggtggtcatgacttttttttgttgtcttctctctttcggttatctttcagttactgagggatttagaagttgttagtgttgatatagtggaccccggtacatacccggcactttctctttctgctgtggtctttggtgtttggcgttcgtgtcacaccaacaccacccaataaggatatttcatagagttggtgagttgttttatctttattatgtttatgattatga

SEQ ID NO: 4729 - DNA, 1442 bp, Ambrosia trifida
agcacatatataaaaacataacggcggatctttattattcattttccgtttagggttccgctgcagtttagggtttaggccgttgacataacatggcgtcagaggatgtggtagggaagacaagtgctacaatcgctaatctcgctgaagaagcaaagatcgctagtgaaggtgttaaggctcctagccgtcacgctttgctctccatctgcaagtctctcgtcgccggcggtgtcgccggaggagtatcaagaaccgctgttgctcctctagaacgactgaaaatcttgctccaggtacaaaatcctcatgccatcaagtataatggtaccattcaggggttgaaatatatatggagaacagagggttttcgtggactgtttaaaggaaatggcactaattgtgctcggattgttccaaactctgctgtcaagttcttcagctatgaagaagcatcaaagggaattttgtggctttaccggcaacaacctggaaatgaggatgctgaactcacccctgtcttacgccttggagctggtgcttgtgctggaataatcgccatgtcagctacctacccaatggacttggttcgtggtcggattactgttcagacggataaatcttcaacccaatatcgaggaatcacacatgctcttagaactgtactgcgtgaagaaggtccacgcgcattgtacaaagggtggcttccttctgtcattggtgttatcccatacgtgggtcttaattttgcggtgtatgaatctttaaaagattggttgattaaatcaagaccatatgggctagccgaagatgctgagttgagcgtggtaacaaagcttgcatgtggggctgcagctggaaccgtgggtcaaaccgttgcttatcctcttgacgtcatccgcagaagaatgcaaatggttggttggaaacatgcagcttcagttgtcactgcagatggcaaatcagcacttgagtacaccggtatggttgatgctttcaggaaaactgtccgttatgaaggttttggagccttgtacaaaggcttggtccccaactcagtcaaggtggttccttcaatagcaattgcattcgtttcatacgaggtggttaaggatctacttggggttgagatgaggatatctgattgaaaactatcctagttaagataataatgttgttggatgaataatattatttttgctcgcagaagagaaagtaggaggtataaactatggtggtcatttacttttttttggttgtcttctctctttcggttatctttcagttactgaaggatttagaagttgttagtgttgatatagtggaccccggtacatacccgacactttctctttctgctgtggtctttggtgtttggcgttcgtgtcacaccaacaccacccaataaggatatttcatagagttggtgagttgtttgatct

SEQ ID NO: 4730 - DNA, 1737 bp, Tropaeolum majus
cggccggggtctgcctcactttcagttgctatatagccgccgccgccgccaccaccaccaccagcacatcgacgcatccctcagggaaaacccccattaaaagaggcgacagagaaaatcgcaaagtacatctgcaggagtaaattgcgcgaagatctgaattttggacattttcaccggaaacctcttttgaaattagagatcccgagccctatcaatccaggatttcgggaatacatctgctaacttgtttttttggtcgcagcttcgttgtattttcatttttttgttgtgtccgtgcaattttgttgtaattcatggcatcggaggacgtgaagacgagcgaatcggcggtgtcaacgattgtgaatctagccgaggaggcgaagctggctagggagggcgttaaggccccaagctatgctgttctcagtatttgcaaatctctcgtagctggtggagtcgctggtggagtgtcccgaactgctgtcgctccgttggaaaggttgaagatattgctgcaggttcagaatcctcacagtataaagtacaatggaacagttcaagggctaaaatatatatggaggactgaagggtttcgtggattgtttaaaggaaatggtgctaattgtgctcggatagttccaaactcagcagtcaagttcttcagctatgaacaagcatcaaagggaatactgtggctatatcaacaacaaaccggaaacaaggatgctcaactcactcctgttttacgacttggagctggggcctgtgctggaataattgccatgtctgctacgtaccctttggatttagtgcggggaaggctcacagtgcagacagaaaattctccttatcagtatagaggaatgtaccatgctctaacatctgtgttgcggcaagaaggtccacgagctttgtacaagggctggcttccatctgtcattggagtcgttccatatgtggggttaaactttgctgtatacgagtctttaaaggattggttaattaaagcaaaaccatttggactgctccaagattctgagttgagtgtgacgactaggcttgcgtgtggggctgctgctggaactgttggacaaacggttgcttacccacttgatgtcattcgtcgaagaatgcaaatggttggctggaaggatgcctcctcaattgtcactggcggtggaggaagcgctgctgctcatgaatatactggcatgattgatgcatttagaaaaaccgttcgtcatgagggttttggagccttatacaagggtttggtccccaattctgtgaaggttgtcccatcaattgccatcgcgtttgtgtcgtacgaggtggtgaaagacattttgggagttgagattagaatatcggactgaatttcgggagaacttgttatgtttcttcaaagagcgctctatttttgtagccaagtcgataagagagaaggcaaactaggggtaaatttttcttgttcctgtcttccgagaacgagttttttttagatatatcagtgccctttttgtttatatatctatttcccttgtttcctcatcagttttcttgttaacaaactttaaactttcagcatctaatttatgtgctgatctaatttaagagttgagaaagcagttttctttagctgtaagtttttgccaccagctttcttttgattgcaccatggtatgcgtacctacctctgttaacaatcttacgatgataatggatttcatt

SEQ ID NO: 4731 - DNA, 1603 bp, Populus trichocarpa
gcacatgaaaggcaaaccaaaccccccgtcacacaacgcccactcgctctaagcttgaggcctcagcgtactctcacctctctcaagagccgtcattgcagaaagaaagaaagtaatgcagagactacctcttcgttgaattaaataagaataattaagatccgaccagattgattgccgaagaatccgagatctcttcatctcacagagttgactatactgaggttttcttttggtgatcgatcgatggcatcggaggatgtgaaggcgagcgaatcggctgtgactactattgtcaatttggcggaggaagctaagcttgcgagagaaggagtcaaggctcctagccttgctattcttagcatctgcaagtctcttgttgccggtggtgttgctggtggagtgtctcgcactgctgttgctcccctggagaggatgaaaatactgctacaggttcaaaatccacataacataaaatacaatggaacaattcaagggttgaaatacatatggaggactgagggttttcatggactattcaaaggcaatggcaccaattgtgctcgtattgtcccaaactcggcagtcaagtttttcagctatgagcaagcttccaagggaatattgtatctctatcaacagcaaactggtaatgaggatgctcagctcactcctcttttacgccttggagctggagcatgtgcaggaattatagcaatgtctgcaacttatcccctggatatggtacgaggcaggctaactgtacagactgagaaatcacctcatcaatatagaggaatgttccatgctctatcaaccgtgcttcggcaagaaggcccacgggcactgtacaagggctggcttccttctgtcattggagttattccatacgtgggtctcaacttttcagtgtatgaatctctaaaggattggttggttaaagctagaccatctggactcgttgaagattctgaattgaatgtgactacaaggctagcttgtggggctgcagctggaaccgttggccaaactgttgcttatcctcttgatgttattcgccggcggatgcaaatggtgggatggaaaggtgctgcttccatcgtcactggtgatgggaggagcaaggccccactcgagtatactggcatgattgatgcattcaggaaaactgttcggcatgagggctttggagcattatacaagggtttggtaccaaactcagtgaaggtagttccatccatagcaattgcatttgtgacatatgagatggtgaaagacattttaggagtccagatcagaatatcagactgaattcccaggggtcctgcctgatatttgttgaatcagggtgctatttttgtaggcaagggaatagagagaaggtaaactagctcatgcaaaagagcgagtttagaaacatgtttaagactctgtatgcttagccttaagattctcattcatatgttgtgtcaataaagcatgctgatgggacgactcatgatttgtaatttgatgcttcataagagctgaagtaattttctgaagcttaatttgcacttactagctattaattgactttcccttctttatattttgtgtgcct

SEQ ID NO: 4732 - DNA, 1543 bp, Helianthus annuus
atcgccggaggaggtataacaacggcggatctttatttaattacagttagggttctgcctcaattcacactttcgatttctagggtttaggccgcacacatggcgtcagaggatgtggtaggtaaaaccagcgctacgatcgctaatctcgctgaagaagcgaagatcgccagtgaaggtgtcaaggctcccagccgccacgctttactctccatctgcaagtctctcgtcgccggaggtgtcgccggaggagtatcaagaaccgctgttgctcctctagaacgactgaaaatcttgctccaggttcaaaatcctcatgcaatcaaatataacggtaccattcaggggttgaaatatatatggaggacagagggttttcgtggacttttcaaaggaaatggcactaattgtgctcgtattgtcccaaactctgctgtcaagttctttagctatgaagaagcatcaaagggaatcttgtggttctaccgacagcaacctggaaatgaggatgctgaactcacacctgtcttacgccttggagctggtgcttgtgctggaattatcgccatgtcagctacctacccgatggacttggttcgtggtcggcttactgtgcagactgataaatctccaagccaatatcgaggaatcgcgcatgctcttgcaaccgtgctgcgtgaagaaggtccacgcgcgttatacaaagggtggcttccttccgtcattggtgttgtaccatacgtcggtcttaattttgcggtgtatgaatctttaaaagattggttgattaaaacgaaaccatacgggatagccgaggacgctgagttgagtgtgacaacgaagcttgcatgtggggctgcagctggaaccgtgggtcaaaccgttgcttatcctcttgatgtcatccgcagaagaatgcaaatggttggctggaaacacgcagcttctgttgtcaccgcagatggcaaatcagcactcgagtacaccggtatggttgatgctttcaggaaaaccgttcgttatgaaggttttggagccttgtataaaggcttggttccgaactcggtcaaggtggttccatcaatagcaattgcgtttgtgtcgtatgaggtggttaaggatctacttggggtagagatgaggatatctgattgaaaaccatcctggctataacaataataatgttgttgaatgaataatattatttttgcgcgcagaagagaaagtaggaggtataaaatatggtggtcgtgagttcgtgactctttttttgttgtcttctccctttcggttatcttctttcagttactgagggatttagaagttgttagtgttgatatagtggaccccagtgcataccgacactttctctttctgctgtggtcttttggtgtttggcgttcgtgtcacaccaacaccacccaataaggatatttcatagagttggcgagttgtttgatctttactatggttatgattatgattatgataatcgtttcttttaatagttattattttgtggtgatgatttagcaaagaaaaa

SEQ ID NO: 4733 - DNA, 1603 bp, Helianthus annuus
gcagcccactctacaacgagaaccggcggaaccctaaccctaatctctcatcatcatcagcctcgccggaggaggtataacaacggcggatctttatttattacagttagggttccgcctcaattcacactttcgatttctagggtttaggccgcacacatggcgtcagaggatgtggtaggtaaaaccagcgctacgatcgctaatctcgctgaagaagcgaagatcgctagtgaaggtgtcaaggctcccagccgccacgctttactctccatctgcaagtctctcgtcgccggaggtgtcgccggaggagtatcaagaaccgctgttgctcctctggaacgactgaaaatcttgctccaggttcaaaatcctcatgcaatcaaatataatggtaccattcaggggttgaaatatatatggaggacagagggttttcgtggacttttcaaaggaaatggcactaattgtgctcgtattgtcccaaactctgctgtcaagttctttagctatgaagaagcatcaaagggaatcttgtggttctaccgacagcaacctggaaatgaggatgctgaactcacccctgtcttacgccttggagctggtgcttgtgctggaattatcgccatgtcagctacctacccgatggacttggttcgtggtcggcttactgtgcagactgataaatctccaagccaatatcgaggaatcgcgcatgctcttgcaaccgtgctgcgtgaagaaggtccacgcgcgttatacaaagggtggcttccttccgtcattggtgttgtaccatacgtcggtcttaattttgcggtgtatgaatctttaaaagattggttgattaaaacgaaaccatacgggatagccgaggacgctgagttgagtgtgacaacgaagcttgcatgtggggctgcagctggaaccgtgggtcaaaccgttgcttatcctcttgatgtcatccgcagaagaatgcaaatggttggctggaaacacgcagcttctgttgtcaccgcagatggcaaatcagcactcgagtacaccggtatggttgatgctttcaggaaaaccgttcgttatgaaggttttggagccttgtataaaggcttggttccgaactcggtcaaggtggttccatcaatagcaattgcgtttgtgtcgtacgaggtggttaaggatctacttggggtagagatgaggatatctgattgaaaaccatcctagctataacaataataatgttgttgaatgaataatattatttttgcgcgcagaagagaaagtaggaggtataaagtatggtggtcgtgagtttgtgactctttttttgttatcttctccctttcggttatcttctttcagttactgagggatttagaagttgttagtgttgatatagtggaccccagtgcataccgacactttctctttctgctgtggtcttttggtgtttggcgttcgtgtcacaccaacaccacccaataaggatatttcatagagttggcgagttgtttgatctttactatgattatgattatgattatgataatcgtttcttttaatagttattattttgtggtgatgatttagcaaagaaaaa

SEQ ID NO: 4734 - DNA, 1258 bp, Amsonia hubrichtii
gctcactgtccttcgatcgcgggagggcgtaacggcggtgcttagggttccggcaaggtttggagttcagttgctggtttattcttcgtgttgaaatggcctcggaggatgtggttgggaagagaggcgagagtgctgtgaccacgatcgtgaatttggccgaggaagcgaagattgcgagcgaaggcgttaaagctcctagtaaaattgctgttgttagcatctgcaaatctcttgctgctggtggcatcgccggtggagtgtcacgtacagcagttgctccgctagaacggttaaaaattttgctacaggttcaaaatcctcataatataaaatacaacggcacagttcagggattgaaatatatatggagaaccgagggttttcgaggattatttaaaggaaatggcactaattgtgctcgcattgttccaaactcagctgtcaagttcttcagttatgaggaggcatccaagggtatcttatggctatataggaaccaaacaggaaatgacaatgctgaactgactccagttctgcgccttggagctggagcatgtgctggaataattgctatgtctgcaacttacccgatggatatggtgcgaggtcggcttactgtccagacagataagtctcctacccagtacagaggaatttttcatgctttgagaacagtttttgctgaagaagggcctcgtgcattatacaggggatggcttccttctgttataggagtggtaccttatgtgggtctgaactttgctgtgtatgaatctttaaaagattggttggttaaaagtagaccatttggactagaaaaagacacggagttgagtgtaacaacaaagcttgcatgtggggctgctgctggaactgttggccagacagtggcttatcctcttgatgtcatccgccggagaatgcagatggtgggctggaaagatgctgcttcagttgtcactggtgatgggaagatcaaagcaccccttgaatatactggcatggtagacgcgttcaggaaaacagtccgccacgagggatttgctgctctgtacaagggtttaatccccaattcagtgaaggtggtcccatctatagcaattgctttcgtgacatacgaggttgtgaaagatattcttggagttgaggtgaggatatctgattgaaacacccaagaggattatcaagtgttgaaaaatcatactatttttctgtgttggagcaaggagaggaggtaattaatggagatggtagc

SEQ ID NO: 4735 - DNA, 1610 bp, Prunus persica
aaccttcgtaatatagcaaagccaacccttcattttcagctcccgaaagccgtcacgagtcacgacccactctcggagaaagacaacactccacacacacaaaaatgaagcaggggctcgctttcccataaaacgaccacgaagagcttcaaaaaccgtaccgatcgattggcgccgggaaaatagctcagatcaacgtctccgacgatctaggattccggcgaggacgttcgtcgattgctctctgttgaaatggcttcagaggatgtgaaaccgagcgaatcggcggtctccacgatcgtcaatctggctgaggaggctaagatggcgagagagggcgtggtcaaggctccgagccttgcggttctcagtgtctgcaagtctctggttgctggcggagtcgctggtggagtgtctcgaacagctgttgctccattggagcgactgaaaatattgctccaggtccagaatccacataacataaaatacaatggaacaatacaaggcttgaaatatatctggagaagtgagggtttccgtggattgtttaaaggaaatggtacgaattgtgctcgtattgtccccaactcagctgtcaagttcttcagctatgagcaagcttctaagggaatattgttactgtatcgggatcaaactggcaatgaagatgctcagctcactcctcttctacgtcttggagctggagcatgtgctggaattattgccatgtctgcaacttacccgatggacatggtacgaggaaggctaactgtacagacagagaactctccctttcagtacaggggaatgttccatgctctatcgactgtgctccgcgaggagggcccgcgggctttgtacaagggatggcttccttctgtaattggagttgttccctatgttggtctcaactttgctgtgtatgaatccctgaaggattggttaatcaaaagtagaccatttggacttgttgaagatacagacttaagtgtcacaacaaggttggcatgcggggctgctgctggaactgttgggcaaactgttgcttacccccttgatgtcattcgtcgaaggatgcagatggggggatggagtaatgctgcttctgttatcactggtgatgggagaagcaaggccccacttgaatatactggcatgattgatgcattcaggaaaactgttcgacatgagggctttggagcgttgtacaagggtttggttcccaattccgttaaggtagtgccatccattgcaattgcatttgtgacgtatgagatggtgaaggacgttttaggagtcgagatcaggatatcggactgaaattgcaggagctccatgatatttatctttgcgtgtgctatttttgtaggccgggaaatagaggtctgataaactaggggtaatttcttccttttttctctgaagctctagcgagtctgagcctgtgttcataaattgctttcccccctgttttcctttttgtatttccttatgaacacgatgtagctttgaagcttctcattcatatgatgtgccaataagtgtttcgacaatgtaaaacatgcttttgcatgccttcttccataagctttgagaaagcattttctaca

SEQ ID NO: 4736 - DNA, 1615 bp, Fragaria vesca
aaacaaaacgccgtcaacaactgatcgctctctttcagctcaaagccgtcaccactcttcacactcggaccacagagagagagtgcgatacaggctcgccttcccgtaaaacgacctcgtttcaacccagagcctgggaaaccgtgctcccgttcttttcgattttcgccggcgaagaagaaaagctccgggatcaagtgctccgacgaccgcgtagggttccggcgggcgtggttcgggttgatctgtcgagaaatggcttcggaggatgtgaaacgaagcgaaagggctgtctcgacgatcgtgaatctggcggaggaggctaagctggccagagagggcgtcgtcaaggctcctagcctcgccgttctcagcgtctgcaagtctctcgtcgccggcggtgtcgccggtggagtgtctcgaacagctgttgcgccattggaacgaatgaagatattgctccaggtccaaaatccccataacataaagtacagtggaacagtacaaggcctgaaatatatctggagaactgagggtttccgaggactgtttataggaaatggtactaattgtgctcggattgtccccaattcggctgtcaagttcttcagctacgagcaggcttctaagggaatattatggatgtatcgggagaaaactggcaacgaagatgctcagctgactcctctcctacgacttggagctggagcatgtgctggaattattgctatgtccgcaacttacccaatggacatggtacgaggaaggattactgtacagacagaggcgtctccctatcagtataggggaatgttccatgctctatcaactgtgcttcgggaagagggtccacgtgctttgtacaagggctggcttccttctgttattggagttgttccgtatgtggggctcaactttgctgtgtatgaatccctaaaggattggttaattaaaagtagaccatttggacttgtccaagatacagatttgagtgtaaccacacgattggcatgtggggctgctgctggaactgtcgggcagactgttgcatacccacttgatgtcatccgtcgaagaatgcagatggttggttggagtcatgctgcttctgttgttgctggtgaggggagaagcaaggcaccacttgaatatactggcatgattgatgcatttaggaaaactgttcgacacgagggctttggtgcattgtacaagggtttggttcccaattctgttaaggttgtcccatccattgcacttgcatttgtgtcgtacgagatggtgaaggacattttaggagttgagatcaggatatccgactgaaattgtggtagcgccatgatatttatgtgagagtgctatttttgtagggcaggaaataggggtctggtaaactaggggttacttctctaacttttcaagttagaagcgtgtctgagcctttgttcatagattgcttcccttgtttcccttcctgtatttccttatgaacgtgatgtaggcttgggcttctcatttataagctgcaataagtgtttgacaatgcaacacatgcatttgcatgtcttccataagttataagaaagcatatttacatgctgtgacattttactga

SEQ ID NO: 4737 - DNA, 2005 bp, Arachis hypogaea
aacgaacgccgtcagtgtctgagactcagttgtggttgttgtgagctctctgtttttgtctcagccgcaccctctcaattcgccaatgatcgcttctctgcgctaatctccacctattcttcttccaaactcacgatcagatcgacatctccgaataccttctctcttctttctttcaaggtctcgttaggttaagctttagggtttttggtgtaatggcatcggagacgaagatcgtgaatctggccgaggaggccaagctagccagagaaggcgtcaaggctgctcccagctatgccttcaccagcatctgcaagtccctcgtcgctggtggcgtcgccggaggagtatcacgaacagctgttgctccacttgaacgcctgaagattttgctgcaggtccagaatccccacaacataaaatacaatggaacagttcaaggtctaaaatatatatggaggactgaaggttttcgtggactcttcaaagggaatggaactaattgtgctcgaattgtccccaattctgccgtaaagttcttcagttatgagcaagcttcgaaagctatactgcagctgtatcagcagaaaactggaaatgaggatgctcagctgactcctgttttacgtcttggagctggagcatgtgctggaataattgccatgtccgcaacttatccaatggatatggttcgaggcaggataactgtacagacagagaagtccccttaccagtacagagggatgttccatgctttgacaactgtgcttagggaagaaggcccacgtgctttatataagggttggcttccttcagtcattggagttgttccatatgtaggtctaaactttgctgtttatgagtctttgaaagattggttagttaaatccaatccatttggtctagtgcaagattctgagttgagtgtgacaactcgcctggcatgtggtgctgcagctggaactgttgggcaaactgttgcttatccccttgatgtcattcgtcgaagaatgcagatggtggggtggaaccatgctgcctctgttgtagctggcgatggaagagtaaaggccccacttgaatatactggcatggttgatgcatttaggaaaactgttcggtatgaaggagttggtgcattatacaagggtctggttcccaattctgtaaaggtcgtcccatccatagcaattgcatttgtacatatgaggtggtgaaggacgttttaggagtggagttcagaatatcagactgaaggatatatcagtttgcctgtttggggtttttggtaggcaaggggatgcagagatggcaaagtagggctattttcttgtttttcatctctctacggatgagttaggaagcatttgagatagagtctataaatgaattcccttgtttcctatttgtatttccttgggaacatgctgtagcattagcttcttattcatcttctctggcaataagtgttgtggaataacaatacaacgacatatgtgcttggctttttctgcacgagtgaagaaagcatttttactgctggagtttcagtcattgattattggatgctcctccatagctccatctccaggttgtattcattattatgacttgctttctcatgcgaatttttaagctgccagactgacttacacaaacaataaccctggctttttttttttacttcatgtttgcttttagaataacgtaatattagtttgcttttattagtagttgattgcaattggtgcttattgttgtatttctgtaagtaatcgtcttggttcctctttttgctcattcaatatacaaatggtccagacttgttaactgattgggtggaagagtgttcgaaatgtaagctaaatccttccttcgtcattattggttctagtagaagaaatctatatactcccttttgaatctaaattgtggcaattatttgtataagagtggctatatgcctagaatgtaaacatgatagaatatatcatatgtttccagt

SEQ ID NO: 4738 - DNA, 1479 bp, Helianthus annuus
cgttgatatgacatcggaagacgttgtagggaaaacgagtgtgaccatcgctaatatcgctgaagaagcaaaaatcgccagtgaaggtgtcaaggctcccagtcgtcaaactttgctcggaatctgtaaatctctcgtcgctggaggtgttgccggcggagtatcgcgtactgctgttgctcctctagaaagattgaaaattctgcttcaggttcaaaatccgcatgcgatcaaatacaatggaactattcagggactaaagtatatatggagaaccgagggttttaaaggaatgtttaaaggaaatggcaccaattgtgcgcgcattgtcccaaactctgctgtcaaattctttagctatgaagaggcatccaagggaatcttgtggctatatcgacagcaaaccggaaatgatgatgctgaactcacaccgcttttacgccttggagccggtgcttgtgcgggaataattgccatgtcagcgacctatccgatggacttggttcgcggtcgtattactgtccagactgataaatcttctactcaatatagaggaattgcgcatgctcttacgacagtactccgtgaagagggtccacgcgcgttatacaaaggatggcttccttctgttattggcgttataccatatgtgggacttaatttcgcggtatacgaatccttaaaagactatttggtgaaatcaagaccgttcgggctagttgaagacaaggagttgggcgtgacaactaagctcgcatgtggggccgttgctggaacctttggtcaaacggttgcatacccactcgatgtcatacgcagaagaatgcaaatggttggttggaaacacgctgcgtcagttgttactggtaaaggaaattcaacacttgaatacactggtatgattgatgcattcaggaaaaccgttcgttatgagggtttcggcgctttgtacaagggtttggtcccgaattcagtcaaggtggttccatcgatagcgattgcgtttgtgacatatgaggtggttaaggatgtactcaaggtagagatgaggatatccgattaatgaaacaaaacatcacattcttattcaacgttcgtgttagttaatttgcatgcgaaagggtagggtggtaaaatcgtcgctaatatctttgagttatcggtttttggtaataaagagatttagaactagctagcccatgttgatatagtctagccggtcaaccggcctgtatgcacccgaaacactgttttatgtcagctgtagttcgggttttaacttttaagtttttgccattggtatgtatgaacaatgataataaggaaatgctcacagagtttaggcccagtttgacaaacttggaagtgaaactattgttgaattagtattattaacgatttgacgtataatagaggttatggagttttatgtaacgatttgttttgttggtttccgttaatatcattttggtagttgat

SEQ ID NO: 4739 - DNA, 1498 bp, Manihot esculenta
cttcactgaataacaagagccgccgtaataattataatacaaacgccggaggtttattcttagggttccggcgatggcatcagaggacgtgaagacaggagattctgcagtttcgacaatcgtgaatctggctgaggaggcgaagctagcaagagaaggtgtaaaggcgccaagttatgcgcttcaaagtatatgcaagtctctaattgctggtggagttgctggaggagtgtcacgtactgctgttgctccattggaaagattaaaaattcttctgcaggttcaaaatccacacagtataaaatacaatggtacaattcagggcttgaaatacatatggaaaactgaaggtttcagaggaatgtttaaaggcaatggcactaattgtgctcgcattattccaaattcagcagtcaagttctttagttacgaggaagcatccaaacgcatactaattttttacaggaagcaaactggaaatgatgatgcacagcttactcctcttttacgtcttggagcgggtgcatgtgctggaattattgccatgtctgcaacttacccaatggacatggttcggggtcggctaactgtccagacagaaaagtctcctcgccagtatagaggaatctttcatgctctttcaactgtcctcaaggaagaaggtcctcgggctttatacaaaggatggctgccttctgtcataggagtaataccatatgtgggtctaaactttgctgtgtatgaatcactgaaagacttcttactcaaatccaaaccttttggactagttcaagacaatgagttgggagtgacaacaaggcttgcatgtggagcagctgctggaactgtcggccagacagttgcttaccctcttgatgttatccggcgaagaatgcaaatggtgggctggaaggatgctgcttcagttgtcactggtgatgggaaaagtaaagcgcctcttgaatacactggtatgattgatgccttcaggaaaacagttcggcatgagggatttggggcactgtataagggtttggtccccaattcagtgaaggtggtcccgtcgatagcaattgcatttgtgacgtatgagttggtgaaggatgttcttggagtcgaggtgaggatatccgattgaagcaggaagaattctaaaagattaaacttccgtgcttcatttgcaagaggagaaaggagcgttgggtgaaggtcagcaaattggaatatctcaactccagctagcaaggaaatttagaagcccgacttttaacctatgttaatatattcctctatcccatcttattctcatttctatatgtaaacccatcttagtttttagatgtcttattcatatatgtcatgccaataagtatttgtgaggaaatgatgcaccccgtgcattccattagcttcttagagagttttaaagttactctttttacctagttctatctgtgatcattacgagtttatttaatagaatttgacatttttctag

SEQ ID NO: 4740 - DNA, 1283 bp, Cleome spinosa
gtttcggcgaggaggtctcggatacatttgggttctgggtttctctgcctaattggtttctcgtttcgttgtctttaatggcatcggaggacgtgaatacgagcgaatctgcggtttcgacgatcgtgaatctggcagaggaggcgaagctgacgaaggaaggtgtcaaggccccgagccacgcggttctcagcatctgcaagtctctcgtcgctggtggagttgccggtggagtgtcaagaactgcggtggcacctctggagagactgaagattttgctacaggttcaaaatccacacagtataaaatacaatggaacaattcaaggtttgaagtatatatggagaaccgaaggttttcgtggattgttcaaaggcaatggtactaactgtgcccgcatcgttccaaactcagcagtcaagttcttcagctacgagcaggcttcaaaggggatactctacctctatcaacagcaaacagggaatgatgaagctgagcttacacctcttttacgtcttggagctggagcttgtgctggaataattgccatgtctgctacttaccctatggacatggtgcgcgggaggcttactgtccagacagaaaaatctccttatcagtacaggggaatggtccatgctttatcaactgtgctgcgtgaggaaggaccaagagcgttgtacagaggctggcttccatctgttattggagttattccatatgtgggccttaactttgcagtctacgaatctctcaaagattggctggttaaagcaagaccttttgggattgctgacaactctgagttgacagtgaccacaaggcttgcttgcggagccgttgccggaacaatcggacaaaccgttgcataccctcttgatgttgttcgaagaagaatgcagatggttggatggaaagacgcttccacagttataacaggtgacgggagagggaaagctcccctcgaatattctggaatgatcgatgcgtttaggaaaactgttcggcatgagggtgttggagcactttacaagggtttggtccctaacttcgtcaaggttgtcccgtccatcgcaattgccttcgtggcatacgagaaggtgaaggaccttctaggagttgagttcagaatctcggattgacatgcactcatatttttgggctcgcatcgaacagatcaacacttcacgaattagggttttttcccccctttgtttggttgcttcccttcactttattttgctgtgtgcgcatcaacagtctcatttatgtatggtgccaat

SEQ ID NO: 4741 - DNA, 1592 bp, Gossypium hirsutum
aaagaagcgccgcatgagagaaatgcggagcctcttttgactataatatatatagcctcggagatcggaccctataagtcgccggataatcatcgacgactgcccgagactccgccggagtcaccggaaaagtacttcttacggtttctacggcgagagaggggatttgaatatattggccgtgttttggttttcgatggcttcggaggatgtgaagactagtgaatcagctgtttcgacgatcgtgaatttagctgaagaagcgaagctcgctagagaaggcgttaaagctcctagttatgctgttcttagtatctgcaagtctctcgttgccggcggcgttgctggtggagtgtcacgaactgccgttgctcctttggaacgtttaaaaatcttacttcaggttcagaatccacatagtgtaaaatacaatggaacaattcaaggcttgaagtacatttggagaacagaaggttttcggggactattcaaaggcaacggtactaattgcgctcgcattgttccaaattctgccgtcaagttcttcagctatgagcaagcttcaaagggaatcctatatttgtatcaacagcaaactggtgatgatgatgctcagctcactcctcttttacgccttggagctggagcatgtgctggaataattgccatgtctacaacttacccaatggacatggtacgaggcaggcttaccgtacagacagacagctctccttatcagtataggggaatgttccatgctctgtcaactgtgttgcgtgaagaaggcccacgagcattgtacaagggttggcttccttcagtcatcggagttataccatatgtgggcctgaactttgccgtgtacgaatctctaaaagatcggttaatcaaaagtaaagcatttggattggttgaagactccgagttgagcgtgacgaccaggcttgcttgtggggctgctgctggaactgttggccaaaccgttgcttaccctcttgacgtgattcgcagaagaatgcaaatggtaggatggaaagaggcagcctctgtcgtcactggtgatgggaggaacaaggcccctctcgtgtatactggcatgatcgatgcattcgggaaaactgttaggcatgagggctttggagcattatacaagggtctggcccctaattctgttaaggttgtaccatcgatagcactcgcgtttgtgacatatgaagtggtgaaggacattttaggggttgagattagaatatcagactgaaatggtgccccattcagattgaaatgtttatgatgaggaaggtgtgttgctattctttttttgtaggcaatggaacagataggaaggtgaactagggacagttttcttagtactcttatttcgtttctcataaatgagttttagaaacttgtacacagagagctgcaccgactcggaccgagaccgagtctcggctcgtgacactgcctgcctgtataatgtcttataatggcttcaaatgtttcctatgtaaacactgtacttattcacgtgttgtgccaataaggatgaaggaacaatgcgaataaccatttgtttgtaattatcgagc

SEQ ID NO: 4742 - DNA, 1633 bp, Gossypium hirsutum
agaaaagaagcgccgcatgagagaaatgcggagcctcttttgactataatatatatagcctcggagatcggaccctataagtcgccggataatcatcgacgactgcccgagactccgccggagtcaccggaaaagtacttcttacggtttctacggcgagagaggggatttgaatatattggccgtgttttggttttcgatggcttcggaggatgtgaagactagtgaatcagctgtttcgacgatcgtgaatttagctgaagaagcgaagctcgctagagaaggcgttaaagctcctagttatgctgttcttagtatctgcaagtctctcgttgccggcggcgttgctggtggagtgtcacgaactgccgttgctcctttggaacgtttaaaaatcttacttcaggttcagaatccacatagtgtaaaatacaatggaacaattcaaggcttgaagtacatttggagaacagaaggttttcggggactattcaaaggcaacggtactaattgcgctcgcattgttccaaattctgccgtcaagttcttcagctatgagcaagcttcaaagggaatcctatatttgtatcaacagcaaactggtgatgatgatgctcagctcactcctcttttacgccttggagctggagcatgtgctggaataattgccatgtctacaacttacccaatggacatggtacgaggcaggcttaccgtacagacagacagctctccttatcagtataggggaatgttccatgctctgtcaactgtgttgcgtgaagaaggcccacgagcattgtacaagggttggcttccttcagtcatcggagttataccatatgtgggcctgaactttgccgtgtacgaatctctaaaagatcggttaatcaaaagtaaagcatttggattggttgaagactccgagttgagcgtgacgaccaggcttgcttgtggggctgctgctggaactgttggccaaaccgttgcttaccctcttgacgtgattcgcagaagaatgcaaatggtaggatggaaagaggcagcctctgtcgtcactggtgatgggaggaacaaggcccctctcgtgtatactggcatgatcgatgcattcgggaaaactgttaggcatgagggctttggagcattatacaagggtctggcccctaattctgttaaggttgtaccatcgatagcactcgcgtttgtgacatatgaagtggtgaaggacattttaggggttgagattagaatatcagactgaaatggtgccccattcagattgaaatgtttatgatgaggaaggtgtgttgctattctttttttgtaggcaatggaacagataggaaggtgaactagggacagttttcttagtactcttatttcgtttctcataaatgagttttagaaacttgtacacagagagctgcaccgactcggaccgagaccgagtctcggctcgtgacactgcctgcctgtataatgtcttataatggcttcaaatgtttcctatgtaaacactgtacttattcacgtgttgtgccaataaggatgaaggaacaatgcgaataaccatttgtttgtaattatcgagctgagcttaggctgaattcgagcactgcaatattcaaat

SEQ ID NO: 4743 - DNA, 1583 bp, Euonymus alatus
tggtcctattacgccggggggatgtagcgcgtggatacataaacaaacgccgtcgtctctcccaagtcgtatcgtagttggagcctcagttccagttccaaatagccgtcactttacagtctacagagagagcagatactctctctattgtagttaccggagatccgattcgatagattgccgaaataatcgaagcagatccgagttacaccactcctccgacggctacttattttcctgcaagagactttttgttccaactaatttatggcttcagaggatgtaaaagcgagtgaatcggcggtctcgacgatcgtgaatctggccgaggaggcgaagcttgcaagggagggagtcaaggctcccagctatgccgttcttagtatctgcaagtctcttgtcgccggaggagtcgccggaggagtgtcacgcactgctgttgctccattggaacggttgaagatattgctacaggttcaaaatccgcacagcataaaatataatggaacagttcaaggattgaaatatatatggcaaactgagggttttcgtgggctgttcaaaggaaatggtaccaattgtgctcgaatcgtcccaaactcagcggtcaaattcttcagctatgagcaagcatctaaggcaatattgttgctgtatcagcaacaaactggcaatgaggatgctcagcttactcctgttttacgccttggagctggagcatgtgcaggaataattgccatgtctgcaacttatcccatggacatggtacgaggcaggctaacagtgcagacagagaaatctcctttccagtacagaggaatgttccatgctctatcaactgttctccgggaggaaggtccacgggctttgtacaagggctggcttccttctgtcattggagtaattccttatgtgggtctcaactttgctgtgtatggatctctaaaagattggttagtaaaagctaatggactttctgaagattcagaattaagtgtggtaacaaggcttgcatgtggagctgcggctggaactgttggccaaactgttgcctaccctcttgatgtgattcgccgaagaatgcagatggtgggatggaaagatgctgcatccattgtcacgggtgaagggaggagcaaagcgcaacttgaatataatggcatgattgatacattcaggaaaactgttcggcttgaaggctttggggcattgtacaagggtttggtacccaattctgtgaaggttgtcccatccatagcaattgcatttgtgtcctacgagatgataaaagacattttaggagttgaaatcaaaatatcggactgaagatgggtattttatcggatttattgaacaagtgttgctacatttgtaggcaagcatatagagagaaggtaactgggtactgttttcattttttacctgaatctagaagtatttttaagcctgtgttctatacgttgcttttcttggttttatatgtatgctcccctgatttcagcttgtcattcataagctgttttaataagtatgttgatggaataatgcaagaagaggaattgcatggggccatcctctccccc

SEQ ID NO: 4744 - DNA, 1501 bp, Flaveria ramosissima
catttcatttcatattattttccccacacacacttcagatcgccactcacgacggcgctccgcctgagttccctagggttccggcgaagtccccttcgattcaatcacctttcacctcttcttccatttctccggcgacatggcatcggaggacgtcgtagggaagacgagcgctacgatcgctaacatcgctgaagaagcgaagattgcgagtgtaggtgttaaggctccaagtcgtcagacgttgatgagcatctgcaaatcgctcgtcgccggaggcgttgccggtggagtatcgcgaactgctgttgctcctctggaaagaatgaaaattctgctccaggttcaaaatccgcacgcaatcaaatacaatggaactattcagggactaaaatatatatggagaacagagggtttgagaggaatgtttaaaggaaatggcaccaattgtgcacgcattgtcccaaactctgctgtcaaattctttagctatgaagaggcatccaaggggatcttgtggctatatcgacagcagcctggaaatgaggatgctgaactcacccctctcttacgcctcggagctggcgcttgtgctggaattattgccatgtcagcaacctatccaatggacttggttcgaggtcgtcttactgtccagactgataaatctccaagccaatatagaggaattgctcatgctcttacaacagtactccgtgaagaaggcccgcgtgcattatacaaaggatggcttccttcagtgatcggtgttgtaccatatgtggggcttaattttgcggtatatgaatccttaaaagactatctggtgaaatcaagaccatttggactagttgaagacgctgagttgagtgtcacaactaagcttgcatgtggggccgttgctggaaccataggtcaaacagttgcatatccgcttgacgtcattcgcagaagaatgcaaatggttggttggaaacatgctgcttcagttgtcactggtgaaggaaagtcatcacttgaatacactggaatgattgatgcattcaggaagaccgttcaccacgagggttttggtgctttgtacaagggtttggtccctaactcggtcaaggtggttccatcaatagccattgcatttgtgacatatgaggtggttaaggatgtactcaaggtagagatgaggatatccgaataaacaccgcattcttatcatatatttttattaaacgttcgcgttagtttgcttgcgtgtgcaaaagggtaaaaccgtcaagtaaaaaagttttgttctttaatctcttttacgttaagagatttagaactagcagtgttgatatggtcgagcggacccgtgtatgcaaccccagcatggttttctgttcgttatagtctgtttttgaaggtgtttcttgttctgttgttcgtatgtatgaactctaataaggaactgctcacagagttgagtcccgaccctcgctcggttgggaaatgatactatctg

SEQ ID NO: 4745 - DNA, 1535 bp, Flaveria ramosissima
tttccccacacacacttcagatcgccactcacgacggcgctccgcctgaattcgctagggttccggcgaagtccccttcgattcaatcacctttcacctcttcttccatttctccggcgttatggcatcggaggacgtcgtagggaagacgagcgctacgatcgctaacatcgctgaagaagcgaagattgcgagtgtaggtgttaaagctccgagccgtcagacgttgatgagtatctgcaaatcgctcgtcgccggaggcgttgccggtggagtatcgcgaactgctgttgctcctctggaaagaatgaaaattctgctccaggttcaaaatccacacgcaatcaaatacaacggaactattcagggactaaaatatatatggagaacagaggggttgagaggaatgtttaaaggaaatggcactaattgtgcacgcattgtcccaaactctgctgtcaaattctttagctatgaagaggcatccaaggggatcttgtggctatatcgacagcagcctggaaatgaggatgctgaactcacccctctcttacgcctcggagctggcgcttgtgctggaattattgccatgtcagcaacctatccaatggacttggttcgaggtcgtcttactgtccagactgataaatctccaagccaatatagaggaattgctcatgctcttacaacagtactccgtgaagaaggcccgcgtgcattatacaaaggatggcttccttctgtgatcggtgttgtaccatatgtggggcttaattttgcggtatatgaatccttaaaagactatctggtgaaatcaagaccatttggactagttgaagatgctgagttgagtgtcacaactaagcttgcatgtggggccgttgctggaaccgtaggtcaaacagttgcatatccgcttgacgtcattcgcagaagaatgcaaatggttggttggaaacatgctgcttcagttgtcactggtgaaggaaagtcatcacttgaatacactggaatgattgatgcattcaggaagaccgttcgccacgagggttttggtgctttgtacaagggtttggtccctaactcggtcaaggtggttccatcaatagccattgcatttgtgacatatgaggtggttaaggatgtactcaaggtagagatgaggatatccgaataaacaccgcattcttatcatatatttttattaaacgttcgcgttagtttgcttgcgtgtgcaaaagggtaaaaccgtcaagtgaaaaagttttgttctttaatctctcttacgttaagagatttagaactagcagtgttgatatggtcgagcggacccgtgtatgcaccccaagcatggttttctgttcgttatagtctgttttttgaaggtgtttcttgttctgttgttcgtatgtatgaactctaataaggaactgctcacagagttgagtcccgaccctcgctcggttgggaaatgatactatctgattgattagtattgttaacatataatacagagcttatggagtttttatgtt

SEQ ID NO: 4746 - DNA, 1375 bp, Flaveria ramosissima
atttcatttcatattattttccccacacacacttcagatcgccactcacgacggcgctccgcctgagttccctagggttccggcgaagtccccttcgattcaatcacctttcacctcttcttccatttctccggcgacatggcatcggaggacgtcgtagggaagacgagcgctacgatcgctaacatcgctgaagaagcgaagattgcgagtgtaggtgttaaggctccgagtcgtcagacgttgatgagcatctgcaaatcgctcgtcgccggaggcgttgccggtggagtatcgcgaactgctgttgctcctctggaaagaatgaaaattctgctccaggttcaaaatccgcacgcaatcaaatacaatggaactattcagggactaaaatatatatggagaacagagggtttgagaggaatgtttaaaggaaatggcaccaattgtgcacgcattgtcccaaactctgctgtcaaattctttagctatgaagaggcatccaaggggatcttgtggctatatcgacagcagcctggaaatgaggatgctgaactcacccctctcttacgcctcggagctggcgcttgtgctggaattattgccatgtcagcaacctatccaatggacttggttcgaggtcgtcttactgtccagactgataaatctccaagccaatatagaggaattgctcatgctcttacaacagtactccgtgaagaaggcccgcgtgcattatacaaaggatggcttccttctgtgatcggtgttgtaccatatgtggggcttaattttgcggtatacgaatccttaaaagactatctggtgaaatcaagaccatttggactagttgaagacgctgagttgagtgtcacaactaagctcgcatgcggggccattgctggaaccgttggtcagacagttgcatatccgcttgacgtcattcgcagaagaatgcaaatggttggttggaaacatgctgcttcagttgttaccggtgaaggaaagtcagcacttgaatacactggaatgattgatgcattcaggaaaaccgttcgccacgagggttttggtgctttgtacaagggtttggtccctaactcggtcaaggtggttccatcaatagccattgcatttgtgacatatgaggtggttaaggatgtactcaaggtagagatgaggatatccgagtaaacaccacattcttatcatatatttttattaaacgttcgcgttagtttgcttgtgtgtgcaaagggtaaaaccgtcaagtaaaaaggttttgttctttaatctcttttacgttaagagatttagaactagcagtgttgatatggtcgagcggcccctgtatgcaccccaagcatgattttct

SEQ ID NO: 4747 - DNA, 1107 bp, Tripterygium wilfordii
aaaaagcgagggaatcggcggtctcgacgatcgtgaatctggcagaggaggcaaagcttgcaagggagggagttaaggcccccagctatgccgttcttagtatctgcaagtctcttgtagccggaggagtcgccggaggagtgtcacgcactgctgttgctccattggaacggttgaagatattgctacaggttcaaaattcgcacagcataaaatataatggaacagttcaaggattgaaatatatatggaaaactgagggttttcgtgggctattcaaaggaaatggtacaaattgtgctcgaatcgtcccaaactcggcagtcaaattcttcagctatgagcaagcatctaaggcgatattgttgctgtatcagcaacaaactggcaatgaggatgctcagcttactcctgttttacgacttggagcgggagcatgtgcaggaataattgccatgtctgcaacttatcctatggacatggtacgaggcaggctaacggtgcagacagagaaatctcctttccagtacagaggaatgttccacgctctatcgactgttctccgggaggaaggtccacgggctttgtacaagggctggcttccttctgtcattggagtaattccttatgtgggtctcaactttgctgtgtatgaatctctaaaagattggttagtaaaagctaatggacttgctggagattcggaattaagtgtagtaacaaggcttgcatgtggagctgctgctggaactgttggccaaactattgcctaccctcttgatgtaattcgccgaagaatgcagatggtgggatggaaagatgctgcatccattgtcacaggtgaagggaggagcaaagctcaacttgaatataatggcatgattgatgcattcaggaaaactgttcggcatgagggctttggggcattgtacaagggtttggtacccaattctgtgaaggttgttccatccatagcaattgcatttgtgacctatgagatggtaaaagacattttaggagttgaaatcagaatatcagactaaagatggggtattctatcatctttattgaacaagcgtgctatttttgtaggctagcatatagaga

SEQ ID NO: 4748 - DNA, 1203 bp, Brassica juncea
agatcgtaatcgtagtggagtgattgcgattagatggcatcagaggatgtgaagaggagcgaatcggcagctgtatcaacgatcgtgaacctggcggaggaagcgagggaaggagtcaaagctccgggctatgctgtcctcagcatctgcaagtctctcttcgccggtggcgtcgctggtggagtgtcacgaactgcagttgcacctctggaaaggatgaagatattgcttcaggtgcaaaatccacataacataaagtatagtgggacggtccaagggttgaagtatatttggagaaccgagggacttcgtggtctgttcaaaggaaacggcaccaactgtgctcgtattgttcctaactcggctgtgaagtttttcagctatgagcaggcttccaagggtatactgtacttgtatcgtcagcagccaggaaatgaaaatgcacaactgactcctgttttacggcttggagctggtgcaactgctggaataatagccatgtctgcaacatacccgatggatatggttcgtggaaggctaactgtccagactgcaaactctccttatcaatatagaggaattgcacatgctttgtcaactgtactgcgagaggaaggtccaagggccttgtaccgtggttggcttccatcagtgattggagttgttccatatgtgggattgaactttgctgtctacgagtctctaaaggactggctagtcaaagacaatccgttcggactagttgagaacaatgagctgaccattataacgagactctcgtgtggtgctatagctggaacagttggtcaaaccattgcttatccactcgatgtgattcgtaggagaatgcaaatggttgggtggaaagatgcttcctctgtcgttacaggcgaggggagaagcaagcttgaatacaacggtatggttgatgcattcaggaaaacagttcgccatgaaggctttggagcattgtacaagggtttggtccccaactcagtgaaggttgtaccatcgattgcgattgcatttgtgacatatgagatggtgaaagacgttttaggagtggagtttaggatatcagattgagtccatttgatgatatcttcaagaagagagcagacttgtatttttgtaggcgaggagacagaagagaagttcgaaagtgaagggcttttatttgaatctcctttcagcatccttgga

SEQ ID NO: 4749 - DNA, 1614 bp, Vaccinium corymbosum
gtttgcccatttctcacgaaagaaccaacaagcatatctccttcgatcgggtatcgccggagaactcccgtcggcggcgccgctaggttagttagggtttgttgaatggcctctgaggatgtggtagggaagacgagcgagacggcggtgtcgacgattgtcaatctggcggaggaagccaagattgccagtgaaggagtcaaggctccctctcacgccgctctcttaagcatctgcaagtccctcgtcgccggcggcgttgccggaggagtgtcacgtactgctgttgctccattggaacgcttgaagattttgctccaggttcaaaatccccatagtataaagtacagtggaacagttcagggcttgaaatatatctggcgaactgaaggtttccgaggattatttaaaggcaatggtactaattgtgctcgcattgtcccaaactcagcagtcaagttctttagctatgaggaagcgtctaagggaattttatggttttatcgacagcaaactggaaatgaagatgctgagctcacccctctcttacgccttggagctggagcatgtgctggtatcattgccatgtcagcaacttacccaatggacatggtacgagggcgtctcactgtccagactgcaacgtctcctcgtcagtatagaggaattgcccatgctctttcaacagtttttcgtgaagaaggcccccgagctttgtacaaaggatggcttccttcggttataggagttattccctacgtgggcctgaactttgcagtatatgagtctctaaaggactggttgatcaaatctagaccatttggaatggccgaaaatgctgacttgagtgttgcaacaaagcttgcatgtggagctgcagctggaactgttggccagacagttgcctatcctcttgatgttatccgtcgaaggatgcagatggtgggctggaaagatgctgcttcagttcttactggtgaggggggagagcagagcaccactcgaatatactggcatggttgatgccttcagaaaaacagttcgcaatgagggttttagagccttgtataagggtttggtccccaattcggtgaaggtggtcccttcaatagcgattgcatttgtgacgtacgaggtggtaaaggacattcttggagttgagataaggatatctgactaaaaaaccgcaggcaagtttgggtatttgttggacttccgcgcgtatttttgcgaggaacggagatggtaaattatgggattatcttcttttagtctttaccagattgtgaggaagtttagaaaacaatttatagcacatgttgatattttccaacttatcttctccatctccctttgttcttagtctttttatttgtatgcattgccaataagtcgtcgagaaggttgcgccgaacgccctcttgtagatttcagaaacttttaacgtgtccgttgtttcgtattagtcctgtaacttgtttttcaagtggagagttattttgatttgttatgaaacagaaatgaataatttggtgctcgtctttgcacatctgctttttctattttggctgatgctttccctttatggtttttgtgattcttggactgctatgg

SEQ ID NO: 4750 - DNA, 1676 bp, Cicer arietinum
ggaagcttcgctcttagtagttagtggtctctgtgagctctcactcactctctctacagaagcttccgcagcaaccactttccgagcgagcaggagataaattatcgcttcttatcactaatcgccggagtagtttaccggagattcatagatcttacaatctccgacgacctagatttctctcttttttattttattccattccgattaggtcagggattataacttatttctattattaatattaattaattatatatataagcatggcttcggtggatgtgaaaaccggtgaatcagctgttacgaagatcgttaatctggaagaagcgaagctcgctagagaaggagttgttaagtctccaaactatgccatcggtagcatctgcaagtctctcgtcgccggtggagtcgcaggaggagtatcacgaacagcagttgctccactggaacgaatgaaaattttgctgcaggtccagaatcatcaaagcgtaaaatacaatggaacaatacagggcctaaaatatatatggagaactgaaggattccgtggactgtttaagggaaatggtactaattgtgctcgaattgtcccaaattctgcagtgaagttcttcagttatgagcaagcttctaaaggcatattgcatctgtatcagcagcaaactggaaatgagaatgctcaactgactcctgttttacgtcttggagctggagcatgtgctggaataattgctatgtctgccacttatcctatggatatggtccgaggcaggataactgtacagactgagaaatccccttatcagtacagaggaatgttccatgctttgtctactgtgcttagggaagaaggtccacgggctttatataagggatggcttccttcagtaattggagttgttccttatgtaggtctcaactttgctgtctatgagtccctaaaagattggttgattaaatccagaccatttggtctagtccaagattctgagttgagtgtgacaacacgcctagcttgtggtgctgctgctggaaccattggacaaactgtcgcttaccctctagatgtcattcgtcgaagaatgcagatgaccggctggaacaatgctgcttctgttataactggtgatggaagaggcaaagccccacttgaatatactggaatggttgatgcttttaggaaaactgttcgccacgaggggtttggtgcattatacaagggtctggtgcccaattctgtaaaggtggtcccatccatagctcttgcatttgtatcatatgagatggtgaaggacattttaggagtggagatcagaatatcagactaaagtttgataactcagtattatttgtttacctggtgtggtttacttctttttttgataggcaaggggatgcagagatggtaacttaaaattattttcttgttttcatctccaaggatgagtttagaactctagagttagtgtataaatttattcccttgtttctgtttgttttctttgagaacgtgctgtagtttccagcttcttattcatcttccatgtcaataagtgttgtggaaaaacaatgcaaggacatatttgcctagctttctgcactagttaagaaagcatttttcttagtggaatcgaatgtgattgatatttgcgtgccccatcccaccatatccc

SEQ ID NO: 4751 - DNA, 2782 bp, Gossypium raimondii
gtttgtattattatatttttataatttcttgtatcaaaacaaaatcttagaatttactgtaatattacacttcaaatttatatcatattcatattaattttggtgatttattttttaatcttatatttgtttgtttggagaggaaacgagggttagttgtagaatgaaaagagagggtattctggatatagaaatttcatttatctccgccaagttctaacagttctatatttttctacaacttcccttttctttgtatttctatcaacttagccaatgcttgctcactttcactcattcccctaatcactgcaaacaggatctcttcttcttctccgatcaccggtgtctgctcagcgccttattttgatcggataagttagggttccaacgttatatctctgtctgaattgcttttttcctctccttttttaattttattccccaaaaaatggcgtctgaggatgtgaaaagaagcgagtcggcggtctcgacgatcgtgaatctggcggaagaagcgaagatagctagcgaaggagttaaggcgccgagtcatgcgctgcttagtatttgcaagtctcttgttgctggtggtgtcgccggtggagtgtcacgtagtgctgttgctcccctagaaagattaaaaattttacttcaggttcagaatcctcatagtataaaatacaatggaacaatccagggtttgaaatacatatggagaactgagggtttcaggggaatgtttaaaggaaatggtactaattgtgctcgcatcattcctaactcagcagtgaagtttttcagctacgaagaagcctctaaggggattttatacctttatcggcagcaatcaggaaatgaggatgcacaactcactccgcttctacgccttggagctggtgcatgtgctggaatcattgccatgtcagcaacttatccaatggatatggtacgaggtcgtctaacagttcagactgagaagtcgcctcaccaatatagaggaatctttcatgctctttcaacagtattaagggaagaaggaccccgtgcattgtacaaaggctggttaccatctgtaataggagttgtaccttacgtcggtcttaactttgctgtttatgaatctctgaaagattggttgatcaaaaggaaaccccttgggctagttgaggactctgaactgggtgtcacaacaaggcttgcatgtggagctgctgctggaaccattggccagacagttgcttaccctcttgatgtcattcgacgcagaatgcagatggtgggctggaaggatgctgcttcagttgtcaccggtgatgggaagaacaaggcccccattgaatataatggtatggttgatacattcaggaaaacagtgcgctatgaaggttttggagcattatacaagggtttggttccgaattcagtgaaggtggttccatctatagcaattgcatttgtcacgtacgagttggtaaaggatgtactcggagttgagttaaggatatctgactgaaggaactcccaagagtttggtcaatcttttgtgttcattttgatgagcaagaattattttgcttttaaaggaaagatggttgattccatgcacctcatgtaattccgtgagcgtgaaaagttcccttatgcatttcctcttttgatggactcaagtcagctgagttgttttattgtgccccgcgcctgctgaacctcatctgaaacctccaaaagttatgagttgggacttattttcttctgaagcagcattaagactggctcaattctgaaatttgctgttctgcagattccagctgttgctgcatgttggaaactttctgatgatttcctccgcttctcacaccttgcttaaagaagctagataatctgatttaaatagaataccatgttaagctgactggcattttgaaatatccaggaaccagagttattggtaaaatgtagaaattacctagtttacttactttaagctgttcatcctttttggggtcaacatgatgcacaaggcacttcatagactccctaacaatgcttggtcatctcttagtcaaattaggaccagattaccgattaatttctctcagcaagtgtgcagaaagacaatctcatctcgagcatgaattctgaaaagcggaattaaggataccttgtgtttgtccgtggctattaacatgtaatgaagacacgctcgattcgaatcatgctttggctgtactagagttcactgtagcaacactaacatcgattgcacgccctgtcgactgtactttctctctggtgactatgctcttttggcatttgcgctctgaagctacggagatcaacccctcttgtgttctgctcttcctacttctagcactttggtcttccaaagtttatcatactccaacgattagagcccagcactccaccaacattgtttatttagcattccagcgtttcgtgctcacaagcatttaccagaaatgatttgtaatgttgctactaagatccaccaacattgtttattttagcattccagcgtttcgtgctcacaagcatttaccagaaatgatttgtaatgttgctactaagatccatcatgcattgaaggctatgaaactaactttagtttatcaggaacataatctgaaatataaagtatgccaagttttatttgcataccttttgtccccacctgaaacaggatttgaatcacttaattccatgttctgcaccaatcaactcaacagtacattatacaaatttcaccaatcaactcaac

SEQ ID NO: 4752 - DNA, 1955 bp, Eutrema halophilum
aacttttagtcgaaaagacatattcaaacctgttcctgttaaaaattatacactcttacaattatgttactcaaattttcaaccgaataacatacaaacatgaaattcgaatttttgaataattagaagtaaagttttgtgcttttcaaagtagaagggctattttacaaaacatgggttagtctaggatttggtttgtaaatttccgtaacaaaaggttgccattaaaacggcgtcgtcaggccagaggcttaatcagtagtaggttgtgtcttttggcttttatcatcgccgccgaaacagagagaaagagggtagatttgatctctcttttcgattaacttaaacggaaatttctgttagggtttcgatcgttgctggagagatcgaggagtggcataacttgtgaagagatcttaggagggatcgtaatcgtatttggtgtgattgcgatttatctgttggtggtgatttctcgatggcatcagaggatgtgaaaaggaccgaatcggctgcagtttcgacgatcgttaatctggcggaggaagcgaagctagcgagagaaggagtcaaagctccgagttatgctatccttagcgtctgcaagtctctctttgccggtggcgtcgctggtggagtgtcacgaactgcagttgcacctctggaaaggatgaagatattactccaggtccaaaatccgcataacataaagtacagtggtacagttcaagggttgaagtatatttggagaaccgagggccttcgtggactgttcaaaggaaatggcaccaattgtgctcgtattgttccaaattcggctgtgaagtttttcagctacgagcaagcttcagagggcctactgtacctgtatcgccggcggacaaaaaacgaaaatgctcaactcactcctcttttacgccttggagctggtgcaactgctggaataatagccatgtctgcaacgtacccgatggatatggttcgtggaaggctaactgttcagaccgcaaactctccttatcaatatagaggaattgcacatgctttgtcaactgtcctgcgagaggaaggtttccgggccttgtaccgtggttggcttccatcagtgattggagttgttccatatgtgggcttgaactttgctgtctatgagtccctgaaagactggctagtcaaagacaatccgttcggacttgtagaaaacaatgatctgaccattataacaagactctcttgtggtgctatagctggaacagttggtcaaacaattgcttatccactcgatgtgattcgtaggagaatgcaaatggttgggtggaaagatgcttcctctgttgtcacaggcgatgggagaaacaaggccgcgcttgaatacagcggtatgattgatgcatttagaaaaacagttcgtcatgaaggctttggagcattgtacaagggtttagttcccaactcagtcaaggttgtaccatcgattgccattgcatttgtgacatatgagatggtgaaagacgttttaggagtggaatttaggatatcagactgagagtcgtttgatatcttcaagaagagagcagcacacttctatttttgtagccgaggagacagaagagaagttcaaaatttaggggctttatttatctcctttcagcatccgtggaaggataaaaggctatagggctttagccaaactttttttttttcctttctacttatagattgggtttttgcttttcttctgaatcaaataagtcagagaccaactatatcaaacctatctggtactggagtttgtgttagatgctttggttgggtcttttggcattgagttatcattattgttatgtgactcatattggtaacttgccgattagttgaataattccgctttttctgtagttttcttaagaattcgtatcgtgtaaaataaaattcatgtgtgctagtctcagttt

SEQ ID NO: 4753 - DNA, 1595 bp, Gossypium hirsutum
gccaagttctaacagttctatatttttctacaacttcccttttctttgtatttctatcaacttagccaatgcttgctcactttcactcattcccctaatcactgcaaacaggatctcttcttcttctccgatcaccggtgtctgctcagcgccttattttgatcggataagttagggttccaacgttatatctctgtctgaattgcttttttcctctccttttttaattttattccccaaaaaatggcgtctgaggatgtgaaaagaagcgagtcggcggtctcgacgatcgtgaatctggcggaagaagcgaagatagctagcgaaggagttaaggcgccgagtcatgcgctgcttagtatttgcaagtctcttgttgctggtggtgtcgccggtggagtgtcacgtagtgctgttgctcccctagaaagattaaaaattttacttcaggttcagaatcctcatagtataaaatacaatggaacaatccagggtttgaaatacatatggagaactgagggtttcaggggaatgtttaaaggaaatggtactaattgtgctcgcatcattcctaactcagcagtgaagtttttcagctacgaagaagcctctaaggggattttatacctttatcggcagcaatcaggaaatgaggatgcacaactcactccgcttctacgccttggagctggtgcatgtgctggaatcattgccatgtcagcaacttatccaatggatatggtacgaggtcgtctaacagttcagactgagaagtcgcctcaccaatatagaggaatctttcatgctctttcaacagtattaagggaagaaggaccccgtgcattgtacaaaggctggttaccatctgtaataggagttgtaccttacgtcggtcttaactttgctgtttatgaatctctgaaagattggttgatcaaaaggaaaccccttgggctagttgaggactctgaactgggtgtcacaacaaggcttgcatgtggagctgctgctggaaccattggccagacagttgcttaccctcttgatgtcattcgacgcagaatgcagatggtgggctggaaggatgctgcttcagttgtcaccggtgatgggaagaacaaggcccccattgaatataatggtatggttgatacattcaggaaaacagtgcgctatgaaggttttggagcattatacaagggtttggttccgaattcagtgaaggtggttccatctatagcaattgcatttgtcacgtacgagttggtgaaggatgtacttggagttgagttaaggatatctgactgaaggaactcccaagagtttggtcaatcttttgtgttcattttgatgagcaagaattattttgcttttaaaggaaaggtaggaggatatttagagctcacttttagtatttttttaatgtcttccttatagctattgtcttctttgctcttaggttttcatattcatatatgcttttgccaataagtattttttgggaggttatcagaaaatagtatattcattaggaaatgatgcagccgatacacattctgatagatttcgcttttagtgaacttaaaatgttctgt

SEQ ID NO: 4754 - DNA, 6217 bp, Vitis vinifera
cgaatggaatcgcgtacatataatagttagtagactccgtctctctctatatatatagacccttcgaaacttctcgaatctccgtttcttttgagaaatgcagattcttggcctgtgataatcgccggaaccacctgaagagttaactgcggtgaactttgattgcgaatcctagggttccggcgagttcaattgaatcttagggttggtttaatggcatcggaagatgtgaagacaagcgaggctgcggtttcgaggatcgtgaatctggccgaagaagcgaagctcgcgagggaaggagtgaaggcgccgagtcacgcgcttctcagcgtctgcaagtctctcgtggccggaggagtcgccggaggagtgtcacgcactgctgttgctccattggaacggttaaaaattttgcttcaggtccaaaatcctcatactataaaatataacggaaccatccagggcttgaaatatatatggaaatctgagggtttccggggactatttaaaggcaatggaaccaattgtgcccgcattgtaccaaattcagcagtcaagttctatagttatgagcaagcatccaagggaattttatggctttaccggcagcaacctggcaatgaaaatgcagaactcactcctcttttacgccttggtgctggagcatgtgcaggaatcattgccatgtcagcgacctaccctatggacatggtacgagggcgattaactgtccagacagagaagtctcctcgccagtatagaggaatcttccatgctctttcaacagtcctcagggaagaaggtgcccgggctttgtacaaaggctggcttccttctgttataggagttataccatacgtgggtctcaactttgctgtgtacgaatccttaaaagattggttgatgaaagcaaaaccatttgggttagttgaggactccgagttgggtgtgacgacaaggctcgcatgtggggctgctgctggaaccgttggccagacagttgcttaccctcttgatgtcatccgccgcagaatgcagatggtgggctggaaagatgctgcttcagtcgtcactggtgatggtaggggcaaggcaccccttgaatacacggggatggttgatgcgttcaggaaaacagttcggcatgagggatttggggccttgtacaagggtttggtccccaattcagtaaaggtggtcccatccatagcaattgcatttgtgacatacgagatggtgaaggacattcttggagttgagatgaggatttctgactgaagccaagggaaactccagattatttattggacattggttctaattccaggagcaagaggaaggaataatggacactgtacctgctcttaccattcaaagtgagccctttcactccgaagagaaggtacatttcaagaaaaaagggttgttctgataccagaaacttaacaaaacccttttgtaatcattatttcccctcatcctcctctcaatttgaacctgccttagtttttagcttctacattcatatgctgtgccaataaggatttgtcaggtaataatgcaccagagctttctagaaattttaaattatcctttacctttatttgttgttactagtttatgaaatagaatttcagattctccctaccatgttctctatcctcatggcttttatctcgtctgtcgttgttctatcatataggttaaacaatatctgtggtttaatggcaatctaaatcgatagatggggaagctgaaaacttctgtgttcaatcagcagctactattattcgtttccgcacacttaatcgccctattgaaaaaattgaagtaatacaaaataaaccttcacacaaaaatcaaaatggacatattccaataaaaaattattaggaaaagaaaggaaaaatcttctaagttctctggcttctgatattcatctttgctagcatttcccttaggtaatcacagcgttcacggtgataatcgatccagatgcatagctgccttatggcttccctcttctgctcccccagatccaagataccttcgtccttcaaattcatcatcttctccaattctcccaccttcttctcaagttggctcacagcttttatcaggctctccttctcaccttcttccttccgttttttatattttagttgttccactaggttacttgcctcactcttcagttgttctttctcacttttggccatcttcacccagttccttgcaacctgaacttcgcctgctatttcagagatgcggttcttgaagtttatggagtcttcctcaaatttcccaactgtggattcaagtccagctaaggtattgtttactgtctctgagatatctgtgatcatcctgacatgggattcattgttggaagtaattacttctgataatactgcaacttttccttcaagtgccctgttttcttgctggaacctctcttctgctctcctgtagctctcttctttctcggatagtaattgttctgtgacacggagcttctggtttgataagcggagcttaacttcgatattgcggacctcctccaccaaagtactgagttcatctcctttgacttctaggtctcttttcaggtcttcaaccatggtttcaaaatcagcaattatgtgggctttggattcaaggtgaatgcgggactcttcctccatttcttccaacctcctttctgtgacttgcaggttattcttgaactcgtgaaacaaaccttcagattgtttgtactcctccattaacttgttgaatgcatcttcctgttctcttagcattctctgatgttcttcaaccttgctggttaactccatcctctgattctccaattccgtcaggctttccgaagattcttctttatgtctttggatctctaactccaattggcttttctcattctgcaaggaatgcagctcctgttgtagagcagacagctcatcccctctgtctgtaattgttttctccaagtcaaaactcctaacgtgcaagccctccttttcctctctcaactgattgaactccaggtctttggctcttatatgctcttcaagttcgcattcgtgtttccgaatcaactctatctccatttccaggtgctttaaccgtgctgttaaactctctatctcttccagcattctctgctgatccgcagccttgctcactagctcgtctttcagacttcctatttgactaaagtattctgaattttcttgaacttttccctcgagctgtgattccatttcggttttctggctgcttagagaatccaattcctgttgcatctcagtgatccggtccattaagcccttgatttcagctgaagcttcattgcttttgctcactatttgatcctccaattcacttttctgtgcaatcaaggtttccatgtcttgttgcagattgttgacttgtgttgttaaggccagaatttgagcagttgcttcactcgccccatcctcaagtttcttctggagagcagataactcattccctctgtctgttaatgttttctctaagtcaaaactcctaacatgcagaccctccttttcctcactcaacttattgtactcatggtgtttactgcttagctgctcctcgagttcgcttttgtggttctggatggagtccatctccaattccaggtccttcacctttgctaccaaactctccttctcttccagcattctctgctgatccacagtcttgttcgctagctcctctttcagatttcctatctgaatcaggaaccctgaattttcttgagttcttttctcgagtagcaattccttttctgttttctggctgtgtagagattccaattcctgtttcgtttcactgacctggcccatcaagtccttgatctgatctgatgcttcatcgcccctgcgtctcagctgttcttccaattcacctttctgagcttgcaaagaatccatctccactcgcagactgttaacctctgctgttaatgccacgattcgagctgatgcttcattctctgtatcctcaaacttcttctgcagagcagagagctcgtcccctctctctgttattgttttctccaagtcaaaactcctaacatgcaagccctccttttcctctctcaactgattgtactcatggtgtttactgcgtagctgctcatccagttcgcttttgtggttccttatggagtccatctccaattccaggtccttcaccttcgataccaaacactccttctcttccattgttctctgctgatccacagccttgttcgctagctcctctttcagatttccgatctgaatcaggaactctgaattttctagagttcttttcttgagtagcaattccatttcggttttttggctgtgtagagattccaattcctgttttgtttcattgagctggcccatcaagtccttgatctgatctgatgcttcatcgccattgcgtctcagctgttcttccaattcacctttctgagcatgcaaagaatccatctccacttgcagactgttaacctctgctgttaatgccacgattcgagctgatgcttcattctctgtatcctcaaacttcttctgcagagcagagagctcgtcccctctctctgttattgttttctccaagtcgaaactccttacatgcaagccctccttttcctctctcaactgattgtactcatggtgtttactgcttagctgctcctccagtgtgcttctgtggttccggatggagtccatctccaattccaggtccttcaccttccctgttaaactctctttctcttccagtattctctgttggtcggcagccttgctcaccaactcctctttcagatttcccatctgaataagatattctgaattctcctcagttttcttctcaagcatgagttccatttccattttcaagctgtgtaaagattccaattccagtttcagttcagtgacctgttctgttaagcctttgacttgaactgatgcttcttcactgttctggaccacttgtttttccaattcgtctttttgagcttgtagagaatccacctccagctgcagattgttgatctgtgctgtcaaatcagctattttagacaatgactcattctcatcatccttaaatttcttcaagagaccagcaagttcttcttctctctcttttgatatcgtttcaagctgtgaaatctgggctttcagtcctaaattttcctccgccagctgtttggcttcagttgctgtactctcaatcagcttttccatttctcctctctgggtgcttagggaactcagctccagttccaagcctgttacctgagcctctaaaccctttattcgagctgatgcttcattctcatgaccctcatgcttcttcatgagatttgaaagttcactttctttgtcacccagtttcacctttagctgacttgactcagccatgagttcttgcattgcattctccgcctgcttaaactcatttgaaatctccaaaattttcaaggctagagaatctttttcttcctcaatagctctatgagtgtgacttaaactgctcatttcctgccttgtggattccaatagctgctccagattggaaatttctcctttcacagcttccagttcttgctcgaggactagtttctcatctttcaacttatcacccgtcgacttcaattcttcagcaatttcctctcccacttcaatccttttgatagcagtctctttttccatgattaaattctctctctcccgatttaaatcttccagtctctggttcagttcagcttctacattactagcattgtccagtttttgcttcagatttccattctcaaccaaaagttcagttttttcaccatccaacctttcaacttcagatttccaatgcatgataatttcctctgtttctgggtttttgctaaaagcttttccatttttatcactcctttcctttgttgaatgatctgagtctgagtctgagctagtggtagatgaagtatctttctccggtttgccatgaatttttttccttagtatctcagtgagattatcatatcggtcatagagagattgataatttctatggaaatcctcaattagttcaataagtggttgtcttttcaagtttccatctccgttcccatccttttcatctaaaccttcctcttttataagctccaataacgttttcactttatcgtcaatctctg

SEQ ID NO: 4755 - DNA, 1966 bp, Vitis vinifera
atttaagtgttttgatgttttattggctgagaccagggagattctgtggacgacaagtttcttggtgaccacgtggtcctgaagtagcgcgagtatcttgtttttttaactactctggagagtgttttttagagcgatagtttggttatatataaaggtttggttcaggcgccgtcacatcgctctaatctctggactccgcctctctcagtcgccaccacgcgcagcgaccacggaggaatgtggactcttcttctttgaaaatcaccggagagctgatcgatcgccgggcaaacagcaggaaagccgagatctcgatcgtcgacgtagggcctccgtcggacaagtgatcccttacttagggtttcatggcttcggaggatgttaaacctagtgaatctgcggtgacgacgatcgtgaaccttgctgaagaggcgaagctcgcgagagaaggagtcaaggctccgagttatgcgattctcagtgttgcaaagtctctgactgccggtggagtcgcgggaggagtgtcacgcactgctgttgctccattggaacgattaaagattttgctacaggttcaaaatcctcataacataaaatacaatggaacaattcaaggtttaaagtacatatggaaaactgagggttttcggggactgtttaaaggcaatggaactaattgtgctcgtattatcccaaactcagcagtcaagttcttcagctatgagcaagcttctaagggtatattatatctatatcaacagcaaactggcaatgaagatgctcagcttactcctcttttacgccttggagctggagcatgtgctggaattattgccatgtctgcaacttacccaatggacatggtacggggcaggttgactgtacagacagaaaactcaccttatcagtacagaggaatgtttcatgctctatcaacagtgctccgacaagaaggaccacgagctttgtacaagggctggcttccttctgtcattggagttgttccatatgttggccttaactttgctgtttatgaatcattaaaggattggttaatcaaaagtaaagcatttggactagttcatgacaatgagttgggtgtgacaacaaggcttgcctgtggggcagctgctggaactattggccaaactgttgcttaccctcttgatgtcattcgccgaaggatgcagatgataggttggaaagatgctgcttctattgtcactggtgaaggaaggagcaaggcccctatcgaatatactggcatggttgatgccttcaggaaaactgttcggcacgagggcattggagcattgtacaagggtttggtccctaattcagtgaaggtagttccatccatagcacttgcatttgtgacgtacgagatggtgaaagacattctaggagttgagatcaggatatcagactgaagtgtggagaactccaccgtatttattgaaccagtgtgctatttttgtaggcaaagggaaagagagaaggtaaattagggtgatgtcttcctttttgtcacaggatgagaacatttagaaacctgtcggggcctctatgtttatataccgctttcccttgttttcctgtatttccccatgaacatgcttttagctcttagattctcattcatatgcagcatcaataagcatttgcaaggaacaattcaagaaatgcatttgcatgcctttctattaaagtcgaggaaatggttctactatcctatttgtagtgaccgtttatggagtagagtttatctctgtatttaacaagttaaatgtcttcactatgaatggtcattttgattatggttttaaaagcatacaagtagtgaacgaaccggtcttacattgagttatgcaccttctcgaatgtgtttgagcactctctttccttatctctatccatttccttttatttatagactattcgataatttgcttgagaattattg

SEQ ID NO: 4756 - DNA, 1579 bp, Mimulus guttatus
acacacacacaaatacacttactgtgtgccgcattttctcctgatttactctctctctccgccggcacctggaagagactgtaggcgcgtagtatgcacgcctgattcgatcgttgtagacctaggttttttttttttttttttttaatttaaaaaaaaaattagtgatttgattatttgatcgatcgatttttgggggaattgaatttgatggcgtctgaggatgtaaaggcgagcgattcggctgtgtcgaagattgtgaatttagcggaggaggcgaagctcgccaaggaagaaatcaagcctactagatttcaagtttacagtgtttgcaagtctcttttcgccggtggtgtcgccggaggagtgtcacgaactgctgtagctccattggagcgtttaaaaattctgctccaggttcaaaatccacacaatataaaatacagtggtacagttcaaggcttgaagtatatttatagaactgaaggctttaaaggattgtttaaaggcaatggcactaattgtgctcgtattgtcccaaattcggcagtaaagttcttcagctatgagcaggcatccaagggcatattatacttgtaccgtcagcaaactggtgatgaggatgctcagctgactcctttgctacgtctgggtgcgggagcatgtgctgggataattgccatgtcagccacatatccaatggatatggttagaggcagacttactgtacagaccgataagtccccttatcagtacagaggaatgtttcatgctttatcaactgttcttcgtgaggaaggcttccgcgctctgtacaagggttggcttccatctgttattggagtcgtaccgtatgtgggtctgaactttgctgtgtacgaatctcttaaagattggttaatcaaatctaagcaatttggtctagtcgaagacaatgaattgggtgtcataacgaggcttgcatgtggggccgcagctggtacagttggtcaaactattgcgtacccactcgatgtgattcgtcgaagaatgcaaatggtggggtggagtcatgcatcttcgattctcactggtgatggtagaagcaatgccccacttcaatatactggcatggttgatgctttcaggaaaaccgttcggcacgaaggtttcagagcattgtacaagggactagtccccaattctgtcaaggttgtgccatcaatagcaattgcattcgtgacgtacgaacaagtgaaagagttactaggcgtggagattagaatatccgattgatgcagagggagagagatttttttgtaggcaagaagaggaagaaggtatttattcatacaataaaatattacctattctgcacagagagagaaaattggaaactatccttaattcatctctgtttatatgttttttttttcttcgtctcgattcggaattattagctattagtcgaaatcgctttcttcaataagtaatagcaaagaataataatgcagtaacaataagtcttttatttaaggttttggtgtgtaagaagagagtagtaatttatttgtttgtctgtcaattttgaatttctggc

SEQ ID NO: 4757 - DNA, 1337 bp, Carica papaya
atcggcagtctcgacgatcgtgaatctggccgaggaggcgaagctggcgagggagggcgtaaaggctccaagctatgcgattctcagtatctgcaaatcactcgtggctggtggagtcgccggtggagtgtcaagaactgctgttgctccgttggaaaggttgaagatattgctgcaggttcaaaatcctcataatataaagtataatggaacaatccaaggcttgaaatatatttggagaactgagggatttcgtggattgttcaaaggcaatggcactaattgtgctcgtattgttccgaactctgctgtcaaattcttcagctatgagcaagcttctaagggaatactttatctttatcaacagcagactgggaatgaagatgctcaactcactcctgtcttacgccttggggctggggcatgtgctggaataattgccatgtctgcaacatatcccatggatatggtacgcggcaggttaacagtgcagacagagaagtctctctatcaatacagaggaatgttccatgccttgtcaactgtactccgagaagaaggtccccgagcattgtacaagggctggcttccatctgttattggagttattccttatgtgggtctgaactttgctgtgtatgaatcactaaaggattggttaattaaatctaaaccatttgggctagttcaagattctgagttgagtgtgacaacaaggcttgcatgtggggctgctgctggaactgttgggcaaactgtggcttacccacttgatgtcattcgccgaagaatgcagatggttggatggaaagatgcttcctcaattgttactggtgatggaagaagcaaggcatcccttgaatatactggaatgattgatgcatttaggaaaaccgttcgttatgagggctttggagcattatacaagggtttggtccccaattctgtgaaggtagttccatccattgctattgcatttgtgacgtatgaagtggtcaaggacattttaggagttgagattagaatatcagactgactttcaagacctccatatggtttcttcaacaagtgtgctatttttgtaggcaaggggattagagagaagataacctaggggtaattcttcctttttctctctgagaatgagtttagaaatttacgtggggcttgtttatatgttgctctcccttgatttttgtttctttgtgaacacactgtagtgtttggcctttcatttatgtgctgtgtcaataagtaagtttgagagagcaatggggataacattagctacctctctataagaattgagaaaataaattcatttttgcattgttgtt

SEQ ID NO: 4758 - DNA, 1584 bp, Capsicum annuum
gcacgaggctttcatcaaacgctgtcgtataaatcagcagttttttccaccttcatttctccgccgcattttcccatcgatctctcaccgtcgctgccggaaaatgtgcggttttttctaattctaatctatcacctaagttttttcggcgaaggattttgctgtttttttttttttaatggcttcggaggatgtgaaagcggcgagagatgcagcggtggagaaaattgtgaacttggcggaagaggctaagcttgctagagaagaaattaagcctactagtcatgctgttttcagtatttgcaagtcacttgttgctggaggtgttgccggaggcgtgtcacgaactgctgtggctccactggaacggctgaagatattgctacaggttcaaaatccacataacataaaatacaatggcaccattcaaggcttgaaatatatctggagaactgaaggattcaaaggactgtttaagggcaacggcaccaattgtgcacggatcgtcccaaactctgcagtcaagttcttcagttatgagcaagcgtccaagggtatattatatttgtaccggcaacaaactggaaatgaggatgctcagctcactccactactacgtcttggagctggtgcttgtgctggcataattgccatgtctgcaacttacccaatggacatggtgcgaggaagactcactgtgcagacagagaagtctccttatcaatacagaggaatgtttcatgcattgtcaactgtgcttcgcgaggaaggtccccgcgctttgtataaaggatggactccttctgtcataggagttattccatatgtggggcttaattttgctgtatatgaatcattaaaagactggttgatcaaagcaaaaccatttggtcttgttgatgattctgagcttggtgttgttacaaggctggcatgtggagctgctgcaggaacagttggacaaactgttgcataccctcttgatgttattcgcagaagaatgcagatggtggggtggagtcatgctgcgtctattgttactggtgatgggaggggcaaggctcccctcgaatatactggaatgattgatgcttttcggaaaactgtaaagtatgagggtgtcagagccttgtacaagggtttagtgcccaattcagtgaaggttgttccttcaatatctattgctttcgtggcatatgagcaagtgaaggacctattgggagttgagataagaatttctgactaatgaagagaagctccagtatttttctcattcatatgataatttttgtaggcaaggatacaaagggttataataacatggtggttacatagtcagtctagaaggagaatttagcgtcctgtttgtagcctatgtttagatcttcctactgtgtctggttgttgcttatttagtagtgttgtcaataagaaaattatcaagaatattgtaatgaataatctgagtgcctttgtgagttagagtaagaatattcatgtgttatcaacagccttttttttggctatatgatcagtcctttggaattgtaccagtacactcctataatgtgtcttttcacttag

SEQ ID NO: 4759 - DNA, 1406 bp, Capsicum annuum
atggcttcggaggatgtgaaagcggcgagagatgcagcggtggagaaaattgtgaacttggcggaagaggctaagcttgctagagaagaaattaagcctactagtcatgctgttttcagtatttgcaagtcacttgttgctggaggtgttgccggaggcgtgtcacgaactgctgtggctccactggaacggctgaagatattgctacaggttcaaaatccacataacataaaatacaatggcaccattcaaggcttgaaatatatctggagaactgaaggattcaaaggactgtttaagggcaacggcaccaattgtgcacggatcgtcccaaactctgcagtcaagttcttcagttatgagcaagcgtccaagggtatattatatttgtaccggcaacaaactggaaatgaggatgctcagctcactccactactacgtcttggagctggtgcttgtgctggcataattgccatgtctgcaacttacccaatggacatggtgcgaggaagactcactgtgcagacagagaagtctccttatcaatacagaggaatgtttcatgcattgtcaactgtgcttcgcgaggaaggtccccgcgctttgtataaaggatggactccttctgtcataggagttattccatatgtggggcttaattttgctgtatatgaatcattaaaagactggttgatcaaagcaaaaccatttggtcttgttgatgattctgagcttggtgttgttacaaggctggcatgtggagctgctgcaggaacagttggacaaactgttgcataccctcttgatgttattcgcagaagaatgcagatggtggggtggagtcatgctgcgtctattgttactggtgatgggaggggcaaggctcccctcgaatatactggaatgattgatgcttttcggaaaactgtaaagtatgagggtgtcagagccttgtacaagggtttagtgcccaattcagtgaaggttgttccttcaatatctattgctttcgtggcatatgagcaagtgaaggacctattgggagttgagataagaatttctgactaatgaagagaagctccagtatttttctcattcatatgataatttttgtaggcaaggatacaaagggttataataacatggtggttacatagtcagtctagaaggagaatttagcgtcctgtttgtagcctatgtttagatcttcctactgtgtctggttgttgcttatttagtagtgttgtcaataagaaaattatcaagaatattgtaatgaataatctgagtgcctttgtgagttagagtaagaatattcatgtgttatcaacagccttttttttggctatatgatcagtcctttggaattgtaccagtacactcctataatgtgtcttttcacttag

SEQ ID NO: 4760 - DNA, 1571 bp, Solanum tuberosum
gcatcgatctctcgccgtcactgccactgtcaatcaccgtagctgctggctgaggagttgaatcaccgaaacggtcagtggaaaatgtgtggatttccataagttttttttctcattccgatctacaaagtgagtatcggctggtgagttgttttttcggcgaaggagtttgctgttaggtctaggtgttcctttttagtcttatttatggcttcggaggatgtgaaggcggcgagagattcggctgtggagaaaattgtgaacctggcggaagaggctaagttagctagagaagaaattaagcctacaagccatgctgtcctcagtatctgcaagtcacttgtcgccggcggtgttgccggaggcgtgtcacgaactgctgtggctccactggaacggctgaagatattgctacaggttcaaaatccacataacataaaatacaatggcaccattcaaggcttgaaatatatctggagaactgaagggttcaaaggactgtttaagggcaacggcaccaattgtgcccggatcgtcccaaactctgcagtcaagttcttcagctatgaacaagcttccaagggtatattatatttataccggcagcaaactggaattgaggacgctcagctcactccactattacgtctcggagctggtgcttgtgctggcataattgccatgtctgcaacttacccaatggatatggtgcgaggaagactcactgtgcagacagagaactctccttatcaatacagaggaatgtttcatgcactgtcaactgtgcttcgcgaggagggtccacgagctttgtataaaggatggactccttctgtcataggagttattccatatgtggggcttaattttgctgtatatgaatctttaaaagactggttggtcaaaacaaaaccatttggtcttgttgataattctgagcttggggttgttacaaggctggcatgtggagctgctgcaggaacagttggacaaactgttgcctaccctcttgatgttattcgtagaaggatgcagatggtgggatggagtcatgctgcatctattgttactggtgatgggaggagcaaggctcccctcgaatatactggaatgattgatgctttcaggaaaactgtaaagtatgagggtgtcagagccttgtacaagggtttagtgcccaattcagtgaaggttgttccttcaatatctattgctttcgtggcgtatgagcaagtgaaggacctattgggagttgagatcagaatttctgactaatgaagagaagctccagtatttatctcattcttatgataattttgtaggcaaggatacaaagggttataataataacatggtggttacatagtctagacggcaaatttagagtcctgttcctagcctgtgtttagaacttccaactgtatgtggttgttgctttatttagtcgtgttgtcaataagaaaattatcaagaatagtgtaatgaataatttgagtgcctttgttagtgagagaatacgaatattcatgtgttttcaacagcttatttttggttatatgatcagttcctcg

SEQ ID NO: 4761 - DNA, 1629 bp, Solanum phureja
gtcgtataaaagagcaggttttggccttcatttctccgccgcatttaccatcgatctctcgccgtcactgccactgtcaatcaccgtagctgctggctgaggagttgaatcaccgaaacggtcagtggaaaatgtgtggatttccataagttttttttctcattccgatctacaaagtgagtatcggctggtgagttgttttttcggcgaaggagtttgctgttaggtctaggtgttcctttttagtcttatttatggcttcggaggatgtgaaggcggcgagagattcggctgtggagaaaattgtgaacctggcggaagaggctaagttagctagagaagaaattaagcctacaagccatgctgtcctcagtatctgcaagtcacttgtcgccggcggtgttgccggaggcgtgtcacgaactgctgtggctccactggaacggctgaagatattgctacaggttcaaaatccacataacataaaatacaatggcaccattcaaggcttgaaatatatctggagaactgaagggttcaaaggactgtttaagggcaacggcaccaattgtgcccggatcgtcccaaactctgcagtcaagttcttcagctatgaacaagcttccaagggtatattatatttataccggcagcaaactggaattgaggacgctcagctcactccactattacgtctcggagctggtgcttgtgctggcataattgccatgtctgcaacttacccaatggatatggtgcgaggaagactcactgtgcagacagagaactctccttatcaatacagaggaatgtttcatgcactgtcaactgtgcttcgcgaggagggtccacgagctttgtataaaggatggactccttctgtcataggagttattccatatgtggggcttaattttgctgtatatgaatctttaaaagactggttggtcaaaacaaaaccatttggtcttgttgataattctgagcttggggttgttacaaggctggcatgtggagctgctgcaggaacagttggacaaactgttgcctaccctcttgatgttattcgtagaaggatgcagatggtgggatggagtcatgctgcatctattgttactggtgatgggaggagcaaggctcccctcgaatatactggaatgattgatgctttcaggaaaactgtaaagtatgagggtgtcagagccttgtacaagggtttagtgcccaattcagtgaaggttgttccttcaatatctattgctttcgtggcgtatgagcaagtgaaggacctattgggagttgagatcagaatttctgactaatgaagagaagctccagtatttatctcattcttatgataattttgtaggcaaggatacaaagggttataataataacatggtggttacatagtctagacggcaaatttagagtcctgttcctagcctgtgtttagaacttccaactgtatgtggttgttgctttatttagtcgtgttgtcaataagaaaattatcaagaatagtgtaatgaataatttgagtgcctttgttagtgagagaatacgaatattcatgtgttttcaacagcttatttttggttatatgatcagttcctcgaaattatacaa

SEQ ID NO: 4762 - DNA, 1662 bp, Solanum lycopersicum
aagcaaacgccgtcgtataaaagagcaggttttggccttcatttgtccgccgcatttaccatcgatctctcgccgtcgctgcccccgtcaaacaccgttgctgctggctgaggagttgaatcaccgaaacggtcagtgggaaatgtgtgtatttccgtaagtctttttttgtcattccgatctataaagtatcggctggtgaatttttttttcggcgaaggagtttgctgttaggtctaggtgttcctttttagtcttttttatggcttcggaggatgtgaaggcggcgagagattcggctgtggagaaaattgtgaacctggcggaagaggctaagctagctagagaagaaattaagcctacaagccatgctgtcctcagtatttgcaagtcacttgtcgccggaggtgttgccggaggcgtgtcacgaactgctgtggctccactggaacggctgaagatattgctacaggttcaaaatccacataacataaaatacaatggcaccattcaaggcttgaaatatatctggagaactgaagggttcaaaggactgtttaagggcaacggcaccaattgtgcccggatcgtcccaaactctgcagtcaagttcttcagctatgaacaagcttccaagggtatattatatttgtaccggcaacaaactggaaatgaggacgctcagctcactccactattacgtctcggagctggtgcttgtgctggcataattgccatgtctgcaacttacccaatggatatggtgcgaggaagactcactgtgcagacagagaactctccttatcaatacagaggaatgtttcatgcactgtcaactgtgcttcgcgaggagggtccacgagctttgtacaaaggatggactccttctgtcataggagttattccatatgtggggcttaattttgctgtatatgaatctttaaaagactggttggtcaaaacaaaaccatttggtcttgttgataattctgagcttggggttgttacaaggctggcatgtggagctgctgcaggaacagttggacaaactgttgcctaccctcttgatgttattcgtagaaggatgcagatggtgggatggagtcatgctgcatctattgttactggtgatgggaggagcaaggctcctctcgaatatactggaatgattgatgctttcaggaaaactgtaaagtatgagggtgtcagagccttgtacaagggtttagtgcccaattcagtgaaggttgttccttcaatatctattgctttcgtggcgtatgagcaagtgaaggacctactgggagttgagatcagaatttctgactaatgaaagagaagctccagtatttatctcattcttatgataattttgtaggcaaggatacaaagggttataaataacatggtggttccatagtctagacggcgaaatttagagtcctgttcctagcctgtgtttagaacttccaactgtatgtggttgttgcttatttagtcgtgttgtcaataaaaaaattatcaagaatagtgtaacgaataattcgagtgcctttgttagtaagagagtacaaatatttcatgtgttttcaacagcttattgttagctatacgatcagttcctcgaaattatacaagtacactcctatttgtatcttttca

SEQ ID NO: 4763 - DNA, 1579 bp, Triphysaria pusilla
ctgttacgcattttcctcctccattctcactcctcacgaccatcgatccccggccgccaagagaaagagactttagctgggcgtagactgatatattgattttgatcctagacttagttagggttttttggagattgatacttttttgagtttttttactattatttatttccggatttaattgggggatttgatggcttcggaggatgtgaaggcgagcgaatcggcggtgtcgaagattgtcaatttcgcggaggaggcgaagcttgcgaaggaagaaatcaagcctactaagtatcaagtttacagtatctgcaaatctctggtcgccggtggtgtcgccggaggagtgtcaaggactgctgtagctcctctggagcggctaaaaattctgcttcaggttcagaatccgcacaatataaaatacaatggtactgttcaaggtttgaaatacatatggaggactgagggccttaggggattattcaaaggcaacggcactaattgtgctcgaattgtcccgaattcagcagtaaagttcttcagctatgagcaagcttccaagggtatattatacatgtaccggcaacaaactggcaatgaggatgcccagctgacgcctgtactacgtttggctgcgggagcttgtgctggaattattgctatgtcagccacatacccgatggacatggttcgaggcaggattactgtacagacagaaaagtctccttttcagtacagaggaatgtttcatgctttatcaactgtgctgcgtgaggaaggctttcgtgctctatacaagggttggcttccttctgtcattggagtggttccttatgtgggtctcaactttgctgtctatgaatcgcttaaagatcacataataaaaaacaactcctttgggcttgttgaagataaagaacttggtgtcgtgacaagacttgcatgtggggccgcagctggcacagttggacaaaccattgcataccctcttgatgtcgttcgtagaagaatgcagatggttggttggaatcacgcctcttcaattgtcgccggcgatgggagagcaaaggccgcccttgaatacactggcatggtcgatgctttcaggaagactgtgaggcacgagggcttcagagccttgtacaagggtttggtccccaattcagtcaaggttgtaccttcgatagcaattgcctttgtgacgtatgaacaagtgaaggagttgcttggggtagagattaggatatccgactgatccatgtgtgcacagcgagctgcgtcgtttgctcgtttctgtgtatttttttgtggtcggaaataggagaacatttttaacttttatttatattgattacctgtgtttttcttctgggtttcatcactagctgctcagtagaaagtgatgtctcaataagtaataatagcaaaaaacaaatgcaatcatagtttttattttcttgggttgcttgctcagtgattaaattttcaatttttattttatttttaattttcaaggttgaaaccttgcctattttggatcgatcaatctgtctcatcattttactcgtgttttctt

SEQ ID NO: 4764 - DNA, 1493 bp, Tripterygium wilfordii
gctgtcgttcaccctctgctgctcctgtacgcctccatttatctgtctctctgaaatgcgaaggccaagcccatagatcaccaaaaatcattaatcgctacgcacagtcaccgccggagtctgtccatagggttccggcgatggcctcagaggacgtgaaaaccggcgagtctgcagtttcgacgattgtgaacctcgcagaggaggcaaagcacgccagtgaaggagttaaggcgccgagtcatgctttttacagtatctgcaagtctcttgtagccggaggagtagccggaggagtgtcacgtacagccgttgctcctttagaaaggttaaaaattttgctgcaggttcaaaatcctcatagcattagatacaatggaacaattcagggtttgaaatatatctggaaaactgagggtcttagagggatgtttaaaggcaatggcactaattgtgctcgtattgtaccgaattcagcagtcaagttcttcagttatgagcaagcttcaaagggcattttatggcttcatcagcaataaactggaaatgaagaggctgagcttaatcctcttttgcgcctcggagctggtgcatgtgctggaattattgccatgtccgcaacttatccaatggacatggttcgaggtcggctgacagtccagacagagaagtctccccaccaatatagagggatcttccatgctctttcgacagtcctccgtgaagaaggccctcgggcattgtacagaggctggctgccttctgtcataggagtcgtgccatatgtcggtctcaactttgctgtctatgaatctctaaaagactggttggttaaaaccaaaccatttggactagctgagaacaaagaattgagtgtgacaacaaggcttgcatgtggggctgctgctggaactcttggccagacggttgcttaccctcttgatgttatccgacgaagaatgcagatggtgggctggaaagatgctgcttccattgtcactggtgatggtaagagcagagcacccattgaatatcatggtatggtcgatgcattcaggaaaacagtcaagcatgagggttttggagcattgtacaaaggtttagtccccaactcagtcaaggtggtgccatccatagcaattgcatttgtgacgtacgagttagtgaaggacattcttggtgttgagatgaggatatctgactgaagttttacgagttcttatacttgttggtatactgattggctgcctctgcaaattttacctgccaaacaaactaggcattggaaggtaaattgtctgagatttctctcctggctgggtatagtttagaagtctgctttatccgcttgttgataatcccgtgcaacttgtatcctccggtcgcaactcatcttagtctttagattatttatcctcatatgctattccaataagtagatcagaaataatacttctgcattgtaataggtttattaatcgaattttcaattc

SEQ ID NO: 4765 - DNA, 1890 bp, Brassica rapa
tcctttgatagtagaagggctgtttttagaaaacgtaggttagtcaagggtttgattagcaaatattagaaagaaaaggctgactttaaaacggcgtcgtcgtcatcactcgggggcttaatcagtaggttgttgtctcttggcgtttgataatcgccgccggtagatttgattcgagagacgttcttcgatctctcttctcgttaaaatcctaaactgtattgggttttttcgttgagagatcgtgaagaaatcttctgagatcgtaaccgtagtggagtgattgcgattatcgatcgatggcatcagaggatgtgaagaggagcgaatcggcagctgtatcaacgatcgtgaacctggcggaggaagcgagggaaggagtcaaagctccgggctatgctgtcctcagcatctgcaagtctctcttcgccggtggcgtcgctggtggagtgtcacgaactgcagttgcacctctggaaaggatgaaaatattgcttcaggtgcaaaatccacataacataaagtatagtgggacggtccaagggttgaagtatatttggagaaccgagggacttcgtggtctgttcaaaggaaacggcaccaactgtgctcgtattgttccaaactctgctgtgaagtttttcagctatgagcaggcttccaagggtatactgtacttgtatcgtcagcagccaggaaatgaaaatgcacaactgactcctgttttacggcttggagctggtgcaactgctggaataatagccatgtctgcaacatacccgatggatatggttcgtggaaggctaactgtccagacggcaaactctccttatcagtatagaggaattgcacatgctttgtcaactgtccttcgagaggaaggtccacgagccttgtaccgtggttggcttccatcagtgattggagttgttccatatgtgggattgaactttgctgtctacgagtctctaaaggactggctagtcaaagacaatcctttcggactagtggagaacaacgagctgaccatcataacgagactctcgtgtggtgccatagctggaacggttggtcagacaattgcttatccactcgatgtgattcgtaggagaatgcaaatggtggggtggaaagatgcttcctctgtcgttacaggcgaggggagaagcaagcttgaatacaacggtatggttgatgcatttaggaagacagttcgtcatgaaggctttggagcattgtacaagggtttggtccccaactcagtgaaggttgtaccatcgattgcgattgcgtttgtgacatatgagatggtgaaagacgttctaggagtggagtttaagatatcagactgagtccatttgatgatgatgtattcaagaagagagagggagcaccacacttctatttttgtagccagaggagagacagaagagaagttttaggggctttttatttcaatctcctttcagcatccttggaagggataaaaggctataggtcattcattagccaaaccttttgttttctttttcgttctttctatttatagattgagttttcttctgaattataataaagtcaagaggccaacctttatcaaaaacattcaaacctgtttgctgctggagcttgtgtttgcaggttttggttgggtcttttgacaaagttatcatcattgttatgactctcttattggttactcgtgtattagttaaataattctgcatttctcttgtatcttgtaagataagattcatgatgtatgctagctactctcaagtgttttatgtatcgaatcatatcttctcaagtcaagtcataaacatggcagactacatttcaaagaaacagattcacagacaagagagaagggtttatggttaaaaaaaa

SEQ ID NO: 4766 - DNA, 1684 bp, Brassica rapa
ttgttgtctcttggcgtttgataatcgccgccggtagatttgattcgagagacgttcttcgatctctcttctcgttaaaatcctaaactgtattgggttttttcgttgagagatcgtgaagaaatcttctgagatcgtaaccgtagtggagtgattgcgattatcgatcgatggcatcagaggatgtgaagaggagcgaatcggcagctgtatcaacgatcgtgaacctggcggaggaagcgagggaaggagtcaaagctccgggctatgctgtcctcagcatctgcaagtctctcttcgccggtggcgtcgctggtggagtgtcacgaactgcagttgcacctctggaaaggatgaaaatattgcttcaggtgcaaaatccacataacataaagtatagtgggacggtccaagggttgaagtatatttggagaaccgagggacttcgtggtctgttcaaaggaaacggcaccaactgtgctcgtattgttccaaactctgctgtgaagtttttcagctatgagcaggcttccaagggtatactgtacttgtatcgtcagcagccaggaaatgaaaatgcacaactgactcctgttttacggcttggagctggtgcaactgctggaataatagccatgtctgcaacatacccgatggatatggttcgtggaaggctaactgtccagacggcaaactctccttatcagtatagaggaattgcacatgctttgtcaactgtccttcgagaggaaggtccacgagccttgtaccgtggttggcttccatcagtgattggagttgttccatatgtgggattgaactttgctgtctacgagtctctaaaggactggctagtcaaagacaatcctttcggactagtggagaacaacgagctgaccatcataacgagactctcgtgtggtgccatagctggaacggttggtcagacaattgcttatccactcgatgtgattcgtaggagaatgcaaatggtggggtggaaagatgcttcctctgtcgttacaggcgaggggagaagcaagcttgaatacaacggtatggttgatgcatttaggaagacagttcgtcatgaaggctttggagcattgtacaagggtttggtccccaactcagtgaaggttgtaccatcgattgcgattgcgtttgtgacatatgagatggtgaaagacgttctaggagtggagtttaagatatcagactgagtccatttgatgatgatgtattcaagaagagagagggagcaccacacttctatttttgtagccagaggagagacagaagagaagttttaggggctttttatttcaatctcctttcagcatccttggaagggataaaaggctataggtcattcattagccaaaccttttgttttctttttcgttctttctatttatagattgagttttcttctgaattataataaagtcaagaggccaacctttatcaaaaacattcaaacctgtttgctgctggagcttgtgtttgcaggttttggttgggtcttttgacaaagttatcatcattgttatgactctcttattggttactcgtgtattagttaaataattctgcatttctcttgtatcttgtaagataagattcatgatgtatgctagctactctcaagtgttttatgtatcgaatcatatcttctcaagtc

SEQ ID NO: 4767 - DNA, 2247 bp, Cannabis sativa
atcaaatttggtagagaaaacatttttatcacagtcgttgaataaagggtgtgatgtggtgcccacgtgagactcagtagactcgcaccaactcagctttgttgagccctcgtgcaccacaaagtggctgaaaatggttctaaccttacacgtgtcgagatatcaaggcgtgtagggtaaatatagtctacacccgcgagtaggtgttccctaccctcgttccttttctttcttaatctgtctgtttatataaatctcaaactaataaacagacgccgtcactttgagagagagagcttccgaagtttcgaccttcatttccagggttcaggcaggctcggctcagctcagctcagctccccctcaaagccgccgtcagtcaccgccgtattcgtatcaccatagccactattttcggtacaaggtaatgttgttgtggaagaggcacgctttcccgtaagagagagagaatcagagtagtcttatttattcttcttcttcttctgatcaatcaacggaattagctgccgagtaaagtatttttcagatcagagtttcacgtagacctaggtttccggcgagtcaattaccgagcttgataaatatggcttcggaggatgttaaacagagtgaatctgcggtttcgacgatcgtcaatctggctgaggaggccaagctttcgagagctcgtgagagtgtggtaaacgcccccaagcacaaccttgcgcttctcagtatatgcaagtctcttgttgctggtggagttgctggaggagtgtcacgcacagctgttgctcctttggaacgcttgaaaatcttactacaggtccagaatccccatagcataaaatacaatggaacaattcaaggtttaaaatatatctggagaactgaaggtttccgtggactatttaaaggaaatggtaccaattgtgcccgtatagtcccaaactctgccgtcaagtttttcagctacgaacaagcttctaaggcaatattgcttatgtatcagcaacaaactggcaacgaggatgctcaactcacacctcttttacgacttggggctggagcatgtgctggaattattgccatgtccgcaacttacccaatggacatggtacgggggaggataactgtgcagacagacaaatctccatatcagtacaggggaatgtttcatgctctctcaactgtactcagagaggagggcgcaagggctttgtacaaaggatggcttccatcagttattggagtggttccttatgttggtctcaactttgctgtttacgagtctctcaaggattggctaattacatctaagccctttggcctcattgataaatctgacactgagttgagtgtgacaacaaggttggcatgtggagctgctgctggaactgtcgggcagactgttgcttacccacttgatgttattcgccggagaatgcagatggtgggttggaataatgctgcatctgttgttgctggtgatggaaggagcaagggctcacttgaatacaaagggatggttgatgcctttaggaaaaccgtccgacatgagggctttggggcattgtacaagggattggtcccaaattctgtcaaggtagtcccgtcgattgcaattgcatttgtttcgtatgagatggtgaaggaaatattaggagtggagatcagaatatctgactagagaagaatgaagtgggaggatattcgtgtgttatttttgtaggaaaggggatagagagatggtaaaactaggggtaatttctttctttctttttcttttgtcttgccaagttagtagctggtattgagtttgttgtttataaattgctgtccctttgttttctgtctttgtttccttgtgaacacatatatatgagtaggtttcaactcctcatttaatatgtatgccaataaatgtttatgacactttcataaaatgcatttttgcatgcatttccctctacaagagttaaatagaggtgaattctccatttgtactgactttatataaatttaagtctctttccaaatgcttcacttccaactactctccacttctttcttaatatattctttggtattttaccttgtaaaaatatctctgtaaatttatttacctttttttttaactgatattcagtttatgtccatgctagctattttgatttatatgtagaaagaaataaaaaaaaccctagtatattactgtagtaccatggttgtcaccctaaatctgat

SEQ ID NO: 4768 - DNA, 1398 bp, Gossypium hirsutum
aatggcgtctgaggatgtgaaaagaagcgagtctgcggtctcgacgatcgtgaatctggcggaagaagcgaagatagctagcgaaggagttaaggcgccgagccatgcgttgcttagtatttgcaagtctcttgttgctggtggtgtcgccggtggagtgtcacgtagtgctgttgctcccctagaaagattaaaaattttacttcaggttcagaatcctcatagtataaaatacaatggaacaatccagggtttgaaatacatatggagaactgagggtttcaggggaatgtttaaaggaaatggtactaattgtgctcgcatcattcctaactcagcagtgaagtttttcagctacgaagaagcctctaaggggattttatacctatatcggcagcaatcaggaaatgaggatgcacaattcactccacttctacgccttggagctggtgcatgtgctggaatcattgccatgtcagcaacttatccaatggatatggtacgaggtcgtctaacagttcagactgagaagtcgcctcgccaatatagaggaatctttcatgctcttttaacagtattaagggaagaaggaccccgtgcattgtacaaaggctggttaccatctgtaataggagttgtaccttacgtcggtcttaattttgctgtttatgaatctctgaaagattggctgatcaaaaggaaaccccttgggctagttgaggactctgaactgggtgtcacaacaaggcttgcatgtggagctgctgctggaaccattggccagacggttgcttaccctcttgatgtcattcgacgcagaatgcagatggtgggctggaaggatgctgcttcagttgtcaccggtgatgggaagaacaaggcccccattgaatataatggtatggtcgatacattcaggaaaacagtgcgctatgaaggttttggagcattatacaagggtttggttccgaattcagtgaaggtggttccatctatagcaattgcatttgtcacgtacgagttggtgaaggatgtacttggagttgagttaaggatatctgactgaaggaactcccaagagcttggtcaatcttttgtgttcattttgatgagcaagaattattttgcttttaaaggaaaggtaggaggatatttagagctcacttttagtatttttttaatgtcttccttatagctattgtcttctttgctcttaggttttcagttttcatattcatatatgcttttgccaataagtattttttgggaggttatcagaaaatagtatattcattaggaaatgatgcagccgatacacattctgatagatttcgcttttagtgaacttaaaatgttctgttgccaagttatattcatgattattctaataaaaaagaa

SEQ ID NO: 4769 - DNA, 1500 bp, Ambrosia trifida
aaaataataatccaattccaacccaaccaactgcagccttcctataaataaatattggagtattattattattcatcatttcctttaatttgttcttcatcacagttgcttgctgaatttgtgtgatcacagttgatatgacatcagaggacgtggcctgcaaaacaagtgtgacgatcactaacatagctgaagaagcaaagattgcaactgaaggtgttaaggctcccaatcgtcaaactttgctcggaatttgcaaatctctcgtcgccggtggcgttgccggtggagtatcgcggactgctgttgctccgctagaaagattgaaaattctgctccaggttcaaaatccacatgcgatcaaatacaatggaactattcagggactaaagtatatttggagaacagagggatttagaggaatgtttaaaggaaatggcaccaattgtgcacgcattgtcccaaactctgctgtcaaattctttagctatgaagaggcatccaagggaattttgtggttatatcgacagcaacctggaaatgaggatgctgaactcactcctcttttacgacttggagctggtgcttgtgctggaataattgccatgtcagcgacctatccaatggacttggttcgaggtcgaattactgtccagactgataaatcttctactcaatatagaggaatgacacatgctcttactacagtactccgtgaagaaggtccacgcgcattatacaaagggtggcttccttctgttattggtgttataccatatgtggggcttaattttgcggtatacgaatccttaaaagactatttggtgaaatcaagaccatttgggctggttgaagacaaggagttgggtgtgactactaagctcgcatgtggggccattgctggaacctttggtcaaacagttgcatacccgcttgatgtcatacgcagaagaatgcaaatggttggttggaaacatgctgcctcagttgttactggtgaaggaaagtcaaagtcaacacttgagtacaccggtatgattgatgcatttagaaaaactgttcgtcatgagggttttggtgctttgtacaagggtttggtaccaaactcagtcaaggtggttccatcaatagcgattgcatttgtgacatatgaggtggttaaggatgtactcaaggtagagatgaggatatccgattaattaaacaaagcttcacattcttattcaatttgcatgctaaagggtaaggaggtaaaccgccactaatatctttgagttatcggtttttgataataaaacgattttaaactagcccatgttgatatagtctagccgacacggcatgtatgcacccagaacactgttttatatcagctgtagttcaggttttaactttaaagctttttaccattggtatgtatgaacaatgataataaggaaatgcttacagagtttaggtccggttttaaaaacctggaaatgatactatgttgtttaataa

SEQ ID NO: 4770 - DNA, 1707 bp, Aquilegia formosa
ttttgatcagtaaattgcaacacaagaaaatgctataaagcgccgacatcgaaaacaatcatttaactggcgtattttagcaaataaaaccctctttcatttctctctcttcatttttagttgtacgaactctttaagagaaatgcagggttttgtcgtcgtatagccgccggaaaaaaattgattgctcatcggataatatatcgggaaactgaaaccttcttcatttcgttattctttagggttccggcgagattgagtgattgatttattagggttttaatggcttcagaagatgtgaaaacaacgagtgaatctgctgtttcaacaatcgttaatctggctgaagaagcaagtgaaagagtgaaagctcctggttatagtattcttagtatttgcaagtctcttattgctggtggtgttgctggaggagtgtcacgtactgctgttgccccattagaacggatgaaaattttgcttcaggttcaaaatccccatagcataaaatatagtggaacagttcaaggcttgaagtatatatggagaactgagggtctcagaggtttatttaaaggcaatggtactaattgtgcgcgtattgttcctaattcggcagtaaaattctttagttacgagcaagcatctagaggtatattgacgctctaccgacggcaaactggcaatgaggatgcacaacttactccacttctacgtcttggagctggagcgtgtgctgggatcattgccatgtcggcaacgtaccccatggatatggtacggggaaggcttactgtccagacggagaaatctcctttccagtatagaggtatatgccatgctcttgcaacagttttccgacaagaaggtcctcgagctctgtacaaaggatggcttccttctgtcattggagttgtcccatacgtcggcctcaattttgcagtgtatgaatcacttaaggactggttaataaagactagaccgtttggactagttgaagactcagaattaagtgtgccaacaaggcttgcatgtggggctgctgctggaactgttggccaaacagttgcttaccctcttgatgtaattcgacgaagaatgcagatggtgggctggagtaatgcttcttctattgttgctggtgaagggatgaataaggcggcacttgagtatactggcatggtcgatgcatttcgaaaaacagttcgtaccgagggttttcgtgcgttgtacaagggcttggtgccaaattctgtgaaggtggttccatctattgcgattgcgtttgtgacatacgagcaagtgaaagatatccttggagtcgaaatcagaatatcagactagttggacttcagaataattgatgaattctcatgctatttttgtaggcagaaggaaagggatagtgtaggtgggagggatggtggtaacttagcgaaatctattattggggagaatgagggatgttaaaatcatttttagttggtatggtttatttattttttgcttatttatgtgtcctttgtttaaagaggcctacattttagcttcttctcattcgggtgctatggaaataagggtgtgtatttaaagctattttttccaataaggtttgaggagaaaataattgactgtttatactttctctgtggtgttgcagttggttgtctttgtttgagacagtatttataaattccatatcatggtgct

SEQ ID NO: 4771 - DNA, 1307 bp, Arnica chamissonis
gatcgccagagagaactcacggcggcgattctttgctgaatttggtaggttccggcgaagttccaattcatttcattccgcgttaactgtgttcatttacgcttttgatatggcatcggaggacgtggtagggaagacgagcgccacgatcgttaatatcgccgaagaagcaaaaattgcgagtgcaggtgtcaaggctccgagtcgtcaaactatactaagcatctgcaaatctctcgttgccggaggcgtcgccgggggagtatcgcggactgctgttgctcctctggaaagaatgaaaattctgctccaggttcaaaatccgcatgcaatcaaatacaatggaactattcagggactaaaatatatatggagaacagagggtttgagaggaatgtttaaaggaaatggcaccaattgtgcacgcatcgtcccaaactctgctgtcaaattctttagctatgaagaggcatccaagggaatcttgtggctatatcgacagcaacctggaaatgaggatgctgaactcactcctctcttacgcctcggagctggtgcttgtgctggaataattgccatgtcagcaacctatccaatggacttggttcgagggcgtcttactgtccagactgataaatctcctagccaatatagaggaattgctcatgctcttacaaccgtactccgtgaagaaggcccgcgtgcattatacaaaggatggcttccttctgtcattggtgttgtaccatacgtggggcttaattttgcggtatacgaatccttaaaagactatttggttaaatcaagaccattaggactagctgaagacaccgagttgagtgtgacaacgaagcttgcatgtggggccgttgctggaactgttggtcaaacgattgcatatccacttgatgtcatacgcagaagaatgcaaatggttggttggaaacatgctgcttcagttgttactggtgaaggaaagtcaaagtcaacacttgaatacactggcatgattgatgcattcagaaaaaccgttcgttatgaaggttttggtgctttgtacaagggtttggtccctaactcggtcaaggtggttccatcaatagccattgcatttgtgacatatgaggtggtcaaggatgtactcaaggtagatatgaggatatctgaatagaacaaaacacggtgttatatatttttattaaatatttgtgttagtttgggtgagcaaaagggtaaaatcgtcaagtaaaaagttttgttctttaatctctgtaaagagatttagaactaactcgtgttgatatagt

SEQ ID NO: 4772 - DNA, 1689 bp, Citrus sinensis
gcttatatagatacacaaatgatgacgtccaaatgagcgcacgccgtcactcgcacagagtcacaaaagttgacactccactttcagtcctcggaagccgtcaacaaaatcttcgtcagtaacagatgcaaattatcatcgccgcccgataatcgccggagatccgacacccgaccgatcaattgaaagtgcgaaaggacacgactgcttgctgtctgtctttttctggtagcctagggtttggtatcattgatggcttcggaggatgtgaagacgagcgaatcggcggtgtcgaagatcgttaatctggcggaagaggccaagcttgcaggagaaggcgtcaaagccccaagctatgctgttctcagtatttgcaaatctctcgttgctggaggagttgccggcgcagtatctcgcactgctgttgctccattggaacgattgaaaatactactacaggtgcagaatccccacagtataaaatataatggaacgattcaaggtttgaaatatatatggagaactgaaggatttcgcggactgtttaaaggcaatggtaccaattgcgcacgtattgttccaaactcagctgtcaaatttttcagctatgagcaagcttctaagggaatactgtatctgtatcagcatcacactggaaatgaagatgctgaactcactcctcttttacgccttggagctggagcatgtgctggaataattgccatgtctgccacttaccccatggatatggtacgggggaggctaactgttcagacagaaaagtctccataccggtacaggggaatcttccatgctctttcaactgtgctgcgggaagaaggcccacgggctttgtacaggggctggtttccttcagtaattggagttgtcccctacgtgggtctcaactttgctgtgtatgaatctttaaaagtttggttaatcaaaactaagccccttgggttagctgaagattctgagttgagtgtgacgacaagactagcgtgtggagctgctgcaggaacagttggccaaactgttgcctaccctcttgatgttatacgccgaagaatgcagatggtgggttggaaagaagcttcctctgtggtcattggtgatgggagaaacagagctcctcttgaatataatggcatgattgatgcattccgaaaaactgtccggcacgaggggtttggagcattatacaagggcttggttcccaattctgtgaaggttgttccatccatatcactagcatttgtgacttatgaggtggtgaaggacattttaggagttgaaattagaatatcagactgaagtttgtggaactttgacatttgttggacagaggtgttatttttgtagggaaggggttagggaaaaggtaaagtaggcattcttgccttttgtctttctaaggtcaagtctagatacacgtttgagcttgtgtttataattcgctttcttttgtttcccatctatgtttccctgggaacattctgtacctttcaacttcctattcatgtgccgtgtcaataagttatgcagaaggaacaaagcagaaaataagcaaatttttgagtccttcctagtaattgattttacttgatctctctcatgtactgcatgttattgcactatgaatatatcatttaaataattggatgcgaatgagtgatgcagtttgtt

SEQ ID NO: 4773 - DNA, 1696 bp, Unknown
  Sequence found in Organisms: Citrus clementina, Citrus sinensis
gcgcttatatagatacacaaatgatgacgtccaaatgagcgcacgccgtcactcgcacagagtcacaaaagttgacactccactttcagtcctcggaagccgtcaacaaaatcttcgtcagtaacagatgcaaattatcatcgccgcccgataatcgccggagatccgacacccgaccgatcaattgaaagtgcgaaaggacacgactgcttgctgtctgtctttttctggtagcctagggtttggtatcattgatggcttcggaggatgtgaagacgagcgaatcggcggtgtcgaagatcgttaatctggcggaagaggccaagcttgcaggagaaggcgtcaaagccccaagctatgctgttctcagtatttgcaaatctctcgttgctggaggagttgccggcgcagtatctcgcactgctgttgctccattggaacgattgaaaatactactacaggtgcagaatccccacagtataaaatataatggaacgattcaaggtttgaaatatatatggagaactgaaggatttcgcggactgtttaaaggcaatggtaccaattgcgcacgtattgttccaaactcagctgtcaaatttttcagctatgagcaagcttctaagggaatactgtatctgtatcagcatcacactggaaatgaagatgctgaactcactcctcttttacgccttggagctggagcatgtgctggaataattgccatgtctgccacttaccccatggatatggtacgggggaggctaactgttcagacagaaaagtctccataccggtacaggggaatcttccatgctctttcaactgtgctgcgggaagaaggcccacgggctttgtacaggggctggtttccttcagtaattggagttgtcccctacgtgggtctcaactttgctgtgtatgaatctttaaaagtttggttaatcaaaactaagccccttgggttagctgaagattctgagttgagtgtgacgacaagactagcgtgtggagctgctgcaggaacagttggccaaactgttgcctaccctcttgatgttatacgccgaagaatgcagatggtgggttggaaagaagcttcctctgtggtcattggtgatgggagaaacagagctcctcttgaatataatggcatgattgatgcattccgaaaaactgtccggcacgaggggtttggagcattatacaagggcttggttcccaattctgtgaaggttgttccatccatatcactagcatttgtgacttatgaggtggtgaaggacattttaggagttgaaattagaatatcagactgaagtttgtggaactttgacatttgttggacagaggtgttatttttgtagggaaggggttagggaaaaggtaaagtaggcattcttgccttttgtctttctaaggtcaagtctagatacacgtttgagcttgtgtttataattcgctttcttttgtttcccatctatgtttccctgggaacattctgtacctttcaacttcctattcatgtgccgtgtcaataagttatgcagaaggaacaaagcagaaaataagcaaatttttgagtccttcctagtaattgattttacttgatctatctctctcatgcactgcatgttattgcactatgaatatatcatttaaataattggatgcgaatgagtgatgcagtttgtta

SEQ ID NO: 4774 - DNA, 1465 bp, Flaveria ramosissima
cacttcagatcgccactcacgacggcgctccgcctgaattccctagggttccggcgaagtcccctctcattcgatcctctgccacctcttcttcaatttctccggcgatatggcatcggaggacgtcgtagggaagacgagcgctacgatcgctaacatcgctgaagaagcgaagattgcgagtgtaggtgttaaagctccgagtcgtcagacgttgctgagcatctgcaaatcgctcgtcgccggaggcgtcgccggtggagtatcgcgtactgctgttgctcctctggaaagaatgaaaattctgcttcaggttcaaaatccgcatgcaatcaaatacaatggaactattcagggacttaaatatatatggagaacagagggtttgagaggaatgtttaaaggaaatggaaccaattgtgcacgcattgtcccaaactctgctgtcaaattcttcagctatgaagaggcatctaaagggatcttgtggctatatcgacagcagcctggaaatgaggatgctgaacttacgcctctcttacgcctcggagctggtgcttgtgctggaattgttgccatgtccgcaacgtatccaatggacttggttcgaggtcgtcttactgttcagactgataaatctcctagccaatatagaggaattgcccatgctcttacaacagtactccgtgaagaaggtccgcgtgcattatacaaaggatggcttccttctgtcattggtgttgtaccatatgtggggcttaattttgcggtatatgaatccttaaaagactatctggtgaaatcaagaccatttggactagttgaagacaccgagttaagtgtgacaaccaagctcgcgtgtggagccgttgctggaaccgttggtcaaacggttgcatatccacttgatgtcattcgcagaagaatgcaaatggttggttggaaagatgctgcttctgttgttactggtgaaggaaagtcaaagtcagcacttgaatacactggaatgattgatgcattcaggaaaaccgttcggcacgagggttttggtgctttgtacaagggtttggtccctaactcggtcaaggtggttccatcaatagccattgcatttgtgacatatgaggtggttaaggatgtactcaaggtagagatgaggatatccgagtaaacactgcattcttatcatatatttttattaaacgttcgcgttagtttgcttgcgtgtgcataagggtgaaaccgtcaagtaaaaaagttttgttctttaatctcttttacgttaagagatttagaactagccgtgttgatatggtcgagcggacccctgtatgcaccccaagcatggttttctgttagttatagtctgttttttgaaggtgtttcttgttctgttgttcgtatgtatgaactctaataaggaaatgctcaaagagttgagtcccgacccccgctcggttgggaa

SEQ ID NO: 4775 - DNA, 1747 bp, Fragaria vesca
ccttcttgtaacgaacgggctcagagtcgccgataaatcgcgggaaaaactcgtcgttcggatcggcactccggcaggcctatatttccggcgagccgctcgctgaggttctacttggatctcgcttttctttttctttcccttgtgggggctcgggaatgtcgtcggaagacgtcgccgggaagaggacgagcgagacggcggtttcgacgattgtgaacctggcggaggaggcgaagctcgccagcgaaggagtcaaggcgcctacccaggccgcgctccttagcatcgcaaagtctctcgtcgccggaggagtcgccggaggagtgtcgagaactgctgttgctcctttggaaagactgaagattttgctccaggttcaaaatcctcatagtatcaagtacaatgggacagttcagggcttgaagtatatatggagaagtgagggtttcagaggcttgtttaaaggcaatggaactaattgtgctcgcatagtcccaaattcagcagtcaagttctttagctatgaggaggcatccaggggaatcctatggttttatcgacagcaaactggagatgaaaatgctcaactcacacctcttttgcgcctcggagctggtgcatgtgctggaattattgcaatgtcagcaacttacccgttggacttggtacgagggcggctaactgtccagacggaaaactctcctcggcagtataggggaatatttcatgctctttcaactgtctttcgggaagagggacctagagctttgtacaaaggctggttaccttctgtcattggagttataccatatgttggtctaaattttgccgtttatgaatctctgaaagattggttgatcaaaactagacctttcggactagttcaggactctgacttgagtataacaacaaggcttgcatgtggggctgcagctggaactgttggccagacggttgcttaccctcttgatgtcgttcggcgaagaatgcagatggtaggctggaaggacgcggcttcggttgtcactggggatgggaagagcaaggcagctattgaatatgctggtatggttgatacattcaggaaaacagttcgtcatgaggggtttggagcactgtacaagggtttagtacccaattctgttaaggtggtgccttccatagcgattgcctttgtcacttatgaggtagtgaaggatgttcttggagtcgagatgagaatatctgattaaaagcaagagaaacctgagctacatgcttaactctaattcggaaaatgaaaggaatgactggcaggagaaggcaaggtgatggaattcttaggtctcgtagtagcaggaagattagaaacacagttgtagcttatgttgatgttccttcccatttatacctgtcttgcctaaacacctatagttttagctttcaaatccttcttattcttatgcttctgagaacatgttgcttcacagttacttgctacagaatacaggtgtatttatttctctgttatacaggctatataactcttatgtggggaaaaatcatggcgatgaaagaattacagccaatgtaacagagaagtgctgatgaacttcattgactgttttccttgtgtttgggatcttatgtctacagtttcaaattacattagctggattcttatttaataaaagtatttgaagatagtgaggtttcattgtatgctttattgttgtataatagttatcagcctttgctatctagc

SEQ ID NO: 4776 - DNA, 1555 bp, Valeriana officinalis
acatatatagatagatatatgtatgtgtatgtattgcagctataaaatcattttgtgtgctgcccaattctctcgcaggtttttggttttacagatagcttagccggagaatctgagagaggggtttctgttagggttctgttaaagttagggttttagcatggcgtctgggaaaactagcgagacggctgtttcgacgatcgttaatctggctgaagaagctaaaattgcaagtgaaggagttaaggctccgagtcgactcgctttgcttagcatctgtaaatctctcgtcgccggtggcgtcgccggcggagtgtctcgcactgctgttgctcccttggaacggctaaagattctccttcaggttcaaaatccgcataatataaaatacaatggaaccgtccaagggctgaaatatatctggagaacagagggttttcgaggtttgtttaaaggcaatggtactaactgtgctcgaatcgttcctaattctgctgttaagtttttcagctatgaggaagcatcaaaggggattctgtggctgtatagacaacaacctggaaatgaggatgcggaactcagtccacttttacgtcttggagcgggagcatgtgctggaatcattgcgatgtcagcaacctacccaatggacatggtgcgaggccgcattacagtccagacggataagtcacctctaaagtataggggaatagctcatgctcttacaacagttcttcgcgaagaaggtccgcgtgcattatataaaggatggcttccttctgttatcggagtcgtaccatatgtgggtctgaactttgctgtatacgaatctctaaaagattggttagtgaaatcaaggccattcggactagtcgaagacactgagctgagtgtaacaactaagcttgcatgtggggctgctgccggaacggtgggccagacagtggcttatccgctagatgtaattcgccggagaatgcagatggttggctggaaagatgccggaggtgttgtgtccggcgacggaaaagctcatgtcaggcatgaatataccggtatgattgatgcttttagaaaaactgttaggcatgaaggttttggagctctgtacaaaggtttggtccccaattctgtcaaggtggtgccttctatagcgattgcatttgtgacatacgaggtcgtgaaagacgttcttggcgttgaggttaggatatctgattagaatctgacgaaggcaagtttgaggatttctttttgataatcttttggcgttgaagggtattatggtgtaagttattttagtttaaaaatttgtttaatttgtcgattagaaacccggtttggtagctaataatgttgatgttcacatgattcaattatttacccaattaaaacgttttagacttaattgggtttaattaaagttatttttcgtagtaaactagtttaggtttaaggtaggggttaatctggtaggaaacgtgttggtttacgttgcgttacgtggttattagtgttcggtattggttagaattaataataacaagttcgggcg

SEQ ID NO: 4777 - DNA, 1360 bp, Carthamus tinctorius
gaaatcattctcacccatatgtgctttctccttattcgtctcctcccatttcatttcctctcacaaattcagatcgccggaggatagcaacgacggcgaatctagctcaattttcctagggttccggtgaactttcatttcattatatacatacatatatacacacacacatatatacatatatatcgtgtttaggtatggcgtcggaggacgtggtagggaagacgagcgctacgatcgctaatatcgctgaagaagctaagattgcgagtgaaggtgtgaaggctccgagtcgtcagactttgctcggaatctgcaaatcgctcgtcgccggtggcgttgccggtggagtatcacgtactgccgttgctcctttagaacgaatgaaaattcttctccaggttcaaaatccgcatgcgataaaatacaatggaaccatccaggggctaaaatatatatggagaacagagggtttgcgaggaatgtttaaaggcaatgggaccaactgtgctcgcattgtcccaaactctgctgtcaagttcttcagctatgaggaggcatccaagggaatcctgtggctctatcgacagcaacctggaaatgaggatgctgaactcagtcctctattacgccttggagctggtgcttgtgccggaatattgccatgtcggctacttatccatggacttggttcgagggcggcttactgttcagactgataaatctcctagccagtatcgaggaattgctcacgctcttagaacagtactccgtgaagaaggcccgcgcgcgttatacaaaggatggcttccttctgtaattggtgtggtaccatacgtggggcttaatttcgcggtatacgaatctttaaaagattggttggtgaaatcacggccgttcggattagtcaaagacaccgagttaagcgtgacaacaaagcttgcatgtggggctgcggctggaaccgttggccaaacagttgcgtatccgctcgatgtgatacgcagaagaatgcaaatggttgggtggaaagatgcagcttcggttgttacgggggacggcaagtcggcgcttgaatacaccggaatgatcgatgcattcaggaaaaccgttcgatatgagggctttggcgctttgtacaagggtttggtcccgaactcggtgaaggtggtcccgtcgatagccattgcatttgtgacgtacgaggtggttaaggacgtactgaaggtagaaatgaggatatctgattaaacaacgctttgttgaacgttgggcgttattcgtttgcgtgcaaaaaggggtagcaaaatttgttctccgaactctttgattttatcgtggctttatgataacgaaaaag

SEQ ID NO: 4778 - DNA, 1533 bp, Centaurea maculosa
ttattattattaagttagggttccgctgcattacatagtttccatttcgtagggttttaggcggtgctctaatggcgtcggaggatgtggtaggtaaaaccagcgctacgatcgctaatctagccgaagaagctaagattgctagcgaaggtgttaaggctcccagccgtcacgctcttctcagcatctgcaagtctctcgtcgccggcggcgtcgccggtggagtgtcacgaactgctgttgcccctctggaacgattgaaaattctgctccaggttcaaaatcctcatgcaatcaaatataatggtaccatccaagggttgaaatatatatggagaacagagggttttcgtggattgtttaaaggcaatggcactaattgtgctcgtattgttccaaactctgctgtcaagttttttagctacgaagaggcatcaaagggaattctgtggctccatcggcagcaacctggaaatgaggatgctgaactcacccctctcttacgtcttggagctggtgcatgtgctggaataattgccatgtcagctacctatcctatggacttggttcgaggtcggcttactgtccagaccgacaaatctcccagccagtatcgaggaattgcacatgctcttagaacggtactgcgtgaagaaggtccacgtgcattatataaaggatggcttccttctgtcattggtgttgtaccttatgtgggtcttaattttgcggtctatgaatcattaaaggactggttaattaaatcaaggccatttgggctagtcgaggatactgagttgagcgtaacaacaaagctcgcctgtggggctgcagctggaactgttggccaaacagttgcttatcctcttgacgttatccgccgaagaatgcaaatggttggttggaaagatgcagcctctgttgttactgcagacggaaagtcaggactcgagtacactggaatggttgatgcattcaggaaaaccgttcgctatgagggttttggggccttgtacaagggcttggtcccgaactcagtaaaggtggttccttcgatagctattgcgtttgtgtcatatgagatggttaaggatctactgggagtagagatgaggatatctgattgagaattgatgttatttttacgggcagaagagagaaaggagaaggtaaaagacgtggaggtcataatttttttttgttctcttctctgtttcggtgagataaaagcgaagagatttagaagttgttagtgttgatatagccgtcgacccccaacactttgtttctttctttctttctatgttttctgctgtttgtggtttttgggtgttgtgattcatacacaccaacaccacctagtaataaggatgttttcatagggctgaggttgatgatgctactatcagtaaattcagtattattgttagtatttttcattactatcataataatgactgttttctgatgatgcttttgtttttaaagctagttttatttgtatttcaagattctcacttcattgaaaaaaaa

SEQ ID NO: 4779 - DNA, 1280 bp, Ambrosia trifida
gaagctccattcatttgtcaattcaatcactctatttatacatatatggcatcagaggacgtggtagggaagacgagcgccaccatcgctaacatcgccgaagaagcgaagattgcgagtgtaggtgtcaaggctcccagtcgtcagacgttgctaggcatatgtaaatctctcgtcgccggaggtgttgctggtggagtatcacgaactgctgttgctcctctggaaagaatgaaaattctgctacaggtacaaaatccaaatgcaatcaaatacaatggaactattcagggactaaaatatatatggagaacagagggtttgagaggaatgtttaaaggaaatggcaccaattgtgcacgcatcgtcccaaactctgctgtcaagttctttagctatgaagaggcatccaagggaatcttgtggctatatcgacagcaacctggaaatgaggatgctgaactcacccctctcttacgcctcggagctggtgcgtgtgctggaataattgccatgtcagcaacctatccaatggacttggttcgaggccgtcttactgtccagacggataaatcccctagtcaatatagaggtattgcacatgctcttacaacagtactccgtgaagaaggcccacgtgcattatacaaaggatggcttccttctgtcatcggtgttataccatacgtggggcttaattttgcggtatacgaatccttaaaagaccatttggtgaaatcaagaccgcttggactagttcaagacactgagttgagtgtgacaactaaactcgcatgtggggccgttgctggaaccgttggtcagacagttgcctatccacttgatgtcatacgcagaagaatgcaaatgggtggttggaaaaatgctgcttcaattgttaccggtgaaggaaagtcaacacttgagtacactggaatgattgatgcattcaggaaaaccgttcgtcatgagggttttggtgcgttgtacaagggtttggttcccaactcggtcaaggtggttccatcaatagccattgcatttgtgacatatgaggtggttaaggatgtactcaaggtagagatgaggatatcggactagaacaatgcattcttactatatatttttatccaacatttgtgctagctttcgcgtgcaaaagggtaaaaccgtcaagtaaaaggttttgttctttaatctcttttacaaagagattcagaactagcccgtgttcatatggtcgagtggatccctgtatgcaccctaagcatgctttttct

SEQ ID NO: 4780 - DNA, 1645 bp, Brassica napus
ggcgtttgataatcgccgccggtagatttgattcgagagacgttctttgatctctcttctcgttaaaatcctaaactgtgttgggttttttcgttgagagatcgtgaagaaatcttctgagatcgtaaccgtagtgaagtgattgcgattatcgatcgatggcatcagaggatgtgaagaggagcgagtcggcagctgtatcaacgatcgtgaacctggcggaggaagcgagggaaggagtcaaagctccgggctatgctgtcctcagcatctgcaagtctctcttcgccggtggcgtcgctggtggagtgtcacgaactgcagttgcacctctggaaaggatgaagatattgcttcaggtccaaaacccacataacataaagtatagtgggacggtccaagggttgaagtatatctggagaactgagggacttcgtggactgttcaaaggaaacggcaccaactgtgctcgtattgttcctaactctgctgttaagtttttcagctacgagcaggcttccaagggtatactgtacttgtaccgtcagcagccaggaaatgaaaatgcacaactgactcctgttttacggcttggagctggtgcaactgctggaataatagccatgtctgcaacatacccgatggatatggttcgtggaaggctaactgtccagacggcaaactctccttatcaatatagaggaattgcccatgctttgtcaactgtcctgcgagaggaaggtccacgggccttgtaccgtggttggcttccatcagtgattggagttgttccatatgtgggattgaactttgctgtctacgagtctctaaaggactggctagtcaaagacaatcctttcggacgagtggagaacaacgagctgaccatcataacgagactctcgtgtggtgccatagctggaacggttggtcaaacaattgcttatccactcgatgtgattcgtaggagaatgcaaatggtggggtggaaagatgcttcctctgtcgttacaggcgaggggagaagcaagcttgaatacaacggtatggttgatgcatttaggaagacagttcgtcatgaaggctttggagctttgtacaagggtttggtccccaactcagtgaaggttgtaccatcgattgcgattgcgtttgtgacatatgagatggtgaaagacgttctaggagtggagtttaagatatcagactgagtccatttgatgatgatgtattcaagaagagagagggagcagcacacttctatttttgtagccagaggagagacagaagagaagttttaggggctttttatttcaatctcctttcagcatccttggaagggataaaaggctataggtcattcattagccaaaccttttgttttctttttcgttctttctatttatagattgagttttcttctgaattataataaagtcgagaggccaacctttatcaaaaacattcaaacctgtttgctgctggagcttgtgtttgcaggttttggttgggtcttttgacaaagttatcatcattgttatgactctcttattggttactcgtgtattagttaaataattctgcatttctcttgtatcttgtaagataagattcatgatgtatgctagctctctcaagttggggg

SEQ ID NO: 4781 - DNA, 1170 bp, Cirsium arvense
atggcgtcggaggatgtggtaggtaaaaccagcgctacgatcgctaatctagccgaagaagctaagattgctagcgaaggtgttaaggctcccagccgtcacgctcttctcagcatctgcaagtctctcgtcgccggcggcgtcgccggtggagtgtcacgaactgctgttgcccctctggaacgattgaaaattctgctccaggttcaaaatcctcatgcaatcaaatataatggtaccatccaagggttaaaatatatatggagaacagagggttttcgtggattgtttaaaggcaatggcactaattgtgctcgtattgttccaaactctgctgtcaagttttttagctacgaagaggcatcaaagggaattctgtggctccatcggcagcaacctggaaatgaggatgctgaactcacccctctcttacgtcttggagctggtgcatgtgctggaataattgccatgtcagctacctatcctatggacttggttcgaggtcggcttactgtccagaccgacaaatctcccagccagtatcgaggaattgcacatgctcttagaacggtactgcgtgaagaaggtccacgtgcattatataaaggatggcttccttctgtcattggtgttgtaccttatgtgggtcttaattttgcggtctatgaatcattaaaggactggttaattaaatcaaggccatttgggctagtcgaggatactgagttgagcgtaacaacaaagctcgcctgtggggctgcagctggaactgttggccaaacagttgcttatcctcttgacgttatccgccgaagaatgcaaatggttggttggaaagatgcagcctccgttgttactgcagatggaaagtcgggactcgagtacactggaatggttgatgcattcaggaaaaccgttcgctatgagggttttggggccttgtacaagggcttggtcccgaactcagtaaaggtggttccttcgatagctattgcgtttgtgtcatatgagatggttaaggatctactgggagtagagatgaggatatctgattgagaattgatgttatttttacgggcagaagagagaaaggagaaggtaaaagacgtggaggtcataattttttttgttctcttctctgtttcggtgagataaaagcgaagagattta

SEQ ID NO: 4782 - DNA, 1696 bp, Lactuca sativa
atcgcatcgcataaatcgtgttttcttctcatttggttcaattttatatttattccccatttgacatccactgagatcgccggaggaggcctcgcgacggcgaatctttattaatttgcggtagggttccgctccaatttataatttccatttgtagggtttagccggttgacatggcgtcggaggatgtagtagggaagaccagcgctacgatcgctaatctcgccgaagaagcaaagattgccagtgaaggtgtcaaggctcccagccgccacgctttactcagcatctgcaagtctcttgtggccggcggcgtcgccggtggagtatcaagaactgctgttgctcctctagaacgattgaaaattctgctccaggttcaaaaccctcacgctatcaaatataatggtacaatccaagggttgaaatatatatggagaacagagggttttcgtgggctgtttaaaggaaatggtactaattgtgctagaattgttcctaactctgctgttaagttctttagctatgaggaggcctcaaagggaatattgtatctgtatcggcagcaacctggaaatgaggatgctgaactcacccctctcttacgtcttggagccggtgcatgtgctggaataattgccatgtcagcaacctaccccatggacttggttcgtggtcgtcttactgtccagaccgatacatctccaagtcagtatcgaggaattgcccatgctcttagaacagtactacgtgaagaaggtccacgcgcattatacaaaggctggcttccttctgtcatcggtgtcgtcccgtatgtgggtcttaattttgcggtgtatgagtctttaaaagactggttggttaagtcgagaccgtttgggttggttgagggaacagagttgagtgtgaccacaaagcttgcatgtggggctgcagctgggacggttggtcaaacggttgcttacccgcttgatgtgatccgtagaagaatgcaaatggttggttggaaagatgcggcttcggttgttactgcagatggaaagtcagcacttgagtacactggaatggttgatgcctttaggaaaaccgttcgctatgaaggttttggagctttgtacaagggcctcgttcctaactcagtcaaggtggttccttcgatagcgattgcgtttgtgtcgtacgaggttgttaaggatctacttggagtagagatgaggatatctgattgaggaaaaaaaaaaaaaggaaaagaaaagaaaagatgataataatgttggagagaattggtggtgttatttttgcgagcagaaggaaggggtaggatttttgttctcttctctctctctctttgactctttgttattcaatgaagagatgtagaagttgttagtgttgatagagagtggtcgaccactgtgagtacccaattctgctgtgctgtgctctggttttttggtgtttgtcattcataattacaccaacacctggcacccaataaggatatttatttgctacacgagttgtttgtttaattttattagtattatttatgatcatggatttttgccttttatttgaatcatgttgggtgttctatttgaggtgttatagccgttttgactcttgtaaaactgagtatatttttggaccaaaactgcggaaaaaaactcaaaaatctatgatttatctggaaaag

SEQ ID NO: 4783 - DNA, 1565 bp, Helianthus annuus
aggataaatggaaacggaagtacgcggggaccgagttcagatcccccggagacaactcactcacgacggcgcttcttccccaactcgctagggttccggcgaacttccgtttccatttatcctattaaacgttaactcttctcaatctcgccgttgatatggcatcggaagacgtcgtagggaagaccagcgccaccatcgctaacatcgccgaagaagcgaagattgcgagtgtaggtgtcaaggctccgagccgtcaaacgttgctcggaatctgcaaatctctcgtcgccggaggtgttgccggtggagtatcgcgtactgctgttgctcctctggaacgaatgaaaattctgctccaggttcaaaatccgcatgcaatcaaatacaatggaactattcagggactaaaatatatatggagaacagagggtttgagaggaatgtttaaaggaaatggcactaattgtgcacgcatcgtcccaaactctgctgtcaagttctttagctatgaagaggcatccaagggaatcttgtggctatatcgacagcaacctggaaatgaggatgctgaactcacccctctcttacgcctcggagctggtgcgtgcgctggaataattgccatgtcagcaacttatccaatggacttggttcgaggacgtcttaccgtccagactgataaatctcctagccaatatagaggaattgcacatgctcttacaacagtactccgtgaagaaggcccgcgtgcattatacaaaggatggcttccttctgtcattggtgttgtacaatacgtggggcttaattttgcggtatacgaatccttaaaagaccatttggtgaaaacaagaccgtttggactagttgaagacaccgagttgagtgtgacaactaagctcgcgtgtggggctgttgctggaaccattggtcaaacagttgcatacccacttgacgtcatacgcagaagaatgcaaatgggtggttggaaaaatgctgcttcagttgttaccggtgaaggaaagtcaccccttgagtacactggaatgattgacgcatttaggaaaaccgttcgttatgagggttttcgtgctttgtacaagggtttagtccctaactcggtcaaggtggttccatcaatagccattgcatttgtgacatatgaggtggttaaggatgtactcaaggtagagatgaggatatccgaataaaacaatgcattcttactatatattttttattcaacattcgggatagtttatgcgtgcaaaagggtaaatcggcaagtaaagggttttgttctttaatctcatttacataaagagatttagaactagcccgtgttgatatgatcaagtggatacccgtatgcaccttgggcatgcttttctgttagctgtagttttgttatttaaggcgtttttcattcgtatgtatgaactcaaataaggaaatgctcagagttgaggctccagcccggttgggaagtgataatactatcttatcgattagtagtgttaacatataatacatatgttatggagtttatatgttggttttgg

SEQ ID NO: 4784 - DNA, 1643 bp, Helianthus annuus
cgacggcgcttcttccccaactcgctagggttccggcgaacttccgtttccatttatcctattaaacattaactcttctcaatctcgccgttgatatggcatcggaagacgtcgtagggaagaccagcgccaccatcgctaacatcgccgaagaagcgaagattgcgagtgtaggtgtcaaggctccgagccgtcaaacgttgctcggaatctgcaaatctctcatcgccggaggtgttgccggtggagtatcgcgtactgctgttgctcctctggaacgaatgaaaattctgctccaggttcaaaatccgcatgcaatcaaatacaatggaactattcagggactaaaatatatatggagaacagagggtttgagaggaatgtttaaaggaaatggcaccaattgtgcacgcatcgtcccaaactctgctgtcaagttctttagctatgaagaggcatccaagggaatcttgtggctatatcgacagcaacctggaaatgaggatgctgaactcacccctctcttacgcctcggagctggtgcgtgcgctggaataattgccatgtcagcaacttatccaatggacttggttcgaggacgtcttaccgtccagactgataaatctcctagccaatatagaggaattgcacatgctcttacaacagtactccgtgaagaaggcccgcgtgcattatacaaaggatggcttccttctgtcattggtgttgtaccatacgtggggcttaattttgcggtatacgaatccttaaaagaccatttggtgaaaacaagaccgtttggactagttgaagacaccgagttgagcgtgacaactaagctcgcgtgtggggccgttgctggaaccattggtcaaacagttgcatacccacttgacgtcatacgcagaagaatgcaaatgggtggttggaaaaatgctgcttcagttgttaccggtgaaggaaagtcaccacttgagtacactggaatgattgacgcatttaggaaaaccgttcgttatgagggttttcgtgctttgtacaagggtttagtccctaactcggtcaaggtggttccatcaatagccattgcatttgtgacatatgaggtggttaaggatgtactcaaggtagagatgaggatatccgaataaaacaatgcattcttactatatattttttattcaacattcgggatagtttgtgcgtgcaaaagggtaaatcgtcaagtaaagggttttgttctttaatctcatttacataaagagatttagaactagcccgtgttgatatgatcaagtggatacccgtatgcaccttgggcatgcttttctgttagctgtagttttgttatttaaggcgtttttcattcgtatgtatgaactcaaataaggaaatgctcagagttgaggctccagcccggttgggaagtgataatactatcttatcgattagtagtgttaacatataatacatatgttatggagtttatatgttggttttggtttatatcatcctggttagcaatatatgtcaacttttcttgagataagttggtttcagcttgtgtgattcaactttgaacaatgtattgaaccgggaaacccggacacctgactggtttggttggcatgctttgaatcaac

SEQ ID NO: 4785 - DNA, 1319 bp, Gossypium hirsutum
tggcgtctgaggatgtgaaaagaagcgagtcggcggtctcgacgatcgtgaatctggcggaagaagcgaagatagctagcgaaggagttaaggcgccgagtcatgcgctgcttagtatttgcaagtctcttgttgctggtggtgtcgccggtggagtgtcacgtagtgctgttgctcccctagaaagattaaaaattttacttcaggttcagaatcctcatagtataaaatacaatggaacaatccagggtttgaaatacatatggagaactgagggtttcaggggaatgtttaaaggaaatggtactaattgtgctcgcatcattcctaactcagcagtgaagtttttcagctacgaagaagcctctaaggggattttatacctttatcggcagcaatcaggaaatgaggatgcacaactcactccgcttctacgccttggagctggtgcatgtgctggaatcattgccatgtcagcaacttatccaatggatatggtacgaggtcgtctaacagttcagactgagaagtcgcctcaccaatatagaggaatctttcatgctctttcaacagtattaagggaagaaggaccccgtgcattgtacaaaggctggttaccatctgtaataggagttgtaccttacgtcggtcttaactttgctgtttatgaatctctgaaagatgtgttgatcaaaaggaaaccccttgggctagttgaggactctgaactgggtgtcacaacaaggcttgcatgtggagctgctgctggaaccattggccagacagttgcttaccctcttgatgtcattcgacgcagaatgcagatggtgggctggaaggatgctgcttcagttgtcaccggtgatgggaagaacaaggcccccattgaatataatggtatggttgatacattcaggaaaacagtgcgctatgaaggttttggagcattatacaagggtttggttccgaattcagtgaaggtggttccatctatagcaattgcatttgtcacgtacgagttggtaaaggatgtactcggagttgagttaaggatatctgactgaaggaactcccaagagtttggtcaatcttttgtgttcattttgatgagcaagaattattttgcttttaaaggaaaggtaggaggatatttagagctcacttttagtatttttttaatgtcttccttatagctattgtcttctttgctcttaggttttcatattcatatatgcttttgccaataagtatttttcgggaggttatcagaaaatagtatattcattaggaaatgatgcagccgatacacattctgatag

SEQ ID NO: 4786 - DNA, 1389 bp, Castanea mollissima
cggagtctgccgtttcgacgatcgtaaacctcgccgaggaagccaagctcgcaagcgaaggtgtcaaagcccctagccatgccttactcagcatctgcaagtctctcatcgcaggaggcgtcgccggcggagtctcacgtagtgctgttgctcctctagaaagattaaaaattttgctccaggttcaaaatcctcatagtatcaaatacaatggaacgattcaaggcttaaaatatatatggagaactgagggtataagaggaatgtttaaaggaaatggaactaactgtgctcgtattgtcccaaactcagctgtcaagttctttagttatgagcaagcatctagtggaattttatggctttatcgtcaacaatctgggaatgaagaggcaaatcttactcctcttttacgacttggagctggtgcatgtgctggaattattgccatgtcagcaacttacccaatggacatggtacggggtcggctgactgtccagacagaaaattctcctcgccaatataggggaatcttccatgctctttctacagtcttccgggaagaaggccctcgggctctttacagaggttggctaccttctgttataggagttattccatatgtgggtctcaactttgccgtgtatgaatctttgaaagactggttgattcaaactaaaccttttggactggctgaaaactctgagttgagtgtgacaacaagacttgcttgtggtgctgctgctggaactgttggtcagactgttgcttaccctcttgatgtcatccgacgaagaatgcagatggtaggctggaaagatgcttcatctgtcctgactgctgatgggaagagcaagacacctcttgaatatactggcatggttgatgctttcaggaaaacagttcggcacgagggatttggagcattgtacaagggtttggtccccaattcagtgaaggtggtcccatccatagcaattgcattcgtgacatatgaggtggtcaaggatgttcttggagttgagatgaggatatctgactgaagcaagggaaaattaaagcgatttcttccaacatttgtgctaattttgcaagcagaagaaatggttattaggagaaggtattttatcgggaattgtgttctttccagttaggaggaatcattagaaacccacttttagcatcatgttgatattccttctagatattgcccatttgtccaccttagtttttagcattcatattcttatgctattgcaataagtatgatgcactagatgcattctgatatcttcccagtgaagttaatttattactcatttgtaattctggtgaccggtttataaaatagaattgccatcttagacttttggttatttcccctgctttttt

SEQ ID NO: 4787 - DNA, 1614 bp, Coffea canephora
ctcccactcgcattagcacccctacgctgccgcatttcaattgtcacctttctccgccatattcattagcagccgccgccgaacaccgaaaatgtttgccttttaagacgttcaaagatccaatcgtcgtcggtctagggttccggcgagtaattttatttaataaattatttgcagaggaagtaggttatcggattgtaggtattctatggcttcggaggatgtgaagtcgagtgaatcggcagtctcgaagattgtgaattttgctgaagaagccaagcttgccagagaagaaattaagcccactagccacgccgttctcagtatctgcaagtctcttgtcgccggtggtgtcgctggtggtgtatcacgtactgctgtagccccattggaacggctgaaaattttacttcaggttcaaaatccacataacataaagtacagtggtacagttcaaggcttgaaatatatttggagaactgagggttttaggggattgttcaaaggcaatgggaccaattgtgctcgcattgtcccaaattctgcagtaaagttctttagctatgagcaagcttccaagggtatactgtggctatatcgagagaaaactggaaatgaggatgctgaactcactcctgtattgcggcttggagcgggagcttgtgctgggataattgccatgtctgcgacatatccaatggacatggtacgaggaagattgaccgtacagactgagaagtctccctatcagtacaggggaatgtttcatgctttagccactgttctccgagaggaaggcccccgggctttgtacaagggctggcttccttctgttattggagttattccatatgtgggtctcaactttgctgtgtatgaatcattaaaggattggttggttaaggctaaaccttttgggcttgttgaagactcggaattaggtgttataacaagacttgcatgtggggctgcagctgggactgttggtcaaactgttgcttacccttttgatgttatgcgaagaagaatgcagatggtgggatggaaagatgccgcttctgttgtcactggtgatggaaggagcaaagctccacttgagtataccggcatgattgatgccttcaggaaaactgtgaggcacgagggcttcaaagccttgtacaagggtctggtccccaactcagtcaaggtcgtcccatcaatagctattgcatttgtgacgtacgagcaagtgaaggacttacttggcgttgagatcaggatatcagactgacaagagagccttgcatatttttttttttttttgggttgcatgtgaaatttttatagacaaggagaagagcaatcgcaacatggttatggcctctccatccctgagagaatttagagacctgctctagtctgtctatatgttgcttctctgtttagccatgtctatatgttttgcccttccaagtgctttagcatgtagcagttgccattcagatgatgtgtctgtcaataatgatatggctgacgaatattgcaataactgccttggttgtgtccctgataaagcagaacccatcagatttattgtgcgtccgacttttcatcaggaattttatttttggt

SEQ ID NO: 4788 - DNA, 1536 bp, Glycine max
gctgaggtttgttgttgtgtttgtgtttgtggcctctctctctctctcagccgtcgcagtctctgccaaacactcgctcatccaaaattatgatcatttctgtgccgtaaattcgccggtaacacgagatctcaacttctcgcgccgttttcttttccccctttaaaaaaagtacaagttcaggttaagttagggttccatggcttcggagacgaaggtcgtgaatctggctgaggaagccaagctcgccagagaaggtgtaacgactccctcatatgcttttaccaccatctgcaagtccctcgtcgctggtggagtcgccggaggagtatcacgaacagcagttgctccactggaacgcttgaagattttgctacaggttcagaatccacacagcattaaatacaatggaacaattcaaggtctaaaatatatatggagaactgaaggttttcgtgggctgttcaaaggaaatggtactaactgtgcgcgaattgtcccaaattctgctgtgaagttcttcagttatgagcaagcttccaaaggcatactacatctgtaccggaagcaaactggaaatgaggatgctcagctgactcctcttttacgtcttggggctggagcatgtgcgggaataattgccatgtctgcaacttatccaatggacatggttcgaggcagaataactgtacagacagagaagtccccttaccagtacagaggaatgtttcatgccctgtcaactgtactcagggaagaaggtccacgtgctttatataagggctggcttccttcagtcattggagttattccttatgtgggtctcaactttgcagtgtatgagtctttgaaagattggttaattaaatctaatccattaggtctagttcaagattctgagttgagtgtgacaactcgcctggcttgtggtgctgcagctggaactattggacaaactgttgcttaccctcttgatgtcattcgtcgaagaatgcagatggtgggttggaaccatgctgcttctgttgtagctggtgatggaagagggaaggtaccacttgaatacacaggcatggttgatgcttttaggaaaactgttcggtatgagggatttggcgcattatacaagggtctggtgccaaattctgtaaaggtggtcccatccatagcaattgcatttgtaacatatgaggtggtgaaggacattttaggagtggagatcagaatatcagattgaagattcgcatgcatgtgatatttgattgcctgttattttcttgtaggcaaggggatgcagagatgataaattagggttactttcttgtttttcaactcttcaatgagttaggcagcacttgagttagcgtgtataaattaattcccttgcatcccatttgttttgccttgggaacatgatttagcttttagctttttattcatcttctatggcaataaatgttgtggaaaaacaatgcaaggatatatctgcatgcatttctgcagagtgaacagtgaagaaagcatttttattggttg

SEQ ID NO: 4789 - DNA, 1662 bp, Tabernaemontana elegans
cgcggcattttccctcccacttctctttctgccatagccacccagtcacctgcagaggcttaacaagatgttcgctttctgattattcctgacgctgccgatcgatcttggctgaggatagattaagagacagatttggatcgtcgtcgacttagggttccgacgagttttattattattagtattttttctgtttatatggcttccgaagatgtcaagactagcgaatcggcggtgtcgaagattgtgaatctagctgaagaggccaagcttgcgagagaagaaattaagcctactagctatgctgtaatcagtatctgcaagtctcttgtagccggtggcgttgccggtggcgtatcacgtactgctgtggctccattggagcgacttaaaatattgctgcaggtgcaaaatccacataacataaagtataatggtacagttcaaggtttgaaatacatttggagaactgagggtttcaggggattgttcaaaggcaatggcactaattgtgctcgcatcgtcccaaattcagcagtgaagttcttcagctatgagcaagcttcaaagggtatactatggcaataccagcagcaaactggcaatgaggatgctgaacttactcctctattgcggcttggagccggtgcttgtgctggaatagttgccatgtctgcaacttacccaatggacatggttcggggaagactgactgtgcagacagagaagtctccttatcagtacaggggaatgttccatgccttatccacagttcttcgtgaggaaggtccaagggcattgtataagggttggcttccttctgttataggagttattccatatgttggtctcaactttgctgtttatgaatcacttaaggattggttggtaaagggaaacccttttgggcttgttgaaggctcagagttgggtgttacaacaaaacttgcatgtggagctgctgctgggactgtgggacaaactgttgcttaccctcttgatgtcattcgaagaaggatgcagatggtgggatggaaagatgctgcttctattgttaccggcgatgggaggagcaaagcacctctggaatacaatggcatggttgatgctttcagaaaaactgtaagacatgagggattcagagctttgtacaagggtttggtccccaattccgtgaaggttgtcccatcaatagctattgctttcgtgacatacgagcaagtgagggacttattgggggttcagattagaatatcggactgaagcagaacggcccttgcatatttttttgcttgcgtgtgagattttgtagtcaaggagaagagagatcatagtaaggtggccatgtcctctccgtccgccagagagtttggagacctcatttaccctgtgtttatatgatgcttctctgtttagtgttgtaactctgggatgctttagcatttagattgcaatttaaatgatgcccccaataagaactcaatagaggaaaaatgcaataagtggttgattgtttccgctgattatttgataaagcatgagccagttgatctctttcatattcccaatgtttagactaagaatcttgagaaacttttgatggctcagttcatgagattattgttgtaattgtatgaaccaaaatagtttctgagatgataa

SEQ ID NO: 4790 - DNA, 1606 bp, Carthamus tinctorius
  misc_feature (959)..(959): n is a, c, g, or t
cggggggctcaaattttatttattccttttttttccctcacatccactgagatcgccggaaggaggtggttctcgcgacggcgaatcttcttctctatttattaatattatttttataagctagggttcctccgctgcattacatagttttccattcgtagggttttaggcggtggtggctctctctctcatggcgtcggaggatgtggtaggtaaaaccagcgctacgatcgctaatctggccgaagaagctaagattgctagcgaaggtgttaaggctcccagccgtcacgctctgctcagcatctgcaagtctctcgtcgccggcggcgtcgccggtggagtgtcacgaactgctgttgcccctctggaacgattgaaaattctgctccaggttcaaaatcctcatgcaatcaaatataatggtaccatccaagggttgaaatatatatggagaacagagggttttcgtggattgtttaaaggcaatggcactaattgtgctcgaattgttccaaactctgctgtcaagttttttagctatgaagaggcctcaaagggaattctgtggctccatcggcagcaacctggaaatgaggatgctgaactcacccctctcttacgtcttggagctggtgcatgtgctggaataattgccatgtcagctacctatcctatggacttggttcgaggtcggcttaccgtccagaccgacaaatctcccagccagtatcgaggaattgcacatgctcttagaacagtactgcgtgaagaaggtccacgtgcattatataaaggatggcttccttctgtcattggtgttgtaccatatgtgggtcttaattttgcggtctatgaatcattaaaggactggttaattaaatcaaggccatttgggctagttgaggatactgagttgagcgtaacaaccaagctcgcctgtggggctgcagctgganctgttggccaaacagttgcttatcctcttgacgtcatccgccgaagaatgcaaatggttggttggaaagatgcagcctccgttgttactgcagacggcaagtcggggctcgagtacactggaatgattgatgcattcaggaaaaccgttcgctatgagggttttggggccttgtacaagggcttggtcccgaactcagtaaaggtggttccttcgatagccattgcgtttgtgtcatacgagatggttaaggaactactgggagtagagatgaggatatctgattgagactttatgttatttttacgggcagaagagagaaaggagaaggtaaaagccgtggaggtcataattttttttttgttctcttctctgtttcggtgagataaaagcgaagagatttagaagttgttagtgttgatatagccgtcgacccccaacactttgtttctttctttctttctttttatgttttctgctgttgtggtttttgggtgttgtgattcatacacaccaacaccacctgataataaggatgttttcatagggctgaggttgatgatgctactatcagtaaattcagtattattgttagtatttttattactatcataataatgactgtttcctgatgatgcttttggtttc

SEQ ID NO: 4791 - DNA, 1521 bp, Silene vulgaris
agagtttacctcacttattaaagccgccggaaaaaaaacacaacactatacttactgcctccttttacgatccccatttttttctccacaccttctctctcttcctatacgacgtcgtttaggttcatttctagggtttttacacggtggagagaaaagatagtgcggaaatggcgtcggaagatgtgaagcagagaggagacggagctgtgtcgacgatcgtgaatttggcggaggaagcgaaggcggcgactgaaggagttaaatctccgaaatatgctcttcttactatttctaagtctcttgctgcaggcggtattgctggcgccgtatctcgtacagctgttgctcctctagaacggttgaagattttattgcaggttcagaatcctcacaacatcaaatacaatggaactattcagggcttgaagtatatttggcagacagagggagttcgtggcctgttcaaaggcaatggaaccaactgcgctcgtattgtcccgaattcagcagtcaagttctttagttatgagcaggcatccaagggaattctctggctttatcagcagcaacctggaaatgaaaatgctgaattgaatcctctgttgcgtcttggagctggagcttgtgctgggatcattgccatgtccgcaacatacccgatggacatggtacgaggtcgcctaactgttcagaccgataaatcacctcaacagtacaggggtatatatcatgctctcacaactgtactccgcgaggagggtgcccgggctttgtacaaaggatggctcccttctgttattggtgtggtaccatatgtgggtctcaactttgcggtatatgaatccctaaaggattatttgctcaaggaaaacccgcttggcctagttcaggacaatgagcttagtgtgacaaccagacttgcatgtggtgctgctgctggaactgttggtcagactatagcttatcctctagatgtcatacgaaggagaatgcagatggtcggttggaaagatgcatcaaaggttataactggtgacgggagaaaggggcctcttgagtatacaggcatgatcgatgccttcaggaaaactgttaaatacgagggtgttggagccttatacaagggtttggtcccgaattctgtgaaggtggtcccatccattgcaattgcatttgtgtcatatgaagtggtgaaagatcttcttggggtggaaatgaggatatcagactgaagccgagagggatcttcgatttttagtcagattttttagtcgaaatttgtagttttaacaaacactagcaaaggtgaatcatggggagcattcctccataggtcatggggtatttagaaagccacatcgactgatcacggtgtttggccgtgaaacgatcacctttttgtcttctgaatttttgggtgttcgctcatttatatttcttgcgaataattagcttgtgtatgttgtcctagacttttctaggagatccatgtactttatacttcgtattaataatctt

SEQ ID NO: 4792 - DNA, 1520 bp, Tragopogon dubius
ataggggccaattggcaccatttctagtccaccgattacagcgcctccgttatttaaaaaccttcacttgccaccacgtgttcattcgctatatgcgtgatcaattttctttatccttttaatcactcacaattcagatcgccggaggagaacgcaccacggcgaatcttcctgaatttgggtagggctccggtgatttttcatttcgttttattgaatatggcgtcggaggacgtggtagggaaaacgagcgtcacgttcgctaatatcgctgaagaagcaaagattgcgagtgaaggtgtgaaggctccgagtcgtcacgctttaattggcatcgggaaatctctcgtcgctggaggcattgccggtggagtatcacgtactgctgttgctcctctagaacgactgaaaattctcctccaggttcaaaatccacatgcaataaagtacaatggaacaattcaggggttaaaatacatatggagaacagagggtttaagaggaatgtttaaaggcaatggcaccaattgtgctcgcattgtcccaaactcagctgtcaagttctttagctatgaagaggcatccaagggaatcttatggctctatcgacaacaacctggaaatgaggatgctgaacttacacctttgttacgacttggagcgggtgcttgtgcggggataattgccatgtcagcaacgtatccgatggacttggttcgcggtcgccttactgtacagacggataaatctcctagccagtatagaggaattgctcatgctctttcgactgtactccgtgaagaaggtccacgtgcattgtacaaaggatggcttccttccgtgatcggagtcgtaccatacgtgggcctaaattttgcggtatacgagtctttaaaagattggttagtgaagtcaagaccgtttggactagcggagaacaccgagttaagcgtgacaacaaagcttgcatgtggggccgcagccggaaccgtgggccaaacgattgcttatcctcttgatgtgattcgaaggagaatgcaaatggtcgggtggaaagatgcagcttcagttgttaccgcagatggaaagtcagcactcgagtacaccggaatgattgatgcgtttaggaaaaccgttcggtatgagggttttcgcgctttatacaagggtttggtccccaactcggtcaaggtggttccatcgatagcaattgcgtttgtgacgtacgaggtagttaaggacgtactgaaggtagagatgaggatatcggattaaaaaatagccgaagaagggtaaaatggtaatttttttgttgtgtgagtctctttaacgaagagatttatagaggtagggaatgtttatatacacaccacacccatagcatgatttgcgccaggtgtagtttgttttgttttttttaaggtaataagggtacactcggaggttggtttctccttgaagtaaaatttattgtttgatgactattattattaacatataatagtgggttttgtgttggt

SEQ ID NO: 4793 - DNA, 1703 bp, Artemisia annua
ctcgcgtgtcttatatttcattttataatttagccaccatacaccaaccgagatcgccctccggactcttttgttactaactaatattagcgacggcggctaaatcttgatttattagtgacagaaaaaagatggcgtcagaagatgtggttggtaagacaagtgcaacgattgcaaatctagcagaagaagcgaataagatagcgactgaaggtgtcgctgttaaggctccttctcgtcatgctttgctttccatcgctaagtcactcgtcgctggtggtgtcgctggtggagtatcacgaactgctgttgctcctctagaaagactgaaaattctgcttcaggttcaaaatccacatgcaatcaaatacaacggtactatccaggggttaaaatatatatacagaacagagggttttcgtggattgtttaaaggcaatggaactaattgtgctcgtattgtcccaaactctgctgtcaaattctttagctacgaggaggcatcaaagggaattttatggctctaccggcagcaacctggaaatgaggatgctgaactcacccctctcttacgtcttggagctggtgcttgtgctggaataattgccatgtcagctacctacccaatggatttggttcgaggtcggcttactgtgcagactgataaatctcccagtcaatatcgaggaattgcacatgctcttagaactgtactgcgtgaagaaggtccacgtgcattatataaaggatggcttccttcagtcattggtgttgtaccatacgtgggtcttaattttgcggtgtatgaatctttaaaagactggttggttaaatcaagaccatttgggctagttgaggacactgagttgagtgtcacaacgaagctcgcatgtggggctgcagctggaactgttggccaaacggttgcttatcctcttgatgtcatccgccgaagaatgcaaatggttggttggaaagatgcagcttcagttgttacagcagatggcaagtcatcactcgagtacactggaatggttgacgccttcaggaaaactgtccgccacgagggttttggggcattgtacaagggcttggtccctaactcagtgaaggtggttccttcaatagccattgcgtttgtctcatacgaggtggttaaggatctacttggggtagagatgaggatatctgattagaaagacatcctaaaaataatgttgttgaatattcatgctatttttgcgcgcagaagagaaagtaggaggtaaaaactatggatgtcataaaatttttgttctcttcactctttcagttatccctcactgataacatgaagagatttagaactcattagtgttgatagaatcgactccaaaacatacccactttgttctttctgctgtggttttttggtgtcgtcatttatgccatgccaacaccacccaataaggatatttcatagagccgaggttctcattgcctcatagttgctacatgagttgttttgtcagtatttattattccgataatggtttttaaacatagttttcgactttctttatatttggttattctgttgtagtgttaattttggtttgcaacattgcatctgtttaacttttacggttttgaaatagatttcaaaccgaataagccgagttatgtgtttggttgaattgattcagcaaagcaaattcattcct

SEQ ID NO: 4794 - DNA, 1610 bp, Citrus sinensis
cacgcgtccgcattttcgcctccgttgtccccccgctctctctcgaagcacctcagagaagctgagctcactctcttcatatattaataaatatagcaattttatcaaattaatcccaaaaaaaaaaaagaaaaaaagaaagggacgatcaggggcagccggtcaactccttgagtttgaccgttaacttagggtttcccactttgttggaatattaaatggcgtcaacggaggacgtgaagagcgagtctgccgtcacgacgatcgtgaacctggctgaagaggcgaagctcgcgagggaaggagtgaaggcgccgagccacgcgcttcttagtgtcacaaagtctcttgtcgctggcggcgtcgctggtggagtgtcacgcacggctgttgcccccttagaaagactcaaaatattattacaggttcaaaatcctcatagtataaaatacaatggaacaattcagggattgaaatacatatggaaatctgagggttttagaggattgtttaaggggaatggcactaattgcgctcgcattatcccaaactcagcagtcaagttctttagttatgaggaagcatctaagggtattttatggctttaccgtcggcaaactagaaatgaagaggctgagctcactcctgttctacgtcttggagctggtgcatgtgctggtatcattgccatgtcagccacttacccgatggacatggtacgaggtcggctaactgtccagactgagaagtctcctcgtcagtatagaggaatcttccatgctcttacaacagtccttagagaagaaggtccacggtctttgtacaaaggatggctaccttctgtcataggagttataccatatgtgggtctcaactttgctgtatatgaatctctgaaagactggctgatcaaaagtaaagcattgggactagttgatgataacaatgagttgggtgtggcaactaggcttgcatgtggagctgctgctggaactgttggccagacagttgcttaccctcttgatgttatccggagaagaatgcagatggcgggttggaaagatgctgcttcagttgtcactggggatggaaagaccaaggcagccctcgagtataatggtatggttgatgcctttaggaaaacagttcggcatgagggatttggagcattgtacaagggtctggtccccaattcagtaaaggtggttccttctatagcaattgcatttgtcacgtatgaaatggtgaaggacatactcggagttgagatgaggatatctgactgaagcaagaggaactccaagaattttgtagaactttcattgtgtaatttgcaatccaaagtaatattagaaatatttatttgcaggtaggggaagatttggaaacaagtaaatcacttttggctagtgttgatatccctttccatgcatacccatgtctcgattggaatccgccttagttgtagtatatattaatatatgctatggcaataagtatttccaaggaaatgatgcactagatgcatcctattctagtatttactagtaatgctttaagtaaattattcctctgttaaattctttggtggttttcaaaatataatcaac

SEQ ID NO: 4795 - DNA, 1630 bp, Zostera marina
gggggagataactagggagtgaaatcgttttatatccacgggcgcattttaacacaaaccttccacgttaatattcgatccagggatgggcaaggcggtcgagtaagaccctcgttcttggagttcaagcggagccaagtattggttttctgttggactttggatttcgttattcgttaagttttttcttttcttttatcgatgtcgtcggaggacgtagttggtaagagcacgggagagactacggttaacacgatcgtcaataatcttgctgaggaggctaagttagccacacaaggggttaaagctccgggacacgctattctcagtgtctgcaagtctctcgtcgcaggtggagtcgctggtggagtgtcacgaactgcagttgcaccgttggagcgtttgaaaattctacttcaggttcaaaatcctcacaatatcaaatacaatggaaccattcagggtttaaaatatatttggaatactgaaggttttagaggtctctttaaaggaaatggtacaaattgtgctcgtattgttccaaattctgccgtcaagttctatagctatgagcaagctgcaagcggcattttgtggctttatcaacggcaaactggcaatgaagatgcagagcttacacctgttttgcgtctcggtgctggagcatgtgctgggattatagctatgtccgcaacttatcctatggacatggttagaggaagaataactgtacagactagcaagtctccccatcagtacactggcatgtttcatgcattgtctacaatctaccgacatgaaggttttcgagctttatacaaagggtggcttccttcagttattggagtcgtgccatatgtgggtctcaactttgccgtttatgaatctttgaaggattggatggtcaaaacaaatccgtatagaatagttgaaaacaatgaattgtctgttaccatgagacttgcttgtggagctgctgctggaacagtaggccagacagtagcctacccacttgatgtcattcgcagaagaatgcagatgactggatggaaaggtgcttctgcctcaattgtaacaggtgatggaaaaaacaaaggtctggtcgagtataatggcatgatcgatgctttcagaaaaacagtcaggaatgagggatttggtgcattatacaagggtttggttcccaattcagtaaaagtggttccttcaatagcacttgcatttgtgtcctacgagattgtaaaggatattcttggagtggaaatgaagatatcagcatgaaactaaattaggtgaaaggattgagtatttattcttttactgggaaggataaaagaaagccaagaaagaggtagatagataagctgaagcaaattcatcccatctgatcaatgtttgtggttatttgtatgatttctccctttcaaatagttgcttttactctgtttttaaccccttcttacatcttatccaataaatgatactgaccagggagcataggctacttgttgaaatatcgaactgattaattgtatcttaaggcttgcgattttgctgtatgcctgtttgtaataatgcaatatgcatggatcatgattgtgtatgtctctactatttgaaaatgtttttt

SEQ ID NO: 4796 - DNA, 2004 bp, Theobroma cacao
atttaaagtattaatacaaaattattattaaatatattgaataatcttgttaatcttttcaccaacgaaacacgatttaaattcaacgcaaaaaaatattttttttaattaaaaaaaaaaagcaaagagctttcactaaccaaacatagtgtaaattcattgtcccgtttatttttaattaaatgtggcaaccctacatttgaaccacgtttctctgtttttatttttatttttattttcccgttatttatgaaattgtaacccaaaaatgaataatccatttcctaagtttccaaattttcatacatagaaagctcccagccaaacagttttttggttgtatttttctccaaagcgcctctcttttgtttcgtttttcaactcctcagccaatggtcgctcactctcactcgttcccataatcaccggagagaggatcccctcgtcttagccgatcaccggtaaacgccccactttgaccggataagctagggttcctacgatatattttcccttttttttttgttcatattattcttctcgctcccgagaaatggcgtccgaggatgtgaagaggagcgagtcggcggtcacgacgatcgtgaatatcgctgaagaagcgaagcttgctagcgaaggagttaaagcaccgagtcgcgcgttccttagtatttgcaagtctcttgttgctggtggtgtcgccggtggagtgtcacgtactgctgttgctcccctagaaagattaaaaattttacttcaggttcagaatcctcatagtataaaatacaatggaacaatactgggtttgaaatatatatggaaaactgagggtttcaggggaatgtttaaaggcaatggtactaattgtgctcgcatcattcctaactcagcagtgaagttttttagctatgaggaagcatctaagcagattttatacctttaccggcaacactcaggaaatgaggatgctcaactcactccagttctacgccttggagctggtgcatgtgctggaattattgccatgtcagccacttatccaatggatatggtacgaggtcgtctaactgtccagactgagaagtcgcctcgccagtatagaggaatctttcatgctctttcaacagtattacgggaagaaggtcctcgtgctttgtacaaaggctggttaccttctgtaataggagttgtaccctatgtgggtcttaactttgcggtttatgaatctctgaaagactggttgatcaaaagcaaaccatttgggctagttgaggactctgaattgggtgtcatgacaaggcttgcatgtggggctgctgctggaactgttggccagacagttgcttaccctcttgatgtcattagacggagaatgcagatggtgggctggaaagacgctgcttcagttgtcactggtgatgggaagagcaaggcccctcttgagtatactggtatggttgatgcattcaggaaaacagttcggtacgagggcattggagcattatacaagggtttggttcccaattccgtgaaggtggttccctcaatagcaattgcatttgtcacatacgagttggtgaaggatgttcttggagttgagttaaggatatcagactgaaggaactcccaagatattttggtcaatctgtcgtgagcagaaggaaaggagtatatcataggtcaatatatcttcctcacttacagcccatcctcttcagtcttaggtttttagcttgaggaaattattcataatatgctgtgacaataaagttatatacactctgataggaaatgatgcagtttatatactctctgatagttttattttaatgaagttaaaatccctgttgccgagttctatttggaattattattattattattattattttaattaaataccaaatgtaacacactgttaataacctggccgtactctgcttttttcgactaataattaacattacaaaatactagaattacgactaaacaataaattaattg

SEQ ID NO: 4797 - DNA, 1495 bp, Cajanus cajan
ctgaggtaaaggtttgtttgtggcctggctcactctctcaggcctcagccgtattggccaccaacctgagtctgacgccgctaactcttttttcttatttacttttccctacatagctacgttggcttagggttttctcttttcacttctcatggcttccgagacgaagatcgtcaatcttgccgaggaagccaagctcgccagagaaggtgtcaaggctcccacctatgccttttccaccatctgcaagtccctcgtcgccggtggagtcgccggaggactatcacgaacggcagttgctccactggaacggatgaaaattttactacaggttcagaatccacacaacataaaatacaatggaactattcaaggtctaaaatatatatggagatccgaaggtttccgtggactgttcaaagggaatggtactaattgtgctcgaattgtccctaattctgcagtcaagttcttcagttatgagcaagcttccaaaggtatactacatctgtatcagaagcaaactggaaacgaggatgctcaactgactcctcttttacgacttggtgctggagcatgtgcgggaataattgccatgtctgcaacttatccaatggacatggttcgaggcaggataactgtacagacggagaagtccccttaccaatacagaggaatgtttcatgctctgtcaactgtactcagggaagaaggtccacgtgctttatataagggttggcttccttcagtcattggagttattccttatgtgggtctcaactttgctgtgtacgagtctttgaaagattggttaattaaatccaatccattgggtctagtacaagattctgagttgagtgtgacaactcgcctagcttgtggtgccgcagctggaactattgggcaaactgttgcttaccctctcgatgtcattcgtcgaagaatgcagatggtgggttggaatcatgctgcttctgttgtagctggtgatgggagagggaaggtaccacttgaatacactggcatgattgatgcttttaggaaaactgtcagatacgaaggttttggcgcattatacaagggtctggtgccaaattctgtaaaggtggtcccatccatagcaattgcgtttgtaacatatgaggtggtgaaggacattttaggagtggagatcagaatatcagactgaagattggtatccatgtgatatttgattgcctgttgttttcatgtaggcaagggtacgcagagatgataatttagggttattttcttgtttttcgtctcttcaatgagttaggaagcacatgagctggtgtgtataaattaattcccttgtatcccattttttccccttgtgaacatgatgtagcttttagctttgtattcatcttctgacttctatggcaataagagttgtagagaaacaatgcaaggacatatctgcatgccgcctttctgcctgagtgaagaaaccatttatcggtggaaaaat

SEQ ID NO: 4798 - DNA, 1587 bp, Cajanus cajan
gctgagtgctgaggtaaaggtttgtttgtggcctggctcactctctcaggcctcagccgtattggccaccaacctgagtctgacgccgctaactcttttttcttatttacttttccctacatagctacgttggcttagggttttctcttttcacttctcatggcttccgagacgaagatcgtcaatcttgccgaggaagccaagctcgccagagaaggtgtcaaggctcccacctatgccttttccaccatctgcaagtccctcgtcgccggtggagtcgccggaggactatcacgaacggcagttgctccactggaacggatgaaaattttactacaggttcagaatccacacaacataaaatacaatggaactattcaaggtctaaaatatatatggagatccgaaggtttccgtggactgttcaaagggaatggtactaattgtgctcgaattgtccctaattctgcagtcaagttcttcagttatgagcaagcttccaaaggtatactacatctgtatcagaagcaaactggaaacgaggatgctcaactgactcctcttttacgacttggtgctggagcatgtgcgggaataattgccatgtctgcaacttatccaatggacatggttcgaggcaggataactgtacagacggagaagtccccttaccaatacagaggaatgtttcatgctctgtcaactgtactcagggaagaaggtccacgtgctttatataagggttggcttccttcagtcattggagttattccttatgtgggtctcaactttgctgtgtacgagtctttgaaagattggttaattaaatccaatccattgggtctagtacaagattctgagttgagtgtgacaactcgcctagcttgtggtgccgcagctggaactattgggcaaactgttgcttaccctctcgatgtcattcgtcgaagaatgcagatggtgggttggaatcatgctgcttctgttgtagctggtgatgggagagggaaggtaccacttgaatacactggcatgattgatgcttttaggaaaactgtcagatacgaaggttttggcgcattatacaagggtctggtgccaaattctgtaaaggtggtcccatccatagcaattgcgtttgtaacatatgaggtggtgaaggacattttaggagtggagatcagaatatcagactgaagattggtatccatgtgatatttgattgcctgttgttttcatgtaggcaagggtacgcagagatgataatttagggttattttcttgtttttcgtctcttcaatgagttaggaagcacatgagctggtgtgtataaattaattcccttgtatcccatttttttccccttgtgaacatgatgtagcttttagctttgtattcatcttctgacttctatggcaataagagttgtagagaaacaatgcaaggacatatctgcatgccgcctttctgcctgagtgaagaaaccatttatcggtggaatatccggtgaccgattattgtgtacccttctagaaatcgtataagcgttgttgtgtgcaagttattaagcagccggtttgtcacaat

SEQ ID NO: 4799 - DNA, 1496 bp, Ambrosia trifida
acacaatacacaatacactcacggcggcgcttcttcctctctccggtagggttccgtcgtcgaagttttattcatttgcaattcaatcactctatttatacatatatggcatcggaggacgtcgtagggaagactagcgccaccatcgctaacatcgctgaagaagcgaagattgctagtgtaggtgttaaggctcccagtcgtcagacgttgcttggaatatgtaaatctctcgtcgctggaggtgttgctggtggagtatcacgaactgctgttgctcctctggaaagaatgaaattctgctccaggtacaaaatccacatgcaatcaaatacaatggaactattcagggactaaaatatatatggagaacagagggtttgagaggaatgtttaaaggaaatggcaccaattgtgcacgcatcgtcccaaactctgctgtcaagttctttagctatgaagaggcatctaagggaatcttgtggctatatcgacagcaacctggaaatgaggatgctgaactcacccctctcttacgccttggagctggtgcgtgtgctggaataattgccatgtcagcaacgtatccaatggacttggttcgaggacgtcttactgtccagacggataaatcccctagccagtatagaggaattgcacatgctcttacaactgtactccgtgaagaaggcccacgtgcattatacaaaggatggcttccatctgtcattggtgttataccatacgtggggctaaattttgcggtatacgaatccttaaaagaccatttggtgaaatcaagaccggttggactagttcaagacactgagttgagtgtgacaactaagctcgcatgtggggctgttgccggaaccgttggtcaaacagttgcatatccgcttgatgtcatacgcagaagaatgcaaatgggtggttggaaaaatgctgcttcaattgttaccggtgaaggaaagtcaacacttgagtacaccggaatgattgatgcattcaggaaaaccgttcgtcatgagggttttggtgctttgtacaagggtttggttcccaactcggtcaaggtggttccatcaatagccattgcatttgtgacatatgaggtggtcaaggatgtactcaaggtagagatgaggatatctgagtagaacaatgcattcttactatatatttttatccaacattcgtgttggcttgcgcgtgcaaaagggtaaaaccgtcaagtaaaacgttttgttcttcaatctcttttacataaagagatttagaactagcccgtgttgatatggtcgagtggatcccctgtatgcaccccaagcatgctttttctgttagctgtagtttgttctctaaggcgtttttcattcgtatgtatgaaccctaataaggaaatgctcacagagttgaggccccagcccggttgggaaatgatactatttggtcaattagtatttttaacatataatagagaggttatggagttt

SEQ ID NO: 4800 - DNA, 1622 bp, Citrus clementina
cacattttcgcctccgttgtccccccgctctctctcgaagcacctcagagaagctgagctcactctcttcatatattaataaatatagcaattttatcaaattaatcccaaaaaaaaaaaagaaaaaaagaaagggacgatcaggggcagccggtcaactccttgagtttgaccgttaacttagggtttcccactttgttggaatattaaatggcgtcaacggaggacgtgaagagcgagtctgccgtcacgacgatcgtgaacctggctgaagaggcgaagctcgcgagggaaggagtgaaggcgccgagccacgcgcttcttagtgtcacaaagtctcttgtcgctggcggcgtcgctggtggagtgtcacgcacggctgttgcccccttagaaagactcaaaatattattacaggttcaaaatcctcatagtataaaatacaatggaacaattcagggattgaaatacatatggaaatctgagggttttagaggattgtttaaggggaatggcactaattgcgctcgcattatcccaaactcagcagtcaagttctttagttatgaggaagcatctaagggtattttatggctttaccgtcggcaaactagaaatgaagaggctgagctcactcctgttctacgtcttggagctggtgcatgtgctggtatcattgccatgtcagccacttacccgatggacatggtacgaggtcggctaactgtccagactgagaagtctcctcgtcagtatagaggaatcttccatgctcttacaacagtccttagagaagaaggtccacggtctttgtacaaaggatggctaccttctgtcataggagttataccatatgtgggtctcaactttgctgtatatgaatctctgaaagactggctgatcaaaagtaaagcattgggactggttgatgataacaatgagttgggtgtggcaactaggcttgcatgtggagctgctgctggaactgttggccagacagttgcttaccctcttgatgttatccggagaagaatgcagatggcgggttggaaagatgctgcttcagttgtcactggggatggaaagaccaaggcaaccctcgagtataatggtatggttgatgcctttaggaaaacagttcggcatgagggatttggagcattgtacaagggtctggtccccaattcagtaaaggtggttccttctatagcaattgcatttgtcacgtatgaaatggtgaaggacatactcggagttgagatgaggatatctgactgaagcaaagaggaactccaagaattttgtagaactttcattgtgtaatttgcaatccaaagtaatattagaaatatttatttgcaggtaggggaagatttggaaacaagtaaatcacttttggctagtgttgatatccctttccatgcatacccatgtctcgattggaatccgccttagttgtagtatatattaatacatgctatggcaataagtatttccaaggaaatgatgcactagatgcatcctattctagtagttcctagtaatgcttataagtaaattattcccctgttaaattttttggtggtttttaaaatataatctacgactttttgacgtatttg

SEQ ID NO: 4801 - DNA, 1498 bp, Linum usitatissimum
tatggcgtccgaagatgtgaagacgagtggggaggctgctgtttcgacgatcgtcaatctcgctactgaagaggccaagctagctcgtgaaggtgtcaagactcagggccccgctttcctcagcatctgcaaatccctcgtcgccggtggtgtggccggaggagtgtcccgcacagctgttgctccactagaaagattaaaaattctactccaggtccaaaatccacacagtataaaatacaatggtacaattcagggcctgaagtacatttggagaactgagggtttcagaggattgtttaaaggaaatggtaccaactgcgctcggattgtaccaaattcagcagtcaagttctatagttacgaggaagcctctaagggtattttatggttatacaggcgccaaactggaaaagatgatgcacagcttactcctgttttacgtcttggtgctggtgcttgtgctggtataattgctatgtccgcaacttatccgatggacatggttagaggtcgcttaactgtccagacagataagtctccttgtcggtacagaggtatagcccacgcccttaggactgtcctaaaggaagaagggggccgtgcattatacaaaggctggcttccttcggttataggagttgtaccgtatgtgggtctcaactttgctgtttatgaatccctaaaagactggttgctgaagtccaacgcatttgacctggtcgaaaacaatgaactgagtataatgacaaggcttgcatgtggagccgcggctggaactgttggccagacagttgcttatccactcgatgtcattcgacgaaggatgcaaatggtagggtggaaggatgctgcttcagttgtaactggggatggaaggggcagagcacccctcgagtacaccggtatggttgatgccttcaggaaaacagttcggtacgagggttttggagcattgtacaagggtttagtccccaattcagtaaaggttgttccatccattgccattgcatttgtgtcatacgagatggtgaaaggcgttcttggcgtcgaattgaggatatccgactaaatgcgactgcagagtttctagctagtggcgctgtactgcccggtgatcgaatggtatttggaggaaggaggggatcaataggctgttggtgatggggaacctgcttttagggagtcagatttagaagtaaggaacatatccacaacttatagctctatgttttaataaccggccacctgttttgttttgtgatctccgtctgaacccatatttgttcgccatctagatttcttattattcgtattactggatgttgcaataagagagtaccaaatttaggctagcacatctatgacaggatacatagagagagagagagagagacttgaggtgtattctattcggagaatgtgatgtttcatcaatagctttttgggtgacattttatggaatgtgttgatgcttattaagtgatgttgaatcttt

SEQ ID NO: 4802 - DNA, 1621 bp, Citrus sinensis
cacattttcgcctccgttgtccccccgctctctctcgaagcacctcagagaagctgagctcactctcttcatatattaataaatatagcaattttatcaaattaatcccaaaaaaaaaaaagaaaaaaagaaagggacgatcaggggcagccggtcaactccttgagtttgaccgttaacttagggtttcccactttgttggaatattaaatggcgtcaacggaggacgtgaagagcgagtctgccgtcacgacgatcgtgaacctggctgaagaggcgaagctcgcgagggaaggagtgaaggcgccgagccacgcgcttcttagtgtcacaaagtctcttgtcgctggcggcgtcgctggtggagtgtcacgcacggctgttgcccccttagaaagactcaaaatattattacaggttcaaaatcctcatagtataaaatacaatggaacaattcagggattgaaatacatatggaaatctgagggttttagaggattgtttaaggggaatggcactaattgcgctcgcattatcccaaactcagcagtcaagttctttagttatgaggaagcatctaagggtattttatggctttaccgtcggcaaactagaaatgaagaggctgagctcactcctgttctacgtcttggagctggtgcatgtgctggtatcattgccatgtcagccacttacccgatggacatggtacgaggtcggctaactgtccagactgagaagtctcctcgtcagtatagaggaatcttccatgctcttacaacagtccttagagaagaaggtccacggtctttgtacaaaggatggctaccttctgtcataggagttataccatatgtgggtctcaactttgctgtatatgaatctctgaaagactggctgatcaaaagtaaagcattgggactggttgatgataacaatgagttgggtgtggcaactaggcttgcatgtggagctgctgctggaactgttggccagacagttgcttaccctcttgatgttatccggagaagaatgcagatggcgggttggaaagatgctgcttcagttgtcactggggatggaaagaccaaggcaaccctcgagtataatggtatggttgatgcctttaggaaaacagttcggcatgagggatttggagcattgtacaagggtctggtccccaattcagtaaaggtggttccttctatagcaattgcatttgtcacgtatgaaatggtgaaggacatactcggagttgagatgaggatatctgactgaagcaaagaggaactccaagaattttgtagaactttcattgtgtaatttgcaatccaaagtaatattagaaatatttatttgcaggtaggggaagatttggaaacaagtaaatcacttttggctagtgttgatatccctttccatgcatacccatgtctcgattggaatccgccttagttgtagtatatattaatacatgctatggcaataagtatttccaaggaaatgatgcactagatgcatcctattctagtagttcctagtaatgcttataagtaaattattcccctgttaaatttttggtggtttttaaaatataatctatgactttttgacgtatttg

SEQ ID NO: 4803 - DNA, 1800 bp, Capsicum annuum
gcacgaggccagattgtgcacgttcaccttcctgcttgcgtttccatttccatccatctctgctaattgccgccgccgccgccacataccaccgcgattcactatactctcacagtctaattcgccgtttctccttaactcgtccaaattcccgatcgatcatctggttttgaatagagtaatatcattgagtgagtataagatacgttgagctaaaaagtaggcgatctctatcttatattttatggcttctgaggatgtgaaggcgagcgaatcagcggtggagaaaattgtgaatctggctgaagaggcgaagctagctagacaagaaatcaagcctacaagtcatgctgttatcagtatctgcaaatcactcgtagctggaggtgtggccggaggagtgtcacgaactgctgtggccccactggaacgtctaaagatattgctccaggttcaaaatccacataacataaagtacaacgggaccatttcaggcttaaaatatatctggagaactgaggggttcaaaggactgttcaaggggaatggcaccaactgtgcacgtatcgtcccaaactcagcagtcaagttcttcagctatgagcaagcttccaagggtatactatatctttaccagcaacaaactggcaatgaggatgctcaactcactccattactacgtcttggagctggagcttgtgctggcataattgccatgtctgcaacttacccaatggacatggtgcggggcagaatcactgtgcagacagagaagtctccttatcagtacagaggaatgttccatgctctatccaccatactccgtgaggaaggtccacgtgctttgtataaaggatggcttccttcagtcataggagttattccatatgtgggacttaactttgcagtttatgaatctctaaaagactggttggtcaaaacaaaaccactcggtctagttgatgattctactgagcttggtgttgttacaaggctggcatgtggggctgtggcagggactgtggggcaaactgttgcttaccctcttgacgttgtacgcagaaggatgcagatggtgggttggaaagatgctgcatccatcgttaccggtgatgggaagagcaaggcttccgttgaatattctggaatgattgatactttcaggaaaactgttaggtatgagggcttcagggccttgtacaagggtttggtacctaattcagtaaaggttgtcccttcaatagctattgcttttgtgacatatgagcaagtgaaggacctattgggagttgagatcaggatatctgattgatgaagacaggctccaatgtttttccactgcatacgataattttgtaggcaaggatagatagagtgataataacatggcgggttaccccgtctaaacagagaatttacgattctgttttagcttgtgacagaaagtttaggactttccagttgtgcttataattccctatgtatttgcttattccatattgtcaataagcaaaatttacaacagtgtaatgactaatttgaatgtcttgctatggttcaagtgaagaaaagctgattgctggttgcctttgctaatcctggtctccattgtacttgtggtcgaatttttctggcgtcttcaccagttttcagctctctttttttcattggaaaaagttgaacagtttaggtaagaaaaggggtactcactcatgatctagtgtattctgtaatgccattttgtatgttctgattaatatgacgtgaatcgttttcttttaagaaaatttgggttgctat

SEQ ID NO: 4804 - DNA, 1497 bp, Euonymus alatus
actctctctcaaatcggttgggtatataagtagtcgttaattgctacgcacagtcaccgccggagtttgtccctagggttccggcgatgccctcagaagacgtgaagaccggagagtctacagtttcgacaattgtgaccctcgctcaggaggcgaagcacgccagtgaaggggttaaggcgcccactcatgccttttacagtatctgcaagtctcttgttgctggaggagtagccggaggagtgtcacgtacagccgttgctcccttagaaaggttaaagattttgctgcaggttcaaaatcctcatagcattagatacaatggaacaattcagggtttgaagtatatctggaaaactgagggtcttagagggatgtttaaaggcaatggcactaattgtgctcgtattgtaccaaattcagcagtcaagttcttcagttatgagcaagcttcaaagggcattttatggctgcatcggcaacaaactggaaatgaagaagctgagcttactcctcttttacgcctcggagctggtgcatgtgccggaattattgccatgtccgcaacttatccaatggacatggttcgaggtcggctgacagtccagacagagaagtctccccgccattatagaggaatcatccatgctctttcgacagtcctccgtgaagaagccctcgggcattgtacagaggctggctgccttctgtcataggagttgtgccatatgttggtctcaactttgctgtctatgaatctttgaaagactggttggttaaaaccaaaccatatggactagctgagaacaacgaattgagtgtgataacgaggctttcttgtggggctgctgctggaactattggccagacggtggcttaccctcttgatgttatccgacgaagaatgcagatggtgggctggagaggtgctgcttctgttgtcactggtgatggtaagagcaaagcacccattgaatacagcggtatggtcgatgcattcaggaaaacagtcaagcatgagggttttggagcattgtacaaagggttagtccccaactcagttaaggtggtcccatccatagcaattgcattcgtgacatacgagttagtgaaggacattctcggagttgagatgaggatatctgactgaagttttacgagttcttataccagttggtatactgattggctccttctgcaaatttttcatgccaagcaaactaggcattggaaggtaaattgtcagacatttctctccagacagagtataatttagaggccagcattatctccttgttgataatcccgcgcaacttgtatcctcctgtctcaactcatcttagtctttagattatttatgctattccaataagtaagtcgggagtaatacttctgcactgtgatagggttattaagcgaatttctcaattcaaccagtattatatgtgattactggctttttaaatgaatttacgctgttcttggacctttaattta

SEQ ID NO: 4805 - DNA, 1634 bp, Arabidopsis lyrata
aatcagtaggttgtgtgtcctttggcttttatcatcgccgccgggacacaaaagagagaaaggggcttagatttgtgctttcgagaagtgctttgatctctcttctccactcacttctaatcggagatttctgttagggtttaaacttgtgaagaaatctctagggatcgtaagcgtgttggtgtggggtattacactgattgcggtttcttcgtgaatcgtctctgtcaatcgatggcatcagaggatgtgaaaagaactgaatcagcagctgtttcaacgatcgtaaatctggcggaggaagcgagggaaggagtcaaagctccgagttatgcttttaaaagcatctgcaagtctctttttgccggtggtgtcgctggtggagtgtcacgaactgctgttgcacctttggaaaggatgaagattttacttcaggtccaaaatccgcatagtataaagtacagtggcacagtccaagggctgaagtatatttggaggaccgagggccttcgtggactgttcaaaggaaatggcaccaactgtgctcgtattgttccaaattcggctgtgaaatttttcagctatgagcaagcttcaaagggcattctgtacatgtatcgtcagcggacgggaaatgaaaatgcccaacttactcctcttttacggcttggagctggtgcaaccgctgggataatagccatgtctgcaacgtacccgatggatatggttcgtggaaggctaactgtccagaccgcaaattctccttatcaatatagaggaattgcccatgctttgtcaactgtcctgcgagaggaaggtccacgggccttgtaccgtggttggcttccatcagtaattggcgttgttccatatgtgggcttgaactttgcggtctatgagactctaaaggactggctacttaaagacaacccattcggtcttgtacaaaacaatgacctgaccattgtaacgaggctcacttgtggtgcaatagctggaacagttggtcaatcaattgcttatccactggatgtgattcgtaggagaatgcaaatggtcgggtggaaagatgcttccgctgttgttacaggcgaagggagaagcaaagctttgcttgaatacactggtatgatggatgcatttagaaaaacagttcgtcatgaaggcttcggagcattgtacaagggtttggtccccaattcagtgaaggttgtaccatccattgcgattgcatttgtgacatatgagatggtgaaagaagttttaggagtggagtttaggatatcagactgagtcacatttgatatctcaatacgtttcgccgacaagaaaacgcacttctatttttgtagccagaggagacagaagagaagttcaacaaatttagggggctttatttatctcctttcaacatccggtgggaaggataaaaggctatagggcttagccaaactctttttttttttttttttctcttctacttatagatgattgggtttatgcttttatgctgaatcaaataagtcagtggccaactacatttggtactgcagtttgtgctacaacatgtttgggctgctcttttctcattcaattatttacactgttgttatgactcttattggttactttgc

SEQ ID NO: 4806 - DNA, 1479 bp, Vigna unguiculata
ggtgttggtggctctcctcactcacactcttgtctgaaccgtcacagaacatgtctttgccgtgagcgttgggaacctgagatctcaatttcgcataccgttaactttatttccccttaaaataaaaaatagaaggttagggttttcatggcttcggagacaaagatcgtgaatctggctgaggaagccaagctagccacggaaggtgttaagactccctcctatgctcttaccaccatctgcaagtccctcgtcgccggtggagtcgccggaggagtatcacgaacggcagttgctccgctggaaaggttgaagattttgctacaggttcagaatccacacaatataaaatacaatggaacgattcaaggtctgaaatatatatggagaactgaaggttttcgtgggctgttcaaagggaatgggactaattgcgctcgaattgtcccgaattctgcggtgaagttcttcagttatgagcaagcttctaagggtatactacaactgtatcagaagcaaactggaaacgaggatgctcagctgactcctgttttacgtcttggggctggagcttgtgcgggaataattgccatgtctgctacttacccgatggacatggttcgaggcagaataactgtacagacagataagtccccttaccaatacagaggaatgtttcatgctctgtcaactgtactcagggaagaaggtccacgtgctttgtataagggatggcttccttcagtcattggagttattccttatgtgggtctcaactttgctgtttatgagtctttgaaagattggttagttaaatccaatccatttggtatagttcaagattctgagctgagtgtgacaactcgcctggcttgtggtgctgcagctggaactatgggacaaaccgttgcttaccctcttgatgtcattcgacgaagaatgcagatggtgggttggaaccacgctgcgtctgtcgtagctggtgatggaagagggaaggtgccacttgaatacagtggcatggttgatgcttttaggaaaactgttcggtatgaaggatttggtgcattatacaagggtctggtgccgaattctgtaaaggtggttccatccatagcaatcgcgtttgtaacatatgaggtggtgaaggacattttaggtgtggagatcagaatatcagactgaagattgtcagccatctgataattgattgcctgttgttttcttgtaggcaaggggatgctcagagatgataacatagggttatgttcttggtttacatctcttcattgagatgggaagcactttagttagtgtgcataaattatttccccttgtatcaatttgttttgctctgtgaacatgatgtagctcttagcttcatattcatcttctatggcaataaatgttgtaggaaaaacaatgcacagacttatctgcatgcctttcttcacgagtgaagaatttttttattgatgg

SEQ ID NO: 4807 - DNA, 1574 bp, Vigna unguiculata
  misc_feature (1528)..(1528): n is a, c, g, or t
ggacgaacgccgtcacagggggaggttggttgtggtgttggtggctctcctcactcacactcttgtctgaaccgtcacagaacatgtctttgccgtgagcgttgggaacctgagatctcaatttcgcataccgttaactttatttccccttaaaataaaaaatagaaggttagggttttcatggcttcggagacaaagatcgtgaatctggctgaggaagccaagctagccacggaaggtgttaagactccctcctatgctcttaccaccatctgcaagtccctcgtcgccggtggagtcgccggaggagtatcacgaacggcagttgctccgctggaaaggttgaagattttgctacaggttcagaatccacacaatataaaatacaatggaacgattcaaggtctgaaatatatatggagaactgaaggttttcgtgggctgttcaaagggaatgggactaattgcgctcgaattgtcccgaattctgcggtgaagttcttcagttatgagcaagcttctaagggtatactacaactgtatcagaagcaaactggaaacgaggatgctcagctgactcctgttttacgtcttggggctggagcttgtgcgggaataattgccatgtctgctacttacccgatggacatggttcgaggcagaataactgtacagacagataagtccccttaccaatacagaggaatgtttcatgctctgtcaactgtactcagggaagaaggtccacgtgctttgtataagggatggcttccttcagtcattggagttattccttatgtgggtctcaactttgctgtttatgagtctttgaaagattggttagttaaatccaatccatttggtatagttcaagattctgagctgagtgtgacaactcgcctggcttgtggtgctgcagctggaactatgggacaaaccgttgcttaccctcttgatgtcattcgacgaagaatgcagatggtgggttggaaccacgctgcgtctgtcgtagctggtgatggaagagggaaggtgccacttgaatacagtggcatggttgatgcttttaggaaaactgttcggtatgaaggatttggtgcattatacaagggtctggtgccgaattctgtaaaggtggttccatccatagcaatcgcgtttgtaacatatgaggtggtgaaggacattttaggtgtggagatcagaatatcagactgaagattgtcagccatctgataattgattgcctgttgttttcttgtaggcaaggggatgctcagagatgataacatagggttatgttcttggtttacatctcttcattgagatgggaagcactttagttagtgtgcataaattatttccccttgtatcaatttgttttgctctgtgaacatgatgtagctcttagcttcatattcatcttctatggcaataaatgttgtaggaaaaacaatgcacagacttatctgcatgcctttcttcacgagtgaagaatttttttattgatggaatatccagtgattcnctactttattttattacaatcgatttgacgggataagttaaaagac

SEQ ID NO: 4808 - DNA, 1753 bp, Glycine max
gaacggcgtcaccgtgctgaggtttgttgttgtgtttgtggcctctctcagccgtctcagtctctgcctaacactcgctcatcctaaaatatgatcatttcttcgccgtaaattcgccggcaacccgagacctcaacttctcactgccgttttctcctccctcaaaaaaacaaggttagggttttcatggcttcggagacgaaggtcgtgaatctggctgaggaagccaagctcgccagagaaggtgtcacggctccctcctatgcttttaccaccatctgcaagtccctcgtcgctggtggagtcgccggaggagtatcacgaactgcagttgctccactggaacggttgaagattttgctacaggttcagaatccccacagcattaaatacaatggaacaattcaaggtctaaaatatatatggagaactgaaggttttcgtgggctgttcaaagggaatggtactaattgtgctcgaattgtcccaaattctgctgtgaagttcttcagttatgagcaagcttccaaaggtatactacatctgtatcagaagcaaactggaaacgaggatgctcagctgactcctcttttccgtcttggggctggagcatgtgcgggaataattgccatgtctgcaacttatccaatggacatggttcgaggcagaataactgtacagacagagaagtccccttaccagtacagaggaatgtttcatgctctgtcaactgtactcagggaagaaggtccacgtgctttatataaggggtggcttccttcagtcattggagttattccttatgtgggcctcaactttgctgtgtacgagtctttgaaagattggttagttaaatctaatccattaggtctagttcaagattccgagttgagtgtgacaactcgcctggcttgtggtgctgcagctggaactattggacaaactgttgcttaccctcttgatgtcattcgtcgaagaatgcagatggtgggttggaaccatgctgcttctgttgtagctggtgatggaagagggaaggtacctcttgcatacactggcatggttgatgcttttaggaaaactgttcggtatgagggatttggcgcattatacaggggtctggtgccaaattctgtaaaggtggtcccatccatagcaattgcgtttgtaacatatgaggtggtgaaggacattttaggagtggagatcaggatatcagactgaagatttgcatccatgtgatatttgattgcctgttgttttcttgtaggcaaggggatgcagagatgataaattagggttactttcttatttttaatctcttcaatgagttaggaagcacttgagttagcgtgtataaattaattcccttgcatcccatttgtttttccttgtgaacatgatttagcttttagcttcttattcatcttctatggcaataaatgttgcggaaaaacagtgcaaggacatatcggcatgcatttctgcagagtgaagaaagcatttttattggttgtatatccattgactgattactgagtaccactccctatcctcgtctagaaatcgtatttgtattgtgtgcaagttactctattcagccactctatagcccagcaaatagcgataagtctgaaggtctcgtgttatatttaccttattatatttctcagcacattcctgcaagtggaggtctagtgtcatctatgatattaataatactaattaataaaggataagttttttttttctt

SEQ ID NO: 4809 - DNA, 1318 bp, Valeriana officinalis
aaaaaactctctcttctccctctccttcgccgccgacctggcggatttctcctatcgatcttagatatcgagatctgaacggagaatttaacttatggcatctgaagatgtgaaggcaagcgaatctgctgtttcaactattgtgaatttagctgaagaggcgaaacttgctcgagaaggtgttaaagctccgaatgttcagatcctatcaatttgtaagtctcttgttgctggaggagtcgccggaggcctgtcacgaactgctgtagccccactggaacggttaaagatactgctgcaggttcaaaatgctcataacataaagtacaatggtacacttcaaggcttgaaatatatatatagaacagaaggtttcaggggattatttaaaggaaatgggacaaattgtgctcgtatcgtcccaaattcagcagtcaagttcttcagctatgaagaagcatccaagggaatcttatggttctaccgacggcaaagtggcaatgaggatgctcagctcacgcctctattacggcttggggcgggagccacggctggaataattgccatgtcagcaacgtatccaatggatttggtacgaggccggcttactgtacagacagaaaagtctccgtatcagtacagaggaatattccatgctttatcgactgttcttcgtcatgaaggtccaagagctttatacaaaggctggcttccttctgttatcggcgttgttccatacgtcggtctgaacttcgcagtgtacgaatctctaaaagactggctgataaagtcacgaccattcggacttgtcgaagacaccgaattgagcgtaatcacaaggctggcttgcggtgccgctgccggaacggtcggccagacagtggcctacccactggacgtgattcgccggagaatgcaaatggtgggatggaaagggggctcctccgtcatcgctggcggcgctgacaaagctgcctccatggaatacaccggcatggtcgacgcgttcaggaaaaccgtcagacacgaaggtttcagagccttgtacaagggtttggttccaaactccgttaaggttgtgccgtcgattgcaattgcatttgtgacatacgagcaagtgaaggaaatcttgggagttgagatccgaatttcggactaacttatatataaaatgtgaaatccagatttattcgtctactttttattttatttttatttttttagagaaagagagtgagtgagaaagtaacatagattagtttatgtcctctttcgaatttagtactccgtataaatcagtaaaacctcttttggtacg

SEQ ID NO: 4810 - DNA, 1624 bp, Vinca minor
ggcatttgccgtcttctccttccgccatagcgaccaccaccaccaactccgacgcaacagaggctgaagaacaacgatgttcgctttctgatttctcttcaggctgccgatccatcgaccgtcgcgaggatatatagacagactcggatcgtcttcggctgaggattttattttgcttgtttatatggcttcggaagatgtgaaaacaagcgaatcggcagtatcgaagattgtaaatctagctgaagaagctaagcttgctagagaagaaattaagcctactagtcaaactgtgctcagtgtatgcaaatctcttgtagctggcggtgttgctggtggcttatcacgtactgctgtggccccattggaacggcttaagatattgttgcaggtccaaaatccacatagcataaagtataatggtacagttcagggcctgaaatatatttggagaactgagggattcagaggattgtttaaaggcaatggcactaactgtgctcgcattgtcccaaattcagcagtaaagttctttagttacgagcaagcttcaaagggtatcttatggctataccagcagcaaactggcaatgaggatgctgaacttactcctctattgcggcttggagctggtgcttgtgctggaataattgccatgtctgcaacttaccctatggacttggctcgtggaagactaactgtacagacagcgaagtccccttatcagtacaggggaatgtttcatgctttatctaccgtccttcgcgaagaaggtccaagggcgttatacaagggttggcttccttctgttataggagttattccatatgttggtctcaattttgctgtatacgaatcacttaaggattggttggttaaggctaggccttttgggttcgttgaagaccaagaattgggtgttacaacacggcttgcatgtggagcttttgctggaactgtgggacaaactattgcttaccctctcgatgtcatccggagaaggatgcagatggtgggatggaaaaatgctgatgccattgttactggtgatgggaggatcaaagcacctttggaatacactggcatggttgatgctttcaggaaaactgtgaggcatgaagggttcatagctctgtacaagggtttggtacccaattccgtgaaggttgtcccatcaatagctattgcattcgtgacatatgagcaagtgaaggacttacttggcgttcagattaggatatcggactaatggagaaccgctcctacatacttttttgattgcgtgtgagattttgtaggcaaggagaagaaatatcatagcatggtgcacatgtcactctctatccgggacagttaatttagagatctcatataccctgtgtttatatgatgcttttcatttcagtgatgtatctctgggatgctttagcatgtagatcacaatttaaatgatgtcccaataatgactctgtttaagaaaattgtaataagtgcttgaccagttctgctgactatttgacaagcgtgagccagtggatctcttttatgtcccaatgtttatttagaccttgaacttttgatggctcacttggtgagaatgtagttgtaattgtatgaagcaaaa

SEQ ID NO: 4811 - DNA, 1475 bp, Cynara scolymus
  misc_feature (1002)..(1002): n is a, c, g, or t
  misc_feature (1352)..(1352): n is a, c, g, or t
acgacggcgaatctacctgaatttggctagggttccggtgaatttcatttcatttcattccatcgtgtttagaaccacgctgttgacatggcgtcggaggacgtagtcgggaagacgagcgctacgatcgctaatatcgctgaagaagcaaagattgcgagtgaaggtgtgaaggctccgagtcgtcaaactttacttggcatctgcaaatctctcgtcgccggtggcgttgccggtggagtatcacgtactgctgttgctcctctagaacgaatgaaaattcttctccaggttcaaaatccacatgcaatcaaatacaacggaactatccagggactcaaatatatatggagaacagagggtttgcgaggaatgtttaaaggcaatggtaccaactgtgctcgcattgttccaaactctgctgtcaagttctttagctatgaggaggcatccaaaggaatcctgtggctctatcggcagcaacctggaaatgaggatgctgaactcacccctctcctacgccttggagctggtgcttgtgctggaataattgccatgtcagctacctatccaatggacttggttcgagggcggcttactgttcagactgataaatctcctagccagtatagaggaattgctcacgctcttagaacggtgctccgagaaagaagtccgcgagcattatacaaaggatggcttccttctgtgattggtgtggtaccatatgtggggttaaattttgcggtatatgaatctttaaaagattggttggtgaaatcacggccatttggattagtcgaggacactgagttgagtgtgacaacaaaacttgcatgtggggctgcggccggaacattggccaacggttgcttatccgcttgatgtgatacgcagaagaatgcaaatggttgggtggaaagatgcagcttcaattgttaccgggggcggcaagtcgacagttgaatacacgggaatgattgatgcattcaggaaaactgntcgctatgagggcgttggcgctttgtacaagggtttggtccctaactcggtgaaggtggttccatcgatagcgattgcgtttgtgacgtacgaggtcgttaaagacgtactgaaggtagaaatgaggatatccgattaaacaaagcatcgtattttattgaacgttggtattattagtttgcgtgcaaaaagggggggttaaaatttttgttctcgtatctcttccatttatcgttgctttatgataaacgaagagatttatagaactaggccatgttgatatagtcgacgcgtatccaatacacacctagagcacgctatagttcgggttttaagttgtttgtgttccnacatcacataataaggataggctcggagagtcgaggctcttggtttctcaaccgagaagtgaaattattatttgatcagtattcttattattaacagatataatagaaagttttatgttggtc

SEQ ID NO: 4812 - DNA, 1687 bp, Arabidopsis thaliana
aatcagtaggttgtgtcttttggcttttatcatcgccgccgggacacaacacaaagaggggcttagatttgtgctttcgagaagtgctttgatctctcttctccattttcacttctaatcggagatttctcttagggttttgttattcgttgagagatcgaattaaaaacttgtgaagaaatctctagggatcgtaatcgttgttggtgtggggtattacactgattccggtttgaacctgaatcgtatctatcaatcgatggcatcagaggatgtgaaaagaacagaatcagcagctgtgtcaacgatcgtaaatctggcggaggaagcgagggaaggagtcaaagctccgagttatgcttttaaaagcatctgcaagtctctttttgccggtggtgtcgctggtggagtgtcacgaactgctgttgcacctctggaaaggatgaagatattacttcaggtccaaaatccgcataatataaagtacagtgggacagtccaaggattgaagcatatttggagaaccgagggacttcgtggactgttcaaaggaaatggcaccaactgtgctcgtattgttcctaattcggctgttaaatttttcagctatgagcaagcttcaaatggcatactgtacatgtatcgtcagcggaccggaaatgaaaatgcccaacttactcctcttttacggcttggagctggtgcaaccgctgggataatagccatgtctgcaacgtacccgatggatatggttcgtggaaggctaactgtccagaccgcaaattctccttatcaatatagaggaattgcccatgctttggcaactgtcctgcgagaggaaggtccacgggccttgtaccgtggttggcttccatcagtgattggagttgttccatatgtgggcttgaacttttcggtgtatgagtctctaaaggactggctagttaaagagaacccatacggtctagtagaaaacaatgagctgacggttgtaacgaggctcacttgtggtgcaatagctggaacagttggtcaaacaattgcttatccactggatgtgattcgtaggagaatgcaaatggtcgggtggaaagatgcttccgctattgtaacaggcgaagggagaagcacagcttcacttgaatacactggtatggtcgatgcatttagaaaaacagttcgtcatgaaggctttggagcattgtacaagggtttggtccccaattcagtgaaggttgtaccatcgattgcgattgcatttgtgacatatgagatggtgaaagacgttttaggagtggagtttaggatatcagactgagtcatttgatatctcaatgccgtcaagaaagcgcacttctatttttgtagccagaagagaagttcaacaaagttaggggggctttatttatctcctttcaacatccggtgggaaggataaatggctataggggcttagccaaactctttttttttttcttcttctacacttagattgggtttatgcttttatgctgaatcaaataagtcagtggccaactacatttggtactgcagtttgtgctacaacatgtttgggctcctcttttctcattcaattatttacactcttgttatgacccttattggttactttgcctatttacaaaattcatgtgcttgtgtcatttttatgtacctttgatcacac

SEQ ID NO: 4813 - DNA, 1627 bp, Solanum lycopersicum
attataattatagcagacaaagagagttaactctgattttgcacgttcactttcctgctgcattttcatcgatctttgttcatttacgcccgccgccgccgccgccgccacaaaccaccgggattcagtataccgtcgcggggaaaattacatttttcccttagctcgtccatattccgatcggtcctctggttttgaactgagtatatttttgacagtgttcaaaatctaaggattcgtattaggttgagctataaactaggcgatctcgatcttatatggcttctgaggatgtgaaggcgagcgaatcagcggtggagaaaattgtgaatctcgcagaagaggcgaagttagctagacaagaaatcaggccaacaagccatgctgttatcagtatctgcaagtcactcgtagctggaggtgtcgccggaggcgtgtcacgaactgctgtggccccactggaacggctaaagatattgctccaggttcaaaattcacatagcataaaatacaatgggaccatttcaggcttaaaatatatctggagaactgaggggttcaaaggactgttcaagggcaatggtaccaattgtgcacgtatcgtcccaaactcagcagtcaagttcttcagctatgagcaagcttccaagggtatactttatctttaccagcaacaaactggcaatgaagatgctcagctcactcccttactgcgtcttggagctggagcttgtgctggcataatagccatgtctgcaacttatccaatggacatggtgcggggaagaatcactgtgcagacagagaagtctccttatcaatacagaggaatggtacatgccctatccaccatacttcgtgaggaaggtccacgtgctttgtacaaaggatggcttccttctgtcataggagttattccatatgtgggacttaactttgcagtttacgagtctctaaaagaatggttggtcaaaacaaaaccacttggtctagttgatgattctactgagcttggtgttgttacaaggctggcatgtggggctgtggcagggactatggggcaaactgttgcttaccctcttgacgttgttcgaagaaggatgcagatggtgggttggaaagatgccgcatccatcattactggtgatgggaggagcaaggcctcccttgaatattctggtatgattgatactttcaggaaaactgtgaggtatgagggcttcagtgccttgtacaaaggtttggtgcctaactcagtgaaggtcgttccttcaatagctattgcttttgtgacatatgagcaagtgaaggacctattgggagttgaaatcaggatatctgactgatgaagacaagctccaatcgtttttccttgcatatgataattttgcagacaaggatagatagagtgataataacatgacgggttacaccgtctaaacagagaatttacgcttgtgatggaaaaattaggtttttctagtgtgcttataatttccttatgtatctgtttattgcttattcaattgtcaataagcaaattttagaagaaaacagtgtaatgactaatttgaatgccttgccatggttcaagtgaagaaaagctgattgctggttgcctttgcta

SEQ ID NO: 4814 - DNA, 1400 bp, Valeriana officinalis
tttaacggaaaaactaacgccgttactaattcctcaacaataaaacactctctcaaacacactgccgtattttaacgatcaacactcagaactgaaaaaactctctcttctccctctccttcgccgccgacctggcggatttctccgatcgatcttagatatcgagatctgaacggagaatttaacttatggcatctgaagatgtgaaggcaagcgaatctgctgtttcaactattgtgaatttagctgaagaggcgaaacttgctcgagaaggtgttaaagctccgaatgttcagatcctatcaatttgtaagtctcttgttgctggaggagtcgccggaggcctgtcacgaactgctgtagccccactggaacggttaaagatactgctgcaggttcaaaatgctcataacataaagtacaatggtacacttcaaggcttgaaatatatatatagaacagaaggtttcaggggattatttaaaggaaatgggacaaattgtgctcgtatcgtcccaaattcggcagtcaagttcttcagctatgaagaagcatccaagggaatcttatggttctaccgacggcaaagtggcaatgaggatgctcagctcacgcctctattacggcttggggcgggagccacggctggaataattgccatgtcagcaacgtatccaatggatttggtacgaggccggcttactgtacagacagaaaagtctccgtatcagtacagaggaatattccatgctttatcgactgttcttcgtcatgaaggtccaagagctttatacaaaggctggcttccttctgttatcggcgttattccatacgtcggtctgaacttcgcagtgtacgaatctctaaaagactggctgataaagtcacgaccattcggacttgtcgaagacaccgaattgagcgtaatcacaaggctggcttgcggtgccgctgccggaacggtcggccagacagtggcctacccactggacgtgattcgccggagaatgcaaatggtgggatggaaagggggctcctccgtcatcgctggcggcgctgacaaagctgcctccatggaatacaccggcatggtcgacgcgttcaggaaaaccgtcagacacgaaggtttcagagccttgtacaagggtttggttccaaactccgttaaggttgtgccgtcgattgcaattgcatttgtgacatacgagcaagtgaaggaaatcttgggagttgagatccgaatttcggactaagttatatataaaatgtgaaatccagatttattcgtctactttttatttttatttttttagagaaagagagtgagtgagaaagtaacatagattagtttatgtcctctttcacaatttagtataaatcagtaaaacctcttttggtac

SEQ ID NO: 4815 - DNA, 1284 bp, Flaveria ramosissima
cacttcagatcgccactcacgacggcgctccgcctgaattccctagggttccggcgaagtcccctctgattcaatcacctttcacctcttcttcgatttctccggcgatatggcatcggaggacgtcgtagggaagacgagcgctacaatcgctaacatcgctgaagaagcgaagattgcgagtgtaggtgttaaagctccgagccgtcagacgttgctgagcatctgcaaatcgctcgtcgccggaggcgttgccggtggagtatcgcgtactgctgttgctcccctggaaagaatgaaaattctgctccaggtccaaaatccgcatgcaatcaaatacaacggaactattcagggactaaaatatatatggagaacagagggtttgcgaggaatgtttaaaggcaacggcaccaattgtgcacgcattgtcccaaactctgctgtcaaattcttcagctatgaagaggcatccaaagggatcttgtggctatatcgacagcagcctggaaacgaggatgctgaacttacgcctctcttacgtcttggagctggtgcttgtgctggaataattgccatgtcagcaacgtatccaatggacttggttcgaggtcgtcttactgtccagacggataaatctcctagtcaatatagaggaattgctcatgctcttacaacagtactccgtgaagaaggccctcgtgcattatacaaaggatggcttccttctgtgatcggtgttgtaccatatgtggggcttaattttgcggtatacgaatccttaaaagactatctggtgaaatcaagaccatttggactagttgaagacactgagttgagtgtcacaactaagctcgcatgcggggccattgctggaaccgttggtcaaacagttgcatatccactcgatgtcattcgcagaagaatgcaaatggttggttggaacatgctgcttcagttgttaccggtgaaggaaagtcagcacttgaatactggaatgattgatgcattcaggaaaaccgttcgccacgagggttttggtgctttgtacaagggtttggtccctaactcggtcaaggtggttccatcaatagccattgcatttgtgacatatgaggtggttaaggatgtactcaaggttgagatgaggatatccgagtaaacaccgcattcttatcatttatttttattaaatgttcgcgttagtttgcttgcgtgtgcaaaagggtaaaccctcaagtaaaaaggtttttttctttaatctcttttacgttaagaggttag

SEQ ID NO: 4816 - DNA, 1657 bp, Triphysaria pusilla
agggatacttggcaatcatcgcacgagtgtaaccccttcatcttcaagcaatagtggtgctcacactccgactctcacagctagacgccgtcatctatctccattcctctctccgccaccaccatcaacggaccctctgttagtgaagaggcatcagcgggttgagtgcgcgcctcgatttgatcgtcgacgacctatttttttgttacctttgatatagttgtttgattcttcgatcgatttcttttttgagaagtttggggatttgatggcgtctgaggatgtgaagatgagtgagtcggctgtgtcgaagatggtgaatttagcggaggaagctaagctcgcgaaggaagaaatcaagccctctaagtatcaagttttcagtgtttgcaagtctctcgtcgccgggggtgtagccggaggattatcgcgaacagctgtagctccattagagcgattgaaaatcttgctccaggttcaaaatccacacaatataaaatacagtggtactgttcaaggcttgaagtacatatggagaactgagggctttagaggattgtttaaaggcaatggcactaactgtgctcgtatcgtcccaaactcggcagtaaagttcttcagctacgagcaagcatccaagggcatattatacttgtaccagcagcaaactggaaatgaggatgctcagctgactcctttattacgcctgggagcgggagcaactgctggaataattgccatgtctgctacatacccattggacatggttcgaggcagactcactgtacagacggataaatccccatatcagtatagaggaatgtttcatgctctatcaactgtgcttcgccaggaaggctttcgtgctctgtacaagggttggcttccatctgtcattggagtcgtaccttatgtgggtctcaactttgctgtgtacgaatctcttaaagactggttaattaaatcaaagacgttcaatctcgttgaagataatgagttgggtgtcgtaacaagacttgcatgtggagccgcagcaggcacagttggacaaactgttgcatacccactcgatgtcatacgtcggaggatgcagatggtggggtggaataatgcttcttcggttgtcgttggtggaagcaagggcccacttgaatacactggcatggttgacgctttcaggaaaaccgttaggcatgagggcttcagagcattatacaagggattggtcccaaattctgtgaaggttgtcccgtcaatagcaattgcattcgtgacgtacgaacaagtgaaagagtttttgggcgtggagttcagaatatcagactgatatcaatgaagatgtatgtttcttcattcaactcaacgtgatttttatttttattttatttctatttttgcgggcaacgagagggaaaagagatagaagtaacagaactctatttcgcacagtcgagttagaactacattacgaacctccgtgactgtgtatatgttttacaatggctgtgtttctgaaattccggtttaaaattattagccggttggaagaaacgcttccttataagtaataaggagagacaaataatgccgaaataataacttgtgtacaaacagctatgtattgttcttggacaaacataaaacctgcctattctca

SEQ ID NO: 4817 - DNA, 1427 bp, Lippia dulcis
atttgatggcgtcggaggatgtgaaaacgagcgagctgtcgaagattgtgaatttcggcgggggaggctaagctcgcgaagcaagaaatcaggcctactaagtatcaggttttcagtatttgcaaatctctcgtagctggcggcgtcgccggaggagtttcgcgaactgctgtagctccattggaacgattaaaaattttgctccaggttcagaatccacacaatataaaatacagtggtactgttcaaggcttgaagtatatatggagaactgagggccttagaggattgtttaaaggaaatggcactaattgcgctcgtattgtaccaaattcagcagtaaagttcttcagctatgagcaagcatccaagggcatattatatgtataccagaagcaaactggcaatgaggatgctcagttgactcctttactgcgcctcggagcgggagcatgtgcggggataattgcaatgtctgcgacatacccaatggacatggttcgaggcagacttactgtacagacagataagtctccttaccaatacagaggaatgtttcatgctttatcgactgtccttcgtgaggaaggattccgcgctttgtacaagggttggcttccatctgtaattggagtagtaccttatgtgggtctcaactttgctgtctatgaatctcttaaagactggttaattaaatctagatcttttggccttgttgaagataataacgaattgggagtagtaacaaggcttgcatgtggagctgcagcaggcacagttggacaaactgttgcttaccctcttgatgtcatccgtagaagaatgcaaatggtgggttggaataatgcttcttccattgtcactggtgacgggagagtcaaggccccccttgaatatactggcatggtggatgccttcaggaaaactgtgaaatatgagggcttcagagcattatacaagggattggtccccaattcagtcaaggttgtcccctcaatagccattgcgtttgtgacatacgagcaagtgaaggagctacttggggtagagattaggatatctgactgatgcagatagagatttcaaatttacactccttaggttggatttttgacggcaagaagaggagacgagatttattcgattaccctctattgcaccgagaaagataggaggctattttaacctctgtctatagtttggatttttgcatgtatgttgttcttctgggttcagaaggtagctgctcgatagaagcgcttttcgcaataagccgtaacaatgaataatcaaataataatagtaataattaatgcatttgttgttaaagatgcttggtgagtcttagcttatgtacacgaattggctgctttcgtggatataacctacctatttattagcaatttccttattttatcaaaaaagaa

SEQ ID NO: 4818 - DNA, 1757 bp, Gossypium raimondii
tcctcgaataagggtattaagacagtcatattttcctccaaagcgccttcctctttgaactccttggccaatgcttactcgttctgtctccttaccataatcattggaaagacgatctcctcttcttcgacgattaccggggtccggttaacgccgtattcgaccggataactaagttccgttgatatatcttccggctagcttttttttcgtcattttacttttgtctatctcaaaagatggcgtctgaggacgtgaaaaggagcgagtcggctgtcacgacgattgtgaatctggcggaagaagcgaagttcgctaaggaaggagttcaagccccgagccacgcgttccttagtatttgcaagtctctattcgctggtggtgtcgccggtggagtgtcacgtagtgctgttgcccccctagaaagattaaagattttacttcaggtgcagaatccgcatggtataaaatacaatggaacaatccagggtttaaaatatatatggaaaaccgagggttttagaggaatgtttaaaggcaatggtactaattgtgctcgcatcatcccaaactcagccgtgaagttttttagctatgaggaagcatctaaggggattttatacctttaccggcagcaatcaggaaatgaggatgctcaactcacgccacttctacgccttggagctggtgcatgtgctggaatcattgccatgtcagccacttatccaatggatatggtacgaggtcgtctaactgtccagaccgagatgtcacctcgccactatagaggaatctttcatgctcttacaacagtcttgcgggaagaaggacctcgtgctttgtacaaaggctggttaccttcagtaataggagttgtaccctatgtaggtcttaactttgcggtttatgaatctctgaaagactggttgatcaaaaggagaccatttgggctagttgaggactctgaattaggtgtcacaacaaagctggcatgtggagctgctgctggaaccgttggccagacagttgcttaccctcttgatgtcattcgacgtagaatgcagatggcgggctggaaagatgcagcttcagttgtcactggtgatgggaatagcaaggctccccttgaatatactggtatggttgatgcattcaggaaaacagttcggtatgagggttttggagcattatacaagggtttggttcccaattcagtgaaggtggttccatcgatagcaattgcattcgtcacatacgagttggtgaaggatgttcttggggttgagttaaggatatctgattgaaggattattcgatttttggttgatattcagtttattttagtggtgaggaattgctgtgaatttaggtggttatttagctatgttacttttcttcttcgaaatagcacatatttaaatataaatatagaggtatgatgtgtgaaatatatgaaaaagcttaggagaaaagcataatggtgtcagatatgtatcagtttttgaaatttacctgtccgagtaacatctacttttagagtctgtttaaatttcttcagcatcacatgtgctgtggcaatgacgttaggaaatggtgctgctagaatacgctctgtcagattaccttttttggaagttattgccaagttgtagtagtgatgattattaaataagacatcacatttaagttttaactttaaaatatagatatttatgttactcagatttttacaataaaatatatgatttgggcaccta

SEQ ID NO: 4819 - DNA, 1678 bp, Lactuca sativa
ccgcaatcccaatcaattaaaatattcacgcgccaccaccagcaccacgtgcgtactcgctatatgtttgatcattttttcgtttatttatccttttaatctctctcaattaaagatcgccggaggagaacgcacgacggcgaatctagctgagtttggctagggttcctgtgaatttccatatctcgtttgattgtgtttcacagctgcgctattgaaacatggcgtcggaggacgtggtcgggaaaacgagcgctacgatcgcgaatatcgctgaagaagcaaagatagcgagtgaaggtgtgaaggctccgagtcgtctcgctttacttggcatctgcaaatctctcgccgccggaggcattgctggtggagtatcacgtactgctgttgctcctttagaacgtttgaaaattctcctccaggttcaaaatccacatgcaatcaaatacaatggaacaattcaggggttgaagtatatatggagaacagagggtttaagaggaatgtttaaaggaaatggcaccaattgtgctcgcattgtcccaaactctgctgtcaagttctttagctatgaagaggcatccaagggaatcttgtggctctataagcagcaacctggaaatgaggatgctgaactcacccctctcttacgccttggagccggtgcttgtgccggaataatcgccatgtcagcaacctacccaatggacttggtccgcggtcgccttactgtccaaaccgataaatctcctagccaatatagaggaatcgctcatgctcttaaaaccgtactccgtgaagaaggcccacgcgcattatacaaaggatggctcccttccgtcatcggtgtcgtaccatatgtggggcttaattttgcggtatacgaatcattaaaagattggttggtgaaaacaaggccatttgggctaaccgaaggcacggacctaagcgtgaccacaaagcttgcatgtggggccgcagcgggaaccgttggacaaacggtggcttatcctctcgatgtgatccggcggagaatgcaaatggtcgggtggaaagacgcggcttcggttgtaaccgcaggtggcaagtcgggaggactcgagtacaccggaatggtcgatgcctttaggaaaaccgttcgctatgaaggcttccgtgcgttgtacaagggcctcgtccccaactcggtcaaggtggtaccatcaatagctattgcgtttgtgacatatgaggtggtgaaggacgtattgcatgtagagatgaggatatccgattaaagaaatagcatcctactttattaaactttatagttaaagttaaagtttgtgtgtgaaagggtaaaattgtgtaaactaccaagtggaaatttttttgttctctaagtgtctagagatttaagagtagctcatgtttatatacaacaacacccatagcaccaggtgtagtagtttggtttttaaagtatttgtacccacagccactgtgtttaataaggataggcttggagagctgagtcccgtggtttttttttttttttttttggttttggaagtgaagttattgtttgattagtatattattaacatatgatagtgaatttatataaagtttttatgttgcttatttatttcttttgtatacatcgatataaaataaagacttaagttgtgggatt

SEQ ID NO: 4820 - DNA, 1627 bp, Phaseolus coccineus
ggatggattgagtccacgtatctatatatattgtatgaatggtacaatagacacaaacgccgtcacagtggtgaagttcgttgtggtgtttgtgacttctctggtctgaaccgtcacaaaacatgtctttgccgtaagcgttgggaaccagtgatctcaatttctcatactgttaactttattttcccttaaaataaaattagaaggttagggtttccatggcttcggagacaaagatcgtgaatctgactgaggaacccaacctagccagggaaggtgttaagcctccctcctatgcttttacgaccatctgcaagtccctcgtcgccggtggagtcgccggaggagtatcacgaacggcagttgctccactggaaaggttgaagattttgctacaggttcagaatccacacaatataaagtacaatggaacaattcaaggtcttaaatatatatggagaactgagggttttcgtgggctattcaaagggaatggtactaattgtgctcgaatagtcccgaattctgcggtgaagttcttcagttatgagcaagcttccaagggtatactacaactgtatcagaagcaaactggaaacgaggatgctcagctgactcctgttttacgtcttggggctggagcttgtgcgggaataattgccatgtctgcaacttatccaatggacatggttcgaggcagaataactgtacagacagagaagtccccttaccagtacagaggaatgtttcatgctctgtcaactgtactcaaggaagaaggtccacgtgctttatacaagggttggcttccttcagtcattggagttattccttatgtgggtctcaactttgctgtgtatgagtctttgaaagattggttagttaaatccaatccatttggtatagttcaagattctgagctgagtgtgacaactcgcctggcttgtggtgctgcagctggaactatgggacaaaccgttgcttaccctcttgatgtcattcgacgaagaatgcagatggtgggttggaaccacgctgcttctgtcatagctggtgatggaagagggaaggtgccgcttgaatacagtggcatgattgatgcttttagtaaaactgttcggtatgagggatttggtgcattatacaagggtctggtgccgaattctgtaaaggtggtcccatccatagcaattgcgtttgtaacgtatgaggtggtgaaggacattttaggtgtggagatcagaatatcagactgaagattgtcttctatctgatattgattggttgttgttttcttgtaggcaaggggataatcagagatgataaccctaagttatcatctcttcattgagataggaagcacttgtgttagtgtgcataaattatttctcttgtatcccatttgtttttccctgtgaacatgatgtagcttttagcttcatattcatcttctatggcaataaatgttttagaacaaacaatgcaaagacttatctgcatgcctttcttcacgagtgaagatttctttttatggagtatcctgtggttcaccactgaagtactccaccctatcctcgtctagaaatcgtgttatcagtgcgcaagttactaagcatcactctaacgc

SEQ ID NO: 4821 - DNA, 1695 bp, Gossypium hirsutum
ctccctctttgaactctttggccaatgcttactcgttctgtctccttaccataatcattggaaagacgatctcctcttcttcgacgattaccggggtccggttaacgccatattcgaccggataactaagttccgttgatatatcttccggctagcttttttttttcgtcattttacttttgtctatctcaaaaagatggcgtctgaggacgtgaaaaaggagcgagtcggctgtcacgacgattgtgaatctggcggaagaagcgaagttcgctaaggaaggagttcaagcgccgagccacgcgttccttagtatttgcaagtctctattcgctggtggtgtcgccggtggagtgtcacgtagtgctgttgcccccctagaaagattaaagattttacttcaggtgcagaatccgcatggtataaaatacaatggaacaatccagggtttaaaatatatatggaaaactgagggttttagaggaatgtttaaaggcaatggtactaattgtgctcgcatcatcccaaactcagccgtgaagttttttagctatgaggaagcatctaaggggattttatacctttaccgacagcaatcaggaaatgaggatgctcaactcacgccacttctatgccttggagctggtgcatgtgctggaatcattgccatgtcagccacttatccaatggatatggtacgaggtcgtctaactgtccagaccgagatgtcacctcgccactatagaggaatctttcatgctcttacaacagtcttgcgggaagaaggacctcgtgctttgtacaaaggctggttaccttcagtaataggagttgtaccctatgtaggtcttaactttgcggtttatgaatctctgaaagactggttgatcaaaaggagaccatttgggctagttgaggactctgaattaggtgtcacaacaaagctggcatgtggagctgctgctggaaccgttggccagacagttgcttaccctcttgatgtcattcgacgtagaatgcagatggcgggctggaaagatgcagcttcagttgtcactggtgatgggaatagcaaggctccccttgaatatactggtatggttgatgcattcaggaaaacagttcggtatgagggttttggagcattatacaagggtttggttcccaattcagtgaaggtggttccatcgatagcaattgcattcgtcacatacgagttggtgaaggatgttcttggggttgagttaaggatatctgattgaaggattattcgatttttggttgatattcagtttattttagtggtgaggaattgctgtgaatttaggtggttatttagctacgttacttttcttcttcgaaatagcacatatttaaatataaatatagaggtatgatgtgtgaaatatatgaaaaggcttaggagaaaagcataatggtgtcagatatgtatcagtttttgaaatttacctgtccgagtaacatctacttttagagtctgtttaaatttcttcagcatcacatgtgctgtggcaatgacgttaggaaatggtgctgctagaatacgctctgttagattaccttttttggaagttaatgccaagttgtagtagtgatgattattaaataagacatcacatttaagtttaactttaaaatatagatatttatgttactcagatttttacaataaaa

SEQ ID NO: 4822 - DNA, 1496 bp, Artemisia annua
gatccaccaccagacgaccaattaacatttcctcctcctagggttccggcgactttatttatataattttttttataaaaaaaaaaatttggtatggcgtcggaagatgtggtaggtaagacgagtgcaacgatcgcgaatatagcggaggaagcgaagatagcggcgagtgagaatgttaaggctccgagtcgtcagactttgcttgggatttctaaatctcttgttgctggtggtgttgctggtggagtatcacgtaccgctgttgctcctttggaacgattgaaaattctgcttcaggttcaaaatccgcatgccatcaaatatagtggaactatccagggactgaaatatatatggagaacagagggtttccgtggaatgtttaaaggaaatggtaccaattgtgctcgcattgtcccaaactctgctgtcaagttctttagctatgaagaggcttctaagggaattctgtggctctaccggcagcaaccgggaaatgaggatgctgaactgacccctcttttacgcctcggagctggtgcttgtgctggaataattgccatgtcagctacctatccgatggatctggttcgaggtcggatcactgtccagactgagaaatctggcactcagtacagaggaattgcacatgctcttaggacagtactccgtgaagaaggcccacgtgcattgtacaaaggatggcttccttccgtcattggtgtggtgccctacgtggggctcaattttgcagtatacgaatcactaaaagaccaaatcaagaccatttggactggttgaggacacagagttgagtgtgataacaaagcttgcatgtggggctgcagctggaaccgttggccaaacagttgcttatcctcttgatgtcatacgccgaagaatgcagatggttggatggaaacatgctggttcagttgttaaaggggagggaaagtcggcaatggaatacaatggaatgattgatgcattcaggaaaaccgttcgtcatgagggttttggcgctttgtacaagggtttggtccccaactccgtcaaggtcgttccatcaatagccatagcctttgtgtcgtacgaggttattaaggacatcctcaaggtagatatgaggatatctgattaaaacaaagcatcatattttgctcaacattcgtgttagcttccatgccaaagggaaaggaggaggtaaaagctacccagtacaaagttgtgttcttaaatctctttcggttttggatgacaaagagatagggaactagcccatgttgatatagttgagtcgacccctttacccatagcatgatttttcgtcacttgtagttcagatttatttatggtgtttggcattcgtatgtatgaacaaaataaggaaatggtcagagtcaggccggcttgataaacatggaaagacactattgtttgattagcattattaacgtatactagagcgcttatggagtttaaagagtgcgtct

SEQ ID NO: 4823 - DNA, 1694 bp, Fagopyrum esculentum
cctttctggaggcgtatgagtcgtttgcctttttgcgccggaacacaacataggcgcccgtacaaaccaccatttttaacgatctcctccttctcatttcccagcttccaacatatataaacctccctctctctcacaactaacttgattttcattttcacattcttgttcactccctagatttccattggcaacctttgcagtttttcctcgctgttttaccgctttcccggcaattacggccgccgtgaggtgctagggatccggatattcttcgatcgtcgacgatttgtagtcgaagtgacgatggcgtctgaggatgtgaagacgagcgaatccgcggtttctacgattgtgaatttggctgaggaggcgaagactgctaccgaaagcgttaagcctccgagtatcgcgctacttagtgtttgcaagtctctcgccgctggtggtattgccggtggagtgtctcgaactgcagttgccccacttgaacgattgaaaatcttgcttcaggttcaaaatccccatagcataaaatacaatgggacaattcagggtctgaaatatatttggaggactgaaggcttaagaggtttgttcaaaggcaatggtactaactgtgctcgtattgtaccaaattcagcggtcaagttcttcagctacgagcaggcatcacatggaattctatggctttatcggcagcaaacaggaaatgaaaatgctgagctcacccctgtactccgtcttggagccggagcatgtgctggaattatagccatgtcagcaacctaccccatggacatggttcgaggtcgtttaactgtccagacagagaattcccctcgtcagtacacaggtatagccaatgccctcagaaccgtattccgagaagaaggtgctcgggctttatacaggggttggcttccttccgttataggtgtggtaccctatgttggtctgaattttgctgtatacgagtctctaaaggattggttggtaaaggacaaaccttttgggcttgtgaccggtaatgagttgagtgtgacaacaaggcttgcctgtggagctgcagcagggaccataggccagactatcgcgtatccattggatgttgttcgtcgtaggatgcaaatggttggttggaaagacgcttctgcagttatcattggtgatgggagaacaaaagttcctctggaatatacaggaatggtcgatgctttcaggaaacagttcgttatgagggatttggtgctttgtacaagggtttggtccctaattcagtcaaggtcgttccatctatcgctattgcattcgtgacatacgaggttgtcaaggacgtacttggagttgagatgaggatatcagactaatggaaatcaatgccgtcatcttcaacggggaatgagccaagtgtttttaggaaaataattatttttgcatctgcttattgtaagtttattcaaattcccttattaggtgctgaggttagcacagataaagttatgttaagcggtaccttaaacgatagtgtttggcctggttgctcggtgtaataagcctcctgggacatatatgacgatatagctgcataacttgcattgctatagctcttgtaggttggtagattgtgttctttcgagctccattcctcaacgttatgtttcctattactcttactattgatttcctcccca

SEQ ID NO: 4824 - DNA, 1348 bp, Cichorium intybus
tcaatggcgtcggacgatgtggtagggaaaaccagcgctacgatcgctaatctcgccgaagaagtcaaagattgctagtgaaggtgtcaaggctcctagccgccacgctttgctcagcatctgcaaatctcttgtcgccggcggcgtcgctggtggagtatcaagaactgctgttgctcctctagaacgattgaaaatcctgctccaggttcaaaatcctcatgcgataaaatataacggtacaatccagggattgaaatatatatggagaacagagggatttcgtggactatttaaaggaaatggcactaattgtgctcgcattgttccaaattctgctgtcgagtcctttagttatgaggaggcgtcaaagggaattttgtggctgtaccgccagcaacctggaaatgaggatgctgaactctcccctctcttacgtcttggagctggcgcgtgtgctggaataattgccatgtcagctacctaccccatggacttggttcgtggtcgccttactgtccagacggataaatctccaagtcagtatcgaggaatcgcacatgctcttagaacagtactacgtgaagaaggcgcgcgtgcattatacaaaggctggcttccttccgtcatcggtgtcgtcccatacgtgggtcttaattttgcggtgtatgaatcgttaaaagactggttggtaaagtcaagaccattcgggttagttgaggacacggaattaagcgtgaccacaaagcttgcatgtggggccgcagctgggacggttggtcaaacggttgcttacccacttgacgtgatccgtagaagaatgcaaatggttggttggaaagatgcagcttcagttgtaaccgcagatggcaagtcatcactcgagtacaccggaatggtcgatgcgtttagaaaaaccgttcgttatgaaggcttcggcgccttgaacaagggtctcgttcctaactcggtcaaggtggttccgtcgatagcgattgcgtttgtgtcgtacgaggttgttaaggatctattggagtagagatgaggatatcagactgagaaaaagaatatgttagcaataataatgttggaaatttggtgttatttttgcgagcagaaggggtaggatttttgttctctttttgctgttgttattcggtgaagagatgtagaagttgttagtgttgatacagtcgaccactgtgagtacccaatctgctgtggtttttcggtgttgtcattcataagtcataactatacaccaacatcgcccaataaggatatttgctacgcgagttgtttgattattagtattattattatgattcatggattttattttaaaaaa

SEQ ID NO: 4825 - DNA, 1448 bp, Flaveria ramosissima
ggagaactcacgacggcgattgttcctgaattcgtttagggttccgtcgtagctccgcttcattcggttgtgtgattttgtcgttgatatgacatcggaggatgtggtagcgaaaacaactgtcacgatcgctaatatcgctgaagaagcaaagatcgcgagtgaaggtgtgaaggctccgagtcgtcagactttaattggagtctgtaaatcgcttgttgccggaggtgttgccggtggagtatcacgtactgctgttgctccactggaaagattgaaaattttgctccaggttcaaaatccacatgcaatcaaatacaatgggactattcagggactaaaatatatatggagaacagagggtttgcgaggaatgtttaaaggaaatggcaccaattgtgcacgaattgtcccaaactctgctgtcaaattctttagctatgaacaggcatccaaaggaatcttgtggctgtgtcgacaacaacctggaaatgaggatgcctgaccttaccctctttacgccttggagctggtgcttgtgctggaataattgccatgtcagcaacctatccaatggacttggttcgaggtcgcattactgtccagactgaaaaatcttctactcaatatagaggaatggcacatgctcttacaacagtactccgtgaagaaggcccacgtgcactatacaaaggatggcttccttctgttattggtgttataccatatgtggggcttaatttcgcggtatatgaatccttaaaagactatttggtgaaatcaagaccatttggaatggttgaagacaaggagttgagtgtgacaactaagcttgcatgtggggccgttgctggaaccgcaggtcaaacggttgcatatccacttgatgtcatacgcagaagaatgcaaatggttggctggaaacatgctgcctcagttgttactggtgaaggaaagtcaacgcttgaatacactggaatgattgatgcattcaggaagaccgttcgttatgagggttttggcgctttgtacaagggcttggtccctaactcggtcaaggtggttccatcaatagctattgcatttgtgacgtacgaggtggttaaggatgtactcaaggtagagatgaggatatcagagtaaacactgcattcttatcatatatttttattaagcattcacgttagttttcttgcgtgtgcaaaagggtaaaaccgtcaagtaaaaagttttgttctttaatctcttttacgttaagagatctagaactagtcgtgttgatatggtcgagtgggcccctgtgtgcaccccaagcttggttttctgttagctatagtctgttttttgaaggtgtttcttgttctgttgttcgtatgtatgaactctaataaggaaatgctcacagagttgagtcgcaaccacacccggttgggagatgatactatctg

SEQ ID NO: 4826 - DNA, 1780 bp, Lotus japonicus
aaatatgaagaaatccaaatatgaaggggaaaggaccgaaaattgttgcctctgaccctgagcctgagtgagtccacgtaagcaaacaatatatacacactgacacacacgaatgaatagcgccattctaaccaaccaacgccgtcacttgcactctttcatcagctaccacacactcacactcacagccgccggcaagattatcgtatctctgcgatgatcgctgccggaaacctaagatcttaatctccgacattgatagctcctcatctccacttccattttctcatttcgtacgaggttagggtttgttttgtatggcttcagattcgaagatggtcaatctggccgaggaagcgaaagcgaagctcgctagtgaaggtgtcaaggctcccagctatgctcttatgagcatctgcaaatccctcgtcgccggtggagtcgccggaggagtatcacgaacggcagttgctccactggaacgcatgaaaattttgctacaggtccagaatcctcacaacatcaaatacaatggaacaattcaaggactcaaatatatatggaggactgaaggtttccgtgggctgttcaaaggaaatggtactaattgtgctcgaatcgtccctaattctgcagtgaagttcttcagttatgagcaagcttccaaaggtatactacatctgtatcggcagaaaactggaaaggaggatgctgagcttactcctcttttacgtcttggggctggagcatgtgctggaataattgccatgtctgcaacttatccaatggacatggtccgaggcaggataactgtacagacagagaagtccccttaccaatacagaggaatgttccatgctctgtcaactgtgcttagagaagaaggtccacgtgctttatataaaggctggcttccttcagtcattggagttgttccttatgtgggtcttaactttgctgtgtatgaatctttgaaagattggttaataaaatcaaaaccatttggtttagctcaagattctgagttgggtgtgacaactcgcctggcatgtggtgctgcagctggaaccattggacaaaccgttgcttatcctcttgatgttattcgtcgaagaatgcagatggtgggttggaatcatgctgcttctgttgtagctggtgatggaagaggcaagacaccacttgaatacacgggcatggttgatgcatttaggaaaactgttcggtatgagggatttggcgcattatacaagggtctggtgcccaactctgtaaaggtggtcccatccatagcactggcgtttgtaacatatgagatggtgaaggacattttaggagtggagatcagaatatcagactgaaggttatatccacttcagttctgattgcctgttgttatttttttccccttgtaggcaagggggtggagaaatgataaatcttgttttttatttctccaagaattagttaggaagcacttgaggtagtgcctacaaattagttctcttgtttcctgtttgtatttccttgtgaacacactgtagctttcagcttcttttttcccctatcttttatagcaataagtgttatggagaaacaatgcaagcatatctgcttggctttcttcaccagtgaagaaatcattttgattattgaaaataatcactgactgattattggaatattcattgactaattattgagtgcccctctctaccctcatctaaaagggtatttattaccgcatttgcaatttaattgatgaggtaattaaaatgtg

SEQ ID NO: 4827 - DNA, 1555 bp, Solanum tuberosum
cctgctgcattttcatcgatctctgttcatttacgcccgccgccgcacaaaccaccgtgattcagtatactgtcaccgggaaatttacattcccccttagctcgtccatattccgatcggtcctctggttttgaactgagtatacattgacagagtgttcaaaatctaaggattcgtagaaggttgagctataaactaggcgatctcgatcttatatggcttctgaggatgtgaaggcgagcgaatcagcggtggagaaaattgtgagtctcgcggaagaggcgaagttagctagacaagaaatcaggcctacaagccatgctgttatcagtatctgcaagtcactcgtagctggaggtgtcgccggaggcgtgtcacgaactgctgtggccccactggaacggctaaagatattgctccaggttcaaaattcacatagcataaaatacaatgggaccatttcaggcttaaaatatatctggagaactgaggggttcaaaggactgttcaagggcaatggcaccaattgtgcacgtatcgtcccaaactcagcagtcaagttcttcagctatgagcaagcttccaagggtatactatatctttaccagcaacaaactggcaatgaggatgctcagctcactcccttactacgtcttggagctggagcttgtgctggcataattgccatgtctgcaacttacccaatggacatggtgcggggaagaattactgtgcagacagagaagtctccttatcaatacagaggaatggtccatgccctatccaccatactccgtgaggaaggtccacgtgctttgtataaaggatggcttccttctgtcataggagttattccatatgtgggacttaactttgcagtttacgaatctctaaaagaatggttggtcaaaacaaaaccacttggtctagttgatgattctactgaacctggtgttgttacaaggctggcatgtggggctgtggcagggactttggggcaaactgttgcttaccctcttgacgttgtacgcagaaggatgcagatggtgggttggaaagatgctgcatccatcgttactggtgatgggaggagcaaggcctcccttgaatattctggtatgattgatactttcaggaaaactgtgaggtatgagggcttcagcgccttgtacaaaggtttggtgcctaattcagtgaaggtcgtcccttcaatagctattgcttttgtgacatatgagcaagtgaaggacctattgggagttgagatcaggatatctgactgatgaagacaagctccaatcgtttttccctgcatatgataattttgcagacaaggatagatagagtgataataacatggcgggttacaccgtctaaacagagaatttacgcttttgttctagcttgtgacgacaaatttaggattttctagtgtgcttataatttccttatgtatctgtttattgcttattcaattgtcaataagcaaattttacaagaatagtgtaatgatgattgctggttgcttttgtaatcctggtctccgttgcacttg

SEQ ID NO: 4828 - DNA, 1519 bp, Arachis hypogaea
agagagagagagagagaatcgatcccttctgtgtatggcttcggaagatgtgaagagcggtgaatctgcagtcacaaagatcgttactctggctgaggaagctaagctcgctagtcgtgaaggcgtcgtcaccgccgccgccgctccttcctacgccttcaccaccatctgcaagtcccttatcgccggtggagtcgccggaggagtatcacgaacagcagttgccccactggaacggttgaagattttgctacaggtccagaatcctcataacattaaatacaatggaacagtccaaggcctgaaatatatatggagaactgaaggttttcgtggactgttcaaagggaatggtactaattgtgctcggattgtccctaactctgcagtgaagttcttcagttatgagcaagcttctaagggtatactctatatgtataggcagcaaactggaaatgaggatgctcagctgactcctgttttacgacttggagctggagcatgtgctggaataattgccatgtctgcaacttatccaatggatatggttcgaggcaggataactgtacagactgagaaatccccttatcagtatagaggaatgttccatgctctgtctaccgtacttagggaagaaggtccacgtgctttatacaagggttggctaccttcagtaattggagttattccttatgtgggtctcaactttgctgtctacgagtctttaaaagattggttaatcaaatccaaaccgtttggtctagctcaagattctgagttgagtgtgacaacacgtctggcttgtggtgctgttgccggaacttttggacaaactgttgcttatcctctcgacgtcattcgtcgaagaatgcagatggtgggctggaaccatgctgcttctgttgtagctggggacggaagaggcaaggtcccgctcgaatacactggaatgatagatgcatttaggaaaaccgttcggtacgagggatttggtgcattatacaagggtctggtgccaaattctgtaaaggtggtgccgtccatagcaatcgcatttgtacgtacgaggtggtgaaggacattctaggagtcgagttccgaatatcagactgaagtttgataacagtataatatccatttaaccgtttggtttttcgtttttgtaggcaaggggatgcagagatgatagatcatagttgttatttttctttctttttagaaacttttagatttagtgtccataaatttattcccttgttttttttccttgtgaacattctgtagctttcacagctgcttattcatcttctatgtcaataagttgtggaaaaaaacaatgcaactacatagctaccttgctctttgcacgagtcaagaaagcgtttttcctcctagtggaatttgcagtgaaagattattgagattttagatccctattcaaataggtttggaactaatgatgttatatcatttttttatgtgcttgtttctaagaaacctggttaatgcaatgtttgtt

SEQ ID NO: 4829 - DNA, 1657 bp, Sequoia sempervirens
aaagtgaagtagggcgatattcaatggcagagagcaaagaggcggcggtggcaacgtttgttaacctggcggaggaggccaagttagcgagcgaaggggtgaaggcccccagtcacgctattctcactgtctgtaaatctctcgtggcgggcggcgtggcaggaggggtgtcccgctctgctgtggctccattagagagactgaaaatcctgcttcaggttcaaaaccctcttaaccgcaagtacaatggtacagttcaaggaatacgttatatttggaatacagaaggaatccgtggtctttttaaaggaaatggtacaaattgtgccaggatagtaccaaattctgctgtaaaattttacagctacgagcaggcttccagtgcaatcctctggttatatagacagcaaacagggaatgaagaagcacagcttacacccattctacgtctaggagcaggagcttgtgctggaataattgcaatgtctgcaacatacccaatggacatggttcggggaaggttaactgttcagacagaaaaatcaccttatcagtaccgaggaatgttccatgcattgtcaactgtcttccgtgaagaaggtccgagagcattgtataaaggctggttgccatctgtaattggagtgattccatatgttgggcttaactttgctgtttatgagtctttgaaagaatggttgctcaaatcccgaccctttggttcagatcaaggctcagagctgagtgttgtaacaaaattggcctgtggagctgctgcaggaactattgggcaaactgtagcttatcctcttgatgtgataaggaggagaatgcaaatggtcgggtggaaagatgctgcttctattgtaacaggagatggtagatccaaagctcctcttcaatattcgggtatgattgatgccttcaggcaaactgtgaggaatgaaggttttggtgcgttatacagaggtttggtcccaaattcagtgaaggtagtgccatctatagcaattgcctttgtgtcatatgaagttgtgaaggatctccttggtgtggagatgagaatttccgattaaagaaattcaaatgttttatttggtagcgagtggagaaagtccttcaatttaattagaaggaattaatcctcttcaggtttttctaatattcaacatggtgtagagaagatattcttcttgatggctggatctaaatcttcaaaggcaggtctgaccactgttgaagacaaataaaatttgtggcggagaaattggactttgcacattccagcggttttgttaagccgaggaaacaaatatttagttaatgtcaaggttatttgccaattatattgccttttaggcagtatgtgtaaggagggcgagatttgctcctttgcttaaatttagatttagaaggtttcaattgatcataatgcaactttagtttgggccttgagcctattctagagtcattccatctactcctatgtcactgatgttttacatggtggtattctctctctatctctagagttattccatctactcctgtctcactgatgttttacatggtggttctctctctctctctctgcatattagtaaatcattttttgtagctctctattcatagtattcatatctttatcagaagcaat

SEQ ID NO: 4830 - DNA, 2010 bp, Cajanus cajan
aggtccgtctattactgcatcttcttgtcttcccactctctctctctctctgcttattgaaacttgaaaaattagagaaggttgtcacttttgcaactcaaaagcttcaaacccaaacaagtacttagctcatagcagagaggaacaccttacttagtctgcattatgtaaagattgcacttttgctccaactaggacaatccatttgtcaaatatggattacgaaaggatccaaaagcctcagggtggtgggggattctcaccgggaaaattaaggagcatgctgctgggtgtggagaagaaaaggaaagaagaggaagagcttgattctactttcaccacgagatctcagaattcagacatggatgaatctggtggtagcagttctgatcattgtaaagatgtagatgttgtgagtgtccttcctgaatattcaacttctgctatagttcgcaccagtagcatagaggcagttgctggtgatcgtgttgtgaaggctaatgcagcagtaagttcaaggactagaatcttagaagacccttcttcagattatgatagtgggcatgatactacgagcatgtcatcatcagtgtttgagtttcaaaaggctgagcgtgctccacagagagtgcctgtagggccattctcaaaaccagcgccatcaaaatgggatgatgctcagaagtggatagcaagtccaacatccaacaggccgaagacagcacagacacaggggcaaggtgggcatgtaggaccccgtaaggttggtagtcttggttatggtagccggcaaccttcaatgaaggttgttgtagaagttccagatcaaagggaaattgctttagatgagccagataccaagcagattgatacaaatcaaactaagatggaaagtggaggacagaaatttgtgagttgggaggctgatccctatgcaattgaaagttcttgtgttagtctcagccagcataattcatctctcgccattcagaatgcaacaacatttgttcctcccccttcaacagctcggtctgtatcaatgagagacatgggtacggaaatgacccctattgctagccaggagccatcaagaacaggtacaccagtgagggcaacgacaccaatgcgcagccctaattcttcccggccttcgactcctcccagagcttcccctgcatctactttaacggattcacttagtgacaatctgaatctcaccaaaaatgaattgtctgaaaaggagctacaaatgaaaaccaggcgagaaataatggtccttgggacacaactaggtaaaatgaacattgctgcatgggctagcaaagaagaggaggataaggatgcatccacttccttgaaaacaaaagcagaaccacctaagagtgtcattgaagcacgtgcagtagcatgggaggaagctgagaaggccaagtatatggccaggtttaggcgcgaggagatgaaaatacaagcatgggaaaatcatcaaaaagcaaaaacagaagccaagatgagaaaaattgaggtagaagttgaaagaatacggagtaaggcacatgataagctaatgaataaattagcagctgcaaggcacaaggctgaggaaaagcgagcagcagcagaagccaatagaaatcaccaagctgcaaaaactgaagagcaagcagagtatatacgaagaactggtcatgtcccttcctcatatttatcattttcttgctgcaattggtgctcctaaagaaggccaatccttgtcaatgttttttttttgttctataggtatgcaatgccttttgctgcttacacccaagcatgttaaatatgccagttgcatttccctcgtggtgtaaaatgttacattgttttgcagaataattgcaatttgaaagtgctatgctatttttcatgtttttattttctgaacttttttttgggatcgataattattctctgaatttgggttttaggtcaatcgactccaaaagttagctcatggggcgagggttgtac

SEQ ID NO: 4831 - DNA, 1984 bp, Vigna unguiculata
aacactgtcacttttgcaactcaaaagcttcaaacccaaagaagtacctgcaagcttacggcactgatgaactttcactacattgtgtaaagattgcatttttgctctcaccaggacaccttttgctctcaccaggacaccccatttatccactatggtttacgaaaggatccaaaagcctcagggtggcgggggattttcaccgggaaaattgaggaacatgctactgggcgtggagaagaagaggaaagaagaagaagagctcgattctactttcaccacgagatctcagaattcggaaatggatgaatctggtggtagcagttctgatcattgtaaagatgtagatgttgtgagtgtccttcctgagtattcaacttctgctttagttcgcaccagtagcatagaggcagttggtggtgatgatcgttttgtgaaggctaatgcagcagtgagttcaaggaatagaatcttagaagacccttcttcagattatgatagtgggcatgaaaatatgagcatctcatcgtcagtgtttgaatttcaaaaggccgagcggtctacacagagagtgccagtgagaccattctcaaaaccagcaccatctaaatgggatgatgctcagaagtggatagctagtccaacatcaaaccggccgaagacagtgcaggctcaaggacaaggtgggcatgtaggtccacgtaaggtcggtagtcttggttatggaagccggcaaccttcaatgaaggttgttgttgaagttccagatcaaagagaaattgctttagatgaaccggataccaagcaaattgatacaaatcaaactaagatggaaagtggaggacagaaatttgtgagttgggaggctgatccctatgcaattgcaagttcttgtgtaagccttagccagcacaattcgtctcttgccatccagaatgcaacaacatttgttcctcccccttcaacagctcggtctgtatcgatgagagatatgggaaccgaaatgacccctattgctagccaggagccttcaagaacaggtacccctgtgagggcaacaacaccaatgcgcagtcctaactcttctcggccttctactcccccaagatcctcccctgtatccactttaactgatcttcatagtgacaatctgaatctcagcaagaatgaattgtccgaaaaggagctacaaatgaagaccaggcgtgaaataatggtccttgggacacaacttggtaaaatgaatattgctgcttgggctagcaaagaagaggaagataaggatgcatctacttccctcaaaactaaagcagaacagcctaagagtgttgttgaagcacgtgcagcagcatgggaggaagctgagaaggccaagtatatggccaggtttaggcgtgaggagatgaaaattcaagcatgggaaaatcatcagaaagcaaaaacagaagccaagatgaaaaaaattgaggtagaagttgagagaatacgtagtaaggcacatgataagctaatgaataaattagctgctgcaaggcataaagctgaggaaaaacgagcagcagcagaagccaatagaaatcatcaagctgcaaaaactgaagagcaagcagattatatacgaagaactggtcatgtcccttcctcgtatttgtcattttcttgctgcaattggtgctcttgaaaaaaaagtcaatccttttcaatatttaattttttgttctataggcttgcaatgccttttgctgcttacacccaatcatgttaaatatgcctattgcattttctccctggtgtaaaacgttaccttcttctgcagaataattgcaatttggaagtgctatgctatttgtccagttatattttctgaatttcttttgggtttcataatttggaagtgctattctatttgtttatatacatgttatgatattaacattgtgtgaagcatcttctaattcaaaatgatcatcatgattttgatagt

SEQ ID NO: 4832 - DNA, 1985 bp, Vigna unguiculata
  misc_feature (401)..(401): n is a, c, g, or t
aacactgtcacttttgcaactcaaaagcttcaaacccaaagaagtacctgcaagcttacggcactgatgaactttcactacattgtgtaaagattgcatttttgctctcaccaggacaccttttgctctcaccaggacaccccatttatccactatggtttacgaaaggatccaaaagcctcagggtggcgggggattttcaccgggaaaattgaggaacatgctactgggcgtggagaagaagaggaaagaagaagaagagctcgattctactttcaccacgagatctcagaattcggaaatggatgaatctggtggtagcagttctgatcattgtaaagatgtagatgttgtgagtgtccttcctgagtattcaacttctgctttagttcgcaccagtngcatagaggcagttggtggtgatgatcgttttgtgaaggctaatgcagcagtgagttcaaggaatagaatcttagaagacccttcttcagattatgatagtgggcatgaaaatatgagcatctcatcgtcagtgtttgaatttcaaaaggccgagcggtctacacagagagtgccagtgagaccattctcaaaaccagcaccatctaaatgggatgatgctcagaagtggatagctagtccaacatcaaaccggccgaagacagtgcaggctcaaggacaaggtgggcatgtaggtccacgtaaggtcggtagtcttggttatggaagccggcaaccttcaatgaaggttgttgttgaagttccagatcaaagagaaattgctttagatgaaccggataccaagcaaattgatacaaatcaaactaagatggaaagtggaggacagaaatttgtgagttgggaggctgatccctatgcaattgcaagttcttgtgtaagccttagccagcacaattcgtctcttgccatccagaatgcaacaacatttgttcctcccccttcaacagctcggtctgtatcgatgagagatatgggaaccgaaatgacccctattgctagccaggagccttcaagaacaggtacccctgtgagggcaacaacaccaatgcgcagtcctaactcttctcggccttctactcccccaagatcctcccctgtatccactttaactgatcttcatagtgacaatctgaatctcagcaagaatgaattgtccgaaaaggagctacaaatgaagaccaggcgtgaaataatggtccttgggacacaacttggtaaaatgaatattgctgcttgggctagcaaagaagaggaagataaggatgcatctacttccctcaaaactaaagcagaacagcctaagagtgttgttgaagcacgtgcagcagcatgggaggaagctgagaaggccaagtatatggccaggtttaggcgtgaggagatgaaaattcaagcatgggaaaatcatcagaaagcaaaaacagaagccaagatgaaaaaaattgaggtagaagttgagagaatacgtagtaaggcacatgataagctaatgaataaattagctgctgcaaggcataaagctgaggaaaaacgagcagcagcagaagccaatagaaatcatcaagctgcaaaaactgaagagcaagcagattatatacgaagaactggtcatgtcccttcctcgtatttgtcattttcttgctgcaattggtgctcttgaaaaaaaagtcaatccttttcaatatttaattttttgttctataggcttgcaatgccttttgctgcttacacccaatcatgttaaatatgcctattgcattttctccctggtgtaaaacgttaccttcttctgcagaataattgcaatttggaagtgctatgctatttgtccagttatattttctgaatttcttttgggtttcataatttggaagtgctattctatttgtttatatacatgttatgatattaacattgtgtgaagcatcttctaattcaaaatgatcatcatgattttgatagta

SEQ ID NO: 4833 - DNA, 1685 bp, Lotus japonicus
ggacaacccatttgtcaaatatggattatgaaaggattcaaaagcctcagggtaatgggggattttcacctggaaagttgaggagcatgctactgggtgtggagaagaagaggaaagaagaggaggaggttgattccactttcacccctggatctcaaaatccagacatggatgaatctggtggtagcagttctgatcattgtaaagatgtagatgttgtgagtgtccttcctgattattcaacttctacagctcgcacttggagcatagagacagccggtggtgatcgcattgggaaggttaatgcaggaataacttctaagaatagaatccttgaagacccttctttagattatgatagtgggcaggacaatatgagcatgtcctcatcggtgtttgaatttcaaaaggctgagcgtgctcccccaagagtgcccgcggggccattctcaaagccagcgccatctaaatgggatgatgcccagaaatggatagcgagtccaacatcaaacaggccaaagacagcacagagccaggggcaaggcgggcatgggggaccgcgtaaagttggtagtcttggttatggaagccggcagtcttccatgaaggttgttgttgaagttccagatcaaagagaaattgctttagatgagccggatacaaagcaaatggatacagatcaaactaagatggacagtgaaggacataagtttgcgagttatgaggttgacccctatgcagttgcaaattcttatgtcagtctcagccagcacaattcatccgttgccatccagagtgcaacgacatttgttcctcccccatcaactgctcggtctgtatcaatgagagatatgggcacagaaatgacacctattgccagccaggagccatcaagaacaggtacaccggtgcggtcaaccacgccaatgcgcagccctaattcttctcagccttctactcccacaagaacttcccctatgtcaactttaactgatccacatatcgacaacctgaatctcaacaagagtgaattgtccgaaaaggagctacaaatgaaaaccaggcgagaaatcatggtcctcgggacacaactaggtaaaatgaatattgctgcctgggctagtaaagaagaagaggataaggatgcatccacttcactgaaagcaaaaacagctgatcaaccagctaagagtgtcattgaagcacgtgcagcagcatgggaggaggctgagaaagccaagtatatggccagatttaggcgtgaggagatgaaaattcaggcatgggaaaatcatcagaaagcaaaaacagaagccaagatgagaaaaattgaggtagaggttgaaagaatacggagcaagtcacatgataagctgatgaataaattagcttctgcaaggcacaaggctgaggaaaagcgagcagcagcagaagccaatagaaatcatcaagctgcaaaaactgaagagcaagcagaatacatacgaagaactggtcatgttccttcctcatatttaacattctcttggtgcagttggtgctcttaaggaaatgtggttcttgtcaacgtttcatttttctatagctatgcatgttgaatgaatatgcatgttgtattttccctcggggtgtaaaaggatacgttgttctgcagaataataatttagttggaacacttatgtgta

SEQ ID NO: 4834 - DNA, 2010 bp, Glycine max
tcacttttgcaactcaaaagcttcaaacccaaagcaaagtagtacttagcttatagccagtgaggaacactaactgcattatgtaaggattgcatttttgctcccacaaggacaacctcatttgtcaaatatggattacgaaaggatccaaaagcctcagggtggtgggggattttcaccgggaaaattgaggagcatgctactgggtgtggagaagaagaggaaagaagaggaagagcttgattctactttcaccacgagatctcagaattcagacatggatgaatctggtggtagtagttccgatcattgcaaagatgtagatgttgtgagtgtccttcctgaatattcaacttctgctatagttcgcactagtagcgtagaggcagttggtggtgatcgttttgtgaaggctaatgcaggagtgaattcaaggagtagaatcttggaagacccttcttcagattatgatagtgggcacgataatatgagcatgtcctcgtcaatgtttgaatttcaaaaggccgagcgtgccccacagagggttcccgtggggccattctcaaaaccagcaccatctaaatgggatgatgcacagaagtggatagcaagtccaacttcaaacaggccaaagacagtgcagagccaggggcaaggtgggcaaagtgggcatgtaggaccgcgaaaggttggtagtcttggttatggaagccggcaatcttcaatgaaggttgttgttgaagttccagatcaaaaagaaattgctttagatgaaccagataccaagcaaattgatacagatcagactaagatggaaactggaggacagaaatttgtgagttgggaggctgatccctatgcaattgcaagttcttgtgggtctttatgtttatttggggctggttattcaacctgggcgtaccaccaattgtgtggatcaactagcgtggggttgttccaacttaaaccagatgtctctggttcaagtcctgggtatgcaaatgcgttaaatacttggagggagagttttgccgcatatagtagtcctatctggctcaaacagcctccaatggaggatacctgtgatctagaccaaaaaaacctgggccttaagttacggtttacttgtctcagccagcacaattcatctcttgcaatccaaaatgaaacaacatttgttcctcccccttcaacagctcggtctgtatcaatgagagatatgggtaccgaaatgacccctattgctagccaggagccatcaagaacaggtaccccagtgagggcaacaacaccgatgcgcagccctaattcttcccggccttctactccccccagagcctcccctgcatctactttaactgatctgcatagtgacaatctgaatctcaacatgaatgagttgtccgaaaaggagctacaaatgaaaaccaggcgagaaataatggttctcgggacacaactaggtaaaatgagcattgctgcctgggctagcaaagaagaggaggataaggatgcatccacttccttgaaaacaaaaacagaaccacctaaaagtgtcgttgtagcacgtgcagcggcatgggaggaggctgagaaggccaagtatatggccaggtttaggcgtgaggagatgaaaattcaagcatgggaaaatcatcagaaagcaaaaacagaagccaagatgaaaaaaattgaggtagaagttgaaagaatacgaggtaaggcgcatgataagctaatgaacaaattagcagctgcaaggcataaagccgaggaaaagcgagcagcagcagaagccaatagaaatcatcaagctgcaaaaactgaagagcaagcagagtatatacgaagaactggtcatgtcccttcctcatatttatcattttcttgctgcaattggtatgcaatgccttttgctgcttacacccaagcatgttaaatatgtctgttgcatttccctcgaggtgtaaaatgttacattgttctgctgaataattgcaaattgaaagt

SEQ ID NO: 4835 - DNA, 2788 bp, Glycine max
ctcctccaacaaattaagccctattattaatatttttcttcttctcctgaaaatgacggggaagaagaatgtgaaggcggcgacaaccacgacaccggaagaggaagaccagaggaagcaaacgacgacgtcgtcttccccctcgtcgtcttcgcgctcctcctcctcgtcgtcgtcttcggatgagagagagtacgaggtgcaggacctgcgtgaccggttgaaatcgtcgcgagggagcaggttcgatctcatagagaaccagttgggactcaactcgacttggagcaagttcagtcgccaagcgcttctccatggaatccgaggcttctccgtggacttcgttattcatcctgataacaggtggtatcgggcatggacaaaattcatattgctatgggcagtgtattcatccttcttcaccccaatggagtttgggtttttccgtggcctgcctgagaatctctttattctggacatcattggacaaatagcttttcttgtagatattgtcttgcaattttttgttgcttatagagatagtcagacctatcgtacggtctacaagagaacccctattgctctgcggtatctgaaatctaacttcatatttgatcttcttggatgtatgccctgggacatcatctacaaggcttgtggaagaaaagaggaagtgagataccttttgtggatcagactatatagggttcggaaagtcacagattttttccacaagttggagaaggacatacgtgtcaattacattattacccggattgtgaaactgatagtagttgaactctattgcacccatacagcagcctgcattttctactatttggctaccacactacctgaatcccaagaagggtacacatggataggaagtttaaaactaggtgactttagttattcacatttcagagaaattgatctttggaagcgctatacaacatctctgtacttcgctattgttacaatggctacagttggctatggagatatacatgcagtaaatatgagggagatggtattcataatggtgtatgtttcatttgatatgattcttggtgcctatttgattggtaacatgacagctttgatagtcaagggatcaaagactgaaaagtttagggacaagatgacagaccttatgaaatatatgaacagaaataggcttggaagggatatccgtgaacaaattaagggccatgtgcggttacagtatgagagtagctacactgaggcttctgtcattcaggatatccctatatctattcgagctaagatatcccaaacattatatttgccgtacattgaaaaggtttctctttttaagggatgctcttctgaattcatccgtcagattgttattaggctccatgaggagttctttcttccaggggaagttataatggaacaaggaaatgttgtggatcaactatattttgtctgccatggagtactggaggaagtaggcactgctgaagatgggactgaagaaactgtttcacttctgcagcctaacagttcattcggagaaatatctattctttgcaacattcctcaaccatatactgtccgtgtttgtgaactgagtagactcctgcgacttgataaacaatcatttacaaatatcctagacatatacttttatgatggaaggaaagtattaaacaaccttctagagggaaaagaatcttttcgagataagcagttggagtcagacatcacatttcatattggaaagcaagaagctgagcttgctttgaaggtcaataatgcagctttcaatggggatctgtatcagctaaaaggtttaattcgcgctggagctgatcccaacaagacagattatgatggaaggtcacctttgcatcttgcagcatctagaggatatgaagatatcacacttttccttattcaagaacgtgtagatgtcaatattaaagataacttcgggaacacacccttacttgaagcagttaagaatggacatgatcgggttgcttctttacttgttagagaaggggcctctatgaagattgaaaatgctggtagttttttgtgtactgcagttgcaaggggagattcagattatcttaaaagacttttatccaatggcatggatcctaacttaaaagattatgattaccgaagtcctcttcacattgctgcagctgaaggtttatatttcatggcaaagttgctattagaaggaggagctagtgtttttaccaaagacagatggggaaatacgccgcttgatgaagctcggatgtgtggaaataagaacctgatcaagcttctggaagatgcaaaatctgctcaactgtcagaattcccatcccaagaatatacagacaaaatgcatccaaagaagtgcacagtgttcccttaccacccgtgggatccgaaagataatagaagacatggaattgtattatggattccacactccatacaagagctaatcaaatcagcggcagaacaaatagaattttctggcgatgcttgtattttatcagaagatgctggtaaagttactgatgtggacatgatcaaggatggtcagaagctgtatttagtccatgaaacacattaggcctccatattatggctcttcacaaccatatagtaaagtgccttgtaacgtgttgtgctttctagaaattagcatgttatttgatcttattaaccgcacaaaaagtgtcatatcctgtcaaatacagacgagtaattaagatcaaataatgtgcttatgatgtgcatgtgctgtagttgcacc

SEQ ID NO: 4836 - DNA, 3237 bp, Phaseolus coccineus
atgaggctgaaggcaaaggagattgaagaaccttacctctctcactcttaatttggattcttaagtcttttctttttcataaccgtcttttttgttatttgcacgccatagccgtaacataaaccctttctttctccctgtgacgaatctacatccatctctataatctcccgtgacctattaacttccatttccagcacttgtggccctcctcaaccgcgtcaccttcatcgcacgcatatatacatacacacaagacgacgtcgtagatccgttcggaaatggaaaccgttcgtcaaaagccaaattgacctctcttcattataataataaataataataacagtttcttgggagtttcttttctcttttttttcttctgaaaatgacggagagcaagaatgtgaaggcggcggcgacggaagagagagaggaagggaagcagacgacgtcgtcttcgactccactttctcattcgcggtcgttgtctttgtcgtcgtcgtcgtcttccgatgagagagagtacgaggtgcaggacctgcgggaccggttgaaatcttcgagagggagccgattcaatctgatacagaatgagttgggactcaactcaagatggagcaagttcagtcgcgaagctcttctccatggaatccgaggcttctccaaggacttcgtcattcatcctgataacaggtggtaccgggcatggacaaaattcatattgctatgggcagtgtattcatccttcttcaccccaatggagtttggatttttccgtggcttgcctgagaatctctttattctggacatcattggacaaatagcttttctcgtcgatattttcttgcaattctttgttgcttacagagacagccagacctatcgtatgatctacaagcgaacacctatagctctgcggtatctaaaatctgacttcatgcttgatcttcttgggtgtatgccatgggacgtcatcttcaaggctagtggacgaaaagaggaggtgaggtaccttttgtggatcagattatacagggtgcggaaagtcacagattttttccacaagttggagaaggacatacgtgtcaattacattactacccggattgtgaaactgattgtggtcgaactctactgcacccatacagcagcctgcattttctactttttggctaccactctaccagactcacaagaagggtacacatggataggaagtttaaaattgggtgactatagttattcacatttcagagaaattgatctttggaagcgctacacaacatctctgtatttcgctattgttactatggcaacagtcggctatggagacatacatgcagttaatttgagggagatgatattcgtaatggtatacgtttcatttgatatgattcttggtgcctatttgatcggtaacatgacagctttgatagtcaaggggtcaaaaactgagaagtttagagataagatgacagaccttctgaaatatatgaacagaaataagcttggaagggatatccgtgaacaaattaaaggccatgtgcgattacagtatgagagtagctacactgaggctgctgtcattcaggatatccctatttctattcgagctaagatatcccaaacattatacttgccatacatagaaaatgtttctcttttcaagggatgctcttcagaattcatcaaccagattgttattaggatccatgaggagttctttcttcctggggaagttataatggatcaaggaaatgctgtagatcaactatattttgtctgtcatggagtgctggaagaagtgggcatagctgaagatgggtctgaagaaactgtttcacttctgcagcgtcacagttcatttggagaaatatcaattctttgcaacattcctcagccatatactgttcgcgtttctgaactgagtagactcctgcgacttgataaacaatcatttacaaatatcctagacgtatacttttatgatggaaggaaagtattaaacaaccttctagagggaaaagagtcttttcgaggtaagcagttgaagtcagacatcacatttcacattggaaaacaagaagctgagcttgctttgaaggtcaatagtgcagcttttcatggggatctgcatcagcttaaaggtttaattcgagctggagctgatcccaacaagacagattatgatggaagatcacctatacatcttgcagcatctagaggacacgaagatataacacttttccttattaaagaacgtgtagatatcaatattaaagataacttcgggaacacacccttacttgaagcagttaagaatggaaatgatcgggttgcttctttacttcttaaagaaggggcctccatgaagatcgaaaatgctggtagttttttgtgtacagcagttgcaaggggagattcagattatcttaaaagacttttatccaatggcatggatcctaacttaaaagattatgattaccgaagccctcttcacatagccgcagccgaaggtttacacttcatggcaaagttgctattagaagccggagctactgtttttaacaaagacagatggggaaatactccgcttgatgaagcccggatgtgtggaaataagaatctgatcaagttactggaagaagcaaaatctgctcaacttttagaattcccgtattcctcccaagaatgtacagataaaatgcacgcaaagaagtgcacagtcttccctttccacccgtgggatccggaagataatagaagacatggaattgtactatggattccgcactccatcgaagagctaatcaaatcagctgcagaacaaataaacatttctggcgattcttgtattttatcagaagatggtggtaaaattaatgacgtggacatgattaaggatggtcagaagctgtacttagtcaatgaaacacattaatgctctatataatggctcttttaaaccatataataaagttcctcgttatgtgttgtgctttctagacattagcacagtatttgatcttattaaccgcacaaaagagtgtcggatcctgtcaatacacagatgagtgatttagatcaaataatgtgctgatgatgtgcatgtgcttttgtggcaccattctaagcagcttgtgctgatgaagtgctcaatagttgttagtggggtggcaaacatcagagctcagctagaatttatcaaagatcagggcacatggatttcattgcact

SEQ ID NO: 4837 - DNA, 1297 bp, Vigna unguiculata
aaacaatgaaacaagaccaccaatcttatctgttgtgttctgctctacactccaaccctccttcccaccgataacatcttcggcattacacaatacacaatcatgcattccttaacatgcacaccactttcttcttcttcctcctctcatcacaccactctaaagcctaatctcaaccctctgctaggtgcagatgcaacttccaggccatgttctttacccttcaaaagaagaacctgttttactaccagagccatactctcttccaccagagaagatgtcttgaagcacttcaacgaacgtagagctctcaagattatctcaggcttgcagaatttcaataaagacaatgttgcatcggtggtcactgctgctgacaagggtggagcaactcatgtggatatagcatgtgaccctgagttggtaaagctagctattggcttaacttcttgtccggtttgtgtttcttctgtagatcctgcaacatttccagctgcagttgaagcaggagcactaatggttgagattggaaactatgattcattctatgagcagggaataattttcactccagaaaagattcttggtctgacaaaggagacaaggagaatacttccatccatagtcttgtctgtcactgttcctcacacactaagcctccctgatcaggtcaagcttgcagagtcattggaactagtaggtgtagatgttattcaaactgaaggaggaaaatgttctaatcctacaaaatctggtgttatgggtttgattgaaaaggcaacaccaactttagcagcagcatattccatatcacgagctgttaagatccctgtcatgtgttcatcagggctaagcgctgtgacagcacctatggctataacagctggggcagctggtgtgggtgtagggtctgcagttaatagactcaatgatgtggttgctatgattgccgaggtgagaagcattgctaattcattgcagacatcatttcagacatccaccacttatgaagtggaaactcagagacagtagtttgttttgcaagaaacaaatgaagggtttgtaggcagtgaataaaacatgcaaagaaaatttggatccttataagttccttttttctttgtcctttatatttcagacttgttctccaataaaaacttgttggtcagttgaatggaactatgtattcttccttgttctttcagaggttttgcttgctataaaaaaagttggtattttaagaggtaaaagaatgttcttatcagtagtttttgcactacagtaatggatttttagt

SEQ ID NO: 4838 - DNA, 1327 bp, Vigna unguiculata
aaacaatgaaacaagaccaccaatcttatctgttgtgttctgctctacactccaaccctccttcccaccgataacatcttcggcattacacaatacacaatcatgcattccttaacatgcacaccactttcttcttcttcctcctctcatcacaccactctaaagcctaatctcaaccctctgctaggtgcagatgcaacttccaggccatgttctttacccttcaaaagaagaacctgttttactaccagagccatactctcttccaccagagaagatgtcttgaagcacttcaacgaacgtagagctctcaagattatctcaggcttgcagaatttcaataaagacaatgttgcatcggtggtcactgctgctgacaagggtggagcaactcatgtggatatagcatgtgaccctgagttggtaaagctagctattggcttaacttcttgtccggtttgtgtttcttctgtagatcctgcaacatttccagctgcagttgaagcaggagcactaatggttgagattggaaactatgattcattctatgagcagggaataattttcactccagaaaagattcttggtctgacaaaggagacaaggagaatacttccatccatagtcttgtctgtcactgttcctcacacactaagcctccctgatcaggtcaagcttgcagagtcattggaactagtaggtgtagatgttattcaaactgaaggaggaaaatgttctaatcctacaaaatctggtgttatgggtttgattgaaaaggcaacaccaactttagcagcagcatattccatatcacgagctgttaagatccctgtcatgtgttcatcagggctaagcgctgtgacagcacctatggctataacagctggggcagctggtgtgggtgtagggtctgcagttaatagactcaatgatgtggttgctatgattgccgaggtgagaagcattgctaattcattgcagacatcatttcagacatccaccacttatgaagtggaaactcagagacagtagtttgttttgcaagaaacaaatgaagggtttgtaggcagtgaataaaacatgcaaagaaaatttggatccttataagttccttttttctttgtcctttatatttcagacttgttctccaataaaaacttgttggtcagttgaatggaactatgtattcttccttgttctttcagaggttttgcttgctataaaaaaagttggtattttaagaggtaaaagaatgttcttatcagtagtttttgcactacagtaatggatttttagtacaatgattatggatttactactactatta

SEQ ID NO: 4839 - DNA, 1282 bp, Glycine max
gttgtgttctgctcttcactacaaccttgcttcccatagataacatctgcatcagacaatagacaaacatgtattccttaacatgcacaccactttcttcttcttcttattctcatcacaccactctaaagccaaacctcaaccctcttctgggtgcagatgcaacttctaggccatgttctctacccttgaaaagaagaacatgctttactaccaaagccattctctcatccaccagagaagatgtcttgaagcatttcaacgaacgacgagctctcaagattatctcaggcttgcagaatttcaataaagacaatgttgcctcggttgtcactgctgcagacaagggtggagcaactctcgtggatatagcatgtgaccctgagttggtaaagctggccattgacttaacttcttgtccggtttgtgtttcttctgtagatcctgcaacatttccagctgcagttgaagcaggagcactaatggttgagattggaaactatgattcattctacgagaagggaataattttcactccagagaagattctaggtctaacaaaggagacaaggaggatacttccatctgtagtcttgtctgttactgttcctcacacactaagcctccctgatcaggtcaagcttgcagagtcattggaacaagaaggtgtagatatcattcaaactgagggaggaaaatgttctaatcccacacaatctggtgttatgggtttgattgagaaggcaacgccaactttagcagcagcgtattctatatcacgcgctgttaagatccctgtcatgtgctcttcggggttaagcactgtcacagtaccgatggctataacagctggagctgctggtgtgggtgtaggctctgcagttaatagacttaatgatgtggttgctatgattgctgaggtcagaagcattgctaattcattgcagacaccatttcagatatccactgcacatgaagtggaaactcaaagacagtaggttatgttgcaagaaacagatgaaggaggtgtaggtagtgaattaaacatgcaaagaatattaagaactgatccaaatatttgtgttcctgtgtggatgctaaattaaaagaaatagtgacctatttggaattttgcttcgttaatgggtggagttgatcagtttagtgaagctatgtattgttcgttgttctttcgccaaattcgtgatgcccttgttttatttttgcagtcagtaccatttagaaaggtcaataaatacataccaatgcttttgtcacgtgc

SEQ ID NO: 4840 - DNA, 1360 bp, Phaseolus coccineus
gttggagacaaaatatctgacgaacatgacagtttaatctatgcaacaacaccaccaatcttatctgttgtgttctgctcttcactccaaccctgcttctctctgataacatcttcggcatcacacaatacacaagcatgcattccttaacatgcacaccactttcttctcatcacaccactctaaaccctcttcttggtgctgatgcaacttcaaggccattttctcattctctacccttcaaaagaagaacctgctttactaccagagccgtactctcttccaccagagaagatgtcttgaagcacttcaacgaacgcagagctctcaagattatcacaggcttgcagaatttcaataaagacaatgttgcatcggtggtcactgctgctgataagggtggagcaactcatgtggatatagcatgtgaccctgagttggtcaagctagccatcggcttaacttcttgtccggtttgtgtttcttctgtagatcctgcaacatttccagctgcagttgaagcaggagcactaatggttgagattggaaactatgattcattctatgagaagggaataattttcactccagaaaagattctaggtctgacaaaggagacaaggaggatacttccatccgtagtcttgtctgtcactgttccacacacactaagcctccctgatcaggtcaagcttgcagagtctctggaactagaaggtgtagatatcattcaaactgaaggaggaaaatgttctaatcctacacaatctggtgttatgggtttgattgagaaggcaacaccaactttagcagcagcatattctatatcacgagctgttaagatccctgtcatgtgctcatcagggctaagcgctgtcacagcacctatggctataacagctggtgcagctggtgtgggtgtaggctctgcagtcaataggcttaatgacgtggttgctatgattgccgaggtcagaagcattgctaattcattgcagacatcatttcagacatccaccattcatgaagtggaaactcaaagacagtagtttgttttgcaagaaacaaatgaaggatgtgtaggtagtgaataaaacatgcaaagaaaatttggatccttccttaataataagaacctataggttccatttttctttgtcctttacatttctgacttgttctctgatgaaaacttgttggtcatttgagtggaattatgtattcttcgttgttctttcctgtggctagaaggttttgcttgctatgaaagagttcgtattttaacaggttaaaaactgttcttatcagtagttcttgcattacaagaatggtttgttagtactcaattgttttattttct

SEQ ID NO: 4841 - DNA, 1208 bp, Phaseolus coccineus
  misc_feature (283)..(283): n is a, c, g, or t
ctgctcttcactccaaccctgcttccctctgataacatcttcggcatcacacaatacacaagcatgcattccttaacatgcacaccactttcttctcatcacaccactctaaaccctcttcttggtgctgatgcaacttcaaggccattttctcattctctacccttcaaaagaagaacctgctttactaccagagccgtactctcttccaccagagaagatgtcttgaagcacttcaacgaacgcagagctctcaagattatcacaggcttgcagaatttcnataaagacaatgttgcatcggtggtcactgctgctgataagggtggagcaactcatgtggacatagcatgtgaccctgagttggtcaagctagccatcggcttaacttcttgtccggtttgtgtttcttctgtagatcctgcaacatttccagctgcagttgaagcaggagcactaatggttgagattggaaactatgattcattctatgagaagggaataattttcactccagaaaagattctaggtctgacaaaggagacaaggaggatacttccatccgtagtcttgtctgtcactgttcctcacacactaagcctccctgatcaggtcaagcttgcagagtcactggaactagaaggtgtagatatcattcaaactgaaggaggaaaatgttctaatcctacacagtctggtgttatgggtttgattgagaaggcaacaccaactttagcagcagcatattctatatcacgagctgttaagatccctgtcatgtgctcatcagggctaagcgctgtcacagcacctatggctataacagctggtgcagctggtgtgggtgtaggctctgcagtcaataggcttaatgacgtggttgctatgattgccgaggtcagaagcattgctaattcattgcagacatcatttcagacatccaccattcatgaagtggaaactcaaagacagtagtttgttttgcaagaaacaaatgaaggatgtgtaggtagtgaataaaacatgcaaagaaaatttggatccttccttaataataagaacctataggttccatttttctttgtcctttacatttctgacttgttctctgatgaaaacttgttggtcatttgagtggaattatgtattcttcgttgttctttcctgtggctagaaggttttgcttgctatgaaagagttcgtatttt

SEQ ID NO: 4842 - DNA, 1346 bp, Cajanus cajan
aaaggcaaaatatctgacgaacacgacagtttagtttaaagctagcacaacagaaatcttatctgttgggttctgcgcttcacttcttcaaccttgcttgctactcataacatacacatcgaaatttgacaacaacagaaaaaaaacatgcattccctaacatgcacaccactttcttcttctcttaagccaaaccacaaccctctacttgctgcagttgcaacttccaggccatattccctacccttcaaaacaacaacctgctttaccaccagagccacactctcatccaccagagaatctgtcttgaaccacttccaccaacgaacggctctcaagattatctcaggcttgcagaatttcaataaagacaatgttgcctccgttgtcactgctgcggacaagggtggtgcaactcacgtggatatagcatgtgacccagagttggtaaagctagctattggcttaacttcttgtccggtttgtgtttcctctgttgatcctgcaacatttccagctgcagttgaagcaggagcactaatggttgagattggaaactatgattcattctatgagaagggaatgattttcactccagaaaagattctaggtctaacgaaggagacgaggaggatacttccgtctgtagtcctttctgtcactgttcctcacacactaagcctccctgatcaggtcaagcttgcagagtccctggaacaagaaggtgtagacattattcaaactgaaggaggaaaatgttctaatcctacacaatctggtgttatgggtttgatagagaaggcaacaccaactttagcagcagcatactctatatcacgagctgttaagatccctgtcatgtgttcatcggggctaagtgctgtcacagcacctatggctataacagctggggctgctggtgtgggtgtgggatctgcagttaatagacttaatgatgtggttgctatgattgctgaggtcagaagcattgctaattcattgcagacaccatttcagatatccactacacacgaagtggaaactcaaagacagtagttcaataaatgggcctatgttgtaagaaacggctgaaggaagtgtaggtagtgaataaaacgtgcaaagaaaatttggaccctaccttaatagtaagaactgataggttccatatttctttgtcctttatatttcggactttgttatttgattcaattttttgtgttcctggatgttgatcccgctgtgtcaaagaattaagagaaacagttaagtatttggaatttttggctttcattaatgggtggagttggccagttgagtggaattatgtatgtattgttggttgt

SEQ ID NO: 4843 - DNA, 1499 bp, Cajanus cajan
gtggtcattttttcacacacagcaccccaatttaaattacctcaactcatcaacagtgaccctcaaaggcaaaatatctgacgaacacgacagtttagtttaaagctagcacaacagaaatcttatctgttgtgttctgcgcttcacttcttcaaccttgcttgctactcataacatacacatcgaaatttgacaacaacagaaaaaaaaaaatgcattccctaacatgcacaccactttcttcttctcttaagccaaaccacaaccctctacttgctgcagttgcaacttccaggccatattccctacccttcaaaacaacaacctgctttaccaccagagccacactctcatccaccagagaatctgtcttgaaccacttccaccaacgaacggctctcaagattatctcaggcttgcagaatttcaataaagacaatgttgcctccgttgtcactgctgcggacaagggtggtgcaactcacgtggatatagcatgtgacccagagttggtaaagctagctattggcttaacttcttgtccggtttgtgtttcctctgttgatcctgcaacatttccagctgcagttgaagcaggagcactaatggttgagattggaaactatgattcattctatgagaagggaatgattttcactccagaaaagattctaggtctaacgaaggagacgaggaggatacttccgtctgtagtcctttctgtcactgttcctcacacactaagcctccctgatcaggtcaagcttgcagagtccctggaacaagaaggtgtagacattattcaaactgaaggaggaaaatgttctaatcctacacaatctggtgttatgggtttgatagagaaggcaacaccaactttagcagcagcatactctatatcacgagctgttaagatccctgtcatgtgttcatcggggctaagtgctgtcacagcacctatggctataacagctggggctgctggtgtgggtgtgggatctgcagttaatagacttaatgatgtggttgctatgattgctgaggtcagaagcattgctaattcattgcagacaccatttcagatatccactacacacgaagtggaaactcaaagacagtagttcaataaatgggcctatgttgtaagaaacggctgaaggaagtgtaggtagtgaataaaacgtgcaaagaaaatttggaccctaccttaatagtaagaactgataggttccatatttctttgtcctttatatttcggactttgttatttgattcaattttttgtgttcctggatgttgatcccgctgtgtcaaagaattaagagaaacagttaagtatttggaattttggcttcattaatgggtggagttggccagttgagtggaattatgtatgtattgttggttgttctttcgccatgatcccggaaggtgttttttttactataaaaaaaatgtcatatttcaagtcataaaatgttagtggtactgtggtaggt

SEQ ID NO: 4844 - DNA, 1258 bp, Lotus japonicus
ggagtttaatcttgccaccatcttttcttatctcttctgttctctctctctctcttgcttgcagtgttcctcctcactccaaccttgcttgcctctgaactgataccatgcattccttaacatgcaccccagtttcatctccttctcacacccttctaaagccaaacaacaacaaccctttattgggttcaacttggaggccttgtccacctttgaaaagaagagcctgcttcactaccagagctctattgtcatccaccaaagaaactgttttgaaggatttccaggaacgaagagctctcaagattatctcaggcttgcataattttgataaagacaatgttgcctctgttgtcactgctgcagacaaggggggagcgactcacgtggatatagcatgtgacccggagttggtcaagctagctatcagtttaacttcttgtccggtttgtgtttcttctgtagatcctgcaacattcccagctgcagttgaagcaggagcactaatggttgagattggaaactacgattcattctatgagaagggagtagtttttactccagagcagattctaatactaacaaaggaaacaaggaggctacttccttctatcgccttgtctgttacagttcctcacacactaagcctccctgatcaggtcaagctcgcagagttactggaacaagaaggcgtggatattattcaaaccgagggaggaaaatgttccaatcctacaaagtctggtatactgggtttgattgagaaggcaacaccaactttagcagcagcatattctatatcgcgagctgttaagatacctgtcatgtgctcatctgggctaagtgctgtcacagcacctatggctatcactgctggagctgctggagtgggtgtgggctctgctgttaatagactaaatgatgtggttgccatgattgctgaggtcagaagcattgctaattcattgaagacaccctttcagatatgccctgcaacacatgaagtggaaattaacagacagtagtatgaaggtggtgtaggtagtgaataaaatttgtgaagaacatttggatccttccttaagcatgacaacttctaggatccacctttcttcttcctttctattgtagaatttattctaatctgaaaagagagtgtctatttggaaacttgttgcaccagacatttgttactaaacatcactctcatattgagtttttttagaatctcataaattcaggatattttctctttccg

SEQ ID NO: 4845 - DNA, 1127 bp, Cicer arietinum
tgccacatcttatctgttattttccttccttctcttgtatagacagacaacacaacacacactgcttcttctcaatccaacctttcttaccataataactacacaaacatgcattccttaacatgcatatcactttcttctccttcttctacctcttttttaaacccaaaccataacaaccctttacttgctgcaacttcaaggccatgtctactacctttgaaaagaaaaacctgttttactaccaaagctctactgtcatcaaccaaagagtctgtccttaaagattttcgcgaacaaatggctctcaagattatctcaggcttgcagaattttgacagagaaaatgttgcatcagttgtcattgctgcagacaagggaggagcaactcacgtcgatattgcatgtgacccggagttggtgaagctagctatcagcctaacatcgtgtccggtttgtgtttcttctgtagatcctgcaacttttccagctgcagttgaagcaggagcactaatggttgagattggaaattatgattcattctatgagaaaggaatggtttttactccagagcagattctgagtctaacaaaagagacaaggaggatacttccttctatagttttgtctgtcactgttcctcacacactaagcctccctgatcaggtcaagcttgcagagtcattggaactagaaggtgtagatattattcaaactgagggaggcaaatgttccaatcctactaagtctggtgttctaggtttgattgagaaggcaacgccaactttagcagcagcctattctatatcgcgagctgttaagatacctgttatgtgttcatctgggctaagtgctgtcacagcacctatggctatcactgctggagctgctggtgtgggtgtgggatctgcagttaacagactaaatgatgtggttgccatgatagctgaagttagaagcattgctgattcattgaagacatcctttcagatacactctgcacatgaagtggaaactcatagacagtagtttaatatatgttgcaaaaggtggtgtaggtagtgaataaaacgtgtgaagaaaatttggatccttccttagacttatttagaactgctaggatacat

SEQ ID NO: 4846 - DNA, 1300 bp, Medicago truncatula
tatctgtctcaagaacaggacagttcaaagctgccacatatcttatctgttattttccttctcttcttgtatagacagacaacaacacacagtatttctcaatccaactcttcttcttgctttctactcataactgcaattaatacacaaacatgcattccttaacatgtctaacactttcttctccttcttcaatctcatctctaaagccaaatcataactataaccctttattaggtgcagcctcaaagccatgtctactaacattgaaaagaaaaaccagttttactactagagcattactttcatcaaccaaagaatctgtcctaaaggattttcgcgaaagaacagctctcaagattatcacaggcttgcagaattttgataaagacaatgttgcctcagttgtcactgccgcagaaaagggaggagcaactcacgtcgatatagcatgtgacccggagttggtgaagctagctatcagcctaacttcttgtccggtttgtgtttcttctgtagatcctgcaacatttccagctgcagttgaagcaggagcactaatggttgagattggaaattatgattcattttatgagaagggagtgatttttactccagagcagattctgagtctaacaaaagagacaaggaggatacttccatctgtggttttgtctgtcactgttcctcacacactaagccttcccgatcaggtcaagcttgcagaatcacttgaactagaaggtgtggatattattcaaactgagggaggaaaatgttccaatcctacaaagtctggtgttcttggtttgattgagaaggcaacaccaactttagcagctgcatattctatatcacgagctgttaagatacctgtcatgtgttcatccgggctaagtgctgtcacagcacctatggctatcactgccggagcttctggtgtgggtgtgggctccgcagttaacaaactaaatgacgtggtcgctatgattgctgaagttagaagcattgctgattcattgaagacatcccttccgatacacactacacatgaagtcaaaactcatttccagtagttcaatatatggaagaaatagcttaaggtggtttaggtagtgaataaaacgtttgaagaaaatctggatccttccttaaaaataagaactgctaggatccatcttttttcctccttttctattttagacttctgttttacttgtagtttgtgttcttgtatgggtgttgaaattacactgtcaaagtgaaatgattaatgagctatttgggggttttgcttctt

SEQ ID NO: 4847 - DNA, 1390 bp, Arachis hypogaea
ggggaaaattaaaatatctaataaactttgtagtttcaaagctaccaacaccagcatcatcatcttatcttgttcttgttgcaaccctttcctcactcctcactcttcactccaaaactttacttccttagtcactgatacatagcaaagtatttagacatagacatagacatgcattctttaacatgcataacaatttcttcttcttcttcttacacctttctaaagccataccataaccctctattggctcctacttcaaggcctaatcttctaactttgaaaaagaaaccatgcttttctaccaaagctctattatcatctaccaaagaatctgtgttgaaggacttccatgaacgtagagctctcaagattatctcaggcctgcataattttgataaggacaatgttgcttcagttgtgacagctgcagagaagggtggagcaactcatgtggatatagcgtgcgacccggagttggtgaaactggctatcagcttaacttcttgtccggtttgtgtttcatctgtagaccctgcatcatttccggctgcagtcgaagcaggagcactaatggtcgagattggaaattatgattcattctatgagaagggagtggtttttactccgcagcagattctaggtctaacaaaggagacaaggaggatacttccatcagtaacattgtccgtcaccgtgcctcacacactaagcctccctgatcaggtcaagcttgcagagttactagaacaagaaggtgtagacattattcaaaccgagggaggaaaatgctcaaatcctacaaagtctggtgttttaggcttgattgagaaggcaacaccaactttggcagcagcatattctatatcaagagctgttaagatccctgtcatgtgctcatctggcttaagtgctgttacagcgcctatggctatcacagccggggcagctggtgtgggtataggttctgcagttaacaggctaaatgatgtggttgctatgattgctgaggttaaaagcattgcgacttcattgcagacatcatctccgatgcatgctacacgcaaagtggaaactcgtagacagtagttcagttctatccattgggttgtgtcacaagaaataggttagaagtgaaggataccagtgaataaaacatgaagaaaatttgggaaccttacttcaacatagggttaaaaaagtgtgaggatccatctttcttcttcctttctatttcagagctatggtattctgatgtttctacagaggaaagtataactttgccctgcatatttttgcttctttaattgctaattttggattctaaaatttccctaataaaacgagcattaaagtaaaatgaacatacgctatgaagaagcttattcta

SEQ ID NO: 4848 - DNA, 3038 bp, Triticum aestivum
gcgcgccgcggggtgacccgggccgtcttcgagcgcttcacggagcgggccgtcaaggcggtggtgcactcccagaaggaggcccgggggctcggggagggcgccgtggcgccgcgccacctgctgctcggcctcgtcgccgaggaccgctccgccgggggcttcctttcctccgggatcaccgtcgagcgcgcgcgcgaggagtgccgcggcctcatcggcggcgccgcccagaaggcgggcgggctcgacaccgacgtgcccttcgacgggggctgcaggcgcgtcttcgaggtcgccgtcgagctgtccaggaacatgggctgcagcttcatctcccccgagcacctcgccatcgcgctcttcacgctcgacgatcccaccaccaacaatctcctcagaagcttgggagcggatccgagtcagctagcgtcagttgcagtcacccgactccatgaagagcttgcaaaagatggcagagatctcgcaggagcatcttctctcaaagtgcccgagaaagcacccgctggagctggagctggaagatctgccttcagcaaatccttaagcaaaaagaaagataaaggcgcgctagatcagttttgtctagatttgaccacacaagccagtggagggtttattgaccccattattggccgcgaggaggagatcgaaagggtagttcagataatatgccggcgaacaaagaacaatcccatccttttgggtgaggctggtgttggtaaaactgcgatcgccgaagggttggctcttcggattgcaaatggagatgtccccattttcctcgtggcaaagcgtataatgtcactagacattggcctgcttattgctggcgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctactgaagcccccacttgccagaggtgaactgcagtgcattgcagctacaactttagatgaacaccggatgcattttgagaaggataaggctttgaaccgcaggttccagccagtatttgtagatgagcctagccaggaagatgctgtgaaaatattactgggtcttcgtgagaattatgaaacttatcataaatgcaaattcactctagaagccatcaatgcagcagtttatttgtcagcaagatatatccctgacagacagcttcctgacaaggctattgatcttattgacgaagctggcagtagagctcgaattgaatcatatcaaaagaagaaggaaggacagtcttccgttctcttaaaggagccggatgaatactggcaggagataaaagctgtccaggccatgcatgacgtggtgtcatctaacaagatgaaatattctccgaataagaataatcaacagaatgcgagtcttaacactgaagcgccacatcaggataaggccgagccaacaattgaggagcctattgtagttggaacagaagaaattgcaagagttgcctcattatggtcgggtattccagtccaacagctgactgctgatgataaaaagatcttagtaggactggatgatgagcttagaaagcgtgttattggtcaagatgacgctgttgcggcgatatcgcgggcggtgaagagatcacgtgtaggcctcagtgaccctgacagacctatagctacgatgctcttttgtggtcctacaggggttggtaaaaccgagcttaccaaagctcttgcggcgagctactttggatcggaatctgctatgcttagactagacatgagtgaatacatggagaggcacacggtgagcaaactgataggctctcctccagggtacgttggatatggtgaaactggtactttgacagaagcagtcaggagaaaaccattcaccgtggtactgcttgatgagatagagaaagctcaccctgatattttcaatatccttctccaaatttttgaagatgggcatctggcagactcacagggtcgcagagtttcgttcaagaacacattgattgtcatgacatcaaatgttggttctacgtcaatttcgaatggacgacggagcatgggtttctcaacagaggatactgagtcgagcagatatgtcgcggtgaaatccctcgtgatggaagagctgaaaggattcttccgtccagaattgctcaacaggattgatgagacggttgtcttccgtcctctggaacagactcagatgctagcgattctcgatatcctcctagaggaactgaagggcaagctcttggccgtcgggatcggcctagaggtctccgatgccatgaaggagctgatctgccgagaaggctacgacaagaactacggcgcgcggccgctgaggagagccatcacccaactgatggaggatgtcatcagcgaagcgatccttttcggcgagtacaagcctggcgacacgatactggtggacaccgacagcaaggggaagccttgcttgagtcgtctgaaccaaccaccgatcgtccaagtgtctgactcaacacggacattctgaagtgaagcccttgggtggtagacttggtagagtagaggcctaatttcctgttctttcgatttcgagtaacgagataagtagtacagtaattctttgataggtagataccaaatattcatttcgttatgtacataacattgagggaattcgtcccagcatggtcttattcggcaagtatatatccaactgtatattgtcctccggtttatgacaaatataattttgaaacggctgcatggagtcgatattttggactaaagatcactgaatgcaaactttgtttttctctttactgcatgcagtcggtatttgcagctgctttttaagaaagttcagtaacttgtgtttacactctgcaacactgccaattgaaagacaagccatgtacatgtggcctttttattcagaatgattcgaaatgcagc

SEQ ID NO: 4849 - DNA, 2969 bp, Hordeum vulgare
cggccggccgcggcccggaggccggcgcgccgcggggtcaccagggccgtattcgagcgcttcacggagcgggccgtcaaggcggtggtgcactcccagaaggaggcccgggggctaggggagggcgccgtggcgccgcgccacctgctgctcggcctcgtcgccgaggaccgctccgccgggggcttcctctcctccgggatcaccgtcgagcgcgcgcgcgaggagtgccgcggcctcatcggcgccgccgccgccgccgcacacaaggcgggtgggctcgacaccgacgtgcccttcgacgggggctgcaggcgcgtcttcgaggtcgccgtcgagctgtccaggaacatgggctgcagcttcatctcccccgagcacctcgccatcgcactcttcactctcgacgatcccaccaccaacaacctcctcagaagcttgggagcggatccgagtcagctagcatccgttgcagtcacccgacttcatgaggagcttgcaaaagatggcagagataccgcaggagcttcttctctcaaagtgcccgagaaagcacccgctggagctggggctggaagatctgccttcagcaaatccttgagtaaaaagaaagataaaggtgcgctagatcagttttgtctagatttgaccacacaagccagtggagggtttattgaccccatcatcggccgcgaggaggagatcgaaagggtagttcagataatatgccggcgaacaaagaacaatcccatccttttgggtgaggcaggtgttggtaaaactgcgatcgccgaagggttggctcttcggattgcaaatggagatgtccccattttcctcgtggcaaagcgtataatgtcactagacattggcctgcttattgctggcgcaaaagagaggggcgaactggagtccaggatcactagtttaattcgtgaagtccgtgaagcaggtgatgttattcttttcatcgatgaggttcacaatcttgttggatctggaactgctggaaagggtaagggtgctggccttgatattagcaatctcctgaagcccccacttgccagaggtgaactgcagtgcattgcagctacaactttagatgaacaccggatgcattttgagaaggataaggctttgaaccgcaggttccagccagtatttgtagatgagcctagccaggaagatgctgtgaaaatattacttggtcttcgtgagaattatgaaacttatcataaatgcaaattcactctagaagccattaatgcagcagtttatttgtcagcaagatatatcccagacagacagcttcctgataaggctattgatcttattgacgaagctggcagtagagctcgaattgaatcatatcaaaagaagaaggagggacaatcttctgttctcttaaaggagccggatgaatactggcaggagataaaagctgttcaggccatgcatgatgtggtgttatctaacaagatgaaatattctccgaatgagaataatcaacagaatgcgagtcttaacgctgaaggaccacgtcaggataaggctgagtcaacaactgaggagcctattgtagttggaacagaagaaattgcaagagtcgcctcattatggtcaggtattccagtccagcagctgacagctgatgataaaaagatcttagtaggactggatgatgagcttcgaaagcgtgttattggtcaagatgacgctgttgcggcgatatcgcgggcggtgaagagatcacgtgttggccttagtgaccctgacagacctatcgctacgatgctcttttgtggtcctacaggtgttggtaaaaccgagcttaccaaagctcttgcggcgagctactttggatcggaatctgctatgcttagactagacatgagtgaatacatggagaggcacacagtgagcaaactgataggctctcctccagggtacattgggtatggtgaaactggtactttgacagaagcggtcaggagaaaaccattcaccgtggtactgcttgatgaaatagagaaagctcaccctgatattttcaatatccttctccaaatttttgaagatgggcatctggcagactcacagggtcgcagagtttcgttcaagaatacattgattgtcatgacttcgaatgttggttctacgtcaatttcgaatggacgacggagcatgggtttctcaacagatgataccgaatcaagcagatacgttgcggtgaaatccctggtgatggaagagctgaaggggttcttccgtccagaattgctcaacagaatcgatgagacggtcgtcttccgtcctctggaacaaactcagatgctagcaattcttgatatcctcctagaggaactgaagggcaagctcttggccgtcgggatcggcctagaggtttccgatgcgatgaaggagctgatctgccgggaaggctacgacaagaactacggtgcgcgaccactgaggagagccatcacccagctgatggaggatgtcatcagcgaagcgattcttttcggcgagtacaagcccggcgacacgatactggtggataccgacaacaaggggaagccttgcttgagtcgtctgaaccaaccaccgatcgtccaagtttccgactcaacgcggacattctgaagtgaagctcttgtgtggtagacgagataagtagtaattctttgataggtcaaaattttctattctttcagtctcaagtaacgagataagtagtaattctttgataggtagataccaaatattcatttccttgtgtacatatatagcattgagggaattcgtcccaggatgatcttattcgggaagtatatatcaaactgtaatattgttctctggtttattccaaataatattgttctctggtttattccaaatattattttgaaacggttcagttgccgtaggttactgacacaacttctgcttggagttgatatttttgg

SEQ ID NO: 4850 - DNA, 3305 bp, Brachypodium distachyon
catccattcgcttcgctcgccaacactccaagtagatacgatacaccacgcgtagtagacggtagtagtacacgcggcacgatacgtagtggctcgattaacgcccactttttcttcactatactccacgcaccaaattaaagcagagggtgttgttcatttcgttggaagatttggagggagcccgtttctataccagtagaggactacaccacgcaccaaatagaagcgggggtacagatcggtaagtgccgacgatcgatggaggtgtgctgctgctccacctcgtcttccgtcctcgccggggatcgcgtcggcaggaggttcgccccgccggcggcgcggtactggggcgcggtgggcggcggcggcgggagggcggtggtgctggcgcacccgctgcgcccggccgccgccaggccggcgcaggctcagccccacgcgcgtcgggtgcggcgcgggggcgcggtgatcaggtccgtgttcgagcggttcacggagcgggccgtcaaggcggtggtgctgtcgcagagggaggccaaggggctcggcgcgggcgccgtggcgccgcgccacatgctgctgggcctcgtcgcggaggaccgctccgctggggggttcctctcctccgggatcagcatcgagcgcgcgcgcgaggagtgccgcagcatcggcgcccaggacgcgggagcgcctccgccgccgccggcgggctcggggctggagacggacgtgcccttctccggaacctgcaagcgtgtgttcgaggtggccgtggagttctccaagaacatgggctgcagcttcatctccccggagcacctcgccctcgcgctcttcactctcgacgatcccaccaccaacactctactcagaagcctgggagccgatccgagtcagctagcatcagttgcacttgcccgacttcaaggggagcttgcaaaagatggcagagatcccgcaggagcctcttctttcaaagtacctgagaaatctcctgctggagccggaagatccgccttcaccaaatccttgagtaaaaagaaagagaagggtgcactagatcaattttgtttagatttgaccacacaagctagtggaggtttcattgaccctattattggccgtgaggaggagattgaacgagtagttcagataatatgccgacggacaaagaacaatcctattcttctgggtgaggcgggtgttggtaaaactgcaattgctgaagggctggctcttcgaattgcaaatggagatgtccccatttacctcgtggcaaagcgtataatgtcactggacgtcggtctactcattgctggtgccaaagaaaggggcgaattggagtccagggtcactaatttaattcgtgaagtccgtgaagcaggtgatgttattcttttcattgacgaggttcacaatcttattggatccggaactgttggaaagagtaagggtgctggccttgacattagcaatttgctcaagcccccacttgctagaggtgaattgcagtgcattgcagctacaactttagatgaacatagaatgcattttgagaaggataaggctttggcacgcaggttccagccagttttagtagaggagcctagccaggaagatgcggtgaaaattttgcttggtcttcgtgagaactatgaaacttatcataaatgcaagttcactttagaggccatcaatgcagcagtttatttgtcagcaagatatatccctgacagacagcttcccgataaggctattgatcttcttgatgaagctggcagtagagctcgtattgaatcatttcaaaggaagaaagaagggcagtcttctgttcttttaaaggcaccagatgaatactggcaagagataaaagctgttaaggccatgcatgaagtggtgttatctaacaagacaaaatattctccaaatgagaacgctcaagagaatgatagtagtaacaccgaaaaacaatgtcaagagaaggctgggtcaacatctacctcatcaccctcagttgaggagccagttgtagtgggaacagaggaaattgcaagggtggcctcgctatggtcaggtataccagtccagcagctgactgctgatgataaaaagattttagtaggactagatgatgagctcagaaagcgtgtcattggtcaagatgatgctgttgttgcaatatcacgagcggtgaagagatcacgtgttggcctcagtgaccctgacagacctattgctacactccttttctgtggtccaacaggagttggtaaaaccgagcttaccaaagctctagcagcaagttactttggatcggaatctgctatgcttagattagacatgagcgaatatatggagaggcacaccgtgagcaagctgataggctcccctccagggtacattggatatggtgaaactggtactttgacagaagcagtcaggagaaaaccattcaccgtggtactacttgatgagatagagaaagctcaccctgatattttcaacattcttctccaaatcttcgaagatggacatctggcagactcacagggtcgcagagtttcattcaagaatacattgattgtcatgacatcaaatgttggttctacgtcaatttcgagtggacggcggagcataggcttctcaacagatgatactgaatcaagcacgtatattgcaatgaaatccctcgtaatggaagagctcaagggatttttccgcccagaattgctcaatagaattgatgagatggttgtgttccgtcctctggagaagactcagatgctagcaattcttgatatcatcctacaagaactgaagggtaggctgttagcccttgggatagggctagaggtgtccgacgcaatgaaaggcttgatttgccaagaaggctatgacaagagctacggtgcacgaccactgaggagagcagtcacccacctgatggaggatgtcatcagtgaagcaattctgttcggtgagtacaagcctggcgacacgatattggtggatactgacgatgaaggaaagccttgcttgagccatctgaacaagcagatcgttcaattgtctgacccaacacggacattctgaagctctgatgccgtagagtagttgtctaatttttcattctttcaggcaacgagattagtaattctttgataggtagactcggagtatttcattatgtacataacattcagtaaatttgtcacgacatgtcgacatagtcttgtcctaaattatccaactgtatattgtccttcacatcagcaaatatattggagtattttgaaactacc

SEQ ID NO: 4851 - DNA, 3457 bp, Brachypodium distachyon
gcgtgcttcctcccccttccgtcccgatgtttttatactccgtcttccacctcctccctcgctgcagtattcatccattcgcttcgctcgccaacactccaagtagatacgatacaccacgcgtagtagacggtagtagtacacgcggcacgatacgtagtggctcgattaacgcccactttttcttcactatactccacgcaccaaattaaagcagagggtgttgttcatttcgttggaagatttggagggagcccgtttctataccagtagaggactacaccacgcaccaaatagaagcgggggtacagatcggtaagtgccgacgatcgatggaggtgtgctgctgctccacctcgtcttccgtcctcgccggggatcgcgtcggcaggaggttcgccccgccggcggcgcggtactggggcgcggtgggcggcggcggcgggagggcggtggtgctggcgcacccgctgcgcccggccgccgccaggccggcgcaggctcagccccacgcgcgtcgggtgcggcgcgggggcgcggtgatcaggtccgtgttcgagcggttcacggagcgggccgtcaaggcggtggtgctgtcgcagagggaggccaaggggctcggcgcgggcgccgtggcgccgcgccacatgctgctgggcctcgtcgcggaggaccgctccgctggggggttcctctcctccgggatcagcatcgagcgcgcgcgcgaggagtgccgcagcatcggcgcccaggacgcgggagcgcctccgccgccgccggcgggctcggggctggagacggacgtgcccttctccggaacctgcaagcgtgtgttcgaggtggccgtggagttctccaagaacatgggctgcagcttcatctccccggagcacctcgccctcgcgctcttcactctcgacgatcccaccaccaacactctactcagaagcctgggagccgatccgagtcagctagcatcagttgcacttgcccgacttcaaggggagcttgcaaaagatggcagagatcccgcaggagcctcttctttcaaagtacctgagaaatctcctgctggagccggaagatccgccttcaccaaatccttgagtaaaaagaaagagaagggtgcactagatcaattttgtttagatttgaccacacaagctagtggaggtttcattgaccctattattggccgtgaggaggagattgaacgagtagttcagataatatgccgacggacaaagaacaatcctattcttctgggtgaggcgggtgttggtaaaactgcaattgctgaagggctggctcttcgaattgcaaatggagatgtccccatttacctcgtggcaaagcgtataatgtcactggacgtcggtctactcattgctggtgccaaagaaaggggcgaattggagtccagggtcactaatttaattcgtgaagtccgtgaagcaggtgatgttattcttttcattgacgaggttcacaatcttattggatccggaactgttggaaagagtaagggtgctggccttgacattagcaatttgctcaagcccccacttgctagaggtgaattgcagtgcattgcagctacaactttagatgaacatagaatgcattttgagaaggataaggctttggcacgcaggttccagccagttttagtagaggagcctagccaggaagatgcggtgaaaattttgcttggtcttcgtgagaactatgaaacttatcataaatgcaagttcactttagaggccatcaatgcagcagtttatttgtcagcaagatatatccctgacagacagcttcccgataaggctattgatcttcttgatgaagctggcagtagagctcgtattgaatcatttcaaaggaagaaagaagggcagtcttctgttcttttaaaggcaccagatgaatactggcaagagataaaagctgttaaggccatgcatgaagtggtgttatctaacaagacaaaatattctccaaatgagaacgctcaagagaatgatagtagtaacaccgaaaaacaatgtcaagagaaggctgggtcaacatctacctcatcaccctcagttgaggagccagttgtagtgggaacagaggaaattgcaagggtggcctcgctatggtcaggtataccagtccagcagctgactgctgatgataaaaagattttagtaggactagatgatgagctcagaaagcgtgtcattggtcaagatgatgctgttgttgcaatatcacgagcggtgaagagatcacgtgttggcctcagtgaccctgacagacctattgctacactccttttctgtggtccaacaggagttggtaaaaccgagcttaccaaagctctagcagcaagttactttggatcggaatctgctatgcttagattagacatgagcgaatatatggagaggcacaccgtgagcaagctgataggctcccctccagggtacattggatatggtgaaactggtactttgacagaagcagtcaggagaaaaccattcaccgtggtactacttgatgagatagagaaagctcaccctgatattttcaacattcttctccaaatcttcgaagatggacatctggcagactcacagggtcgcagagtttcattcaagaatacattgattgtcatgacatcaaatgttggttctacgtcaatttcgagtggacggcggagcataggcttctcaacagatgatactgaatcaagcacgtatattgcaatgaaatccctcgtaatggaagagctcaagggatttttccgcccagaattgctcaatagaattgatgagatggttgtgttccgtcctctggagaagactcagatgctagcaattcttgatatcatcctacaagaactgaagggtaggctgttagcccttgggatagggctagaggtgtccgacgcaatgaaaggcttgatttgccaagaaggctatgacaagagctacggtgcacgaccactgaggagagcagtcacccacctgatggaggatgtcatcagtgaagcaattctgttcggtgagtacaagcctggcgacacgatattggtggatactgacgatgaaggaaagccttgcttgagccatctgaacaagcagatcgttcaattgtctgacccaacacggacattctgaagctctgatgccgtagagtagttgtctaatttttcattctttcaggcaacgagattagtaattctttgataggtagactcggagtatttcattatgtacataacattcagtaaatttgtcacgacatgtcgacatagtcttgtcctaaattatccaactgtatattgtccttcacatcagcaaatatattggagtattttgaaactaccatctgccggatgttactggcagtgaatttcgtttcgttcctctacagtttactccaggtatagcaaagtacagtacattgg

SEQ ID NO: 4852 - DNA, 3428 bp, Oryza sativa
taccgtcccaaactccccatttccaacgtgaattcctcaccctccttccttccttgcgtgtttccttcgccttccgcccggtatttcttataccccccctcgtccaacccggcgctattcaattcaccgatttcgttcgttcacccaccacaactcctccagcgagtcggggactcggggtagatcgtagaaatacggagtatacatacgtacaccgctacatttctagattacagtatttacagatacgtgggcaacgtgatcacgcagcttattagcatttgttaagtgcgtagttcgttcgttcgttgattgattgtgttgaattaattgagaggggctaaagatagtagtagtggttggttggtgcggttgcggcgggtgatcgaacgatggaggtgtgctgctgctcgacgtcatcggccgtgcccgggaggaggttcgcggcggccggggcggcggcggcggcggtggcggcgaggtggggcgccgtgggggtcgggagggcggtggtgctggcgcacccgctgcgcccggcgccgcgcggcgggcacgcgcacgcgcagcaggcgggcgcgcggcgggcgcggcgcgcggtcgtcagggcggtgttcgagcggttcacggagcgggcggtgaaggcggtggtgctgtcgcagcgggaggccaaggggctcggggagggcgccgtggcgccgcgccacctgctgctggggctcatcgccgaggaccggtcggcgggcgggttcctctcgtcggggatcaacatcgagcgcgcgcgcgaggagtgccgcggcatcggcgccagggacttgacccccggcgcgccgtcgccgtccggctccgggctggaaatggacatacccttctccggcagctgcaagcgggtgttcgaggtcgccgtggagttctcccggaacatgggctgcagcttcatctccccggagcacctcgccctcgcgctcttcaccctcgacgatcccaccaccaacagcctcctcaggagcttgggagcggatccgagtcaactagcatcagtagcgcttacccgactccaagcggagcttgcgaaagattgcagagaacctgcaggagcatcatctttcaaagtacccaagaaatctcctgctggagctggaagatctgccttctcgaaatctttaaattcaaagaaagaaaagggtgcgcttgatcaattttgtttagatctgaccacacaagctagtggcgggtttattgatcctatcattggccgtgaggaggagattgaaagagtagttcagataatatgccgacggacaaagaacaatcctattcttttgggtgaggcaggtgttggcaaaactgcaatcgctgaagggttggctcttcgaattgcaaatggagatgtccccatttaccttgtggcaaagcgtataatgtcattggacgttggtctacttattgctggtgcaaaagaaagaggtgaactggagtccagggttactagtttaattcgtgaagtccgggaagcaggggatgttattcttttcattgatgaggttcacaatcttattggatctggcactgttggaaagggtaagggtgctggccttgacattggcaacttgctgaagcccccacttgctagaggtgaattgcagtgcattgcagctacaactctagatgaacacagaatgcattttgagaaggataaggctttggctcgccgcttccagccagtattagtagaggagcctagtcaggatgatgctgtgaagatattacttggtcttcgtgaaaaatatgaaacatatcacaaatgcaaatttaccttagaagccatcaatgcagcagtttatctgtcagcaagatatattcctgacaggcagctccctgacaaggccatcgatctgattgatgaagctggcagtagagctcgaatggaatcatttaataggaagaaagaagggcagtcttcaatcctcttaaagtcgccagatgaatactggcaagagataagagctgctcaaaacatgcatgaagtggtgtcatcaaaccagatgaagtattcccctcgtcaagagaatggcagtgctgccattaaagcaccaagcgaggacatgaatgagttgacatctgaactccaagttgaggaaccaattgtagttggaacagaggaaattgcaagagttgcctcattgtggtcagggataccagtccagcagttaactgctgatgatagaaagcttctcgtaggactagatggtgaactcagaaagcgtgtgattggtcaagatgatgctgttatggcaatatctagagcggtgaagagatcacgtgttggcctcaatgatcctgacagacctattgccactctacttttctgtggtccgacaggagttggtaaaactgagcttactaaagctctagcagctagttattttggatcggaatctgctatgcttagattagacatgagcgagtatatggagaggcacactgtgagcaagctcataggctctcctccagggtacatcggatatggtgaaactggtactctgacagaagctgtcaggagaaagccatttactgtagtattacttgatgagatagagaaagctcaccctgatattttcaacattcttctccaaatttttgaagatgggcatctgtcggactcacagggccgcagagtgtccttcaagaacacattgattgtcatgacatcaaatattggttctacatcaatttcaaagggaagacgaagcatgggtttcatgacagaagatactgaatcaagctcatatgttgcaatgaaatctctagtaatggaagagttgaaggcatttttccgtccagaattgctcaacagaatcgatgagatggttgtattccgtcccttagagaaaactcagatgctagcaattcttgatatcatcctacaagaagtgaagggtaggctgttagcccttggaataggcctcgaggtgtccgatgcaatgaaggacctgatttgcgaagaaggctatgacaagagctacggtgcgcggccactgaggagagccgtcacccacctgattgaggatgtgatcagcgaagcaattctatttggcgaatacaagcctggggacacgatactgatggatattgatgccggggggaaactttgcatgagccacctgaatgagaaggttgtccagttgtctgatccgacacggacattctgaagttctgcatactgcttagtacattagagatctaatttttcattctttcgagattactaattctttttttaggtagacacggaatatatttcattatgtacataacagttaagggattcgttcgggcatataaatgtcttaaaacttgtacccaactgtatattgttgttcaattgatcaaatatattattttgaaaccatagttgcggaatgttatcg

SEQ ID NO: 4853 - DNA, 3311 bp, Oryza sativa
ttcaattcaccgatttcgttcgttcacccaccacaactcctccagcgagtcggggactcggggtagatcgtagaaatacggagtatacatacgtacaccgctacatttctagattacagtatttacagatacgtgggcaacgtgatcacgcagcttattagcatttgttaagtgcgtagttcgttcgttcgttgattgattgtgttgaattaattgagaggggctaaagatagtagtagtggttggttggtgcggttgcggcgggtgatcgaacgatggaggtgtgctgctgctcgacgtcatcggccgtgcccgggaggaggttcgcggcggccggggcggcggcggcggcggtggcggcgaggtggggcgccgtgggggtcgggagggcggtggtgctggcgcacccgctgcgcccggcgccgcgcggcgggcacgcgcacgcgcagcaggcgggcgcgcggcgggcgcggcgcgcggtcgtcagggcggtgttcgagcggttcacggagcgggcggtgaaggcggtggtgctgtcgcagcgggaggccaaggggctcggggagggcgccgtggcgccgcgccacctgctgctggggctcatcgccgaggaccggtcggcgggcgggttcctctcgtcggggatcaacatcgagcgcgcgcgcgaggagtgccgcggcatcggcgccagggacttgacccccggcgcgccgtcgccgtccggctccgggctggaaatggacatacccttctccggcagctgcaagcgggtgttcgaggtcgccgtggagttctcccggaacatgggctgcagcttcatctccccggagcacctcgccctcgcgctcttcaccctcgacgatcccaccaccaacagcctcctcaggagcttgggagcggatccgagtcaactagcatcagtagcgcttacccgactccaagcggagcttgcgaaagattgcagagaacctgcaggagcatcatctttcaaagtacccaagaaatctcctgctggagctggaagatctgccttctcgaaatctttaaattcaaagaaagaaaagggtgcgcttgatcaattttgtttagatctgaccacacaagctagtggcgggtttattgatcctatcattggccgtgaggaggagattgaaagagtagttcagataatatgccgacggacaaagaacaatcctattcttttgggtgaggcaggtgttggcaaaactgcaatcgctgaagggttggctcttcgaattgcaaatggagatgtccccatttaccttgtggcaaagcgtataatgtcattggacgttggtctacttattgctggtgcaaaagaaagaggtgaactggagtccagggttactagtttaattcgtgaagtccgggaagcaggggatgttattcttttcattgatgaggttcacaatcttattggatctggcactgttggaaagggtaagggtgctggccttgacattggcaacttgctgaagcccccacttgctagaggtgaattgcagtgcattgcagctacaactctagatgaacacagaatgcattttgagaaggataaggctttggctcgccgcttccagccagtattagtagaggagcctagtcaggatgatgctgtgaagatattacttggtcttcgtgaaaaatatgaaacatatcacaaatgcaaatttaccttagaagccatcaatgcagcagtttatctgtcagcaagatatattcctgacaggcagctccctgacaaggccatcgatctgattgatgaagctggcagtagagctcgaatggaatcatttaataggaagaaagaagggcagtcttcaatcctcttaaagtcgccagatgaatactggcaagagataagagctgctcaaaacatgcatgaagtggtgtcatcaaaccagatgaagtattcccctcgtcaagagaatggcagtgctgccattaaagcaccaagcgaggacatgaatgagttgacatctgaactccaagttgaggaaccaattgtagttggaacagaggaaattgcaagagttgcctcattgtggtcagggataccagtccagcagttaactgctgatgatagaaagcttctcgtaggactagatggtgaactcagaaagcgtgtgattggtcaagatgatgctgttatggcaatatctagagcggtgaagagatcacgtgttggcctcaatgatcctgacagacctattgccactctacttttctgtggtccgacaggagttggtaaaactgagcttactaaagctctagcagctagttattttggatcggaatctgctatgcttagattagacatgagcgagtatatggagaggcacactgtgagcaagctcataggctctcctccagggtacatcggatatggtgaaactggtactctgacagaagctgtcaggagaaagccatttactgtagtattacttgatgagatagagaaagctcaccctgatattttcaacattcttctccaaatttttgaagatgggcatctgtcggactcacagggccgcagagtgtccttcaagaacacattgattgtcatgacatcaaatattggttctacatcaatttcaaagggaagacgaagcatgggtttcatgacagaagatactgaatcaagctcatatgttgcaatgaaatctctagtaatggaagagttgaaggcatttttccgtccagaattgctcaacagaatcgatgagatggttgtattccgtcccttagagaaaactcagatgctagcaattcttgatatcatcctacaagaagtgaagggtaggctgttagcccttggaataggcctcgaggtgtccgatgcaatgaaggacctgatttgcgaagaaggctatgacaagagctacggtgcgcggccactgaggagagccgtcacccacctgattgaggatgtgatcagcgaagcaattctatttggcgaatacaagcctggggacacgatactgatggatattgatgccggggggaaactttgcatgagccacctgaatgagaaggttgtccagttgtctgatccgacacggacattctgaagttctgcatactgcttagtacattagagatctaatttttcattctttcgagattactaattctttttttaggtagacacggaatatatttcattatgtacataacagttaagggattcgttcgggcatataaatgtcttaaaacttgtacccaactgtatattgttgttcaattgatcaaatatattattttgaaaccatagttgcggaatgttatcg

SEQ ID NO: 4854 - DNA, 2927 bp, Avena sativa
cggcccccacgcgccggccgcgccgcagggccggggtcatcagggcggtcttcgagcgcttcacggagcgagccgtcaaggctgtggtgctgtcccagagggaggcaaaggggctcagggagggcgccgtggcgccgcgccacatgctgctgggtctcattgcggaggaccgctccgccggaggcttcctctcgtcgggaatcagcatcgagcgcgcgcgcgaggagtgccgcagcatcggcgcccaggacgcgggggcatccccgccgcctccgacctcggggctggacacggacgtgcccttctccgggggctgcaagagggtgtttgaggtggcgttggagttgtccaggaacatgggctgcagcttcatctccccggagcacctcgccatagcgctcttcactctcgacgatcccactaccagcaatctcctcagaagcttgggggcagatcctagtcaactggcatccgttgcactcatccgactacagggagagcttgcaaaagatggcagagatcctgctggagcgtcttctttcaaagtgcctgagaaatctcctgctggagccggaagatctgccttcaccaaatccttgagtaacaagaaagaaaaaggtgcgctagatcagttttgtctagatttgaccacacaagccagcggaggatttgttgatcctattattggtcgtgaggaggagattgaaagagtagttcagattatatgcaggcggacaaagaacaatcccattcttttgggtgaggcaggtgttggtaaaactgcaattgccgaagggcttgctcttcgaattgcaaatggcaatgtccccatttacctcgtggcaaagcgtattatgtcactggatgttggcctacttattgctggtgcaaaagagaggggcgaattggagtccagggtcactagtttaattcgtgaagtccgtgaagcaggtgatgttattcttttcattgatgaggttcacaatcttattggatctggaactgttggaaagggtaagggttctggcctggatattagcaatttgctaaagccgccacttgcaagaggcgaactgcagtgcattgcagctacgactctagatgaacaccggatgcattttgagaaggataaggctttggcccgtaggttccagccagtattcgtagatgagcctagccaggaagatgctgtggaaatactacttggtcttcgtgagaattatgaaatttatcataaatgcaaattcactctagaagccatcaatgcagctgtttatttgtcagcaagatatatccctgacagacagcttcctgataaggctattgatcttattgatgaagctggcagtagagctcgaattgagacatttcaaaagaggaaggaagggcagtcttctgttctcttaaaggcaccagatgaatactggcaagagataaaagctgtgcaggccatgcatgaagtggtattatctaacaagatgaaatattctccaaatgagaatgatcaacatagtgacaatggtaacaatgaagcgccaaatcaggataaggctggatcagcatccacctcgcccgtctcaattgaggagccagttgtagttggaagagaagaaattgcaagagtcacctcattatggtcgggtataccagtccagcagctcactgctgatgacagaaagatcttagtaggactagatgatgagctcaaaatgcgtgttattggtcaagatgatgctgttgtggcaatatcaagagcagtgaagagatcacgtgttggactcagtgaccctgacagacctatcgctacatttcttttttgtggtcctacaggggttggtaaaactgagcttaccaaagctctagcggcgagctactttggatcggaatctgctatgcttaggttagacatgagcgaatatatggaaaggcacacagtgagcaagttgataggctctcctccagggtacatcggatatggtgaaactggtactttgacagaggcagtcaggagaaaaccatttaccgtggtactgcttgatgagatagagaaagctcaccctgatattttcaacattcttctccaaatttttgaagatgggcatctggcagactcgcagggtcgcagagtttcgttcaagaatacattgattgtcatgacatcaaatgttggttctacatcaatttctgacggacgacggagcataggcttctcaacagatgaaactgagtcaagcacatatattgcaatgaaatccctcgtgatggaagagctgaaggcattttttcgtccagaattgctcaacagaatcgatgagatggttgtgttccgtcctttagagaagactcagatgctagcaattcttgatatcatcctacaagaactgaagggtaagctcttggcccttgggataggcttagaggtttcagatgcaatgaagagcctgatttgccaagaaggctatgacaagagctacggtgcgcgaccactgagaagagctgtcacccaactgatggaggatgtcatcagtgaggcaattcttttcggtgagtacaagcctggcgacacgatactggtggataccgacaaggatgggaaaccttgcttgagccgattgaaccaacagatcgtccaactgtctgacccaacacggacactctaatgctcttgtagagtagagtagaggtctaattttttattctttcatgcaacgagattagtaattctttgataggtagacaccgaatatatttcattatgtatagatataacaatcgggaatccgtccaagcagccttgttcagaatccaactgtatattgtccctcggttagcaaatacggagtatattatattttgaaacagctctgctgccggaagttactgctaggacttctccgtgtgcatcttcctggaatggatattttgga

SEQ ID NO: 4855 - DNA, 3274 bp, Setaria italica
cgcctccgagtagtagagttacagattaccttacgagccaagtagaacaagcgcatcgctcgacacgtagcgagcgtgattagtagttaggagtgtatagtttctccaagcaaagcatttcattcgttcgtattaagcggctaaagatagtgctgattttccccccctccggaagctagcgatggaggtgtgctgctgctcgacctcgtcgtcggtcctcgcggggggccgcgggggcgcggcacggaggctggccgccccggcggcggcgcggtggggcgcggcggggttctggaacagggcggtggtgctggcgcacccgctcccgcgccgggcgtcgtcctcgaggccgtccccgcggcgggcgcggaggggcctgatcatggcggtgttcgagcgcttcacggagcgggccgtcaaggcggtcgtgctgtcgcagcgggaggcccgggggctcggggaggccgccgtggcgccgcgccacctcttcctcggcctcgtcgcggaggaccgctcgtccggcgggtacctctcgtcggggattggcatcgagcgcgcgcgggaggagtgccgcggcatcggcgccagggacgtggacgcgccgccgccgccgccgcccaagaccggatcggggctcgacaccgacgtgcccttctccgcggccagcaagcaggtcttcgaggtcgccgtcgtgctgtcaaagaacatggggtccagcttcatctcgccggagcacctcgccatcgcgctcttcaccctcgacgatcccaccaccaacaacctcctcaggagtttgggagcagatccgagtcagctttcatcagttgcagtcgaccgtctccaagcagagcttgcgaaagatggaagagatcccgcaggagcatcatctttcaaaatcccagagaaggctcctgcagcagctggaagatctgctttctcccaatccttgactaaaaagaaagggaagggtgcactagatcagttttgtttggatttgaccacacaagctagtggaggtttcatcgatcctattattggccgtgaagaggagattgaaagagtggttcagataatatgccgacggacgaagaacaatcctattcttttgggtgaggcaggagttggcaaaactgcaattgctgagggactggctcttcgaattgcaaatggcgatgtccccatttatcttgtggcaaagcgtatattgtcactggatgttggtctacttatcgctggtgcaaaagagaggggtgaattggagtctagggttactaatataattcgtgaagtccgggaagcaggcgatgttattctttttattgatgaggttcacaatcttattggatctggaaccgttgggaagggtaagggttctagccttgatattggcaacttgctgaaacccgcgcttgctagaggtgaactgcagtgcattgcagcaacaactctagatgaacaccgaatgcattttgagaaggataaggctttggcccgccgcttccagccagtattagtagctgagcctagtcaggaagatgctgtgaagatattgcttggtcttcgtgagaaatacgaaacgtaccataaatgcagattcacattagaagccatcaatgcagcagtttatctatcagcaagatatatccctgacagacagcttcctgataaggctattgatctaattgacgaggctggaagtagagctcggatggagtcatttaacaggaagaaggaagggcagtcttcaattctcttgaagtcaccagatgaatattggcaagagataagagctgcacaggccatgcatgaagtggtgttatctaacaaggaaaaatattctccaaatgcgaatgatcaagagagtggtaatgctgatgttgaagcaccatatgaagacaatagagggtcaacatcaacctcatcactctcagctgatgagccaattgtagttgggacagaggaaattgcaagagttgcctcattatggtcagggataccagttcagcagttgactgctgatgataaaaagcttctagtaggactagatgatgagctcaggaaacgggtcattggccaagatgatgcagttgtggccatatctcgtgcagtgaagagatcgcgtgttggccttaatgaccctgacagacctattgctacactgcttttctgtggtccaacaggagttggtaaaacggagcttaccaaggctctagcagcaagttattttggatcagaatctgctatgcttagattagacatgagcgagtatatggagaggcacactgtgagcaagctgatcggctctcctccagggtacattggatatggtgaaactggtactttgacagaagcggtcaggaggaaaccatttactgtggttttgctggatgagatagagaaagcccaccctgatattttcaacatccttctccaaatctttgaggatggacatttgacagactcacagggccgcagggtttccttcaagaatacattgattgtgatgacgtccaatgttggttctacatcaatttcaaagggaagacggagcataggtttcttgaaggaagatactgagtcaagctcatatgtcgcaatgaaatccctagtaatggaagagctgaaggcatttttccgaccagagttgctcaacagaattgatgagatggtcgtgttccgtcctctagagaagactcagatgctggccattcttgatatcatcctgaaggaagtgaagggcaggcttttggcccttgggataggcttggaggtgtctgatgcaatgaaggacctgatctgccaagaggggtacgacaagagttacggtgcgcggccgctgcggagggctgtcacccacatgattgaggatgtcatcagcgaagcgattcttttcggcgaattcaagcccggcaacaccatactgatggacattgatgccgaggggaagccgtgcatgagccatctggaccaacagatcgtccaggtcactgacccaacacgggcattctgaagctctgcaccggatgcccttttgttgtgattccagatttccagtatagtagagagtagaggtctaattttttattctttcaagcgtcgagattaataattctttcatacgtagacagagtattccattatgtacatatcaacaagataggggaatttgggcagctactaatgttgttccgagattttatccaactgtatattgccgaatgggtcccgttcaattgatcaaatatatatcattctgaaattgagaatgttgccc

SEQ ID NO: 4856 - DNA, 3329 bp, Zea mays
actcatccactcgccacgccacgccacgccacgcctccaactccaagcagatagatagactagatagctgttggcgtgcgacgcgtagcgagagcgtgactaaccgctgcctaagcaagcatataagcatttgattcgttcctaggacaggggagggttaaggtagttccttaatttttcttgtttctttttttgtgtgtcgttgctggtgcggtagctatggaggtgtgctgctgctccacctcgtcgtccgtcctcaccgccgggggccgcggcgccgcggcgcggaggctggccgcgccggcggctcgctggggcgcagcggggttcgggagggcggtggtgctggcgcacccgctcccacgcccggcatccgcggccgcggcggcgcccacgcgccgggcgcgcagggggggcgtcggcgtcgtcagggcggtgttcgagcggttcacggagcgggccgtcaaggcggtcgtgctgtcgcagcgggaggcccgggggctcggggagcccgccgtggcgccgcgccacctcctcctcggcctggtcgccgaggaccgatcctcgggcggcttcctctcgtcggggatcaacatcgagcgcgcgcgcgaggagtgccgcggcatcgctgccagtgccagggacgcggactcggccaccgcggcgtctaggcccgggtcgtcggggctcgacacggacgtgcccttcgccgcgcccaccaagcaggtcttcgacgtggccgtcgtgctctccaagaacatgggctccagcttcgtctcgcccgagcacctcgccatcgcactcttctccctcgacgatccaaccaccaacaacctcctaaggagtttgggagcggatcccagtcatctagcatcggttgcagtcgaccgtctccaagcagagcttgcgaaagatggcagagatcctgctgaaccatcatctttcaaagttccaaagaaagcccctgctgcagccggaagatctgccttctcccagtccttgactaaaaagaaagataagggtgcgctggatcaattttgtttggatttgaccacacaagctagtggaggtttcattgatcctattattggccgtgaagaagagattgaaagagtagttcagatagtatgccggcggacgaagaacaaccctattcttttgggtgaggcgggtgttggcaaaactgcaattgccgagggtctggctcttcgaattgcaaatggagatgtccccatttaccttgtggcaaagcgcatattgtcgctagatgttggtctccttattgctggtgcaaaggagaggggtgaactggagtctagggttactaatataatccgcgaggtccgggaagcaggcgatgttattctttttattgatgaggtccacaaccttattggatctggaactgttggaaagagtaagggttctggtcttgacattggcaacttgctgaagcccgcgcttgctagaggtgaattgcagtgcattgctgctacaactctagatgaacaccggatgcattttgagaaggataaggctttggcccgccgcttccagccagtactagtagatgagcctagtcaggaagatgctgtgaagatattactgggtcttcgtgaaaaatatgaaacttaccataaatgcaaattcacattggaagccatcaatgcagcagtttatttgtcagcaagatacattcctgacagacagcttcctgataaggctattgatctgattgatgaggctggaagtagagctcggatggaatcatttaataggaagaaggaagggcagtcttcgattctcttgaagtcaccagatgaatactggcaagagataagagctgctcaggccatgcatgaagtggtgttatctaacaaggaaaaatattctccaaatgagaatgctgaagagagtggtagtgctaacgttgaagcactacacagagacaatattgagtcaacatctacttcatcactctcagctgatgaaccagttgtagttgggacagaggaaattgcaagggttgcctcattatggtctgggataccagtacagcagttgactgccgacgataaaaaacttctagtaggactggacgacgaactcagaaaacgtgtcattggccaagatgatgctgttgtggccatatctcgtgcagtgaagagatcacgtgttggccttaacgatcctgatagacctattgctacgctgcttttctgtggtccaacaggagttggtaaaacagagctcaccaaagctctagcagctagttattttggatcggaatctgctatgcttaggttagacatgagcgagtatatggagaggcacactgtgagcaagctcataggctctcctccagggtacattgggtatggtgaaactggtactttgacagaagcagtcaggagaaaaccatttactgtggtattgttggatgagatagagaaagctcaccctgatattttcaacatccttctccaaatatttgaggatggacatttgacagactcacagggtcgcagggtttccttcaaaaatacgttgattgtcatgacttcgaatgttggttcaacatcaatttcaaaaggaagacagagcataggtttcttgaaggaagataccgagtcaggctcatacttcgcaatgaaatccttagtgatggaagagctcaaggcatttttccgtccagagttgctcaatagaatcgacgagatggttgtgttccgtcctctggagaagactcagatgctggccattcttgatatcatcctaaaggaagtcaagggccgacttttggccctcgggataggtttggaggtgtctgatgcaatgaaggacctgatatgccaagagggctacgacaaaagctatggcgctcggcctctgaggagagctgtcacccacattatcgaggatgtcatcagcgaagcgattctttttggcgagttcaagcccggtgacacgatactgatggacatcgatgcagaggggaagccatgcatgggccatctggaccaacagatcgtccaggtctctgacccaacacgggcaatctgaagctgtgttggaccttttccagtgtagtagattagggatctaaatcttttattctttcaagcatcgagattattaattctttgttacgtagatatatagagtagtatttcattatgtatatatatcaaccagatgatccagataggggaatctggtcagtcattggagttatttgaaattttcatccagctgtatgtatattgttgaattgtttctgattcaactggccatatatatcatcattaaactatcttcatcggcttacc

SEQ ID NO: 4857 - DNA, 3280 bp, Sorghum bicolor
ttgttgttgttgttgttggcgcggccgtgtagcgatggaggtgtgctgctgctcgacctcctcgtcgtcgtccgtcctcaccgtgggccacggcggcgccgcgcggatgctggcggcgccggcgggtcggtggggcgcggcggcggggttcgggagggcgatggtgctggcgcaccagctcccgctcccgctcccgctcccgctcccgcgcccggcagccagggccagggccaggccggccccgcggcgccgcaggggaggaggagtcgtcagggcggtgttcgagcggttcacggagcgggccgtcaaggcggtggtgctgtcgcagcgggaggcccgggggctcggggagcccgccgtggcgccgcgccacctcttcctcggcctcgtcgccgaggaccgctcctcgggcgggttcctctcgtccgggatcaacatcgagcgcgcaagggaggagtgccgcggcatcgctgccgccagggacgacgccgactcgacggccgcgccgtcgtccaggcccggatcgggggggctcgacacggacgtgcccttctccgccaccgccaagcaggtcttcgatgtcgccgtcgtgctgtccaagaacatgggcgccagcttcatctcgcctgagcacctcgccatcgcgctcttcaccctcgacgatccaaccaccaacaacctcctaaggagtttgggagcggatcccagtcacctagcatcagttgcggtcgaccgtctccaagcggagcttgcgaaagatggcagagaacctgccgaaccgtcgtctttcaaagtcccaaagaaagcccctgctggagccggaagatctgccttctcccactccttgactaaaaagaaagataagggtgcactggatcaattttgtttggatttgaccacacaagctagtggaggtttcattgatcctattattggccgtgaagacgagattgaaagagtagttcagataatatgccgacggacgaagaacaaccctattcttctgggtgaggcgggtgttggcaaaactgcaattgctgaggggctggctcttcgaattgcaaatggagatgtccccatttaccttgtggcaaagcgtatattgtcactggacgttggtctacttattgctggtgcaaaggagaggggtgaactggagtctagggtcactaatataatccgtgaagtccgggaagcaggcgatgttattctttttatcgatgaggttcacaatcttattggatctggaactgttggaaagggtaagggttctggtcttgacattggcaacttgctgaagcccgcacttgctagaggtgaactgcagtgcattgcggctacaactctagatgaacaccggatgcattttgagaaggataaggctttggcccgccgcttccagccagtattagtagatgagcctagtcaggaagatgctgtgaagatattactgggtcttcgtgagaaatatgaaacttaccataaatgcaaattcacattggaagccatcaatgcagcagtttatttgtcagcaagatacattcctgacagacaacttcctgataaggctattgatctgattgatgaggctggaagtagggctcggatggaatcatttaataagaagaaggaagggcagtcttcaattctcttgaaatcaccagatgagtactggcaagagataagagctgctcaggccatgcatgaagtggtgttatctaacaaggcaaaatattctccaaatgagaatgctcaagaaagtggtagcgctaccgttgaagcaccaagtcgagacaatatcgagtcaacatctggttcctcactctcagctgatgaaccaattgtagttgggacagaggaaattgcaagagttgcctcattatggtctggaataccagtgcagcagttgactgccgacgataaaaaacttctagtaggactagacgacgagctcagaaaacgtgtcattggtcaagatgatgctgttgtggccatatctcgtgcagtgaagagatcacgtgttggccttaatgaccctgacagacctattgccacgctgcttttctgtggtccaacaggagttggtaaaacagagctcaccaaagctctagcagctagttattttggatcggaatctgctatgcttaggttagacatgagcgagtatatggagaggcacactgtgagcaagctcataggttctcctccagggtacattgggtatggtgaaactggtactttgacagaagcagtcaggagaaaaccatttaccgtggtattgatggatgagatagagaaagctcaccctgatattttcaacatccttctccaaatctttgaggatggacatttgacagactcacagggccgtaaggtttccttcaaaaatacgttgattgtcatgacttcgaatgttggttcgacaacaatttcaaagggacgacagagcataggtttcttgaaggaagataccgagtcaagctcgtattttgcaatgaaatccttagtaatggaagagctcaaggcatttttccgtccagagttgctcaataggattgacgagatggttgtgttccgtcctctggagaagactcagatgctggccattcttgatatcatcctaaaggaagtcaagggccgacttttggcccttgggataggtttggaggtgtctgaggcaatgaagcacctgatttgccaagaaggctacgacaagagctatggtgctcggcctctgaggagagctgttgcccacattatcgaggatgtcattagtgaagctattctttttggcgagttcaagcctggtgacacgatactgatggacattgatgcagaggggaagccatgcatgaaccatctggaccgacagatcgtccaggtctctgacccaacacggacgttctgaagttctgtgccggactttctgaagttgtacttccagtgtagtagactagggatctaatcttttattctttcaagcatcgtgattattaattctttcatacatagatatatagagtagtattccatcttgtacatatatcaaccagatggtccagataggggaatctggtcagttattgacgttgtttgaaattttcatccaactgtatgtatatttgttgaattgtttccgattcaattggccacatgtatcattcttataccgtctatgcctccgcttgccagaaggtacagttcatgactattgttctgttaccattcaactgactatatgtatatcattctaataccgtctactccagtcggttgcttc

SEQ ID NO: 4858 - DNA, 3269 bp, Sorghum bicolor
gttgttggcgcggccgtgtagcgatggaggtgtgctgctgctcgacctcctcgtcgtcgtccgtcctcaccgtgggccacggcggcgccgcgcggatgctggcggcgccggcgggtcggtggggcgcggcggcggggttcgggagggcgatggtgctggcgcaccagctcccgctcccgctcccgctcccgctcccgcgcccggcagccagggccagggccaggccggccccgcggcgccgcaggggaggaggagtcgtcagggcggtgttcgagcggttcacggagcgggccgtcaaggcggtggtgctgtcgcagcgggaggcccgggggctcggggagcccgccgtggcgccgcgccacctcttcctcggcctcgtcgccgaggaccgctcctcgggcgggttcctctcgtccgggatcaacatcgagcgcgcaagggaggagtgccgcggcatcgctgccgccagggacgacgccgactcgacggccgcgccgtcgtccaggcccggatcgggggggctcgacacggacgtgcccttctccgccaccgccaagcaggtcttcgatgtcgccgtcgtgctgtccaagaacatgggcgccagcttcatctcgcctgagcacctcgccatcgcgctcttcaccctcgacgatccaaccaccaacaacctcctaaggagtttgggagcggatcccagtcacctagcatcagttgcggtcgaccgtctccaagcggagcttgcgaaagatggcagagaacctgccgaaccgtcgtctttcaaagtcccaaagaaagcccctgctggagccggaagatctgccttctcccactccttgactaaaaagaaagataagggtgcactggatcaattttgtttggatttgaccacacaagctagtggaggtttcattgatcctattattggccgtgaagacgagattgaaagagtagttcagataatatgccgacggacgaagaacaaccctattcttctgggtgaggcgggtgttggcaaaactgcaattgctgaggggctggctcttcgaattgcaaatggagatgtccccatttaccttgtggcaaagcgtatattgtcactggacgttggtctacttattgctggtgcaaaggagaggggtgaactggagtctagggtcactaatataatccgtgaagtccgggaagcaggcgatgttattctttttatcgatgaggttcacaatcttattggatctggaactgttggaaagggtaagggttctggtcttgacattggcaacttgctgaagcccgcacttgctagaggtgaactgcagtgcattgcggctacaactctagatgaacaccggatgcattttgagaaggataaggctttggcccgccgcttccagccagtattagtagatgagcctagtcaggaagatgctgtgaagatattactgggtcttcgtgagaaatatgaaacttaccataaatgcaaattcacattggaagccatcaatgcagcagtttatttgtcagcaagatacattcctgacagacaacttcctgataaggctattgatctgattgatgaggctggaagtagggctcggatggaatcatttaataagaagaaggaagggcagtcttcaattctcttgaaatcaccagatgagtactggcaagagataagagctgctcaggccatgcatgaagtggtgttatctaacaaggcaaaatattctccaaatgagaatgctcaagaaagtggtagcgctaccgttgaagcaccaagtcgagacaatatcgagtcaacatctggttcctcactctcagctgatgaaccaattgtagttgggacagaggaaattgcaagagttgcctcattatggtctggaataccagtgcagcagttgactgccgacgataaaaaacttctagtaggactagacgacgagctcagaaaacgtgtcattggtcaagatgatgctgttgtggccatatctcgtgcagtgaagagatcacgtgttggccttaatgaccctgacagacctattgccacgctgcttttctgtggtccaacaggagttggtaaaacagagctcaccaaagctctagcagctagttattttggatcggaatctgctatgcttaggttagacatgagcgagtatatggagaggcacactgtgagcaagctcataggttctcctccagggtacattgggtatggtgaaactggtactttgacagaagcagtcaggagaaaaccatttaccgtggtattgatggatgagatagagaaagctcaccctgatattttcaacatccttctccaaatctttgaggatggacatttgacagactcacagggccgtaaggtttccttcaaaaatacgttgattgtcatgacttcgaatgttggttcgacaacaatttcaaagggacgacagagcataggtttcttgaaggaagataccgagtcaagctcgtattttgcaatgaaatccttagtaatggaagagctcaaggcatttttccgtccagagttgctcaataggattgacgagatggttgtgttccgtcctctggagaagactcagatgctggccattcttgatatcatcctaaaggaagtcaagggccgacttttggcccttgggataggtttggaggtgtctgaggcaatgaagcacctgatttgccaagaaggctacgacaagagctatggtgctcggcctctgaggagagctgttgcccacattatcgaggatgtcattagtgaagctattctttttggcgagttcaagcctggtgacacgatactgatggacattgatgcagaggggaagccatgcatgaaccatctggaccgacagatcgtccaggtctctgacccaacacggacgttctgaagttctgtgccggactttctgaagttgtacttccagtgtagtagactagggatctaatcttttattctttcaagcatcgtgattattaattctttcatacatagatatatagagtagtattccatcttgtacatatatcaaccagatggtccagataggggaatctggtcagttattgacgttgtttgaaattttcatccaactgtatgtatatttgttgaattgtttccgattcaattggccacatgtatcattcttataccgtctatgcctccgcttgccagaaggtacagttcatgactattgttctgttaccattcaactgactatatgtatatcattctaataccgtctactccagtcggttgcttc

SEQ ID NO: 4859 - DNA, 1780 bp, Secale cereale
tcagatcgcttccacacgatcgaactcagccgagagattctggactgttccacgcgatccatgacgtccacggtgaccacgcccacgcccagccgcccgctcccggcggggccccagcgccgccggtaccggcccaccgtgctcgccatcgccggcggtagcaagcccccgcggcgccgggcgcccgccgccgccaccagctgcgccgcgctcgtggcgcccgagaagcagagcacggcctccgctaagatccaaccttcgcccgcgcaggtgccggtgcccgagggcacggactacgacgaggtggccgccacgctggagacgctgtacaagctgagccccgtcatcgtcgaggaggacgagaagaggagcaagaagcaggcggccaccaagacgaagaggaagcaggggaggaagaactcggcagcagcgacgacgacgacgacggcgacgccgaggaggacagtggtggtcaggagccagcggcaacgccggatggacctcgggaagagggtggagatgcgggatctggccgccggcaaggaggacgagcaccgggacggggagcgcgcgttcgaggaggcgctgctgcgggagcacgccgtgtcgacggacatgggcagcctcgactggaggcggatgaagatcccgccggtgctctccgccccgcagagcgcccgcctcttcaagatcatgcagcccatgaaggccattttggaggtgcaagagaacctgcggaacgagctgcagagggagccgacggacgcagaggtcgccgaggccatgaacatgccggtgcagcggctacggcggctccgcgacgtcggccgggcggcgaggaacaagctcatcaagcacaacctacggctcgtcctgtacgcgatcaacaagtactacccggacatgaccggcgacgagaggttcgccgacctgtgccaggccggcgccaacgggctcatcacggccatcgaccgcttcgagcccaagcgcggcttccgcatctccacctacgcgctcttctggatccgccactccgtcgtccgcgccatgacgctctccagcttcacccgcttcccattcgccatggaatcggagaggcaggagatcaacagggctcgggaggagctgtcgttcgagctcgggaggacgccgacggacgaggagacgatgaagaaagtggggctgtcgccggcgaggtaccgcgacgtggtgcggatgacgaggccgacctactcgctccactcgcggaaccgtgtcacgcagaaggagctcatcaacgaggtcaccgacgtcgacgccatcggggtcgacacccacaagcacaaccgcctcctccgcctcgccattgacgacctcctggattcgctgaagcccaaggagagcgtggtgatcaggcagaggttcgggctggacggcagggggcggcgcacgctgagcgagatcgccggcaacctgaggatctcgagggagatggtgcgcaagtacgagctcaaggcgctcatgaagctcaagcaccccacccgggtcgactacctacgaagatacatgtgaaatcatctgtatctctgtcgcccacacacataccgttctctaatttgattacgctgcatatactgtagtacattgcaagatggcatagactcatcattgattccgtatttcggacatgtatataagtctgtatatacgagtgaggttgtatatataatatttgatttagacctcgcgctgatgtaattcatagcacgcagaaaagaaaatggtctctggtttattagaa

SEQ ID NO: 4860 - DNA, 1743 bp, Avena sativa
ctgagctcagactttctagacggttctgtcgatcgcgatcccacccgatcatcgccgatgacgtccacggtgaccacgcccagccggccgctctcggcgggtggccagcgccggcggtacaggcccacggtgctcgccatcgccggcggggcaaagtcgccaaagcgccgagccccggccgccaaagcgctcgcgtcgaagcagagcacggccgtggccaagctccctcctccgccggcgccgtcggaggaggcgggcgtgatcagcacggactacaacgaggttgccgccgcgctggagacgctgtacaagcggagcccggccctggtggaggaggacgagcagagcaagaaggcgacgaagaagaagcggaaggggaggaagaaggcggcggcggggacgacgaccaccacgccgacgaggacgacggtggtggtgcggagccggcggcggcggcggatggacctggggaagagggtggagatgagggaggccgcggctaaggaggaggtgggcgaggagcgcgggttcgaggaggcgctgctgagggagcacgccgtgtcgacggacatgggcagcctggactggaggcggatgaagatcccgcccgtgctctccgccgcgcagagcgcccggctcttcaagatcgtgcagcccatgaaggcgattttggaggtgcacgagaaccttcagagcgaactggagagggagccgacggacgtcgaggtcgccgaggccatgaacatgcccgtgcagcggctgcggcggtgccgcgaggtcggccgggctgccaggaacaagctcatcaagcataaccttcgtctggtcctgtacgcgatcaacaagtactacccggacatgaccggcgacgagcggttcgccgacctgtgccaggccggcgccaacgggctcatcacggccatcgaccgcttcgagcccaagcgcggcttccgcatctccacctacgcgctcttctggatccgccactccgtcgtccgcgccatgacgctctccagcttcacccggttccccttcgccatggaatcggagaggcaggagatcaacagggcgagggaggagctggccttcgagctcgggagggcgccgacggacgaggagacgatgaagaaagtggggctgtctccggcgaggtaccgcgacgtggtgcggatgaccaggcccacctactcgctccactcccggaaccgtgtcacgcaggaggagctcatcaacgaggtcaccgacggcgacgccatcggggtcgacacccacaagcacaaccgcctcctccgcctcgccatcgacgacctcctcgattcgctgaagcccaaggagagcgtggtgatccggcagaggttcgggctggacggaagggggaggcgcacactgagcgagatcgccggcaatctgaggatctcgagggagatggtgcgcaagtacgagctcaaggcgctcatgaagctcaagcaccccacacgggtcgactacctacgaagatacatgtgatgaaaccaattgtgtccatctcgatcgcgcacatacatactaccaattctctattcggatttatgttgtgtatatatattcatggcgacataggaatcactaatcccctgtttcagatatgtatatatgcagctgtgttcatgggtttatatatgcaatatactgtatattcaactgaagttgcaccaatttgatgtgtacctctcggatgatgtaattttaacatacagatatatg

SEQ ID NO: 4861 - DNA, 2715 bp, Triticum aestivum
ccgagccaaacccccctgctccattaaatttcataaaaccaccaccgtcacacgcctcagcctcgcctcacgcacgcacacgctcggcagccatgggcacgtcgggctccaaggggctggacggcgtcggggggctcggcgcggcggcgctcgccggcggcagcgggggcggaatgggcggggacgagggcgacggcgccgtgacggggtcgtggcacggcggcgcgcagctctacgtgtcgctcaagatggagaacgcgcggatcatcggcgacctcgtgccgcacgtctacggctccgagcccatcatcggctcatgggagcccgcccgcgccctcgcgatggagagggagctggcgtccatgtgggagctcagcttcgtcgtgccgccggaccatgaaacactcgacttcaaattcttgctcaagcccaaggatgcagagaccccttgcatcattgaggaagggccaacgcggcttctcaccgggggcatgctcgagggtgatgtgaggcttgcaaacttcaggcttaacggagatgatgagttgcttgagttcagggttttcaacaaggccgacatcgtgtctccgcttgatcttgccgcgagctggagggtatacaaagaaaatttccagccttccaaggtccggggaattcctgatatcagtataaatgaagcacccactcatgcgaccgaggatggatctggttctagtttggagcttgacttagagcattatgttgttccaacgccaactgcaccaccaactgaatatgcagcaaaccttgctgcaaccccagcatccttagatcagcctgaaacaccgtggacaaatgatatgcttcttagtgatggcattcagagtccaagaagtgctgctgcagattttaaagatgatagttaccataataaggatactgaggcttcaatagcagattcttctaattctaagaagttacaagtttctggaatggtagagtcaaaatcagttggtaccttaatacaactgcaaaagaaggacaggccacaagggctatacgttgacaggggtgttgtctctcctaagcttggaaaatcatttagtgcatgttccctggcatctggccttaattttggatcaacaaaggccatgccagaagcagccggagctgttgcagctgcagctgtagctgataggttgcacggatcaaaggaggaccggaaactggctattgttctggttggcctaccagctcgtgggaaaaccttcaccgcagttaagcttacaaggtaccttcgttggctaggtcatgaaacaaaacatttcaacgttggaaagtaccgccgtctgaagcatggagcgaatcagtctgcagattttttccgccctgataaccaagaggggatcgaggcacgtaatgaggtggctgctttagcaatggaagacatgatagactggatgcacggaggaggtcaggttggtatatttgatgcaacaaacagcacaaggaaaagaagatatatgctaatgaagatggctgaagggaactgcaagataatatttctggagacaatatgtaatgatcgaaacataatcgaaaggaatgtacgcctgaaaattcagcaaagccctgattatgctgaccagccggattatgaagctggattgcaggacttccttgaacgtttgacaaattatgaaaaggtctacgagccagtgcaggaaggctcatatatcaaaatgattgatatggtaaaaggggagggtggccagttacaggtgaacaatatcagtggctatctccctgggcgtattgtctttttcttggtgaattctcatcttgcgcctcggcctattttgcttaccaggcatggtgagagtttacacaatgttagaggaagagttggtggtgacacggtgctaagtgaagacggagagctttactcaaagaaactagccaactttattgaaaagcgcctcaaaaatgagaaaactgcaactatttggactagcactctacagagaacaattttgacagcaactccaattgttggattcccaaagatacaatggcgtgctcttgatgagatcaattctggtgtatgtgatgggatgacgtatgaagagataaagaaaattatgcctgaggaatatgagtcacgcaagaaggacaagctgcgttatcggtacccacgtggggagtcttaccttgatgtgattcagaggttggagcctgttatcatcgagctcgaacgccagcgagcaccagtggtcgttatatcccaccaggccgtattacgagcgctgtactcgtattttgcggacaggcctttgagggaagttccagacatggagatgccactccataccataatcgagatacaaatgggcgtcaccggcgtcgaggagaagaggtacaagctcatggattgagaatctgagatgcaggtaggctcagcacaacagcaagttccggattgtctgttccagatacaaccatacagacagtatatacatacagttaactcaatacagtaaccagctattcatctctcctctccggacggcgtggaagtaagactaacccccccggtgtaaaatattcgaccaaaaacacctattggtcactgtaaaagaaaacatatagtaccgctaataagtaactgtaaaaagatactgtaccagaagatgtaactgctggtaatgataagaaaaatgcaggttcatcttgaaa

SEQ ID NO: 4862 - DNA, 2669 bp, Triticum aestivum
cacgcacacgctcggcaaccatgggcacgtcgggctccaaggggctggacggcgtcggggggctcggcgcggcggcgctcgccggcggcagcgggggcggaatgggcggggacgagggcgacggcgccgtgacggggtcgtggcacggcggcgcgcagctctacgtgtcgctcaagatggagaacgcgcggatcatcggcgacctcgtgccgcacgtctacggctccgagcccatcatcggctcatgggagcccgcccgcgccctcgcgatggagagggagctggcgtccatgtgggagctcagcttcgtcgtgccgccggaccatgaaacactcgacttcaaattcttgctcaagcccaaggatgcagagaccccttgcatcattgaggaagggccaacgcggcttctcaccgggggcatgctcgagggtgatgtgaggcttgcaaacttcaggcttaacggagacgatgagttgcttgagttcagggttttcaacaaggccgacatcgtgtctccgcttgatcttgccgcgagctggagggtatacaaagaaaatttccagccttccaaggtccggggaattcctgatatcagtataaatgaagcacccactcatgcgaccgaggatggatctggttctagtttggagcttgacttagagcattatgttgttccaacgccaactgcaccaccaactgaatatgcagcaaaccttgctgcaaccccagcatccttagatcagcctgaaacaccgtggacaaatgatatgcttcttagtgatggcattcagagtccaagaagtgctgctgcagattttaaagatgatagttaccataataaggatactgaggcttcaatagcagattcttctaattctaagaagttacaagtttctggaatggtagagtcaaaatcagttggtaccttaatacaactgcaaaagaaggacaggccacaagggctatacgttgacaggggtgttgtctctcctaagcttggaaaatcatttagtgcatgttccctggcatctggccttaattttggatcaacaaaggccatgccagaagcagccggagctgttgcagctgcagctgtagctgataggttgcacggatcaaaggaggaccggaaactggctattgttctggttggcctaccagctcgtgggaaaaccttcaccgcagttaagcttacaaggtaccttcgttggctaggtcatgaaacaaaacatttcaacgttggaaagtaccgccgtctgaagcatggagcgaatcagtctgcagattttttccgccctgataaccaagaggggatcgaggcacgtaatgaggtggctgctttagcaatggaagacatgatagactggatgcacggaggaggtcaggttggtatatttgatgcaacaaacagcacaaggaaaagaagatatatgctaatgaagatggctgaagggaactgcaagataatatttctggagacaatatgtaatgatcgaaacataatcgaaaggaatgtacgcctgaaaattcagcaaagccctgattatgctgaccagccagattatgaagctggattgcaggacttccttgaacgtttgacaaattatgaaaaggtctacgagccagtgcaggaaggctcatatatcaaaatgattgatatggtaaaaggggagggtggccagttacaggtgaacaatatcagtggctatctccctgggcgtattgtctttttcttggtgaattctcatcttgctcctcggcctattttgcttaccaggcatggtgagagtttacacaatgttagaggaagagttggtggtgacacggtgctaagtgaagacggagagctttactcaaagaaactagccaactttattgaaaagcgcctcaaaaatgagaaaactgcaactatttggactagcactctacagagaacaattttgacagcaactccaattgttggattcccaaagatacaatggcgtgctcttgatgagatcaattctggtgtatgtgatgggatgacgtatgaagagataaagaaaattatgcctgaggaatatgagtcacgtaagaaggacaagctgcgttatcggtacccgcgtggggagtcttaccttgacgtgattcagaggttggagcctgttatcatcgagctcgaacgccagcgagcaccagtggtcgttatatcccaccaggccgtattgcgagcgctgtactcgtattttgccgacaggcctttgagggaagttccagacatggagatgccactccataccataatcgagatacaaatgggcgtcaccggtgtcgaggagaagaggtacaagctcatggattgagaatctgagatacaggtaggctcagcacaacagcaagttccggactggctgctccagatacaaccatacagacagtatatacatacagttaactcaatacagtaaccagctattcatctctcctctccggacggcgtgaaagtaaaactaacccctccggtgtaaaatattcgaccgaaaacacctattggtcattgtaaaaaacatatagtactagtaccgctaataaggaactgtaaaaagatactgtaccagaagatgtaactgctggtaatgataagaaaaatgcagattcatctgggaagtaacaagtcaaaggattgttcc

SEQ ID NO: 4863 - DNA, 2845 bp, Secale cereale
tgccaggtggtccccacattttatcctgcgactgcgagctccgaggcctcggactccgcacccgcaccaccaccactcccatcgctctcccgaattcccccaatccgagccaaacccccctgctccattaaatttcataaaaccaccaccgtcacacgcctcagcctcgcctcacgcacgcacacgctcggcagccatgggcacgtcgggctccaaggggatggacggcgtcgggggcctcggcgcggcggcgctcggcggcggcggagggggcggaatgggcggggacgagggcgacggcgccgtgacggggtcgtggcacggcggcgcgcagctctacgtgtcgctcaagatggagaacgcgcggatcatcggcgacctcgtgccgcacgtctacggctccgagcccatcatcggctcatgggagcccgcccgcgccctcgcgatggagagggagctggcgtccatgtgggagctcagcttcgtcgtgccgccggaccatgaaacactcgacttcaaattcttgctcaagcccaaggatgcggagaccccttgcatcattgaggaagggccaacccggcttctcaccgggggcatgctcgagggtgatgtgaggcttgcaaacttcaggcttaacggagacgatgagttgcttgagttcagggttttcaacaaggccgactttgtgtctccgcttgatcttgccgcgagctggagggtatacaaggaaaatttccagccttccaaggtccgaggaattcctgatatcagtataaatgaagcacccactcatgcgaccgaggatgaatctggttctagtttggagcttgacttagagcattatgttgttccaacgccaactgcaccaccaactgaatatgcagcaaaccttgctgcaaccccagcatccttagatcaacctgaagcaccgtggacaaatgatgtgcttcttagtgatggcattcagagtccaagaagtgctgctgcagattttaaagatgatagttaccataataaggatactgaggcttcaatagcagattcttctaattctaagaagttacaagtttctggaatggtagagtcaaaatcagttggtaccttaatacaactgcaaaagaaggacaagccacaagggctttacgttgacaggggtgttgtctctcctaagcttggaaaatcatttagtgcatgttccctggcagatggccttaattttggatcaacaaaggccatgccagaagcagccggagctgttgcagctgcagctgtagctgataggttgcacggatcaaaggaggaccggaaactggctattgttctggttggcctaccagctcgtgggaaaaccttcaccgcagttaagcttacaaggtaccttcgttggctaggtcatgaaacaaaacatttcaacgttggaaagtaccgccgtctgaagcatggagcgaatcagtctgcagattttttccgtcctgataaccaagaggggatcgaggcacgtaatgaggtggctgctttagcaatggaagacatgatagactggatgcacggaggaggtcaggttggtatatttgatgcaacaaacagcacaaggaaaagaagatatatgctaatgaagatggctgaagggaactgcaagataatttttctggagacaatatgtaatgatcgaaacataatcgaaaggaatgtacgcctgaaaattcagcaaagccctgattatgctgaccagccagattatgaagctggattgcaggacttccttgaacgtttgacaaattatgaaaaggtctacgagccagtgcaggaaggctcatatatcaaaatgattgatatggtaaaaggggagggtggacagttacaggtgaacaatatcagtggctatctccctgggcgtattgtctttttcttggtgaattctcatcttgcgcctcggcctattttgcttaccaggcatggtgagagtttacacaatgttagaggaagagttggtggtgacacggtgctaagtgaagacggagagctttactcaaagaaactagccaactttattgaaaagcgcctcaaaaatgagaaaactgcaactatttggactagcactctgcagagaacaattttgacagcaactccaattgttggattcccaaagatacaatggcgtgctcttgatgagatcaattctggtgtatgtgatgggatgacgtacgaagagataaagaaaattatgcctgaggaatatgagtcacgtaagaaggacaagctgcgttatcggtacccgcgtggggagtcttaccttgacgtgattcagaggttggagcctgttatcatcgagctcgaacgccagcgagcgccagtagttgttatatcccaccaggctgtattgcgagcgttgtactcgtatttcgccgacaggcctttgagggaagttccagacatggagatgccactccataccataatcgagatacaaatgggcgtcaccggcgtcgaggagaagaggtacaagctcatggactgagaatctgaggtacaggtaggctcagcacaactgcaagctccggattcgctgttccagatacaaccatacagacagtatatacatacagttaactcaatacagtaaccagctattcatctctcctctccggacggcgtgaaagtaaaactaacccctccggtgtaaagtattcgaccgaaaacacctattggtcattggtaaaaaaaaacatataatatcgctaataaggaactgtaaaaaagatactgtactagaagatgtaactgctggtaatgataagaagaatgcagattcatcttggaagtaacaagtcaaagaattgttccc

SEQ ID NO: 4864 - DNA, 2591 bp, Hordeum vulgare
tcgggctccaaggggatggacggcgtcgggggcctcggctcggcggcgctcgccggcggcggcggggacggaatgggcggggacgagggcggcggcgccgtgacggggtcgtggcacggcggcgcgcagctctacgtgtcgctcaagatggagaacgcgcggatcatcggcgacctcgtgccgcacgtctacggctccgagcccatcatcggctcctgggagcccgcccgcgccctcgcgatggagagggagctggcgtccatgtgggagctcagcttcgtcgtgccgccggaccatgaaacacttgacttcaaattcttgctcaagcccaaggattcggagaccccgtgcataattgaggaagggccgacgcggcttctcaccgggggcatgctcgagggtgatgtgaggcttgcaaacttcaggcttaatggagacgatgagttgcttgagttcagggttttcaacaaggccgacatcgtgtctccgcttgatcttgccgcgagctggagggtatacaaggaaaatttccagccttccaaggtccgaggaattcctgatatcagtataaatgaagcacccactcatgcgaccgaggatggatctggttctagtttggagcttgacttagagcattatgttgttccagcgccaactgcaccaccaactgaatatgcagcaaaccttgctgcaaccccagcatccttagatcaacctgaagcaccatggacaaatgatatgcttcttagtgatggcattcagagtccaagaagtgctgctgcagattttaaagatgacagttaccataataaggatactgaggcttcagtagcagattcttctaattctaagaagttacaagtttctggaatggtagagtcaaaatcagttggtaccttaatacaactgcaaaagaaggacaagccacaagggctttacgttgacaggggtgttgtttctcctaagcttggaaaatcatttagtgcatgttccctggcatctggccttaattttggatcaacaaaggccatgccagaagcagccggagctgttgcagctgcagctgtagctgataggttgcacggatcgaaggaggaccggaaactggctatcgttctggttggcctaccagctcgtgggaaaaccttcaccgcagttaagcttacaaggtaccttcgttggctaggtcatgaaacaaaacatttcaacgttggaaagtaccgccgcctgaagcatggagcgaatcagtctgcagatttttttcgtcctgataaccaagaggggatcgaggcacgtaatgaggtagctgctttagcaatggaagacatgatagactggatgcacggaggaggtcaggttggtatatttgatgcaacaaacagcacaaggaaaagaagatatatgctaatgaagatggctgaagggaactgcaagataatatttctggagacaatatgtaatgatcgaaacataatcgaaaggaatgtacgcctgaaaatccagcaaagccctgattatgctgaccagccggattatgaagctggattgcaggacttccttgaacgtttgacaaattatgaaaaggtctacgagccagtgcaggaaggctcatatatcaaaatgattgatatggtaaaaggggagggtggccagttacaggtcaacaatatcagtggctatctccctgggcgtattgtctttttcttggtgaattctcatcttgcgcctcggcctattttgcttaccaggcatggtgagagtttacacaatgttagaggaagagttggtggtgacacggtgctaagtgaagatggagagctttactcaaagaaactagccaactttattgaaaagcgcctcaaaaatgagaaaactgcaactatttggactagcactctacagagaacaattttgacagcaactccaattgttggattcccaaagatacaatggcgtgctcttgatgagatcaactctggtgtatgtgatgggatgacgtatgaagagataaagaaaattatgcctgaggaatatgagtcacgcaagaaggacaagctgcgttatcgatacccgcgtggagagtcttaccttgatgtgattcagaggttggaacctgttatcatcgagctcgaacggcagcgagcaccagtggtcgttatatcccaccaggccgtactgcgagcgttgtactcgtattttgccgacaggcctttaagggaagttccagacatggagatgccactccataccataatcgagatacaaatgggcgtcaccggcgtcgaggagaagaggtacaagctcatggactgagaatctgaggtacaggtaggctcagcacaacagcaagctccgggttcgctgttgcagatacaaccatacagacagcatatatacagttaactcagtacagtaaccagctattcatctctcctctccggacggcgtgaaagtaaaaactaacccctccggtgtaaaatattcgaccgaaaacacctattggtcattgtaaagaaacataaactgctaataaggaactgtaaaaaaatcactgtaccagaagatgtaactgctggtaatgataaggaaaa

SEQ ID NO: 4865 - DNA, 2578 bp, Brachypodium distachyon
ggcagccatgggcacgtcggggtccaagggcatggacggcgtcgggggcgtcggcgcggcggcggcggcgggcggcgccggaatccaggacgaggacggcgtcggcggcgcggggatggaatcgtggcacggcggcgcgcagctctacgtgtcgctcaagatggagaacgcgcggatcatcggcgacctcgtgccgcacgtctacggatccgagcccatcatcggctcctgggaccccgcccgcgctctcgccatggagagggagctggcgtccatgtgggagctcagcttcgtcgtgccgccggaccatgaaacactctacttcaaattcttgctcaagcccaaggacgcggagacgccatgcgtcatcgaggaaggacccacgaggcttctaaccggaggcatgctcgagggtgatgtgagggttgcaaacttcaggcttaatggagacgatgaggtgcttgagttcagggtgttcaacaaagcggacattgtttctccgcttgaacttgccgcgagctggagggtatacaaggaaaacttccagccttcccaggtccggggaatcccagacgtcagtataaacgttgcacctgctcatgcaaccgaggacggatctggttctagtttggagcttgacttggagcattatgttgttccaacaccaactgcaccaccaactgaatatgctgcaaaccttgctgcaacccctgcatccttaattcaacctggagccttgtggacaaatgatatgcttcttagtgatggcattcagagtccaagcagtgcttctgcagattttcgagatcatagttaccataataaggatattgaggcctcggtagcagattcttctaagaagttacaagtttgtggaatggtagagtccaaatcagttggtaccttaataccattgcaaaagcaggacaggcaaaaggggctttatgttgacacgggtgttgtctctcctaagcttggcaaatcatttagtgcatgtgccctggcatctggccttagttttgcatcaacaaaggccatgccagaagcagccggagctgttgcagctgcagctgtagctgataggttgcatggatcaaaggaggatcggaaactggctattgttttggttggcctaccagctcgtggtaaaacattcaccgcagttaagcttacaaggtaccttcgttggctaggtcatgaaacaaaacatttcaacgttggaaagtaccgccgtctgaagcatggagcaaatcagtctgcagattttttccgtgctgataaccaacaggggattgaggcacgtaatgaggtagctgcattagcaatggaagatatgatagactggatgcacggaggaggtcaggttggtatatttgatgcaacaaacagcacaagaaaaagaagatatatgctaatgaagatggctgaagggaattgtaagataatatttctggagacgatatgtaatgatcggaacataatcgaaaggaatgtacgcctgaaaattcagcagagtcctgactatgctgaccagccggattatgaagctggtttgcaggatttccttgaacgcttgacaaattatgaaaaggtctatgagccagtggaggaaggttcttacataaaaatgattgatatggtaaaagggcagggtggtcagttacaggtgaacaatatcagtggctaccttcctgggcgcattgtctttttcttggtgaactcccatcttgcgcctcggcctattttgcttaccaggcatggtgagagtttacacaatgttaggggaagagttggtggtgacacagtcctgagtgaaaatggagagctttatgcaaagaaactagcgaactttatcgaaaagcgcctcaaatctgagaaaactgcaactatttggaccagcactctgcagagaacaattttgacagcaactccaattgttggattcccaaagatacaatggcgtgctcttgatgagataaattctggggtatgtgacgggatgacctatgaagagataaaaaaaattatgcctgaggaatatgagtcacgcaaaaaggacaagctgagatatcgctacccgcgtggggaatcttaccttgatgtgattcagaggttggagcctgtcattatcgaacttgaacgccagcgtgcaccagtggttgttatatcccaccaggctgtattgcgagccctgtactcatattttgctgacaggcctctaagggaagttccagacatggagatgccacttcatacaataatcgagatacaaatgggcgttaccggtgtcgaggagaagaggtacaagctcatggattgagaatcggtacacagataggctcacaagaacaaccagtttcgattccgctattccaggtacgaccatacagatgatacaattaactggttaccctttttttttggtccggatggcgtaaaactaacccctccggtgtaaagtattcgaccaacaaaccttggtcattgtaaaataaaatatatactcctaataaggaattgtaaaaaataatacatactaatggagtggtaataaggaagatatgcagattatcctggt

SEQ ID NO: 4866 - DNA, 2894 bp, Brachypodium distachyon
cctcgaactccgtacccgcaccaccaccactcccatcgctctctctcccgaatccccccaatcccaaccaaaccccacattgataaaccaccagagtcacacgctcctccagtctccctctctctccctccctctcgtgcgcgcccacgctcggcaggcagccatgggcacgtcggggtccaagggcatggacggcgtcgggggcgtcggcgcggcggcggcggcgggcggcgccggaatccaggacgaggacggcgtcggcggcgcggggatggaatcgtggcacggcggcgcgcagctctacgtgtcgctcaagatggagaacgcgcggatcatcggcgacctcgtgccgcacgtctacggatccgagcccatcatcggctcctgggaccccgcccgcgctctcgccatggagagggagctggcgtccatgtgggagctcagcttcgtcgtgccgccggaccatgaaacactctacttcaaattcttgctcaagcccaaggacgcggagacgccatgcgtcatcgaggaaggacccacgaggcttctaaccggaggcatgctcgagggtgatgtgagggttgcaaacttcaggcttaatggagacgatgaggtgcttgagttcagggtgttcaacaaagcggacattgtttctccgcttgaacttgccgcgagctggagggtatacaaggaaaacttccagccttcccaggtccggggaatcccagacgtcagtataaacgttgcacctgctcatgcaaccgaggacggatctggttctagtttggagcttgacttggagcattatgttgttccaacaccaactgcaccaccaactgaatatgctgcaaaccttgctgcaacccctgcatccttaattcaacctggagccttgtggacaaatgatatgcttcttagtgatggcattcagagtccaagcagtgcttctgcagattttcgagatcatagttaccataataaggatattgaggcctcggtagcagattcttctaagaagttacaagtttgtggaatggtagagtccaaatcagttggtaccttaataccattgcaaaagcaggacaggcaaaaggggctttatgttgacacgggtgttgtctctcctaagcttggcaaatcatttagtgcatgtgccctggcatctggccttagttttgcatcaacaaaggccatgccagaagcagccggagctgttgcagctgcagctgtagctgataggttgcatggatcaaaggaggatcggaaactggctattgttttggttggcctaccagctcgtggtaaaacattcaccgcagttaagcttacaaggtaccttcgttggctaggtcatgaaacaaaacatttcaacgttggaaagtaccgccgtctgaagcatggagcaaatcagtctgcagattttttccgtgctgataaccaacaggggattgaggcacgtaatgaggtagctgcattagcaatggaagatatgatagactggatgcacggaggaggtcaggttggtatatttgatgcaacaaacagcacaagaaaaagaagatatatgctaatgaagatggctgaagggaattgtaagataatatttctggagacgatatgtaatgatcggaacataatcgaaaggaatgtacgcctgaaaattcagcagagtcctgactatgctgaccagccggattatgaagctggtttgcaggatttccttgaacgcttgacaaattatgaaaaggtctatgagccagtggaggaaggttcttacataaaaatgattgatatggtaaaagggcagggtggtcagttacaggtgaacaatatcagtggctaccttcctgggcgcattgtctttttcttggtgaactcccatcttgcgcctcggcctattttgcttaccaggcatggtgagagtttacacaatgttaggggaagagttggtggtgacacagtcctgagtgaaaatggagagctttatgcaaagaaactagcgaactttatcgaaaagcgcctcaaatctgagaaaactgcaactatttggaccagcactctgcagagaacaattttgacagcaactccaattgttggattcccaaagatacaatggcgtgctcttgatgagataaattctggggtatgtgacgggatgacctatgaagagataaaaaaaattatgcctgaggaatatgagtcacgcaaaaaggacaagctgagatatcgctacccgcgtggggaatcttaccttgatgtgattcagaggttggagcctgtcattatcgaacttgaacgccagcgtgcaccagtggttgttatatcccaccaggctgtattgcgagccctgtactcatattttgctgacaggcctctaagggaagttccagacatggagatgccacttcatacaataatcgagatacaaatgggcgttaccggtgtcgaggagaagaggtacaagctcatggattgagaatcggtacacagataggctcacaagaacaaccagtttcgattccgctattccaggtacgaccatacagatgatacaattaactggttaccctttttttttggtccggatggcgtaaaactaacccctccggtgtaaagtattcgaccaacaaaccttggtcattgtaaaataaaatatatactcctaataaggaattgtaaaaaataatacatactaatggagtggtaataaggaagatatgcagattatcctggtagtaacaagtccaaggcttgttccttatgggtttttattttgcaccgcggctgatgagtgaaacaatgaacaatcacggctcaactggactctcaagtcatgagacctgcaaactaaacttcaaactgtcctgttccttgtgtgctgctctgctcccatg

SEQ ID NO: 4867 - DNA, 4736 bp, Oryza sativa
ggggaagggaacagtcgcccctatcgtgtgggggcccacgtctatcctcccgggtggggcccacccgcttcccccctccggacgacacccccggctaccccacccgccgcgtcgccgccgtcgccgccacacgagcccgccacaagaacggatcagtcgctgccgtgtgggccccacgcctatccaccctcccccgcgtgggccccacccgcttccctccgagctccgaagcctcgatcgaagcgcgccaccaccaccactcccatcgctctccccgattccccgccgcccaatccaatcccccaaatattccaaattcccagccaccaccaccacactagcaagctcagagctcagagctcacgactccagagagcggaggcaatggggacgtcggggtcgaaggggatcgacggcgtcgggggagtcggcggcggggcggcggggttggggggaggggaagcgggcgacggcggcggcggggtgggcggcgcggcgtcccggtcgtggcacggcggggcgcagctgtacgtgtcgctcaagatggagaacgcgcggatcaccggcgacctcgtcccgcacgtctacggctccgagcccatcatcggatcctgggaccccgcccgcgccctcgcgatggagagggagctggcgtccatgtgggcgctcagcttcgtcgtgccgcctgaccacgaaacactcgacttcaaattcttgctcaagcccaaggatgcagacaccccgtgcatcattgaggaaggtccgacccggcatctcactggaggcatgctcgagggcgatgtgaggattgcatggttcaagatgaatggggatcatgagacgcttgagttcagggttttcaataaggcagacattgtgtccccacttgatcttgcagcgagttggagggtgttcaaggagaattttcagccttccaaagtccggggaatccctgatgtcagtataaatgtcgcacctgcgcatgggaccgaggatacatctactgaaagtttggagcttgacttggagcattacgttattccaacaccatctgcagcaacatctgaatatgcagcaaaccttgccgcaaacccagcatcattgattcaaactggagctttatggacaaatgacatgcttctcagtgatggcatccagagtccaagtagcgccactgcagattttgaagatcacaataactgtaacaaggataatgtggccttgccatcagattctttcaagaagttacaagtttctggaattgtagagtcaaaatcagttgacaccttaacaacactgcaaaagcaagatggacaaaagggactttttgtagacaggggtgttggctctactaagtttggaaaatcatcaagtgcatgttccctggcttctggtcttaattttggaacaggaaaggccatgccagaagcagcaggagctgttgcagctgcagctgtagctgaccgattgcatgggtcaaaggaggaccgaaaactagctattgttttggttggcctaccagctcgtggtaaaacttttaccgcagctaagcttacaaggtaccttcgttggttaggtcatgaaaccagacatttcaatgttggaaagtaccgccgcctgaagcatggagcaaatcagtctgcagattttttccgtgatgataaccctgaagggattgaggcacgcaatgaggtggctgctttagctatggaggacatgatagattggatgcatgggggaggacaggtcggtatatttgatgcgacaaacagcacaagaaaacgaaggtatatgctaatgaaaatggctgaagggaactgtaagattatatttctggaaactatctgtaacgatccgaatataattgaaaggaatgtacgtctgaagatacagcaaagtcctgactatgctgaccagccagattatgaaactggagtgcgggacttcaaggaacgcctggcaaactatgaaaaggtgtatgagccagtgcaggaaggttcttacattaaaatgattgatatggtaaaagggcagggaggccagttacaggtcaacaatatcagtggttatctccctggaaggattgtctttttcttggtgaactctcatcttacacctcgacctattttgcttacaaggcatggtgagagtttacacaatgtcagaggaagagttggtggtgacacggtcctgagtgaagatggagagctttactcgaagaaattagccaacttcatagaaaagaggctcaaatctgagaaaactgcatctatatggaccagcacgcttcagaggacaattttgacagcaagtccaatagttggattcccaaagatacaatggcgtgctcttgatgagataaactctggggtgtgtgatgggatgacgtatgaagagataaagaaagttatgcccgaggaatttgaatcacgcaagaaggacaaattaagatatcgatacccccgtggagaatcttaccttgatgtgattcagagactggaacctgttatcattgagctagaacgccagcgagcaccagtagtcgttatttcccaccaggctgtattgcgggcgctatatgcatatttcgctgacaggcctctgagggaagtcccagatattgagatgcctctccacaccataattgagatacaaatgggagtcacaggtgttgaggagaagaggtacaagctcatggactgaatatacatacatctaggctcagtaggacagcaagtctttgctgttttcagatagtcatacagtaacacagatatacgatcgagtcactacaggtctacagctaccacattgtcatttttctcccgacggtgcaaaaacaaaaactagcacctccggtgtaaaactgtaacccactatacccatgaatcactgtaaaaagaagcattcacccaatcagtagttaaaaaaaaaaaactgtaaaataaaaggcatactgctaccaataaagagtgcagatatatacatatagggccctccctaaattttttttctaaaaacatcacatcgaatctttggacacatgcatgaagcattaaatatagataaaaaaaactaattgtacagttatggagaaaatcgcgagacgaatcttttaagcctaattagtccgtgattagccataagtgctacagtaatccacatgtgctaatgacggcttaattagtctcaaaagattcttctcgcggtttccaggcgagttctgaaattaattttttcattcgtgtccgaaaaccccttccgacatccggtcaaacgttcgatgtgacatccaaaaattttcttttccccgactaaacacacccatactgtcaaaaggtaacagaagttgtggctgatccatcactgcttagttggacttgatgagactgacctaccaaactttgaactgtcctgtcctcctgtgccatgtgaggacacaaggcaagcagtttcttgctccagaaactctgctcacatcatggcacgatgctgaatagtatgccaaaaacttccttgattccatgcggcctccatggctgctgctgctcatttgtccctgtctcaacaccccttctatctaacaaacactagtaccattttgtaaattatgtatgacgcggttgactttttattaacgtttgaccatttgttttatttaaaatttatgtgaaaatataaaaaattttatgtcatgcttaaaaaacatttgatgatgaatcaagtcataataaaataaataataattacgtaatttttttaaataagatgaatggtcaaacgttaaacgaaaagtcaatggcatcatatattattaaaatatggaggtagtactttgtaagcttgtatgcttctactactatactagtgtaatgcattgctattgccttcaaatgcatatatggtccatctatccatggcttggtgatcactagattgtgccatcatgattgcatgattgattgcacatttgcatcatttccacttgacttgagccgtcatgtctgcttcttctcctgttgcctacgacgccaatgtcctcctggccgcggtcaccgcgctctcggcggccatcgcgttcgtcgccgcgctccacctctacgcccggtgtctcctgcggcggcgcgtcgccggcgccggcgccggcgccgccggcaaccctcacgcgctgcgccgcccggtgaccccgggcggcaactacgagctcgaggtgatcagcgtcgcggcgtgcgcgctggagggcggcggcctggacgccaagcagctgggcgcgctgccggtgttcacgtgggggtcttcttctccggcgacggcggcggcggacgccgccgtgcagtgcgcggtgtgcctcggggagatggaggacggcgagctggggaggctgctcccggcgtgccgccacgtgttccacgccgagtgcatcgacacgtggctcgccgtgagctcgacgtgcccggtgtgcagggcggcggtgggggcggcggaggatgatgagccagcggcggctccggtcgctggcgtgtcgccggcgagctaggtgtgttgagtatcagtgtacattcgatcacttgctagagtttgtatctatgcacttgaaaacaaaattcgggtattttttttctttaggaaacaataaacttcgtaggatttgtacattgcaaatcaaatcgaccctgaatgagcacagagaaacttagaattctcgacaaattccaattaaaaactttatatcccac

SEQ ID NO: 4868 - DNA, 2985 bp, Oryza sativa
aacagtcgcccctatcgtgtgggggcccacgtctatcctcccgggtggggcccacccgcttcccccctccggacgacacccccggctaccccacccgccgcgtcgccgccgtcgccgccacacgagcccgccacaagaacggatcagtcgctgccgtgtgggccccacgcctatccaccctcccccgcgtgggccccacccgcttccctccgagctccgaagcctcgatcgaagcgcgccaccaccaccactcccatcgctctccccgattccccgccgcccaatccaatcccccaaatattccaaattcccagccaccaccaccacactagcaagctcagagctcagagctcacgactccagagagcggaggcaatggggacgtcggggtcgaaggggatcgacggcgtcgggggagtcggcggcggggcggcggggttggggggaggggaagcgggcgacggcggcggcggggtgggcggcgcggcgtcccggtcgtggcacggcggggcgcagctgtacgtgtcgctcaagatggagaacgcgcggatcaccggcgacctcgtcccgcacgtctacggctccgagcccatcatcggatcctgggaccccgcccgcgccctcgcgatggagagggagctggcgtccatgtgggcgctcagcttcgtcgtgccgcctgaccacgaaacactcgacttcaaattcttgctcaagcccaaggatgcagacaccccgtgcatcattgaggaaggtccgacccggcatctcactggaggcatgctcgagggcgatgtgaggattgcatggttcaagatgaatggggatcatgagacgcttgagttcagggttttcaataaggcagacattgtgtccccacttgatcttgcagcgagttggagggtgttcaaggagaattttcagccttccaaagtccggggaatccctgatgtcagtataaatgtcgcacctgcgcatgggaccgaggatacatctactgaaagtttggagcttgacttggagcattacgttattccaacaccatctgcagcaacatctgaatatgcagcaaaccttgccgcaaacccagcatcattgattcaaactggagctttatggacaaatgacatgcttctcagtgatggcatccagagtccaagtagcgccactgcagattttgaagatcacaataactgtaacaaggataatgtggccttgccatcagattctttcaagaagttacaagtttctggaattgtagagtcaaaatcagttgacaccttaacaacactgcaaaagcaagatggacaaaagggactttttgtagacaggggtgttggctctactaagtttggaaaatcatcaagtgcatgttccctggcttctggtcttaattttggaacaggaaaggccatgccagaagcagcaggagctgttgcagctgcagctgtagctgaccgattgcatgggtcaaaggaggaccgaaaactagctattgttttggttggcctaccagctcgtggtaaaacttttaccgcagctaagcttacaaggtaccttcgttggttaggtcatgaaaccagacatttcaatgttggaaagtaccgccgcctgaagcatggagcaaatcagtctgcagattttttccgtgatgataaccctgaagggattgaggcacgcaatgaggtggctgctttagctatggaggacatgatagattggatgcatgggggaggacaggtcggtatatttgatgcgacaaacagcacaagaaaacgaaggtatatgctaatgaaaatggctgaagggaactgtaagattatatttctggaaactatctgtaacgatccgaatataattgaaaggaatgtacgtctgaagatacagcaaagtcctgactatgctgaccagccagattatgaaactggagtgcgggacttcaaggaacgcctggcaaactatgaaaaggtgtatgagccagtgcaggaaggttcttacattaaaatgattgatatggtaaaagggcagggaggccagttacaggtcaacaatatcagtggttatctccctggaaggattgtctttttcttggtgaactctcatcttacacctcgacctattttgcttacaaggcatggtgagagtttacacaatgtcagaggaagagttggtggtgacacggtcctgagtgaagatggagagctttactcgaagaaattagccaacttcatagaaaagaggctcaaatctgagaaaactgcatctatatggaccagcacgcttcagaggacaattttgacagcaagtccaatagttggattcccaaagatacaatggcgtgctcttgatgagataaactctggggtgtgtgatgggatgacgtatgaagagataaagaaagttatgcccgaggaatttgaatcacgcaagaaggacaaattaagatatcgatacccccgtggagaatcttaccttgatgtgattcagagactggaacctgttatcattgagctagaacgccagcgagcaccagtagtcgttatttcccaccaggctgtattgcgggcgctatatgcatatttcgctgacaggcctctgagggaagtcccagatattgagatgcctctccacaccataattgagatacaaatgggagtcacaggtgttgaggagaagaggtacaagctcatggactgaatatacatacatctaggctcagtaggacagcaagtctttgctgttttcagatagtcatacagtaacacagatatacgatcgagtcactacaggtctacagctaccacattgtcatttttctcccgacggtgcaaaaacaaaaactagcacctccggtgtaaaactgtaacccactatacccatgaatcactgtaaaaagaagcattcacccaatcagtagttaaaaaaaaaaaactgtaaaataaaaggcatactgctaccaataaagagtgcagatatatacatataggg

SEQ ID NO: 4869 - DNA, 2895 bp, Setaria italica
gggccccgcgcagacgcggcggagccgccgccgcagcaacgcggaggacgacgctgccacgctggcaggcggccccccttgcttatcccctccggcgggccccgccctctccgctccttgcgggttccaaggcctccggctccacagcatcactcccatcgctctcccgattgcattcgccccaatccaaacggcctccctccattaaaaccccctccgccaccaccacgtccaccaccaccgccccaattccacgcccgcgtgcttgtgccgctccacttgtgctagtagccatggggacgtcggggtccaagggcatcgacggcgtgggtggcctcggctctcaggcggcgggggtcggggcggcgggcggcgacggggaggcgggcgagggcggtggcgccgcggaggcgtggcacggcggggcgcagctctacgtgtcgctcaagatggaaaacgcgcggatcagcggcgacctcgtcccgcacgtctacggctccgagcccatcatcggctcctgggaccccgcccgcgcactcgccatggagagggagctcgcgtccatgtgggagctcagcttcgtcgtcccgccggaccatgaaacggtggagttcaaattcttgctgaagcccaaagacacagcaaccccgtgcatcattgaggaagggccaacgcggctccttactggaggcatgcttgagggcgatgtgagggttgcacttttcaagcttaatggagatgatgaggtgctcgagttcagggtgttcaacaaggcggacatcgtgtcaccgctcgaactcgctgcgagctggagggtgtacaaggagaactttcaaccctccagagtccggggaatccctgatatcagtatcaatgtcgcacccactcatgcaactgaggaaggatcagcggctactttggaacttgacttggagcattatgttgttccagccccaactgcaccaccaaatgaatacgctgcaaaccttactgcgactcctgcatccttgattcaaactggagcatcgtggacaaatgatatgcttcttagtgatgggattcagagtccaagtactgtttctgcggattttgaaggctgtaataacctcaaaaagaatattgaggcctgggcaacagattcttctaaaaaattacaaggttctggactcattgagtcaaaatcagttggtacctttacaccactgcaaaagccagatggtcaaaaggggctgttcattgacaggggcgttggctctcctaagcttccaaaatcagccagtgcatactccctggcatctgggcttagttcaaagaccatgccagaagcagcaggagctgttgcagctgcagctgtagctgatcgcttacatgggtcaaaggaggaccggaagctggccattgttttggttggcttgccagctcgtggtaaaaccttcactgcagttaagcttacaaggtaccttcgttggttgggtcatgaaactagacatttcaatgttgggaagtatcgccgtctgaagcatggagcaaaccaggctgcagattttttccgtgatgataatcctgaaggtattgaggcacgtaatgaggtggctgctttagcaatggaggacatgatagattggatgcatggtggaggtcaggtcggtatatttgatgcaacaaacagcacaagaaaacgaagacatatgctaatgaaaatggctgaaggtaactgtaagattatatttttggagacaatatgtaatgatcccagaataattgaaacaaatatacggctgaagatacaacaaagtcctgactatgctgaccagccagattatgaagctggactgcaggacttcaaggaacgcttgacgaattatgagaaggtctatgagccagtgggggaaggttcttacatcaaaatgattgacatggtaaaggggcagggtggtcagttacaggtaaataatatcagtggttatctccctgggcggattgtctttttcttggtgaactctcatcttacaccacggcctattttgcttaccaggcatggtgagagtttacataatgtaagaggacgagttggtggtgattcagtcctaagtgaagctggagagctgtatgcaaataaactagccaactttatagaaaagcggctcaaatctgagaaaacagcaactatatggactagcacccttcagagaacaattttgacagcaagtccaattattggattcccaaagatacaatggcgtgctcttgatgagatcaattctggagtttgtgatgggatgacatatgaagagataaagaaaattatgcccgaggagtatgagtcacgcaggaaggacaagcttagatatcgctaccctcgtggagagtcttacctcgacgtgatacagaggttggaacccgtcatcatcgagctagaacgccagcaggcaccagtggtggtcatatctcaccaggctgtactgcgagcactatacgcatatttcgcagacaggcctttgagagaagttccaaacatagagatgccactacataccataatcgagatacagatgggagtcactggtgtcgaagagaagaggtacaagctcatggactgaattgtgaatacacataaaggcagcaggctggctgttttgtatagtcatacacagcaaatatagataacacaaatactggagtacagttacccgatttttaactttgcccagacggtgttaaaccaagtccgttgtaaattttattgaaaatacgtatttgatcattgtaaaggcaaacatattactaataaggaactgtaaaaataacacgcttactgccacaactggcaagtgaagaatgcagacaaacttgaaataaacaactccagaccctgttcataagatatatgagcag

SEQ ID NO: 4870 - DNA, 2923 bp, Sorghum bicolor
aggacgccgcgcgcagacgcggcggagccgccgccgcagcagctcggatgccggcgttggcaggttggacgcctccccttatcccctccggcgggccccgcacgctccgtcccttgcggactccgagacctgcgggtcactcccatcgctctcccggttgcattcgccccaatccaaacgccaacggcctccctccattacaagacctcccccccctccactccaccaccaccggccaccaccgccccgattccactcccacgtgctgctccacctgcgccgccacgtcacgcctctaggctctagccatggggacgtcggggtccaagagcatcgacggcgtgggcgccgtctcgggcgtcggcgccgccgcggcggggctgggcggcgccggcggggagggcggcgagggcggcgccgcggaggcgtggcacggcggggcgcagctgtacgtgtcgctcaagatggagaacgcggagatcagcggcgacctcgtcccgcacgtctacggctccgagcccatcatcggcacctgggacccttcccgcgccctcgccatggagagggagctcgcgtctatgtgggagctcagcttcgtcgtgccgccggaccatgaaacactggacttcaagttcttgctgaagcccaaagacgccgaaaccccctgcatcattgaggaagggcccacgcgtctcctcaccggaggcatgctcgagggcgatgtgagggttgcgctgttcaagctcaatggagatgatgaggtgctcgagttcagggtgttcaacaaggcagaccttgtgtcaccgctcgaacttgctgcgagctggagggtgtacaaggagaactttcagccttccaaagtcagggggatacctgatatcagtatcaatgtcgcgcccactaatgcaactgaggaaggatcagcggctactttggaacttgacttggaacactatgttgttccgtccccgccgactgcaccaccaaatggatatgctgcaaaccttgctgcgactccagcatccatgattcaaactggggcatcgtggacaaatgatatccttctaagtgatgggattcaaagtccaagtagtgtttctgcaaaattagaagatcgtagtaacaacaagaagaatattgaggcctgggcaacagattcttctaagaattctggactcattgaatcaaaatcagttggcacctttacaccactgcaaaagctagatggtcaaaaggggctgttcgttgacaggggtgttggctctcctatgcttccaaaatcagccagtgcatgctccctggcatctgggtttagttttggatcagcaaagactatgcctgaagcagcaggagctgttgcagctgcagctgtagctgatcgattgcatgggtcaaaggaggaccggaagctggccattgttttggttggcctaccagctcgtggtaaaaccttcactgcggttaagcttacaaggtaccttcgttggttgggtcatgaaactagacatttcaatgttgggaagtatcgccgtctgaagcatggagcaaatcagcctgcagactttttccgtgatgataaccctgaaggtattgaggcacgtaatgaggtggctgctttagcgatggaggacatgatagattggatgaatggtggaggtcaggttggtatatttgacgcaacaaacagcacaagaaagcgaagatatatgctaatgaaaatggctgaaggtaactgtaagattatatttctggagacaatatgtaatgatccaaatataatcgaaagaaatatacggctgaagatccaacaaagtccagactatgctgatcagccagattatgaagctggactggaggacttcaaggaacgtttgatcaattatgaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtgaaactggagaactttatgcaaagaaactagccaactttatagaaaagcggctcaaatatgagaaaacagcaactatatggaccagtacccttcagagaacaattttgacagcaagtccaattgttggatttcctaagatacaatggcgtgctcttgatgagatcaattctggagtttgtgatgggatgacttatgaagagataaagaaaaatatgcccgaggaatttgagtcacgcaagaaggacaagctaagatatcgctacccccgtggagaatcttaccttgacgttatacagaggttggaacccgtcatcattgagctagaacgccagcgtgcaccagtggttgtcatatctcaccaggctgtactgcgagcactgtatgcatatttcgcggacaggcctttgagagaagttccagatatagagatgccactacacaccataatcgagatacaaatgggcgttctcggtgttgaagagaagaggtacaaactcatggactgaatgaatgaatacataaaagcagcaggtcgttggctgtttcatatcatacagaaagtacagataacacagaagcttttttttatctctccacacggtgtgaaacctacttcagtgtatttttttctctgaaaaaaaacatattgatcattgtaaagaaaaaaacatgtactactaataatgaactgtaaaaatggcagcttatactgcaaggaataaggaatacagactgtggctcaaattaacaattccacggcttaggccttgtttagttcccaccaaaaataaaaaacttttcaagattccct

SEQ ID NO: 4871 - DNA, 3063 bp, Sorghum bicolor
ttcggaactaaacaaggccttaccggagaacagagcagcaagcaggctggggtcaggacgccgcgcgcagacgcggcggagccgccgccgcagcagctcggatgccggcgttggcaggttggacgcctccccttatcccctccggcgggccccgcacgctccgtcccttgcggactccgagacctgcgggtcactcccatcgctctcccggttgcattcgccccaatccaaacgccaacggcctccctccattacaagacctcccccccctccactccaccaccaccggccaccaccgccccgattccactcccacgtgctgctccacctgcgccgccacgtcacgcctctaggctctagccatggggacgtcggggtccaagagcatcgacggcgtgggcgccgtctcgggcgtcggcgccgccgcggcggggctgggcggcgccggcggggagggcggcgagggcggcgccgcggaggcgtggcacggcggggcgcagctgtacgtgtcgctcaagatggagaacgcggagatcagcggcgacctcgtcccgcacgtctacggctccgagcccatcatcggcacctgggacccttcccgcgccctcgccatggagagggagctcgcgtctatgtgggagctcagcttcgtcgtgccgccggaccatgaaacactggacttcaagttcttgctgaagcccaaagacgccgaaaccccctgcatcattgaggaagggcccacgcgtctcctcaccggaggcatgctcgagggcgatgtgagggttgcgctgttcaagctcaatggagatgatgaggtgctcgagttcagggtgttcaacaaggcagaccttgtgtcaccgctcgaacttgctgcgagctggagggtgtacaaggagaactttcagccttccaaagtcagggggatacctgatatcagtatcaatgtcgcgcccactaatgcaactgaggaaggatcagcggctactttggaacttgacttggaacactatgttgttccgtccccgccgactgcaccaccaaatggatatgctgcaaaccttgctgcgactccagcatccatgattcaaactggggcatcgtggacaaatgatatccttctaagtgatgggattcaaagtccaagtagtgtttctgcaaaattagaagatcgtagtaacaacaagaagaatattgaggcctgggcaacagattcttctaagaattctggactcattgaatcaaaatcagttggcacctttacaccactgcaaaagctagatggtcaaaaggggctgttcgttgacaggggtgttggctctcctatgcttccaaaatcagccagtgcatgctccctggcatctgggtttagttttggatcagcaaagactatgcctgaagcagcaggagctgttgcagctgcagctgtagctgatcgattgcatgggtcaaaggaggaccggaagctggccattgttttggttggcctaccagctcgtggtaaaaccttcactgcggttaagcttacaaggtaccttcgttggttgggtcatgaaactagacatttcaatgttgggaagtatcgccgtctgaagcatggagcaaatcagcctgcagactttttccgtgatgataaccctgaaggtattgaggcacgtaatgaggtggctgctttagcgatggaggacatgatagattggatgaatggtggaggtcaggttggtatatttgacgcaacaaacagcacaagaaagcgaagatatatgctaatgaaaatggctgaaggtaactgtaagattatatttctggagacaatatgtaatgatccaaatataatcgaaagaaatatacggctgaagatccaacaaagtccagactatgctgatcagccagattatgaagctggactggaggacttcaaggaacgtttgatcaattatgaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtgaaactggagaactttatgcaaagaaactagccaactttatagaaaagcggctcaaatatgagaaaacagcaactatatggaccagtacccttcagagaacaattttgacagcaagtccaattgttggatttcctaagatacaatggcgtgctcttgatgagatcaattctggagtttgtgatgggatgacttatgaagagataaagaaaaatatgcccgaggaatttgagtcacgcaagaaggacaagctaagatatcgctacccccgtggagaatcttaccttgacgttatacagaggttggaacccgtcatcattgagctagaacgccagcgtgcaccagtggttgtcatatctcaccaggctgtactgcgagcactgtatgcatatttcgcggacaggcctttgagagaagttccagatatagagatgccactacacaccataatcgagatacaaatgggcgttctcggtgttgaagagaagaggtacaaactcatggactgaatgaatgaatacataaaagcagcaggtcgttggctgtttcatatcatacagaaagtacagataacacagaagcttttttttatctctccacacggtgtgaaacctacttcagtgtatttttttctctgaaaaaaaacatattgatcattgtaaagaaaaaaacatgtactactaataatgaactgtaaaaatggcagcttatactgcaaggaataaggaatacagactgtggctcaaattaacaattccacggcttaggccttgtttagttcccaccaaaaataaaaaacttttcaagattccctgtcatatcgaatcttacagcacatgtatggagcattaaatatagatgaaaacaaaaactaattatacctcgcgagacgaatttttt

SEQ ID NO: 4872 - DNA, 2894 bp, Zea mays
aggacgccgcgcagacgcggcggatccgccgccgcagcagttcgatcgccggcgttggcaggtgggacaccttcccttatcccctccggcgggccccgcacgctccgccccttgcggactccgaggcctgcggctccactcccatcgctctcccggttgcattcgccccaatccaaacgacaaacgccaacggttccctccattaaaagaccttcccctccatcaccaccccccgattccactcccacgtgctgctccacttgcgccgccacgttatacctctgggctgtagccatggggacgtcggggtccaagggcatcgacggcgtcggcgcagtttctggcgtcggcgctggcgcggcgggccttggcggcgtcggcgccggcggggacgggggcgagggcgccgccgcggaggcgtggcatggcggggcgcagctgtacgtgtcgctcaagatggagaacgcgttgatcagcggcgacctcgtcccgcacgtgtatggctccgagcccatcatcggcacctgggacccctcccgcgccctcgccatggaaagggagctcgcgtccatgtgggtgctcagcttcgtcgtgccgccggaccatgaaacactggacttcaagttcttgctgaagcccaaagacgctgaaaccccgtgcatcatcgaggaaggacccacacggctcctcaccggaggcatgctagagggtgatgtgagggttgcactgttcaagctcaatggagatgatgaggtgctcgagtttggggtggtcaacaaggcggaccttgtatcaccgcttgaacttgctgcaagctggagggtgtacaaggagaactttcagccttccaaagttcgggggatccctgatatcagtatcaatgtcacacccactaatggagctgaggaaggatcagcggctactttggaacttgacttggaacattatgttgttccgtccccgccaactgcaccaccaaatggatatgctgcaaaccttgctgcgactccagcatccgtgattcaaactgaggcattgttgacaaatgatatccttctaagtgatgggattcagagtccaagtagtgtttctgcaaaattagaagattgtactaaccacaagaatattgaggcctgggcaacagattcttctaagaaaattcagaattccggactcattgaatcaaaatcagttggcacctttacaccaatgcaaaagctagatggtcaaaaggggctgttcgttgacaggggtgttggctcttctatgcttccaaaatcagccagtgcatgctccttggcatctgggtttagttttggatcagcaaagacaatgccagaagcagcaggagctgttgcagctgcagctgtagctgatcgtttgcatgggtcaaaggaggaccggaagctggccattgttttggttggcctaccagctcgtggtaaaaccttcactgcagttaagcttacaaggtaccttcgttggttgggccatgaaactagacatttcaatgttgggaagtatcgccgtcttaagcttggagcaaatcagtctgcagattttttccgtgatgataatcctgaaggtattgaggcacgtaatgaggtggctgctttagcaatggaggacatgatagattggatgaatggtggaggtcaggttggtatatttgacgcaacaaacagcacaagaaagcgaagatatatgctaatgaaaatggctgaaggtaactgtaagattatatttttggagacaatatgtaatgatccaaacataattgaaagaaacatacggctgaagatccaacaaagtccagactatgctgaacagctagattatgaagctggactggaggacttcaaggaacgtttgattaattatgaaaaggtctacgagccagtaggggaaggttcttacatcaaaatgattgacatggtaaaggggcaagatggtcagttacaggtaaataatatcagcggttatctccctgggaggattgtcttcttcttggtgaactctcatcttacaccacgacctattttgcttaccaggcatggtgagagtttacataatgttagaggaagagtcggtggtgatacagttctaagtgaaactggcgaactttatgcaaagaaactagccaactttatagaaaagcggctcaaatgtgagaaaacagcaactatatggaccagtacccttcagagaacaattttgacagcaagtccaattgttggattccccaagatacaatggcgtgctcttgatgagatcaattctggagtgtgtgatgggatgacttatgaagagataaagaaaatcatgcccgaggaatttgagtcacgaaagaaggacaagctaagataccgctacccccgtggagaatcttacctcgatgtgatacagaggctggaacccgtcatcatcgagctagaacgccagcgtgcaccagtggttgtcatatctcatcaggctgtactgcgagcactgtatgcatatttcgcggaccgtcctttgagagaagttccagagatagagatgccactacacaccataatcgagatacaaatgggcgtcacgggtgtggaagagaagaggtacaaactcatggactgaatgaatacataaaagcagctggttggctgtttcatacagcaagtacacataacacagaagccttttcccttctctctctctctccacacggtgttcagtgtaatttctttggaaaaaagacatgttgaacattgtaaagaaaaaactaataaggaactgtaaaaatggcatgcttactgtaacgaataaggaatacagactgggggtctccaatgcttattcagaaacatattccgtcaaatcggttgatcctgtggctgatgggaccaatgaaccgt

SEQ ID NO: 4873 - DNA, 1251 bp, Pseudoroegneria spicata
ccgttgctgtcgccgttgctgtcgggaagccggaagcaagtgagctgagcgcaggcggaggcggacgcgacgatgagggtggtggcgatcgcgagccccggcgggccggaggcgctgcaggtgcgcgaggtcgaggacctcccggcgccgggggagggagaggtgctcgtcgcggtggccgccgccggcgtcaaccgcgccgacacggtccagcggcagggccggtacccgccgccgccgggcgcctccccctacccggggctcgagtgctccggcaccatcctcgcgctcggggccaacgtccccccgcgctgggccgtcggcgaccaggtgtgcgctctgcttaccggcggcgggtatgcggataaagtggtggttccggcggggcagctgctcccggtgccggagggggtgtcgctgaccgacgccgccggcttgcccgaggtggcctgcaccgtctggtccaccgtcttcatgaccagccatctctcccccggtgaatccttccttatccatggtgggtcgagtggaattggtacatttgctatacagattgcgaagcatcttggtgttaaggtttttgttactgcaggaagcgaagaaaagctagctgcctgcaaaggtttgggagcggatgtatgtataaactacaaaaccgaagattttgtagcacgcataaaggaagaaaccaatggaaagggtgttgatgtcattctggacaatatcggcgcatcttatctgcagcgcaatctgaacagcttagctgttgatggtagacttttcatcatcggtttcatgggaggcgttacaactgaagtgaacctgcaggctatgcttgcccgaagattgaccatacaagctgctggactgcggaacagaagcctcgctaacaaagcccagatcgtcagcgaggtggagaagaatgtgtggcctgccgtcgtgtcgggcaaggtgaagccggtgatttacaagacattccctctatctgaagcagctgaatctcacaagttgatggagacgagctcccacattggaaagatactactgatcccatgattgggtatggtaaccatgtgtgcgactgggagtcggacccattgtaagcactgtttctgtagtgaaatatgcatgaccataaaagtctttctatatattgtaagtgggatttcgaagtgctgatgaaattggttatgtgtctcgatgataaacagtcacaataaaatgttggaacttggaagtcttgttctttca

SEQ ID NO: 4874 - DNA, 1352 bp, Hordeum vulgare
agagccggaacccggaagcaagtgagctcagcgcaggcgatgagggtggtggcgatcgcgagccccggcgggccggaggcgctgcaggtgcgcgaggtggacgacctcccgccccccggggagggcgaggtgctggtcgcggtggccgccgccggcgtcaaccgcgccgacacggcccagcggcagggccggtacccgccgccgccgggggcctccccctacccgggtctcgagtgctccggcaccatccttgcgctcggggccaacgtccccccgcgctgggccgtcggcgaccaggtgtgcgctctgcttaccggcggcgggtacgcggagaaggtggtggtgccggcggggcagctgctcccggtgcccgagggggtgtcgctgaccgacgccgccggcttgcccgaggtggcctgcaccgtctggtccaccgtcttcatgactagccacctctctcccggtgaatcgttccttatccatggtggatcaagtggaatcggtacatttgctatacagattgcaaagcacctcggaatcaaggtttttgtcactgcaggaaacgaagaaaaactagctgcctgcaaagatttgggagcagatgtatgtataaactacaaaactgaagattttgtagcacgcgtaaaagaagaaaccaatggaaagggtgttgatgtcattctggacaatatcggcgggtcttatctccaacgcaacttgaacagcttagctgttgatggtagacttttcatcatcggtttcatgggaggcactacaactgaagtgaacctgcaggctatgcttgcccgaagattgaccatacaaggtgctggactgcggaacagaagcctcgctaacaaagcccagatcgtcagtgaggtggagaagaacgtgtggcctgccgtcgtgtcgggcaaggtgaagccggtgatttacaagacattccctctgtccgaagcagctgaatctcacaagctgatggagacgagctcccacattggcaagatactgctgattccatgattgggtatggtctatgtatcatgtattcatgtgtacactggccgctgtgagcactgttttctgtagtgagctatgcatggacatgtccttctactagtatattgtactaataataagttggatctcgaggtgctggtgaaattggatatgtatctcgaggataaatagtactccctccgtcccaaaataagtgtctcaagcttaatacaattttatactagagctaatacaaagttgagacacttattttgggacggagggagtaacaaagaaatgttggaacttggaagtctcgttctttcatctcatgggacatttcatcgttttat

SEQ ID NO: 4875 - DNA, 1443 bp, Hordeum vulgare
cggccctatacccgagtggagccgagagcagagccgtagagcagtggcctgcagacgcggagccaccgagagccggaacccggaagcaagtgagctcagcgcaggcgatgagggtggtggcgatcgcgagccccggcgggccggaggcgctgcaggtgcgcgaggtggacgacctcccgccccccggggagggcgaggtgctcgtcgcggtggccgccgccggcgtcaaccgcgccgacacggcccagcggcagggccggtacccgccgccgccgggggcctccccctacccgggtctcgagtgctccggcaccatccttgcgctcggggccaacgtccccccgcgctgggccgtcggcgaccaggtgtgcgctctgcttaccggcggcgggtacgcggagaaggtggtggtgccggcggggcagctgctcccggtgcccgagggggtgtcgctgaccgacgccgccggcttgcccgaggtggcctgcaccgtctggtccaccgtcttcatgactagccacctctctcccggtgaatcgttccttatccatggtggatcaagtggaatcggtacatttgctatacagattgcaaagcacctcggaatcaaggtttttgtcactgcaggaaacgaagaaaaactagctgcctgcaaagatttgggagcagatgtatgtataaactacaaaactgaagattttgtagcacgcgtaaaagaagaaaccaatggaaagggtgttgatgtcattctggacaatatcggcgggtcttatctccaacgcaacttgaacagcttagctgttgatggtagacttttcatcatcggtttcatgggaggcactacaactgaagtgaacctgcaggctatgcttgcccgaagattgaccatacaaggtgctggactgcggaacagaagcctcgctaacaaagcccagatcgtcagtgaggtggagaagaacgtgtggcctgccttcgtgtcgggcaaggtgaagccggtgatttacaagacattccctctgtccgaagcagctgaatctcacaagctgatggagacgagctcccacattggcaagatactgctgattccatgattgggtatggtctatgtatcatgtattcatgtgtacactggccgctgtgagcactgttttctgtagtgagctatgcatggacatgtccttctactagtatattgtactaataataagttggatctcgaggtgctggtgaaattggatatgtatctcgaggataaatagtactccctccgacccaaaataagtgtctcaagcttaatacaattttatactagagctaatacaaagttgagacacttattttgagacggagggagtaacaaagaaatgttggaacttggaagtctcgttctttcatctcatgggacatttcatcgttttattttgtactccctctgttctttca

SEQ ID NO: 4876 - DNA, 1401 bp, Secale cereale
ggggacggcgagcagtggcctgcagacgcggagcaccgagagccggaagccggaagcaagtgagctgagtgcaggcggaggcggacgcggcgatgagggtggtggcgatcgcgagccccggcgggccggaggcgctgcaggtgcgcgaggtggacgacctcccggcgccgggggagggcgaggtgctcgtcgcggtggccgccgccggcgtcaaccgcgccgacacggcccagcggcagggccggtacccgccgccgcccggcgcctccccctacccgggtctcgagtgctccggcaccatcctcgcgctcggggccaacgtccccccgcgctgggccgtcggcgaccaggtgtgcgcgctgcttaccggcggcgggtatgcggacaaggtggtggtgccggcggggcagctgctcccggtgccggagggggtgtcgctgaccgacgccgccgggttgccggaggtggcctgcaccgtctggtccaccgtcttcatgaccagccacctctcccccggcgaatccttccttatccatggtggatcgagtggaatcggtacattcgctatacagattgcgaagcatcttggtgtcaaggtttttgtcactgcaggaagcgaagaaaaactagatgcctgcaaagctttgggagcggatgtatgtataaactacaaaaccgaagattttgcagcacgcataaaacaagaaaccaatggaaagggtgttgatgtcattctggacaatatcggcggatcttacctccagcgcaatctgaacagcttagctgttgatggtagactcttcatcatcggtttcatgggaggcactacaactgaagtgaacctgcaggctatgcttgctcgaagattgaccatacaagctgctggactgcggaacagaagcctcgctagcaaagcacagatcgtgagcgaggtggagaagaacgtgtggcctgccgtcgtgtcgggcaaggtgaagccggtgatttacaagacattccctctgtctgaagcagctgaatctcacaagttgatggagacgagctcccacattggcaagatactgctgattccctgattggatatggtgtatcatgtgaactatctgaagccgctgtgagcactgttctctgtagtgaactatgcagggacatgtgcttctgtattgtaagtgaactatgcaaggacatgtgcttctatattgtaagataaactggatctcagagtgctgatgaaattggatatgtatcttgacgacaaccagttacaataaaatgttggaacttggaagtcttagttagtttaaaaacgaaaaaaaaaaaaaaaagggggaaggaacgtagaagacgtagaccgtaaggacaacgaacgagggagtagggagagagtagacggtaagaacg

SEQ ID NO: 4877 - DNA, 1146 bp, Leymus cinereus x Leymus triticoides
agccccggcgggccggaggcgctgcagctgcgcgaggtcgaggacctcccggcgccgggggagggagaggtgctcgtcgcggtggccgccgccggcgtgaaccgcgccgacgcggtccagcggcagggccggtacccgccgccgccgggcgcctccccctacctggggctcgagtgctccggcaccatcctcgcgctcggggctaacgtgcccccgcgctgggccgtcggcgaccaggtgtgcgcgctgcttaccggcggcgggtatgcggagaaggtggtggtgccggcggggcagctgctcccggtgccggagggggtgtcgctggccgacgccgccggcttgcccgaggtggcctgcaccgtctggtccaccgtcttcatgaccagccatctctctcccggtgaatccttccttatccatggtggatcaagtggaatcggtacatttgctatacagattgcgaagcaccttggtgttaaggtttttgttactgcaggaagcgaagaaaaactagctgcctgcaaaggtttgggagcggatgtttgtataaactacaaaactgaagattttgtagcacgcataaaagaagaaaccaatggaaagggtgttgatgtcattctggacaatatcggcgggtcttatctccagcgcaatctgaacagcttagctgtcgatggtagacttttcatcatcggtttcatgggaggcactacaactgaagtgaacctgcaggctatgcttgcccgaagattgaccatacaagctgctggactgcggaacagaagcctcgctaacaaagctcagattgtcagcgaggtggagaaaaatgtatggcctgccgtcgtgtcgggcaaggtgaagccggtggtctacaagacattccctctgtctgaagcagctgaagctcacaagttgatggagacgagctcccacattggcaagatactactgattccatgattgggtatggtgtaccatgtttgcgctcgcagtgggagccgctgtgagcactgtttctgtagtgaactatgcatgaacatgtctttttctattgtaagttggatcttgaaatgctgatgaaagtgggtatgaaccttgaaaataaccagttacaataaaatgttggaacctggaaaaaaaaaa

SEQ ID NO: 4878 - DNA, 1176 bp, Avena sativa
gcggacgagagtgacgaggagaccgatgacgatgaaggcggtggtgatctcgagccccggcgggccggaggcgctggaggtgcgcgaggtggaggacctcccggcgccgggagaaggcgaggtgctcgtcaaggtggccgcctccggcgtcaaccgcgccgacacggtccagcggcagggcaagtacccgccgccgcccggcgcctccctctaccctgggctcgagtgctccggtaccataatcgcgctcgggtccaacgtgccctcacgctgggccgtcggtgaccaggtatgtgcgctgctcactggcggcgggtatgcggagaaggtggtggttccggcggggcagctgctcccggtgccggagggggtgtcgctgacggacgcggccggcttgcccgaggtggcctgcaccgtctggtccaccgttttcatgaccagccatctctcccctggtgaatcgttccttatccatggtggatcaagtgggattggcacatttgctatacagattgcaaagcaccttggaattaaggtgttggttactgcagggagtgaagaaaaactagctgcctgcaaagatttgggggccgatgtgtgtataaactacaaaaccgaagactttgtagcacgcataaaagaaagaaactgatggaaagggcgttgatgtcattctggacaacattggtggatcttatctccagcgcaatctgaacagcttagctgttgatggcagactcttcattatcggtttcatgggaggcgttgtaactgaagtgaacctggcagttatgcttgcccgaagattgaccgtacaagctgctggactgcggaacagaagcattgctaataaagctcagattgtcagcgaggtggagaaaaatgtatggcctgcggttgtgtcgggcaaggtgaagccagtggtttacaagacattccctctatctgaagcagctgaatctcacaagctgatggagacgagctcccacattggcaagatactactgatcccatgatcgggcatgtactgcgcccgccgtgagcagttcatctgttgtgaactatgcatgggtattgtctgtttttaccgtatcttgaagtgccgatggttacaataaatgttggaatttggaagtattgttctgtcatctacggggtaacgtgtgatttgggtac

SEQ ID NO: 4879 - DNA, 1187 bp, Avena sativa
acgagagtgacgaggaggccgatgacgatgaaggcggtggtgatctcgagccctggcgggccggaggcgctggagttgcgcgaggtcgaggacctcccggcgccgggggaaggcgaggtgctcgtccaggtggccgccgccggcgtcaaccgcgccgacacggtccagcggcaaggcaagtacccgccgccgcccggcgcatccctctacccggggctcgagtgctccggaaccatcgtcgcgctcggggccaacgtgccctcacgctgggccgtcggtgacgaggtgtgcgcgctgctcaccggcggcgggtatgcggagaaggtggtggttccggcggggcagctgctcccagtgccggagggggtgtcgctgacggacgccgccggcttgcccgaagtggcctgcacggtctggtccaccgttttcatgaccagccatctcgcccctggtgaatcattcctgatccatggtggatcaagtgggattggcacatttgctatacagattgcaaagcaccttggaattaaggtgttggttactgcagggagtgaagaaaaacttgctgcctgcaaagatttgggggccgatgtgtgtataaactacaaaaccgaagactttgtagcacgcataaaagaagaaactgatggaaagggtgttgatgtcattctggacaatatcggcggatcctatctccagcgcaatctgaacagcttagctgttgatggtagactgttcattatcgggttcatgggaggcgttgtaactgaagtgaacctggcggttatgcttgcccgaagattgaccgtacaagctgctgggctgcggaacagaagcattgctaataaagctcagattgtcagcgaggtggagaaaaatgtatggcctgccgttgtgtcgggcaaggtgaagccagtggtttacaagacattccctctatctgaagcagctgaatctcacaagctgatggagacgagctcccacattggcaagatacttctgatcccatgattgggcatgtaccgcggccaccgggagcagttcatctgtttgtgaactatgcatcggtattttctgtttttactgtggtgtaagctggatcttgaagtgctgatggttacaataagtgttggaacttggaattatcgttctttcatctacggagtaaggtgtgatttgggtactaa

SEQ ID NO: 4880 - DNA, 1125 bp, Brachypodium distachyon
atcgatcgatcgatgagggcggtggtgatcgcgagccccggcgggccggaggccctggaggttcgcgaggtggaggacctcctggcgccgggagaaggcgaggtgctcgtcgaggtggccgccgccggcgtcaatcgcgccgacacggtccagcggcagggccggtacccgccgccgcccggcgcgtcgccttacccggggctcgagtgctccggcaccatcctcgccctcggggccaacgtccccgcgcggtgggccgtcggcgaccaggtgtgcgcgctgcttacgggcggcgggtatgcggagaaggtggtggtgccggcggggcagctgctcccggtgccggagggggtgtcgctgacggacgcggctggcttgcccgaggtggcctgcaccgtctggtcgaccgtattcatgacaagccatctctcctctggcgaatcgttccttatccatggtggatcaagtggaattggtacatttgctatacagatcgcaaagcaccttggaattaaggtttttgttactgcaggaagcgaagaaaaactagttgcttgcaaaggtttgggtgctgatgtatgcataaactacaaatctgaagattttgaagcacgtattaaagaagaaaccaatggaaagggtgttgatgtcattctagacaatatcggtggatcttatctccagcgtaatctgaacatcttagctgttgatggtagacttttcattattggtttaatgggaggtgctgttactgaagtgaatctgcaggcaatttttgcccgaaggttgaccgtacaagctgctggactgcgaaacagaagccttgacaataaagctcagattgtcagcgaagtggagaaaaatgtatggccagccattttgttgggcaaggtgaagccggtggtttacaagacctttcctctatccgaagcagctgaagctcacaagttgatggaatcaagctctcacattggcaagatactgctcgttccataatttggtatggtgaatcatgtgtgcccactcacttggagccgctgtaaacacagtgatctatgtatctgcatgtcttttcatgttgtagactggttactgaagcgctaatgaacttggttacatgttttg

SEQ ID NO: 4881 - DNA, 1425 bp, Brachypodium distachyon
cgtagcacagtggcctgccgcctggagaagcggagtcaccgagaggggcaagcaatcgagctgcgcaagcggacgcgaggagtgagcaagcgaaggagatcgatcgatcgatgagggcggtggtgatcgcgagccccggcgggccggaggccctggaggttcgcgaggtggaggacctcctggcgccgggagaaggcgaggtgctcgtcgaggtggccgccgccggcgtcaatcgcgccgacacggtccagcggcagggccggtacccgccgccgcccggcgcgtcgccttacccggggctcgagtgctccggcaccatcctcgccctcggggccaacgtccccgcgcggtgggccgtcggcgaccaggtgtgcgcgctgcttacgggcggcgggtatgcggagaaggtggtggtgccggcggggcagctgctcccggtgccggagggggtgtcgctgacggacgcggctggcttgcccgaggtggcctgcaccgtctggtcgaccgtattcatgacaagccatctctcctctggcgaatcgttccttatccatggtggatcaagtggaattggtacatttgctatacagatcgcaaagcaccttggaattaaggtttttgttactgcaggaagcgaagaaaaactagttgcttgcaaaggtttgggtgctgatgtatgcataaactacaaatctgaagattttgaagcacgtattaaagaagaaaccaatggaaagggtgttgatgtcattctagacaatatcggtggatcttatctccagcgtaatctgaacatcttagctgttgatggtagacttttcattattggtttaatgggaggtgctgttactgaagtgaatctgcaggcaatttttgcccgaaggttgaccgtacaagctgctggactgcgaaacagaagccttgacaataaagctcagattgtcagcgaagtggagaaaaatgtatggccagccattttgttgggcaaggtgaagccggtggtttacaagacctttcctctatccgaagcagctgaagctcacaagttgatggaatcaagctctcacattggcaagatactgctcgttccataatttggtatggtgaatcatgtgtgcccactcacttggagccgctgtaaacacagtgatctatgtatctgcatgtcttttcatgttgtagactggttactgaagcgctaatgaacttggttacatgttttgaaattttcagcggaacttggaagtcgtgcatgttttcatctaatgggtgttttgggtaataataatttattgggtgaagccccagcatatggcgtggtgttcttgatgacaatgtcgttagacatttactagatcctactagtaagcaagaaatgatgatgatgattcataatcttttaaccataatcacttgaggcatttg

SEQ ID NO: 4882 - DNA, 2538 bp, Oryza sativa
gcccatctcaatatccagtcgacgagtcagcagcagagacgcagagtgtcagcgcgtgcgtggactcatcgagaggagcaaagcaaagcgagcagctgagccccgacgaggtagggggagagatgagggcggtggtgatcgcgcgcgccggcgggccggaggtgctggaggagcgggacgtcggggagggcctcccgccgccgggggaaggcgaggtgctcgtcggggtgtccgccgccggcgtcaaccgcgccgacaccgtccagcgccagggccggtaccccgcgccgcccggcgcgtccccttacccgggcctcgagtgctccggcaccatcctcgccctcggccctaacgtcccctcccgctgggccgtcggtgaccaggtgtgcgcgctgctcagcagcggcgggtatgcggagaaggtggtggtgccggcggggcagctgctcccggtgccggagggggtgtctctgacggacgccgccggcttgcccgaggtggcctgcaccgtctggtcgaccgtcttcgtgaccagccacctctcccccagcgaatcgttcctcatccatggtggatcgagtggaattggtacatttgctatacagattgcaaagcaccttggaattaaggtttttgttactgcaggtagtgaggaaaaactagctgcctgcaaaggtttgggtgccgatgtatgcataaactacaaaactgaagatttcgttgcacgtgtcaaagaagaaacaaatggaaagggtgttgatgtcattctggacaacatcggtggattgtatcttcagcgtaacctgaacagcttagctgttgatggtagacttttcatcattggtttccaaggaggcgctgtaactgaagtgaacctgcaacccatgcttgctcgacgattgaccatacaagctgctggactacgcaacagaagccttgataataaagctctgattgtcagtgaggtggagaaaaatgtatggcctgccgttgtgcaaggcaaggtgaaaccagtaatatacaagacgtttcctctgtcagaagctgctgaagctcacaagttgatggaagaaagttcccacattggcaagatactattgattccatgaatgtattggtatcttgtttgtgctctcactatcggagccactttaaacactgtatatttggtttgtcctttgatcttgcatgttgacaagagtggacgtactatgtcagaaaattatgtgtcacaatacatgaagaaagttatgtactcatgctctctcaaccaacggatcatttggatataaatgcgattgcttggtttggagtccctggcattggtgttattcatgatgatgacactagagtagatttttaaaaggcatgattagcaccaaatgatgatgcatgatgtttatataatgcaagtactttttttttggatggatctatattgctacttcaagaaatttgaatatatgtatgcacaacttgatgtcatgatggtgcagctagtagatgtttaagaaacatgattagcatcaaatgatgatgcatgatgttttcataatgttacttcagacatttgaatatattactgcaccacttgatgtcaacgcatggccaaatgtgggcacggaccaaacaagaaaggaactggatatggccattaagacaacgtatatttacaaataccaaacagccttgtaagggccagtcaaggataacttataactgaatacaccactcaaatgaaccaaaaatcttctatttgcactggtagtttgctagtcaggagcaaccacttcaaaatggcatgtgtaaaactcactaacaattgcaagcaaagtaatattcttgctacagtagctatttctcctacttcatacttcaccactctactaggcctcccgctagttcatatgtcaaattttaaggaagatgaatgctaaactacaaaagaagtatgtagtaatgtcattattcttgtgtaaggttcgatgtaacagtgcaattgcattgctgtttcatgatctgaatctgcctcttcaacacctcattatcctgcagttgtgaaaacgagcatctcaaaagagttgaaaaaaaatgagcataagcatggtaacacctaagagagtgaaatatatggagaaaccaggagaaagcgctcaatattactgaggaagcatagagctaatattatgttagggtgttacaacgagaagcatcaaagtttgcccccaaaaggttacctttttcaataggctaaatctcttagttgaagcagagagtgaggccttagcctgtaaacaagattctcaaatgagcactgcagaaggaaactgaggaaagctgtgtacaagtacataatataaatagaccagacctttaaaagttcatcttgcatctgtttgtttttcgcaaactctgtgtcatatttcattctccattcagcagattcatccattgcttctaggttggcacgctcaaattgcctcctgcaaaagattgatgcagaaaaaaaagtgcaattgaaactatcagtcagcctcg

SEQ ID NO: 4883 - DNA, 1266 bp, Oryza sativa
gcgcgtgcgtggactcatcgagaggagcaaagcaaagcgagcagctgagccccgacgaggtagggggagagatgagggcggtggtgatcgcgcgcgccggcgggccggaggtgctggaggagcgggacgtcggggagggcctcccgccgccgggggaaggcgaggtgctcgtcggggtgtccgccgccggcgtcaaccgcgccgacaccgtccagcgccagggccggtaccccgcgccgcccggcgcgtccccttacccgggcctcgagtgctccggcaccatcctcgccctcggccctaacgtcccctcccgctgggccgtcggtgaccaggtgtgcgcgctgctcagcagcggcgggtatgcggagaaggtggtggtgccggcggggcagctgctcccggtgccggagggggtgtctctgacggacgccgccggcttgcccgaggtggcctgcaccgtctggtcgaccgtcttcgtgaccagccacctctcccccagcgaatcgttcctcatccatggtggatcgagtggaattggtacatttgctatacagattgcaaagcaccttggaattaaggtttttgttactgcaggtagtgaggaaaaactagctgcctgcaaaggtttgggtgccgatgtatgcataaactacaaaactgaagatttcgttgcacgtgtcaaagaagaaacaaatggaaagggtgttgatgtcattctggacaacatcggtggattgtatcttcagcgtaacctgaacagcttagctgttgatggtagacttttcatcattggtttccaaggaggcgctgtaactgaagtgaacctgcaacccatgcttgctcgacgattgaccatacaagctgctggactacgcaacagaagccttgataataaagctctgattgtcagtgaggtggagaaaaatgtatggcctgccgttgtgcaaggcaaggtgaaaccagtaatatacaagacgtttcctctgtcagaagctgctgaagctcacaagttgatggaagaaagttcccacattggcaagatactattgattccatgaatgtattggtatcttgtttgtgctctcactatcggagccactttaaacactgtatatttggtttgtcctttgatcttgcatgttgacaagagtggacgtactatgtcagaaaattatgtgtcacaatacatgaagaaagttatgtactcatgctctctcaaccaacggatcatttggatataaatgcgattgcttggtttggagtccc

SEQ ID NO: 4884 - DNA, 1357 bp, Pennisetum glaucum
cccgggccaattttaagcaaattcaggagctttctactacacggggagtaagtggcacagacagagactgacagtcaattgggtcgagtaatcaatcccagcgaagcgggcgaaacaaggagaaatccgggagatgagggccgtggtgatcgcgcgccccggcgggccggaggtgctggaggcgcgggaggtagaggatccccccgcgccaggggaaggagaggtgctcctcgaggtcgccgccgcgggcgtcaatcgcgcggacacggtccagcggatgggccgctacccgccgcccgccggcgcgcccccttacccggggctcgagtgctccggcaccatcctcgcgctcggcaccaacgtcccctcgcggtgggccgtcggagaccaggtctgcgccctgctgagcggcggcgggtacgcggagaaggtggtggtgccagcggggcagctgctgccgataccggagggagtctcgctgagggacgctgccggattgcccgaggtggcctccaccgtctggtcaaccgtgttcatgaccagtcacctctcccccggcgaatcattccttatccacggagggtcaagtggaatcggtacttttgctatacagattgcaaagcacctcggaattaaggtttttgtcactgcagggagcgaagaaaaactagcagcctgcaaaggtttgggagctgatgtatgcataaactacaaaactgaggacttcgttgaccgtgtcaaacaggaaaccaatggaaagggtgttgatgtcattctggacaatattggaggatcatatctccagcgcaatctgaacagcttaggtgttgatggtagacttttcatcattggcttccaaggaggtgttgtggctgaagtaaacctgcaagccgttcttgcacgacgcttgactgtacaagctgccggacttcgcagcagaagccctgccagtaaagcgcagatcgtcagcgaggtggaaaagaatgtgtggcctgctgtcgcgactggcaaggtgaagccggtgatttacaagacgttcccgttatctgaagcggctgaggctcacagattgatggaggctagcacccacatcggcaagatacttctgcttccatgactgcatgtgtgtgtttgcacgctcacgctcagttccggactagaattttgggtcatcagcaacttatgtgacgacatccttgtatcatgtaccgagtggcacgtgtatcttctaaactgcatccttgtttcttgtttgcgagcaattatcttgaaattggacctgtgtttagtttttgtgaccagtaaactttgctctgccactcataaaatcagactgtctgataagccgaggctgaca

SEQ ID NO: 4885 - DNA, 1407 bp, Setaria italica
agataaatcgagagagcccatcccaattctgtaaattaagaccaagaaataagcgtggcagttgggtggagttatcggaagggggcaagcaacttcgttgacagtgagcaagcggacgcgacgaggactgaggaggaggggagggagatgagggccgtggtgatcgcgcgccccggcgggccggaggtactggaggcgcgggaggtggaggatccccccgcgccaggcgaaggagaggtgctcctcgaggtcgccgccgcgggcgtcaatcgcgcggacacggtccagcggatgggccggtacccgccgcctgccggcgcgtccccttacccggggctcgagtgttccggcaccatcctcgcgctcggccccaacgtcccctcgcggtgggccgtcggagacaaggtctgcgcgctgcttagcggcggcgggtacgcggagaaggtgttggtgccagcggggcagctgctgccgataccggagggagtgtctctgacggacgcagccggattgcctgaggtggcctgcaccgtctggtcaaccgtgttcatgatcagtcacctctcccccggcgaatcattccttatccacggaggatcaagtggaatcggtacttttgctatacagattgcaaagcacctcggaattaaggtttttgtcactgcaggaagcgaagaaaaactagcagcctgcaaaggtttgggtgccgatgtatgcataaactacaaaacagaagactttgttgaccgtgtcaaacaggaaaccaatggaaagggtgttgatgtcattctggacaatattggaggatcatatctccagcgcaatctgaacagcttaggcgttgatggtagactcttcatcattggcttccaaggaggcactgtagctgaagtaaacctgcaagccgttcttgcacggcgcttgactgtacaagctgctggacttcgcagcagaagccctgccaataaagcacagatcgtcagtgaggtggaaaagaatgtgtggcccgctgtcgcggctggcaaggtgaagccggtgatttacaagacgttcccgttatctgaagcggctgaggctcacagattgatggaagctagcacccacatcggcaagatacttctgcttccaggactacatatgtagtgtttgtgcgctcactttcgggcgagggagttttgggacatctgcaacttctgtgacgacctccttgtatcatgtactgagtggcatggcttcttatcttgtaaattggatcctttcgtacgagcaattatcttgtcaattgggtctgtgaagtgttgatgatattgttcagtaaactttgatgacagtttgcacagccactcataaagtcgctgctaatcatttcaaatgaaaagtgctgctcaccgtcagtagcaaacaaac

SEQ ID NO: 4886 - DNA, 1293 bp, Saccharum officinarum
gtttctggcgcagtagcagtcgtgtgctcctagtgcagttgctggtgtaattatcggaaggggctagcagcagcagagctgcagcgaccaaggggacgacgcgaggaagatgagggcggtggtgatcacgcgcggcggcggcggcccggaggtgctggaggcgcaggaggtggaggaccccgcgccgctgggagacggcgaggtcctcctccaggtggccgccgcgggcgttaaccgcgccgacacgctccagcgccacggccgccacccgccgcccgccggcgcgcccccgtacccggggctcgagtgctccggcaccatcctcgcgctcggccccaacgtcccaccgcggtgggccgtcggcgacaaggtctgcgcgctccttagcggaggcgggtacgcggagaaggtggtggtgccggcgggccagctgctgccggtgccggagggcgtctcccttacggacgcggccggcttagccgaggtggcctgcaccgtctggtccaccgtgttcatgaccagccacctctcccccggtgaatcgttccttatacatggaggatcaagtggaattggtacatttgctatacagattgccaagcacctcggaattaaggtttttgtcacagcaggaagtgaagaaaaactagcagcctgcaaagatttgggtgctgatgtatgcataaactacaaaactgaagactttgttgagcgtgtcaaacaggaaactgatggaaaaggtgttgatgtaattctcgacaacattggaggaccatatctccagcgcaatctgaacagcttaggtgttgatggtagacttttcatcattggcttccaaggcggcgctgtaactgaagtgaacctgcaagctgtgtttgcacggcgtttgaccatacaagctgctggactgcgcggcagaagccttgctaataaagctcaaatcgtcagtgaggtggaaaagaatgtgtggcccgcagtcgctgctggcaaggtgaagccagtgatttacaagacgttcccgttatctgaagcagctgaggctcataggttgatggaaactagcacacacattggcaaaatactgctgctcccatgacttcctgtccaatgtttgctgtctaactcttgaaggagtcagttcaagcgagctacagctttgtaagactgtaacgacctctgtatgtatcatgtactggtgtggcatgcctttttttatcttgtaaattcgatccttgaaattgctgatgaaattgtttgaactgtgatgtactgtgcagtaataaaatggctgct

SEQ ID NO: 4887 - DNA, 1266 bp, Setaria italica
ggtccaaaagcagagtccgtaggcttgaacgtactgcagtttccagtggagtatcggaaggaccaagcagctgcagcgggcaagcggacgcgtgggggtgaggcggccggagggaggaagaagatgagggcggtggtgatcacgcgcggcggcgggccggaggtgctagaggcccaggaggtggaggaccccgcgccgctgggagaaggcgaggtcctcctccaggtcgccgccgcgggcgtcaaccgcgccgacacgctccagcgccacggccgccacccgccgcccgctggcgcgtccccgtatccggggctcgagtgctccggcaccatcctcgcgctcgggcccaacgtgccctcgcgatggtccgtcggcgacaaggtgtgcgcgttgctaagcggcggcgggtacgcggagaaagtggtggtgccggcggggcagctgctgcccgtaccggagggggtgtcgctaacggacgcagccggcttgccggaggtggcctgcaccgtctggtcgaccgtcttcatgaccagccatctctcacccggtgaatcgttcctgatccatggaggatcaagtggaattggtacttttgctatacagattgcaaagcacctcggaattaaggtttttgtgactgcaggaagcgaagaaaaactagcagcttgcaaaggtttgggtgctgatgtatgcataaactacaaaactgaagactttgttgaacgtgttaaacaggaaaccaacggaaagggtgttgatgtcattctggacaatattggaggattgtatctccagcgcaacctgaatagcttaggtgttgatggtagacttttcatcattggcttccaaggaggcgctgcagctgaagtgaacctgcaacctgttcttgcacggcgcttgaccattcaagctgccggactgcgtggtagaagccctgccaataaagctcagatcgtcagcgaggtggaaaagaatgtgtggcctgcggtcgccgctcccgctggcaaggtaaagcctgtgatttacaagacgttcccgttatctgaagcagctgaggcgcacaggttgatggaaactagcacccacattggcaagatactgctgctcccttgactgcgtgtgtagtgtttgaacgacctctttgtatgtactagcgtggcatgccgttttgtcttgtaaattcgaaccttgaagtgcttaactgcttacgacacttttctgtgaactgtaatgcaataaaatctggcgcatggtcgttttttcccc

SEQ ID NO: 4888 - DNA, 1364 bp, Sorghum bicolor
gtttctggtgcagtagcagagtcgtgtgctcctagtgcagttgctggtgtaattatcggaaggggcaagcagctgcagagctgcagcgaccaaggggacgacgcgaggaagatgagggcggtggtgatcacgcgcggcggcggcggcccggaggtgctggaggcgcaggaggtggaggaacccgcgccgctgggagacggcgaggtcctcctccaggtggccgccgcgggcgttaaccgcgccgacacgctccagcgccacggccgccatccgccgccccccggcgcgcccccttacccggggctcgagtgctccggcactatcctcgcgctcggccccaacgtcccaccgcggtggtccgtcggcgacaaggtctgcgcgctgcttagcggaggcgggtacgcggagaaggtggtggtgccggcgggccagctgttgccggtgccggagggcgtgtcccttacggacgcggccggcttacccgaggtggcctgcaccgtctggtccaccgtgttcatgaccagccacctctctcccggcgaatcgttccttatacatggaggatcaagtggaattggtacgtttgctatacagattgcaaagcacctcggaataaaggtttttatcacagcaggaagtgaagaaaaactagcagcctgcaaagatttgggtgctgatgtatgcattaactacaaaactgaagactttgttgagcgtgtcaaacaggaaactgatgggaaaggtgtcgatgtaattctcgacaacattggaggaccatatctccagcgcaatctgaacagcttaggtgttgatggcagacttttcatcattggcttccaaggcggtgctgtaactgaagtgaacctgcaagctgtgcttgcacggcgtttgaccatacaagctgctggactgcgcaacagaagccttgctaataaagcagagattgttggtgaggtcgaaaagaatgtgtggcctgctgtcgctgctggcaaggtgaagccggtgatttacaagacgtttccgttgtctgaagctgctgaggctcataggttgatggaagctagcacccacatcggcaagatactgctgcttccatgactgtgcctgtagcttttgggctctttagttctggaggagtcagttcaagaacatatgcaacttctgtgacagtctgcatgaatggtgtactggtgtagcatggcctttttatcttgtatactagattggatctttttcccctgagcaattctcttgtcaattggatccttcaagtactgatgatgtttttctgtgagctatgatataataaatctggcagacggacatgtccatgccactacagtacgtcagtacctgatgccaca

SEQ ID NO: 4889 - DNA, 1616 bp, Sorghum bicolor
gcctcgtaaaaacgagatgtacaattattttcggaatgacagttcaagtgaaaatttgtgtttctggtgcagtagcagagtcgtgtgctcctagtgcagttgctggtgtaattatcggaaggggcaagcagctgcagagctgcagcgaccaaggggacgacgcgaggaagatgagggcggtggtgatcacgcgcggcggcggcggcccggaggtgctggaggcgcaggaggtggaggaacccgcgccgctgggagacggcgaggtcctcctccaggtggccgccgcgggcgttaaccgcgccgacacgctccagcgccacggccgccatccgccgccccccggcgcgcccccttacccggggctcgagtgctccggcactatcctcgcgctcggccccaacgtcccaccgcggtggtccgtcggcgacaaggtctgcgcgctgcttagcggaggcgggtacgcggagaaggtggtggtgccggcgggccagctgttgccggtgccggagggcgtgtcccttacggacgcggccggcttacccgaggtggcctgcaccgtctggtccaccgtgttcatgaccagccacctctctcccggcgaatcgttccttatacatggaggatcaagtggaattggtacgtttgctatacagattgcaaagcacctcggaataaaggtttttatcacagcaggaagtgaagaaaaactagcagcctgcaaagatttgggtgctgatgtatgcattaactacaaaactgaagactttgttgagcgtgtcaaacaggaaactgatgggaaaggtgtcgatgtaattctcgacaacattggaggaccatatctccagcgcaatctgaacagcttaggtgttgatggcagacttttcatcattggcttccaaggcggtgctgtaactgaagtgaacctgcaagctgtgcttgcacggcgtttgaccatacaagctgctggactgcgcaacagaagccttgctaataaagcagagattgttggtgaggtcgaaaagaatgtgtggcctgctgtcgctgctggcaaggtgaagccggtgatttacaagacgtttccgttgtctgaagctgctgaggctcataggttgatggaagctagcacccacatcggcaagatactgctgcttccatgactgtgcctgtagcttttgggctctttagttctggaggagtcagttcaagaacatatgcaacttctgtgacagtctgcatgaatggtgtactggtgtagcatggcctttttatcttgtatactagattggatctttttcccctgagcaattctcttgtcaattggatccttcaagtactgatgatgtttttctgtgagctatgatataataaatctggcagacggacatgtccatgccactacagtacgtcagtacctgatgccacattaccactgtactgctgatgcagtctacagatatgtagagatatatgtttatgtaccgtggcctgatggctctatctcgtcggccggccgacgacgagccgatagctctcggttgaagactaggagccaaagatatcgctggattctcaaggagctcgcctccttggataactaccaagattttggtctgaat

SEQ ID NO: 4890 - DNA, 1071 bp, Secale cereale
gagagcgacgagggagatcgacaccgacgacgatgagggcggtggcgatcgcaaggcccggcgggccggaggtgctggaggagcgcgaggtggaggacgtcccggcgccgggggacgcgaggtggtgctcagggtgccgccgccggcgtcaaccgcaccgacacggtccagcggcagggcgggtacccggcgccgcgcggcgcctcgccatacccgggggtcgagtgctccggctccatcctcgctctcggggccaacgtccacccgcgctgggccgtcggcgaccaggtgtgcgcgctgctcaccggcggcgggtacgcggagaaggtggtggtgccggcggggctgctgctgccggtgccggagggggtgtcgctgacggacgccgccggcttgcccgaggtggcctgcaccgtctggtccaccgtcttcatggccagccacctctcccccggcgaatccttccttatccacggtggatcaagcggaatcggtacatttgcgatacagatggcaaagcacctcggagtcaaggttttgttactgcaggaagccaagagaagctagatgcttgcgcaggtttgggtgcggatgtatgcataaactacaaaactgaagactttgaagcacgtatcaaagaagaaactaatggaaatggtgttgatgtcattctggacaatatcggcggatcttacgtccagcgcaatctgaacagcttagcagttgatggtaggcttttcatcattggtttcatgggaggcaccgtgactgaagtgaacctgcacgcaatgcttgcccgaagattgaccatacaagttgctggactgcggagcagaagcctggccaataaagctcacatcgtcagcgaggtggagaaaaatgtatggccagccattgtgtcgggcaaggtgaagccggtggtttacagggcactccctctatctgaggcagccgaagctcacaagctgatggagtcaagcacccatattggcaagatactactgattccatgactgggtatggtatccttcagctttgagaagtgtgtaactaagcattgatgtgctatcc

SEQ ID NO: 4891 - DNA, 1351 bp, Zea mays
attaaatctcattcaatccactaggattgagagcaaatatagggtggggcaagcaaggcaggcggagcgggcaagggcaagcgagggatgagaatgagggccgtggtgatcacgtgcgccggcgggccggaggtgctggaggcgcgggaggtggaggaccatcccgcgctaggcgaaggagaggtgctcctcgaggtcgccgccgcgggcgtcaatcgcgcggacaccgtgcagcggatgggccggtacccgccgcctgccggcgcgtccccttacccggggctcgagtgctccggcaccatcctcgcgctcggccccaacgtcccctcccgctgggccgtgggcgataaggtttgcgcgctcctcagcggcggcgggtacgcggataaggtggtggcgccggcggggcagctgctgccgatacccgagggggtgtcgctgacgcacgcagccggcttgcccgaggtggcctgcaccgtctggtcaaccgtattcatgaccagtcacctctcccccggtgaatcattccttatccatggaggatccagtggaattggtacattcgctatacagattgctaagcacctcggaattaaggtttttgtcactgcaggaagtgaagaaaaactagcagcctgcaaagctttgggtgccgatgtatgcattaactacagaactgaagacttcgttgaacgtatcaaacaggaaaccaacggaaagggtgttgatgtgattctggataacattggaggatcatatctccagcgcaacctgaatagcttaggtgttgatggtagacttttcatcattggcttccaagggggcatagcagctgaagtgaacctgcaagctgtgcttgcacgccgtttgaccatacaagctgctggactgcgcaacagaagccttgctaataaggcagagattgttagtgaggtggaaaagaacgtgtggcctgctgtcgctgctggcaaagtgaagccggtgatttacaagacgtttccgttatgtgaagctgctgaggctcataggttgatggaagctagcacccacatcggcaagatactgctgctcccatgactgcacctgtggcgtttgcgctcttgctctcggaggagtcagttcaaaaacatatgcaattcctgagactgtgacaacctgcacggatgttgtactggtgtcgcatgtcttttttatatatatcttgtagtactagattggatcttttaccccgagaaattatcttgtcaattggatccttaaagtgctgatgacatttttctgtgagctatgatataataaatctggcagatagagccactacagcacgtcagtacctgatgccagtgtactg

SEQ ID NO: 4892 - DNA, 1294 bp, Panicum virgatum
ctcgagaggagcaagcaactgcagcggggaggaagatgagggcggtggtgatcacgcgcggcggcggacctgaggtgctagaggcccaggacgtggaggacccggcaccgctgggggaaggcgaggtgctcctccaggtcgccgccgcgggcgtcaaccgcgccgacacgctccagcgccacggccgccacccgccgcccgccggcgcgtccccgtacccggggctcgagtgctccggcaccatcctcgcgctcggtcccaacgtgccctcgcgatggtccgtcggcgacaaggtgtgcgcgttgctaagcggcggcgggtacgcagagaaagtggtggttccggcggggcagctgctgcctgtgccggagggggtgtcgctaacggatgcagccggcttgcccgaggtggcctgcaccgtctggtcgaccgtgttcatgaccagccacctctcgcccggcgaatcattccttatccatggaggatcaagtggaattggtactttcgctattcagattgcaaagcacctcggaattaaggtttttgtgactgcaggaagcgaagaaaaactagcagcctgcaaagatttgggtgctgatgtatgcataaactacaaaactgaagacttcgttgaacgtgtcaaacaggaaaccaatggaaagggtgttgatgtcattctggacaatattggaggatcatatctccagcgtaacctgaacagcttaggtgttgatggtagacttttcatcattggcttccaaggaggcgctgtagctgaagtgaacctgcaagctgtttttgcacggcgcttgaccatacaagctgctggactgcgtggtagaagccctgccaataaagctcagatcgtcagcgaggtggaaaagaatgtgtggcctgccgtcacggctggcaaggtgaagccggtgatttaccagacgttcccgttatctgaagcggctgaggcgcatagattgatggaagctagcacgcacatcggcaagatattgctgctcccttgactgcgcatgtggtgtttgaactctcgctttgggaagaagtttggggctttgggcagatatacaacttctgtaacggcctctatgtatgttacgatgtggcatgccgttttgtattgtaaattcgatcctgtttgacgtctttctgtgaactgtaatgtaataaatgctgatatttttctgtgactagtgtaataaaaagctggtgcatggtcttaaaacatgccgtcacgctacccgaatccagtttgttgccagtggctaagataagccatctt

SEQ ID NO: 4893 - DNA, 1290 bp, Panicum virgatum
gttatcgaaaggagcaagcaactgcagcgagcaagcggacagaggcggccggagggaggaagatgagggcggtggtgatcacgcgcggcggcgggcctgaggtgctagaggcccaggacgtggaggacccggcgccgctgggggaaggggaggtcctcctccaggtcgccgccgccggcgtcaaccgcgccgacacgctccagcgccacggccgccacccgccgcccgccggcgcgtccccgtaccctgggctcgagtgctccggcaccatcctcgcgctcggtcccaacgtgccctcgcgatggtccgtcggcgacaaggtgtgcgcggtgctaagcggcggcgggtacgcggagaaagtggtggtgccggcggggcagctgctgcccgtgccggagggggtgtcgctaacggacgcagccggcttgcccgaggtggcctgcactgtctggtcgaccgtattcatgatcagccacctctcccccggcgaatcattccttatccatggaggatcaagtggaatcggtactttcgctattcagattgcaaagcacctcggaattaaggtttttgtgactgcaggaagtgaagaaaaactagcggcctgcaaagatctgggtgctgatgtatgcataaactacaaaaccgaagacttcgttgaacgtgtcaaacaggaaaccaatggaaagggtgttgatgtcattctggacaatatcggaggatcatatctccagcgtaacctgaacagcttaggtgttgatggtagacttttcatcattggcttccaaggaggcgctgtagctgaagtgaacctgcaagctgttcttgcacggcgcttgaccatacaagctgctggactgcgtggcagaagccctgcaaataaagctcagattgtcagcgaggtggaaaagaatgtgtggcctgctgtcacagctggcaaggtgaagccggtgatttacaagacgttcccgttatctgaagcggctgaggcgcatagattgatggaagctagcacgcacatcggcaagatactgctgctcccttgacagtgcatgtagtgtttggactctcgctttgggaggaagtttagggctttgggcacatattcaacttctgtaacggcctctatgtatgttacggttgtggcatgtcgttttgtcttgtaaattctatccttgaagtgcttgacatttttctttgaactgtaatgtaataaattctgacatttttctgcgactagttatgcaataagaacctggtgcatggtcttataacatgccgtcacgctac

SEQ ID NO: 4894 - DNA, 1138 bp, Secale cereale
aggaactttctcccgtctgttgacctcatggtggatatgtgaaatccactcgtggccgagagcgacgagggagatcgacaccgacgacgatgagggcggtggcgatcgcaaggcccggcgggccggaggtgctggaggagcgcgaggtggaggacgtcccggcgccgggggacggcgaggtggtcctcagggtggccgccgccggcgtcaaccgcaccgacacggtccagcggcagggcgggtacccggcgccgcccggcgcctcgccctacccgggggtcgagtgctccggcgccatcctcgctctcggggccaacgtccacccgcgctgggccgtcggcgaccaggtgtgcgcgctgctcaccggcggcgggtacgcggagaaggtggtggtgccggcggggctgctgctcccagtgccggcgggggtgtcgttgacggacgccgccggcttgcccgaggtggcctgcaccgtctggtccaccgtcttcatggccagccacctctcccccggcgaatccttccttatccacggtggatcaagcggaatcggtacatttgctatacagatggcaaagcacctcggaatcaaggtttttgctactgcaggaagccaagagaagctagatgcttgcgcaggtttgggtgcggatgtatgcataaactacaaaactgaagactttgcagcacgaatcaaagaagaaactaatggaaatggtgttgatgtcattctggacaacgtcggcggatcttatctccagcgcaatctggacagcttagcagtcgatggtaggcttttcatcattggtttcatgggaggcaccgtgactgaagtgaacctgcacgcaatgcttgcccgaagattgaccatacaagttgctggactgcggagcagaagcctggccaataaagctcacatcgtcagcgaggtggagaaaaatgtatggcgagccattgtgtcgggcaaggtgaagccggtggtttacagggcactccctctatctgaggcagccgaagctcacaagctgatggagtcaagcacccatattggcaagatactactgattccatgactgggtatggtatccttcagctttgagaagtgtgtaactaagcattgatgtgctatcctatcttg

SEQ ID NO: 4895 - DNA, 1149 bp, Triticum aestivum
ccacgcgtccgcgacgggggagatcgcgagccccggcgggccggaggtgctggaggagagcgaggtggaggacctcccggcgccgggggacggcgaggtgctcctcagggtggccgccgccggcgtcaaccgcaccgacacggtccagcggcagggcgggtacccccccgccgcccggcgcctcgccgtacccgggggtcgagtgctccggctccatcctcgccctcggggccaacgtccacccgcgctgggccgtcggcgaccaggtgtgcgcgctgcttaacggcggcgggtacgcggagaaggtggtggtgccggcggggcagcttctcccggtgccggagggggtgtcgctgacggacgccgccggcttgcccgaggtggcctgcaccgtctggtccaccgtcttcatgagcagccacctctcccccggcgaatccttccttatccacggtggatcaagcggaatcggtacatttgctatacagatggcaaagcacctcggaatcaaggtttttgttactgcaggaagccaagagaaactagatgcttgtgcaggtttgggtgcggatgtatgcataaactacaaaaccgaagactttgcagcatgtatcaaagaagaaactaatggaaatggaggtgatgtcattctggacaacgtcggcggatcatatctccagcgcaatctggacagcttagcagttgatggtaggcttttcatcattggtttcatgggaggcagcgtgactgaagtgaacctgcaggcgatgcttgcccgaagattgaccatacaagttgctggctgcggagcagaagccttgccaataaagctcagatcgtcagcgaggtggagagaaatgtatggccagccgttgcgtcgggcaatgtgaagccggtggtttacaggacactccctctatctgaggcagctgaagctcacaagctgatggagtcaagctcccacattggcaagatactactgattccatgactgggtatggcatccttcagctttgagcagtgtgtaactctgcattgatgtgctatcctatcttgtaagttgggtcttgaagtgctgatgaacgtggatatatatattgaaaccagttataataagtgttggaacttcgaagtcgctagatttgggtt

SEQ ID NO: 4896 - DNA, 2404 bp, Triticum aestivum
cgagccccggcgggccggaggtgctggaggagagcgaggtggaggacctcccggcgccgggggacggcgaggtgctcctcagggtggccgccgccggcgtcaaccgcaccgacacggtccagcggcagggcgggtacccccccgccgcccggcgcctcgccgtacccgggggtcgagtgctccggctccatcctcgccctcggggccaacgtccacccgcgctgggccgtcggcgaccaggtgtgcgcgctgcttaacggcggcgggtacgcggagaaggtggtggtgccggcggggcagcttctcccggtgccggagggggtgtcgctgacggacgccgccggcttgcccgaggtggcctgcaccgtctggtccaccgtcttcatgagcagccacctctcccccggcgaatccttccttatccacggtggatcaagcggaatcggtacatttgctatacagatggcaaagcacctcggaatcaaggtttttgttactgcaggaagccaagagaaactagatgcttgtgcaggtttgggtgcggatgtatgcataaactacaaaaccgaagactttgcagcatgtatcaaagaagaaactaatggaaatggaggtgatgtcattctggacaacgtcggcggatcatatctccagcgcaatctggacagcttagcagttgatggtaggcttttcatcattggtttcatgggaggcagcgtgactgaagtgaacctgcaggcgatgcttgcccgaagattgaccatacaagttgctgggctgcggagcagaagccttgccaataaagctcagatcgtcagcgaggtggagagaaatgtatggccagccgttgcgtcgggcaatgtgaagccggtggtttacaggacactccctctatctgaggcagctgaagctcacaagctgatggagtcaagctcccacattggcaagatactactgattccatgactgggtatggtatccttcagctttgagcagtgtgtaaccatgcattgatgtgctatcctatcttgtaaagttggttcttgaagtgctgatgaaagtggatataaacatatattgaaaaccattagttataataagtgttggaacttcgaagtcactagatttgggtttgaaaaaaagtcgcttggttgaggcgcctggcatggtgtccttgatgatgatgctcctagttcagatcctactttgcaggattagcattggacggtcacaaccatgatgcattactttgctcagtaggattaatccaggcacctgagtaggttgatggaggattagtgcctgtatattttggattgggcaactgttgcataaacagaactgaataggtttatgacaactgtatattttggatttggcaactgttgcactgtatatttataacctgaataggtttatgtaaccagaacacttgaagagaatttcacagcaagtggtaactggtcagagacaagaagagcaagacaggcctctgtttgattccccacaagagaatgaaaacatacagtggtctacagaccttaatctgccgccttttaggcccaccctgtgtaatcaggtggattggcaggttcaagaagaaaaggaatgtccacagccaagattttttacttttgaaacatacaccaaaggaatttgatataaccaacactacactgcatatgtacagctgacaagcaattttctcaaatccagcacaaaacttctcttcaaaaatgtacactgaaaacacacttatgcattgctactcacaagtgattacttcaaaaattgtgcccgggtgtataggtcattaacaattgcaaacacaagtttctttgctgcagtcgccatatgtactattacaaagctgctcattccatctgtcctcactccaataataagaaaaatgaaaacgaaactagtgctaatctgccagtgaaatgtacttattcctgattaatattcaatggaacggtgcaattgcactccagtttcatggattcagtctgcctcttcaacatctcattatccttttgtaactcttcaaatctcttggttgaatcagacagtgaggtcttgacctttaaaagttcatcttgcaggtccctgtttttcgccaattccgtgtcgtatttcattctccattcagcggattcatccattgcctctaggttagcatgctcgaactgcctccggagctcctcgcggtcgtcggcggtgaaggaggggtcgtcggactggcgcgcccagatgcggaagtagacggcggtgcccatcagcagcgccaccgcgaacgccaccatcagcgcctgccgctcctgccgccgcccccctcctcctccgcttgctactccccctcttcctcccatcatcttcctccttcctcgccgatctgccctcc

SEQ ID NO: 4897 - DNA, 1391 bp, Secale cereale
ggccggaggtgctggaggagcgcgaggtggaggacgtcccggcgccgggggacggcgaggtggtcctcagggtggccgccgccggcgtcaaccgcaccgacacggtccagcggcagggcgggtacccggcgccgcgcggcgcctcgccatacccgggggtcgagtgctccggctccatcctcgctctcggggccaacgtccacccgcgctgggccgtcggcgaccaggtgtgcgcgctgctcaccggcggcgggtacgcggagaaggtgttggtgccggcggggctgctgctgccggtgccggagggggtgtcgctgacggacgccgccggcttgcccgaggtggcctgcaccgtctggtccaccgtattcatgaccagccacctctcccccggcgaatccttccttatccacggtggatcaagcggaatcggtacatttgctatacagatggcaaagcacctcggaatcaaggtttttgttactgcaggaagccaagagaaactagatgcttgcgcaggtttgggtgcggatgtatgcataaactacaaaactgaagactttgaagcacgtatcaaagaagaaactaatggaaatggtgttgatgtcattctggacaatatcggcggatcttacctccagcgcaatctggacagcttagcagtcgatggtaggcttttcatcattggtttcatgggaggcaccgtgactgaagtgaacctgcacgcaatgcttgcccgaagattgaccatacaagttgctggactgcggagcagaagcctggccaataaagctcacatcgtcagcgaggtggagaaaaatgtatggccagccatcgcgtcgggcaaggtgaaaccggtagtttacaagacgctccctctatctgaggcagctgaagctcacaagctgatggagtcaagctcccacattggcaagatactactgattccatgactgggtatggtatccttcagctttgagcagtgtgtaactatgcattgatgtgctatcctatcttgtaaagttggttcttgaagtgctgatgaaagtggatatatacattgaaaaccattagttataataagtgttggaacttcaaagtcactagatttgggtttcaaaaaagtcgcttagttgaggcgcctggcagagtgttcttgatgatgatgatgctcctagttcagatcctactgagcaggattagcactgaacggtgacaaccatgatgtgttaatttgctcagtaggattaatccaggcacctgaataggttgatggaggattagcacctgtatattttgggttgggcaactgttgcataaacagaagtgaataggtttatgacaactgtatattttggattgggcaaccgttgcactattatttataacct

SEQ ID NO: 4898 - DNA, 1311 bp, Zea mays
gtgaaaaatcgtgttcccagcagagccagtgcaattatcggaagcaactgcagagctgcagcgaccaagcggacgacgcgagagagatgagggcggtggtgatcacgcgcggcggcggcggcccggaggtgctggaggcgcaggaggtagaggaccccgcgccgctgggcgacggcgaggtcctcctccaggtggtcgccgcgggcgtcaaccgcgccgacacgctccagcgccacggccgccacccgccgcccgccggcgcccccccgtacccggggctcgagtgctccggcaccatcctcgcgctcggccccaacgccccaccacggtgggccgtcggcgacaaggtctgcgcgctgcttagcggcggcgggtacgccgagaaggtggtggtgccggcgggacagctgctgccggtgccggagggcgtgtcccttgcggacgcggccggcttacccgaggtggcatgcaccgtctggtccaccgtcttcatgaagtcatgaccagccacctctcccccggagaatcgttccttatacatgggggatcaagtggaattggtacgttcgctatacagattgcgaagcacctcggaattatggtttttgtcacagcaggaactgaagaaaaattagcggcctgcaaaggtttgggtgccgatgtatgcataaactacaaaaccgaagattttgttgagcgtgtcaaacaggaaacaaatgggaaaggtgttgatgtaatccttgacaacatcggaggaccatatctcgagcgcaatctgaacagcctaggtgttgatggtagacttttcatcatcggcttccaaggcggcgctgtagctgaagtgaacctgcaagcggtgtttgcgtggcgtttaaccatacaagctgctggactgcgcggcagaagcgctgctagtaaaacccagatcgtcagtgaggtggagaagaacgtgtggcccgccgtcgctgctggcaaggtgaacccggtgatctacaagacattcccgttatccgaagcagctgatgctcatcggttgatcgaatctagcatgcacattggcaaaatactgctgctcccatgactccatgtccagtgtctgctgtcaaactcttggagagagtcagctaaagcgagctacaaactcctgtaacgacctctaaacatactactatcatgtactggtgtgtagcatgcctttctatattttgttagttcgatccttgatactgccgatgaaactgttctgtgaaccgtggtgcacagtaatacattatggttggttgctacagtaccttgatgtcagcttgttta

SEQ ID NO: 4899 - DNA, 806 bp, Triticum aestivum
ccgggatttctagctgcaggcagagcagagttgagcgtgtgggagtcgaaggagatcgagatggctactgcatatgctcctccgatggcaagccaggtgatgaagagcggcttggtgtgctccaagccgaggggactgtccggcgcttcactcaccaggaggccccgcttcgtcgtcaaggccgtcaagtccgacaaggggacgtaccaggtggtccagcccatcaacggcgacccattcatcggcagcctggagacgcccgtcacgtccagccccctcgtcgcgtggtacctctccaaccttcccgcgtaccgcaccgccgtcagcccgctcctccgtggcatcgaggtcggcctcgcccacggctacctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgccctcacgctcaccggccgcaagaaggaggccgacaagctgcagaccgccgaaggctggtcccagttcaccggaggcttcttcttcggcggcgtctccggcgccatctgggcctacttcctcctctacgtgctcgacctcccatacttcttcaagtagattatttattattggcatgcatgtacgatgggtgcacaactgcagatgatgtgatcgatctcttcttggtggttggttgaaagagtctatgtataaatgaacttacgtattcctca

SEQ ID NO: 4900 - DNA, 817 bp, Pseudoroegneria spicata
tgcaggcagagcagagttgagcgtgtgggagttgaaggaggagagatggctacagcatacgctcctccgatggcgagccaggtgatgaagagcggcttggtgtgctccaagccgcggggaatgtccggcgcttcgctcaccaggaggccccgcttcgtcgtcaaggccgtcaagtctgacaaggggacgtaccaagtggtccagcccatcaacggcgacccgttcatcggcagcctggagacgcccgtcacctccagccccctcgtcgcgtggtacctctccaacctccccgcgtaccgcaccgccgtcagcccgctcctccgcggcatcgaggtcggcctcgcccacggctacctcctcgtcggccccttcgccctcaccggcccgctccgcaacacgcccgtgcacggccaggccggcaccctcggcgccatcggcctcgtctccatcctcagcgtctgcctcaccatgtacggcgtcgcgtccttcaacgagggcgcgccctccaccgcgcccgcgctcacgctcaccggccgcaagaaggaggccgacaagctgcagaccgccgaagggtggtcgcagttcaccggaggcttcttcttcggcggtgtctccggcgccgtgtgggcctacttcctcctctacgtgctcgacctcccatacttcttcaagtagatgattattggcatgtacgatgtgcagatgatgtgatctcttctcggtggttgcttgaacgagtctatgtataaatgaatttacatattcctcacaaactttgggtctagcttatttcttccctcagtggacaaaaaaaaaa

SEQ ID NO: 4901 - DNA, 1145 bp, Triticum aestivum
ccgccgcgtgtttgcgcccacgagaacaccccaggcgcgtccgaccccccggagttgaccctagcccggggcagcggttaacattcgacccccgggggcccctattgaccctaggcctcttgtggggcccccttgagaaccagtttgtcccaaaacacaggctggaccggtccggaattcccggaaattcgtcgaaccaagcgtcccccgatgggggccgagggacactaccatgggtttaagggggaggaaaggattctcccctctgcctttggagccactaaaacatatttccatcccggccaattttcttcctgtaacacatccatccatttctagctgcaggcagagcagagttgagcgtgtgggagtcgaaggagatcgagatggctactgcatatgctcctccgatggcaagccaggtgatgaagagcggcttggtgtgctccaagccgaggggactgtccggcgcttcactcaccaggaggccccgcttcgtcgtcaaggccgtcaagtccgacaaggggacgtaccaggtggtccagcccatcaacggcgacccattcatcggcagcctggagacgcccgtcacgtccagccccctcgtcgcgtggtacctctccaaccttcccgcgtaccgcaccgccgtcagcccgctcctccgtggcatcgaggtcggcctcgcccacggctacctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgccctcacgctcaccggccgcaagaaggaggccgacaagctgcagaccgccgaaggctggtcccagttcaccggaggcttcttcttcggcggcgtctccggcgccatctgggcctacttcctcctctacgtgctcgacctcccatacttcttcaagtagattatttattattggcatgcatgtacgatgggtgcacaactgcagatgatgtgatcgatctcttcttggtggttggttgaaagagtctatgtataaatgaacttacgtattcctcacaatctttgcatg

SEQ ID NO: 4902 - DNA, 821 bp, Triticum aestivum
ttcttcctgtaacacatccatccatttctagctgcaggcagagcagagttgagcgtgtgggagtcgaaggagatcgagatggcaactgcatatgctcctccgatggcgagccaggtgatgaagagcggcttggtgagctccaagccgcgggggctgtccggcgcctcactcaccaggaggccccgcttcgtcgtcaaggccgtcaagtctgacaaggggacgtaccaggtggtccagcccatcaacggcgacccgttcatcggcagcctggagacgcccgtcacctccagccccctcgtcgcgtggtacctctccaacctccccgcgtaccgcaccgccgtcagcccgctcctccgcggcatcgaggtcggcctcgcccacggctatctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgcgctcacgctcaccggccgcaagaaggaggccgacaagctgcagactgcggaaggctggtcgcagttcaccggaggcttcttcttcggcggtgtctcgggcgccatctgggcctacttcctcctctacgtgctcgacctcccatacttcttcaagtagatgattattgtttggcatgtacgatgggtgcagatgatgtgatctcttcttgatggttgcttgaaagagtctatgtataaatgaatttacgtattcctcagaacctttgcatg

SEQ ID NO: 4903 - DNA, 802 bp, Triticum aestivum
ctgtaacacatccatccatttctagctgcaggcagagcagagttgagcgtgtgggagtcgaaggagatcgagatggcaactgcatatgctcctccgatggcgagccaggtgatgaagagcggcttggtgagctccaagccgcgggggctgtccggcgcctcactcaccaggaggccccgcttcgtcgtcaaggccgtcaagtctgacaaggggacgtaccaggtggtccagcccatcaacggcgacccgttcatcggcagcctggagacgcccgtcacctccagccccctcgtcgcgtggtacctctccaacctccccgcgtaccgcaccgccgtcagcccgctcctccgcggcatcgaggtcggcctcgcccacggctatctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgcgctcacgctcaccggccgcaagaaggaggccgacaagctgcagactgcggaaggctggtcgcagttcaccggaggcttcttcttcggcggtgtctcgggcgccatctgggcctacttcctcctctacgtgctcgacctcccatacttcttcaagtagatgattattgtttggcatgtacgatgggtgcagatgatgtgatctcttcttgatggttgcttgaaagagtctatgtataaatgaatttacgtattcctca

SEQ ID NO: 4904 - DNA, 1197 bp, Hordeum vulgare
gctccggaccatatctcgtatgcagggtcccgcccaacaggacccagattctcccctctcccttggagccactaaaacatcttgccatctggacagatcttcttcttgtaacacatccatccatttgacgctgcaggcagagcagagttgagcgtgtgggagtcgaaggaggacatcgagatggccactgcatatgctcctcccatggcgagccaggtgatgaagagcggcttggcgtgctccaagccgcggggcatgtccggcgcttcgctcacccggaggccccgcttcgtcgtcaaggctgtcaagtctgacaagccgacgtaccaagtggtccagcccatcaacggcgacccgttcatcggcagcctggagacgccggtcacctccagccccctcgtcgcgtggtacctctccaacctccccgcctaccgcaccgccgtcagcccgctcctccgcggcatcgaggtcggcctcgcccatggctacctcctcgtcggccccttcgcgctcactggcccgctccgcaacacgcccgtgcacggacaggccggcacactcggcgccatcggactcgtctccatcctcagcgtctgcctcaccatgtacggcgtcgcctccttcaacgagggcgagccgtccaccgcgccggtgctcaccctcaccggacgcaagaaggaggccgacaagctccagaccgccgaagggtggtcgcagttcaccggaggcttcttcttcggcggtgtatccggcgccgtctgggcatacttcctcctctacgtgctcgacctcccatacttcttcaagtagattaataggtggcatgcatgtacgatgtctccagatcatgccatctcttctcggtggttgcctgaacgagtcttctatgtataaatgaatttttacatattcctcataatctttgggactagcttatttcgtcgctcaatggactcgtggtggtggttgtcggcgccgtctcgtcgctgcgccgccttcttctacctcctagcaacactctcttcttctctcaagaacacacaccacggagaaactctacaaacacatgtactaaggaagaacacaaaggctttgtcgagatgctctcttccttggctatcacaatggctacatttttctcttgcattccccacaacgcaaatcagctgagtacatgtgttcaagtaccaaacctac

SEQ ID NO: 4905 - DNA, 1092 bp, Hordeum vulgare
gcctctcccttggagccactaaaacatcttgccatctggacagatcttcttcttgtaacacatccatccatttgacgctgcaggcagagcagagttgagcgtgtgggagtcgaaggaggacatcgagatggccactgcatatgctcctcccatggcgagccaggtgatgaagagcggcttggcgtgctccaagccgcggggcatgtccggcgcttcgctcacccggaggccccgcttcgtcgtcaaggctgtcaagtctgacaagccgacgtaccaagtggtccagcccatcaacggcgacccgttcatcggcagcctggagacgccggtcacctccagccccctcgtcgcgtggtacctctccaacctccccgcctaccgcaccgccgtcagcccgctcctccgcggcatcgaggtcggcctcgcccatggctacctcctcgtcggccccttcgcgctcactggcccgctccgcaacacgcccgtgcacggacaggccggcacactcggcgccatcggactcgtctccatcctcagcgtctgcctcaccatgtacggcgtcgcctccttcaacgagggcgagccgtccaccgcgccggtgctcaccctcaccggacgcaagaaggaggccgacaagctccagaccgccgaagggtggtcgcagttcaccggaggcttcttcttcggcggtgtatccggcgccgtctgggcatacttcctcctctacgtgctcgacctcccatacttcttcaagtagattaataggtggcatgcatgtacgatgtctccagatcatgccatctcttctcggtggttgcctgaacgagtcttctatgtataaatgaatttttacatattcctcataatctttgggactagcttatttcgtcgctcaatggactcgtggtggtggttgtcggcgccgtctcgtcgctgcgccgccttcttctacctcctagcaacactctcttcttctctcaagaacacacaccacggagaaactctacaaacacatgtactaaggaagaacacaaaggctttgtcgagatgctctcttccttggctatcacaatggctacatttttctcttgc

SEQ ID NO: 4906 - DNA, 853 bp, Secale cereale
aacatattgccatctgggcagatcttcttcctgtaacacatccatccatttgtagctgcaggcagagcagagttgagcgtgtgagagttggaggagagatggctactgcatatgctcctccgatggcgagccaggtgatgaagagcggcctggtgtgctccaagccgcgggggctgtccggcgcctcactcaccaggaggtctcgcttcgtagtcaaggccgtcaagtccgacaaggggacgtaccaggtggtccagcccatcaacggcgaccccttcatcggcagcctggagacgcccgtcacctccagccccctcgtcgcctggtacctctccaacctccccgcgtaccgcaccgccgtcagcccgctcctccgcggcatcgagatcggcctcgcccacggctacctcctcgtcggccccttcgcgctcaccggcccgctccgcaacacccccgtgcacggccaggccggcaccctcggcgccatcggcctcgtctccatcctcagcgtctgcctcaccatgtacggggtcgcctccttcaacgagggcgcgccctccaccgcgcccgcgctcacgctcaccggccgcaagaaggaggccgacaagctgcagaccgccgaagggtggtcgcagttcactggaggcttcttcttcggtggtgtttccggcgccatctgggcctacttcctcctctacgtcctcgacctcccatacttcttcaagtagattaattattggcaagcatgtacgatgggcgcacaactgcagatgatgtcatctcttcttggtggttggttgaaagagtctatgtataaatgaacttacgtattcctcaaaaaaaaaaaaaacta

SEQ ID NO: 4907 - DNA, 769 bp, Secale cereale
gactgcgtgtgagagttggaggaggagagatggctactgcatatgctcctccgatggcgagccaggtgatgaagagcggcttggtgtgctccaagccgcgggggctgtctggtgcttcactcaccaggaggtctcgcttcgtcgtcaaggccgtcaagtctgacaaggggacgtaccaggtggtccagcccatcaacggcgacccgttcatcggcagcctggagacgcccgtcacctccagccccctcgtcgcgtggtacctctccaacctccccgcgtaccgcaccgccgtcagcccgctcctccgcggcatcgagatcggcctcgcccacggctacctcctcgtcggccccttcgcgctcaccggcccgctccgcaacacccccgtgcacggccaggccggcaccctcggcgccatcggcctagtctccatcctcagcgtatgtctcaccatgtacggcgtcgcctccttcaacgagggagcgccatccaccgcgcccgcgctcacgctcaccggccgcaagaaggaggccgacaagctgcagaccgccgaagggtggtcgcagttcactggaggcttcttcttcggtggtgtttccggcgccatctgggcctacttcctcctctacgtcctcgacctcccatacttcttcaagtagattaattattggcatgcatgtacgatgggcgcacaactgcagatgatgtcatctcttcttggtggttggttgaaagagtctatgtataaatgaacttacgtattcctcac

SEQ ID NO: 4908 - DNA, 788 bp, Secale cereale
ggcagagcagagttgagcgtgtgagagttggaggaggagagatggctactgcatatgctcctccgatggcgagccaggtgatgaagagcggcttggtgtgctccaagccgcgggggctgtctggtgcttcactcaccaggaggtctcgcttcgtcgtcaaggccgtcaagtctgacaaggggacgtaccaggtggtccagcccatcaacggcgacccgttcatcggcagcttggagacgcccgtcacgtccagccctctcgtcgcgtggtacctctccaacctccccgcgtaccgcaccgccgtcagcccgctcctccgcggcatcgagatcggcctcgcccacggctacctcctcgtcggccccttcgcgctcaccggcccgctccgcaacacccccgtgcacggccaggccggcaccctcggcgccatcggcctagtctccatcctcagcgtatgtctcaccatgtacggcgtcgcctccttcaacgagggagcgccatccaccgcgcccgccctcacgctcaccggccgcaagaaggaggctgacaagctgcagaccgccgaagggtggtcgcagttcaccggaggcttcttcttcggtggtgtttccggcgccatctgggcctacttcctcctctacgtcctcgacctcccatacttcttcaagtagattaattattggcatggatgcatgtacgatgggtgcacaactgcagatgatgtcatctcttcttggtggttggttgaaagagtctatgtataaatgaacttacgtattcctcacaat

SEQ ID NO: 4909 - DNA, 932 bp, Secale cereale
tcagcttggagccactaaaacatattgccatctgggcagatcttcttcctgtaacacatccatccatttgtagctgcaggcagagcagagttgagcgtgtgagagttggaggaggagagatggctactgcatatgctcctccgatggcgagccaggtgatgaagagcggcttggtgtgctccaagccgcgggggctgtctggtgcttcactcaccaggaggccccgcttcgtcgtccaggccgtcaagtccgacaaggggacgtaccaggtggtccagcccatcaacggcgacccgttcatcggcagcctcgagacgcccgtcacctccagccccctcgtcgcgtggtacctctccaacctccccgcgtaccgcaccgccgtcagcccgctcctccgcggcatcgagatcggcctcgcccacggctacctcctcgtcggccccttcgcgctcaccggcccgctccgcaacacccccgtgcacggccaggccggcaccctcggcgccatcggcctagtctccatcctcagcgtatgtctcaccatgtacggcgtcgcctccttcaacgagggagcgccatccaccgcgcccgccctcacgctcaccggccgcaagaaggaggctgacaagctgcagaccgccgaagggtggtcgcagttcaccggaggcttcttcttcggtggtgtttccggcgccatctgggcctacttcctcctctacgtcctcgacctcccatacttcttcaagtagattaattattggcatggatgcatgtacgatgggtgcacaactgcagatgatgtcatctcttcttggtggttggttgaaagagtctatgtataaatgaacttacgtattcctcacaatctttggatggatgatactgcgtgttataacatgggattgtttaatatctactccctccgttcctaa

SEQ ID NO: 4910 - DNA, 822 bp, Leymus cinereus x Leymus triticoides
gcagagttgagcgtgtgggagttgaaggagatcgagatggctactgcatatgctcctccgatggcgagccaggtgatgaagagcggcttggtgtgctccaagccgcgggggctgtctggtgcttcgctcaccaggaggccacgcttcgtcgtcaaggctgtgaagcctgacaaggcgacgtaccaggtggtccagcccatcaacggcgacccattcatcggcagcctggagacgcccgtcacctccagccccctcgtcgcgtggtacctctccaacctcccggcgtaccgcaccgccgtcagcccgctcctccgcggcatcgaggtcggcctcgcccacggctacctcctcgtcggccccttcgcgctcaccggcccgctccgcaacacgcccgtgcacggccaggccggcgccctcggcgccatcggcctcgtctccatcctcagtgtctgcctcaccatgtacggcgtcgcttccttcaacgagggcgcgccgtccaccgcgcccgcgctcacgctcaccggccgcaagaaggaggccgacaagctgcagaccgctgaagggtggtcgcagttcacgggagggttcttctttggcggtgtctccggcgccgtgtgggcttacttcctcctctacgtgctcgacctcccgtacttcttcaagtagaagagacgtgttggcatgtacgatggctgcacaactgcagatgctgtgatctcttcttggtggttgcttgaaagagtctatgtataaatgaatttacatattcctcacaatctttgcatggatgatactacgtactactagtataaccaaagtttt

SEQ ID NO: 4911 - DNA, 758 bp, Secale cereale
  misc_feature (105)..(105): n is a, c, g, or t
  misc_feature (134)..(134): n is a, c, g, or t
  misc_feature (137)..(137): n is a, c, g, or t
  misc_feature (140)..(140): n is a, c, g, or t
  misc_feature (167)..(167): n is a, c, g, or t
  misc_feature (230)..(230): n is a, c, g, or t
  misc_feature (278)..(278): n is a, c, g, or t
  misc_feature (485)..(485): n is a, c, g, or t
  misc_feature (506)..(506): n is a, c, g, or t
  misc_feature (512)..(512): n is a, c, g, or t
  misc_feature (527)..(527): n is a, c, g, or t
  misc_feature (557)..(557): n is a, c, g, or t
  misc_feature (596)..(596): n is a, c, g, or t
  misc_feature (713)..(713): n is a, c, g, or t
acgagcgtagctgcaggcagagcagagttgagcgtgtgagagttggaggagagatggctactgcatatgctcctccgatggcgagccaggtgatgaagagcggcntggtgtgctccaagccgcgggggctgtcnggngcntcactcaccaggaggtctcgcttcgtngtcaaggccgtcaagtccgacaaggggacgtaccaggtggtccagcccatcaacggcgacccnttcatcggcagcctggagacgcccgtcacctccagccccctcgtcgcntggtacctctccaacctccccgcgtaccgcaccgccgtcagcccgctcctccgcggcatcgagatcggcctcgcccacggctacctcctcgtcggccccttcgcgctcaccggcccgctccgcaacacccccgtgcacggccaggccggcaccctcggcgccatcggcctagtctccatcctcagcgtatgtctcaccatgtacggngtcgcctccttcaacgagggngcgccntccaccgcgcccgcnctcacgctcaccggccgcaagaaggaggcngacaagctgcagaccgccgaagggtggtcgcagttcacnggaggcttcttcttcggtggtgtttccggcgccatctgggcctacttcctcctctacgtcctcgacctcccatacttcttcaagtagattaattattggcaagcatgtacgatgggngcacaactgcagatgatgtcatctcttcttggtggttggttgaaa

SEQ ID NO: 4912 - DNA, 889 bp, Secale cereale
tcaggtttttttcttttttgtttctttaggttctagtagtcagagttgagcgtgtgggagtctaaggagatcgagatggccacagcatatgctcctccgatggcgagccaggtgatgaagagcgtcttggtgtgctccaagccgcgggggctgtctggtgcttcactcaccaggaggtctcgcttcgtcgtcaaggccgtcaagtctgacaaggggacgtaccaggtggtccagcccatcaacggcgacccgttcatcggcagcctggagacgcccgtcacctccagccccctcgtcgcgtggtacctctccaacctccccgcgtaccgcaccgccgtcagcccgctcctccgcggcatcgagatcggcctcgcccacggctacctcctcgtcggccccttcgcgctcaccggcccgctccgcaacacccccgtgcacggccaggccggcaccctcggcgccatcggcctcgtctccatcctcagcgtctgcctcaccatgtacggtgtcgcctccttcaacgagggcgcgccctccaccgcgcccgcgctcacgctcaccggccgcaagaaggaggccgacaagctgcagactgccgaagggtggtcccagttcaccggaggcttcttctttggcggtgtctccggcgccatctgggcatacttcctcctctacgtcctcgacctcccttacttcttcaagtagattaattattggcatggatgcatgtacgatgggtgcacaactgcagatgatgtcatctcttcttggtggttggttgaaagagtctatgtataaatgaacttacgtattcctcacaatctttggatggatgatactgcgtgttataacatgggaatgtttaatatctactaccgtaaaaaaaaaa

SEQ ID NO: 4913 - DNA, 805 bp, Leymus cinereus x Leymus triticoides
  misc_feature (278)..(278): n is a, c, g, or t
tgcagcagagcagagttgagcgtgtgagagttggaggaggagagatggctactgcatatgctcctccgatggtgagccaggtgatgaagagcggcttggtgtgctccaagccgcgggggctgtccggcgcttcactcaccaggaggccccgcttcgtcgtcaaggctgtcaagcctgacaaggcgacgtaccaggtggtccagcccatcaacggcgacccgttcatcggcagcctggagacgcccgtcacctccagccccctcgtcgcgtggtacctntccaacctcccggcgtaccgcaccgccgtgagcccgctcctccgcggcatcgaggtcggcctcgcccacggttacctcctcgtcggccccttcgcgctcaccggcccgctccgcaacacgcccgtgcacggccaggccggcgccctcggcgctatcggcctcgtctccatcctcagcgtctgcctcaccatgtacggcgtcgcgtccttcaacgagggtgcgccgtccaccgcgcccgctctcacgctcaccggccgcaagaaggaggccgacaagctgcagaccgccgaagggtggtcccagttcacgggagggttcttcttcggcggtgtctccggcgccgtgtgggcttacttcctcctctacgtgctcgacctcccatacttcttcaagtagattattggcatgtacgatgggtgcacaactgcagatgatgtgatctcttcttggtggttgcttgaaagagtctatgtataaatgaatttacatattcctcacaatctttgcatggatgatactacgtatta

SEQ ID NO: 4914 - DNA, 687 bp, Hordeum vulgare
gtgggagtcgaaggaggacatcgagatggccactgcatatgctcctcccatggcgagccaggtgatgaagagcggcttggcgtgctccaagccgcggggcatgtccggcgcttcgctcacccggaggccccgcttcgtcgtcaaggctgtcaagtctgacaaggtcagtcgacgtaccaagtggtccagcccatcaacggcgacccgttcatcggcagcctggagacgccggtcacctccagccccctcgtcgcgtggtacctctccaacctccccgcctaccgcaccgccgtcagcccgctcctccgcggcatcgaggtcggcctcgcccatggctacctcctcgtcggccccttcgcgctcactggcccgctccgcaacacgcccgtgcacggacaggccggcacactcggcgccatcggactcgtctccatcctcagcgtctgcctcaccatgtacggcgtcgcctccttcaacgagggcgagccgtccaccgcgccggtgctcaccctcaccggacgcaagaaggaggccgacaagctccagaccgccgaagggtggtcgcagttcaccggaggcttcttcttcggcggtgtatccggcgccgtctgggcatacttcctcctctacgtgctcgacctcccatacttcttcaagtagattaataggtggcatgcatgtacgatg

SEQ ID NO: 4915 - DNA, 797 bp, Avena sativa
gcagagttgagctagcaggttgaggggaagacgatggccaccgcgtatgctcctcccatggcgagccagctgctgaagagcagcagcagcagcttggtgtgctccaagccgaggggtctgtccggtgcctcgctcacgaccaggaggccccgcttcgtcgtcaaggccatcaaggctgacaagccaaactaccaggtggtgcagcctatcaacggcgaccccttcatcggcagcctggagacgcccgtcacctccagcccgctcgtcgcgtggtacctctccaacctccccgcctaccgcaccgccgtcagcccgctgctccgcggcatcgaggtcggcctcgcccacggctacctcctcgtcggccccttcgcgctcaccggcccgctccgcaacacccccgtgcacggccaggccggcgcgctcggcgccatcggcctcgtcaccatcctcagcgtcgtcctcaccatgtacggcgtcgcctccttcgaggacggcgcgccctccaccgcgccatcgctcacactcaccggacgcaagaaggaggccgacaagctgcagaccgccgagggctgggcgcagttcaccggggggttcttcttcggcggcgtctccggcgccgtctgggcctacttcctcctctacgtcctcgacctcccatacttcttcaagtagaactcttaccatgtacagtacatgcatggctgtagatgcttgcttgagcctatgtacgtgtaaatgaatctgttccgcacaatccatcttttgcatgcatggaggggagtactattttaaca

SEQ ID NO: 4916 - DNA, 969 bp, Avena sativa
cgcacatacctctgatctgaacaagtcttctccagcagttgcagcagagttgagctagcgcgtgaagcaggttgaggggaagacgatggccaccgcttatgctcctcccatggcgagccagctgctgaagagcagcaacagcagcttggtgtgctccaagccgaggggcctgtccggtgcctcgctcaccacgaggcggccccgcttcgtcgtcaaggctatcaaggctgacaagccaaactaccaggtggtgcagcccatcaacggcgaccccttcatcggcagcctggagacgcccgtcacctccagcccgctcgtcgcatggtacctctccaacctcccggcctaccgcaccgccgtcagcccgctgctccgcggcatcgaggtcggcctcgcgcacggatacctcctcgtcggccccttcgcgctcaccggcccgctccgcaacacgcccgtgcacggccaggccggcgcgctcggcgccatcggcctcgtcaccatcctcagcgtcgtcctcaccatgtacggcgtcgcctccttcgaggacggcgcgccctccaccgcgccatcgctcaccctcacggggcgcaagaaggaggccgacaagctgcagaccgccgagggctgggcgcagttcaccggggggttcttcttcggcggcgtctccggcgctgtctgggcctacttcctcctttacgtcctcgacctcccatacttcttcaagtagaacccttaccgtgtacatgcttgcttgagcctatgtacgtgtaaatgaatctgttccgcacaatccatcttttgcatgcatgcaggggagtactattttaacatggcaagggcgtgctaatttctcaattacttgttgaggtttaagttgcacaacaaatttaggcggcctaactaccgaaatgtatctcccaagctccttggagctactttttaaagaaaattcaaaaaccctaatttcgt

SEQ ID NO: 4917 - DNA, 919 bp, Brachypodium distachyon
acacacactctaattcggccacctcgatcaacatcccattcgcagcagagagttgagcgtctgtacgtgctagactgagggaaaaatcaagatggctactgcgtttgctcccccgatggcaagccagctgatgaagagcagcctggcgtgctccaagcccaggggcctatccggtgcttccctgacgaggaggccccgcttcgtcgtcaaggctatcaagcccgacaaggcaacgtaccaggtggtgcagcccatcaacggcgacccattcatcggcagcctggagaccccggtgacgtcgagcccgctggtggcgtggtacctctcgaacctgccggcgtaccggacggccgtgagcccgctgctccggggcatcgaggtgggcctggcccacgggtacctcctcgtgggccccttcgcgctgacgggcccgctccgcaacacccccgtgcacgggcaggcgggcgccctgggcgccgcgggcctcgtcaccatcctcagcctctgcctcaccatgtacggcgtgtcgtccttcgacgagggcgcgccgtccaccgcgcccacgctcacgctcacgggccgcaagaaggaggccgacaagctgcagacggcccaagggtggtcgcagttcaccggggggttcttcttcggcggcatctccggcgtcctctgggcttacttcctcctctacgtgcttgacctcccctacttcttcaagtagaaagagttttgtgatggtgatatgcatcgggtagatgatgattcgcgtcaatgtttgttgtacttgtaagttgtaaacttgttacttgggggtgttgatttctcagctggccgggtgaaatcgatttacacatggaccaatgcaatattgtatatttcgaaaaggaaatgttccattgtcataaggataggatgcaaa

SEQ ID NO: 4918 - DNA, 1172 bp, Brachypodium distachyon
gggctgcacccaatgaacgccgcacagctcgggaccatatctcctctgcagggccccgcactggccactcgccagattttctccactccccctgcagcatctaaagatcacacacactctaattcggccacctcgatcaacatcccattcgcagcagagagttgagcgtctgtacgtgctagactgagggaaaaatcaagatggctactgcgtttgctcccccgatggcaagccagctgatgaagagcagcctggcgtgctccaagcccaggggcctatccggtgcttccctgacgaggaggccccgcttcgtcgtcaaggctatcaagcccgacaaggcaacgtaccaggtggtgcagcccatcaacggcgacccattcatcggcagcctggagaccccggtgacgtcgagcccgctggtggcgtggtacctctcgaacctgccggcgtaccggacggccgtgagcccgctgctccggggcatcgaggtgggcctggcccacgggtacctcctcgtgggccccttcgcgctgacgggcccgctccgcaacacccccgtgcacgggcaggcgggcgccctgggcgccgcgggcctcgtcaccatcctcagcctctgcctcaccatgtacggcgtgtcgtccttcgacgagggcgcgccgtccaccgcgcccacgctcacgctcacgggccgcaagaaggaggccgacaagctgcagacggcccaagggtggtcgcagttcaccggggggttcttcttcggcggcatctccggcgtcctctgggcttacttcctcctctacgtgcttgacctcccctacttcttcaagtagaaagagttttgtgatggtgatatgcatcgggtagatgatgattcgcgtcaatgtttgttgtacttgtaagttgtaaacttgttacttgggggtgttgatttctcagctggccgggtgaaatcgatttacacatggaccaatgcaatattgtatatttcgaaaaggaaatgttccattgtcataaggataggatgcaaactgagtaggaatctgcgtgcagtgacctgaagcttttttttttggctgcagtttgttgaacatgttgcattagtatttttatactccttttcgcaacagataacggccgtagagagcattcagccaaacctttctaacttctag

SEQ ID NO: 4919 - DNA, 858 bp, Avena sativa
ctaaagatcacgcacatacctctgatctgaacaagtcttctctagcagttgcagcagagttgagctagcgcgtgaagcaggtcgaggggaagacgatggccaccgcttatgctcctcccatggcgagccagctgctgaagagcaacagcagcagcttggtgagctccaagccgaggggcctgtccggtgcctcactcacgaccaggaggccccgcttcgttgtcaaggccatcaaggctgacaagccaaactaccaggtggtgcagcccatcaacggcgaccccttcatcggcagcctggagacgcccgtcacctccagcccgctcgtcgcatggtacctctccaacctccccgcctaccgcaccgccgtcagcccgctgctccgcggcatcgaggtcggcctcgcccacggctacctcctcgtcggccccttcgcgctcaccggcccgctccgcaacacgcccgtgcacggccaggccggcgcgctcggcgccatcggcctcgtcaccatcctcagcgtcgtcctcaccatgtacggcgtcgcctccttcgaggacggcgcgccatccaccgcgccatcgctcaccctcaccggacgcaagaaggaggccgacaagctgcagaccgccgagggctgggcgcagttcaccggggggttcttcttcggcggcgtctccggcgccgtctgggcctacttcctcctctacgtcctcgacctcccatacttcttcaagtagaattcttaccgtgtacatgcatgcatggctgtagatgcttgcttgagtctatgtacgtgtaaatgaatctgttccgcacaatccatcttttgcatgcatggaggggagtactattttaaca

SEQ ID NO: 4920 - DNA, 969 bp, Oryza sativa
agttgccaagaaggctgtttcacatccattttttttggccgggagagagagcatctagctagggagagaaaggaagagacgagaggagagagatggccactgcttatgctcccatggcgagccagctgatgaagagcagcttggtgtgctccaagccgagggggctgtctggtgcttcgctgacaaggaggccccgcttcacagtcaaggccatccagtctgagaagccaacgtaccaggtggtgcagcccatcaatggcgaccccttcatcggcagcctggagacgccggtgacctccagcccgctggtcgcctggtacctctccaacctcccggcgtaccgcaccgccgtcagcccgctgctccgcggcatcgaggtcggcctcgcccacggctacctcctcgtcgggcccttcgcgctcaccggcccgctccgcaacacgccggtgcacggccaggccggcgccctcggcgccgcaggcctcgtcgccatcctcagcgtctgcctcaccatgtacggcgtcgcctccttcggcgagggcgagccgtccacggcgccgacgctgacgctcaccggccgcaagaaggaggccgacaagctgcagaccgccgacggctgggccaagttcaccggcggcttcttcttcggcggcatctccggcgtcctctgggcctacttcctcctctacgtgctcgacctcccgtacttcttcaagtagatcttttgtttgtaagtgcatgaccgggtgatgcatgtgtagatcgatcgatgatggaacatgtgtgtgttcatgtggtggctgatttgagtgccttctacttgtataaatgaaatgcatctgcacaagggcacaaacaggctgcctgcatggatatatggatggtgtgctgttgtaacttgggagtgttactttcttactttgcagataatttaaaatggaaagaaaaagttttaacaatgataattaa

SEQ ID NO: 4921 - DNA, 1241 bp, Oryza sativa
cagattctgttttccacttggcgcgacgggcggcaccgccagctaggcgtccaacgtaaggagggggatctccaggaattcagataagggatagggttgctggcatcctccatccaatgaacgccacacagctctcaaccatatctcatcttcagggacccacccaaacacatactccagattttctctcctgcagcttgtaaagatcacaaactttaatttctagggcagttgccaagaaggctgtttcacatccattttttttggccgggagagagagcatctagctagggagagaaaggaagagacgagaggagagagatggccactgcttatgctcccatggcgagccagctgatgaagagcagcttggtgtgctccaagccgagggggctgtctggtgcttcgctgacaaggaggccccgcttcacagtcaaggccatccagtctgagaagccaacgtaccaggtggtgcagcccatcaatggcgaccccttcatcggcagcctggagacgccggtgacctccagcccgctggtcgcctggtacctctccaacctcccggcgtaccgcaccgccgtcagcccgctgctccgcggcatcgaggtcggcctcgcccacggctacctcctcgtcgggcccttcgcgctcaccggcccgctccgcaacacgccggtgcacggccaggccggcgccctcggcgccgcaggcctcgtcgccatcctcagcgtctgcctcaccatgtacggcgtcgcctccttcggcgagggcgagccgtccacggcgccgacgctgacgctcaccggccgcaagaaggaggccgacaagctgcagaccgccgacggctgggccaagttcaccggcggcttcttcttcggcggcatctccggcgtcctctgggcctacttcctcctctacgtgctcgacctcccgtacttcttcaagtagatcttttgtttgtaagtgcatgaccgggtgatgcatgtgtagatcgatcgatgatggaacatgtgtgtgttcatgtggtggctgatttgagtgccttctacttgtataaatgaaatgcatctgcacaagggcacaaacaggctgcctgcatggatatatggatggtgtgctgttgtaacttgggagtgttactttcttactttgcagataatttaaaatggaaagaaaaagttttaacaatgataattaatcagtttgttgtaattatattagttaatttgcaagggcgagaa

SEQ ID NO: 4922 - DNA, 1192 bp, Oryza sativa
cagattctgttttccacttggcgcgacgggcggcaccgccagctaggcgtccaacgtaaggagggggatctccaggaattcagataagggatagggttgctggcatcctccatccaatgaacgccacacagctctcaaccatatctcatcttcagggacccacccaaacacatactccagattttctctcctgcagcttgtaaagatcacaaactttaatttctagggcagttgccaagaaggctgtttcacatccattttttttggccgggagagagagcatctagctagggagagaaaggaagagacgagaggagagagatggccactgcttatgctcccatggcgagccagctgatgaagagcagcttggtgtgctccaagccgagggggctgtctggtgcttcgctgacaaggaggccccgcttcacagtcaaggccatccagtctgagaagccaacgtaccaggtggtgcagcccatcaatggcgaccccttcatcggcagcctggagacgccggtgacctccagcccgctggtcgcctggtacctctccaacctcccggcgtaccgcaccgccgtcagcccgctgctccgcggcatcgaggtcggcctcgcccacggctacctcctcgtcgggcccttcgcgctcaccggcccgctccgcaacacgccggtgcacggccaggccggcgccctcggcgccgcaggcctcgtcgccatcctcagcgtctgcctcaccatgtacggcgtcgcctccttcggcgagggcgagccgtccacggcgccgacgctgacgctcaccggccgcaagaaggaggccgacaagctgcagaccgccgacggctgggccaagttcaccggcggcttcttcttcggcggcatctccggcgtcctctgggcctacttcctcctctacgtgctcgacctcccgtacttcttcaagtagatcttttgtttgtaagtgcatgaccgggtgatgcatgtgtagatcgatcgatgatggaacatgtgtgtgttcatgtggtggctgatttgagtgccttctacttgtataaatgaaatgcatctgcacaagggcacaaacaggctgcctgcatggatatatggatggtgtgctgttgtaacttgggagtgttactttcttactttgcagataatttaaaatggaaagaaaaagttttaacaatgat

SEQ ID NO: 4923 - DNA, 821 bp, Eragrostis curvula
  misc_feature (590)..(590): n is a, c, g, or t
  misc_feature (641)..(641): n is a, c, g, or t
  misc_feature (690)..(690): n is a, c, g, or t
gcggccgcgggagagctggtgtgagagagaggaaggcgtcgagcatggctaccgcatacgctcccatggcgagccaggtgatgaagggcagcttggtgcagtcgaggccgaggggtttgtctggagctgcactgacgaggcggccacgcttcaccgtgaaggctatccagcccgagaagccaacgtaccaggtggtgcagcccatcaacggcgaccccttcatcggcagcctcgagacgccggtcacctccagccctctcgtcgcgtggtacctctccaacctcccggcctaccgcaccgccgtgagcccgctcctccgcggcgtcgaggtcggcctcgcccacggctacctcctcgttggcccattcgctctcaccggcccgctccgcaacacgccggtgcacggccaggcgggcgccctcggcgccatcggcctcgtcaccatcctcagcgtctgcctcaccatgtacggcgtcgcctccttcaacgagggcgcgccgtccacggcgcccacgctgacgctcaccggccgcaagaaggaggccgacaagctccagaccgccgacggctgggccaagttcaccggaggnttcttcttcggcggcgtctccggcgccatctgggcctacttcctcctctangtgctcgacctcccctactacttcaagtagacatatgcatgtgtccttntgtaggatgcatccatgggtcttaggtgatgtggtggctgtttgaacgattgtataaatgaatttgtgctgcggatggatacggttgtaactcgaaagtgctaattcttatttggacggggacaaattgtg

SEQ ID NO: 4924 - DNA, 866 bp, Avena sativa
cacgcacatacctctgatctgaacaagtcttctctagcagttgcagcagagttgagctagcgcgtgaagcaggtcgaggggaagacgatggccaccgcttatgctcctcccatggcgagccagctgctgaagagcaacagcagcagcttggtgagctccaagccgaggggtctgtccggtgcctcactcacgacgaggaggccctgcttcatcgtcaaggctatcaaggctgacaagccaaactaccaggtggtgcagcccatcaacggcgaccccttcatcggcagcctggagacgcccgtcacctccagcccgctcgtcgcatggtacctctccaacctccccgcctaccgcaccgccgtcagcccgctgctccgcggcatcgaggtcggcctcgcccacggctacctcctcgtcggccccttcgcgctcaccggcccgctccgcaacacgcccgtgcacggccaggccggcgcgcttggcgccatcggcctcgtcaccatcctcagcgtcgtcctcaccatgtacggcgtcgcctccttcgaggacggtgcgccatccaccgcgccatcgctcaccctcaccggacgcaagaaggaggccgacaagctgcagaccgccgagggctgggcgcagttcaccggggggttcttcttcggcggcgtctccggcgccgtctgggcctacttcctcctctacgtcctcgacctcccatacttcttcaagtagaattcttaccgtgtacatgcatgcatggctgtagatgcttgcttgagtctatgtacgtgtaaatgaatctgttccgcacaatccatcttttgcatgcatggaggggagtactattttaacatggcaagggcgtgcta

SEQ ID NO: 4925 - DNA, 806 bp, Lolium multiflorum
ggttctaccatatccatctgcagttgcagcagcagcagagcagagttgagctagcgtgtgagccaggttgagggagacgacgatggctactgcgtatgctcctccgatggcgagccagctgctgaagagcaacagcagcttggtctcctcctccaagccgaggggtctgtccggtgcttcactcaccaccaggaggccccgcttcgtcgtcaaggctatcaaggctgacaagccaaactaccaggtggtgcagcccatcaacggcgaccccttcatcggcagcctggagacgcccgtcacctccagcccgctcgtcgcctggtacctctccaacctccccgcctaccgcaccgccgtcagcccgctcctccgcggcatcgaggtcggcctcgcccacggctacctcctcgtcggccccttcgcgctcaccggcccgctccgcaacacgcccgtgcacggccaggccggcgcgctcggcgccgtggggctcgtcaccatcctcagcgtcgtcctcaccatgtacggcgtcgcctccttcgacgagggcgcgccctccaccgccccctcgctcaccctcacgggccgcaagaaggaggccgacaagctgcagaccgccgaagggtgggcgcagttcaccggggggttcttcttcggcggcgtctccggcgcatctgggcctacttcctcctctacgtcctcgacctccatacttcttcaagtagactgtactcctcaccatgtacttatgtgtgcatgcatggatgtagatgcttgcttgagtctgtgtacgtgtaaatgaatttgtt

SEQ ID NO: 4926 - DNA, 1082 bp, Saccharum officinarum
gttagctcactctcgcagcccaacgagagccacacagacccgagccatatcacgcctgcaggccccatccatccacagacgcaccacggattttctcctaaagatcacaaggagacgaccctccgctaccattttgcagggcagagccgatccgatccggccgtgcgtgtgcgagtgtgagacaccactgctagcaggtcgagatggctacagcttatgctcccatggtgagccaggtgatgaagagcagcctggtgcactcgaggccgaggggtctgtcaggcgctgcgctcaccaggcggccacggttcaccgtcaaggccatccagcccgagaaggcaacgtaccaggtggtgcagcccatcaacggcgacccgttcatcgggagcctggagacgccggtgacctcgagcccgctcgtggcgtggtacctctccaacctgccggcgtaccgcaccgccgtgagcccgctgctgcggggcatcgaggtgggcctggcgcacggctacctcctcgtggggccgttcgcgctcacgggcccgctccgcaacacgcccgtgcacggccaggcgggcgcgctcggcgccgcggggctcgtcgccatcctcagcgtctgcctcaccatgtacggcgtcgcatccttcaacgagggggcaccctccacggcgcccacgctcacgctcacgggacggaagaaggaggccgacaagctgcagaccgccgacgggtggtccaagttcaccggagggttcttcttcggtggcatctccggcgtgctctgggcttacttcctcctctacgtgctcgacctcccctactacttcaagtagaaattattaaagatgcataatatagctcctctctgcgtcggcatgcgtgcgtgcgtgcaagggtatgtaggtgatgcggtccttgtttcccttcagcagtgaagagcaccgtgtataaattaatgtaattcctctgcacatcgaacgattgggatgtaacctggaactcttaatttttttttactttgatgcatcatggaattttactgggaaccatcagtccgtatgtagtcaacatgctactaatgaatc

SEQ ID NO: 4927 - DNA, 1227 bp, Panicum virgatum
ggatccaaagatcacaaactttaattgggccgtcacaagcaaacctcatctacaatttttgcaggaaggaagagctagctccttccttgtgtgtgtgtgtgtgtgacaggaagagggtcgagatggctacggcgtacgctcccatggcgagccaggtgatgaagagcggcatggtgcactcgaggccgaggggcctctctggcgctgcgctgacgaggcggccacgcttcaccgtgaaggccatccagcctgagaagccaacgtaccaggtggtgcagcccatcaacggcgaccccttcatcggcagcctggagacgcccgtcacctcgagcccgctcgtggcctggtacctctccaacctgccggcctaccgcaccgccgtgagcccgctgctccgcggcatcgaggtcggcctcgcgcacggctacctcctcgtcgggcccttcgcgctcaccggcccgctccgcaacacgcccgtgcacggccaggccggcgccctgggcgccgccgggctcgtcaccatcctcagcgtctgcctcaccatgtacggcgtcgcctccttcaacgagggggacccgtccacggcgcccacgctcacgctcacggggcgcaagaaggaggccgacaagctgcagaccgccgacgggtgggccaagttcaccggaggcttcttcttcggcggcatctccggcgtgctctgggcatacttcctcctctacgtgctcgacctcccctactacttcaagtagacgtacgggctccatatgcaaatcccctcctctctacacatgtgggtaggtgatgtttgtgtggttcttgattgagcagtgatcgagcacgtgtataaattaatgtattactttctctggacatggatggatggggttgtaacttggaacggttaatttcttacttggatcacttgggaacaaaacatctgctggtgttgtattcgtacataatcttcttcgttctcggccgatttttttaattaggatcaatagggactatgtttattcagtagatttggctttgtcagaaattagccaagactttggtcacattgttcattcatcctctcatcatgacccgaaacctttgaggatgatgatggcgtctaagtcggagaatatcatagataataaattcagatcaattatgtaaattattattgtataccattattctgtcagaaggaatggatcaccatgctgaatgttttttttt

SEQ ID NO: 4928 - DNA, 1163 bp, Panicum virgatum
cccctccctgcaggatctgatcatcacaaactttaattgggccggcacagcgagacctcttctaccatttttgcaggaaggaagagctgctagctccttgtgtgtgggagataggaagagggtcgagatggctacggcgtacgctcccatggcgagccaggtgatgaagagcagcttgatgcactccaggccgagaggcctctctggcgctgcgctgacgaggcggccccgcttcaccgtgaaggccatccagcccgagaagccaacgtaccaggtggtgcagcccatcaacggcgaccccttcatcggcagcctggagacgcccgtcacctccagcccgctcgtcgcctggtacctctccaacctcccggcctaccgcaccgccgtgagcccgctgctccgtggcatcgaggtcggcctcgcgcacggctacctcctcgtcggccccttcgccctcaccggcccgctccgcaacacgcccgtgcacggccaggccggcgccctgggcgccgccgggctcgtcaccatcctcagcgtctgcctcaccatgtacggcgtcgcctcgttcaacgagggggacccgtccacggcgcccacgctcacgctcacgggacgcaagaaggaggccgacaagctgcagaccgctgacgggtgggccaagttcaccggaggcttcttcttcggcggcatctccggcgtgctctgggcctacttcctcctctacgtgctcgacctcccctactacttcaagtagacgggatccataagcaaattccctcctctctacgtgtgggtaggtgatgtgtttgtggttcttgattgagcagtgagcacgtgtataaatgtattactttctctggacatgcatgggtggatggatgggttgtaacttggaacggttaatttcttacttggatggagttaattacttgggtgaatgagaatgctttcagatcaaaaggttacaggcagaactgcagaaggcttggatggatgaagcccctaaaaatgtaaaataaagatggcatgaagactcatagatgtaaattgtgcattttttatttcttgagttgtggggcatgccgtactattaagtgggggcacaaaatcatttgttgaagatacctcggtgcttaaatcaagtgaggtatacacatgagcct

SEQ ID NO: 4929 - DNA, 1488 bp, Setaria italica
cagattctgtttccacgtggcagcaagctgggggcgccagctaggcgtccagtggagggaggagatctccacgcattcggataagggatagggttgctcactcctttcacccaatgagcgccacacagctctgagccatatctcagctgcagggccccatccatccaaacacgccacagatcttctcacacaccccctgcaggatctaaagatcacaaactttaattgggccgatacaaggagacctcttctaccattttgcaggaaggaagagccctgttcgtgagagacaggcagaggtcgagatggctaccgcgtacgctcccatggcgagccaggtgatgaagagcggcttggtgcactcgaggcccaggggcctttcaggcgctgcgctgaccaggcggccccgcttcaccgtgaaggccatccagcctgagaagacaacgtaccaggtggtgcagcccatcaacggcgaccccttcatcggcagcctggagacgcccatcacctccagcccgctcatcgcctggtacctctccaacctcccggcctaccgcaccgccgtgagcccgctgctccgcggcatcgaggtcgggcttgcgcacggctacctcctcgtgggccccttcgccctcaccggcccgctccgcaacacgcccgtgcacggccaggcgggcgccctgggcgccgccgggctcgtcaccatcctcagcgtctgcctcaccatgtacggcgtcgcctccttcaacgagggcgacccgtccacggcgcccacgctcacgctcaccggccgcaagaaggaggccgacaagctgcagaccgccgacggctgggccaagttcaccggaggcttcttcttcggcggcatctccggcgtggtctgggcctacttcctcctctacgtgctcgacctcccatactacttcaagtagacgtcctctctacatgcgtgtgcgtgcatgggtaggcgatgaggtcgttgattgagcagtgagcacgtgtataaatgtacttcaagtaacttggaacttgaactgttgatttcttacttggatggagttaatttacttggggataaaattaatgactaggtgttgtatttgtacactcttcgttcttgggccgtgttcttaggatcgatcaatatggcgactatatgctggtttcagcagatttggctttgtcaaaaactagctaggccttcttccggaggagaggatggacaaattttgataactgttcagtcaagtcattagccacagattgcactgtcggtcgctagatttgtagaagtgcatccactgcaccatgacactggtggtaggagttagaagtgtcaaggtaccgtttgaacaagtaggaatgatgcttttgtagaggtgtaagtcaaggaatgagttggggtttgaacaagcgagggcacagcagagacacagaattgttggactatcctagtgataaatataagtattcttttctttcttctag

SEQ ID NO: 4930 - DNA, 1114 bp, Pennisetum glaucum
ggcaggatcttctcacacactccccctgcaggatctaaagatcacaaacattaattggtccggcacaagcagacctcttcaaccattttggaggaagggagagctctgtgcgtgtgagagacaggaagagatcgagatggctaccgcgtacgctcccatggcgagccaggtgatgaagagcggcttgatgcagtctaggcccaggggcctttcaggcgctgcgctgaccaggcggccccgcttcaccgtgaaggccatccagcctgagaagccaacgtaccaggtggtgcagcccatcaacggcgaccccttcatcggcagcctcgagacgcccatcacctccagcccgctcatcgcctggtacctctccaacctcccggcctaccgcaccgccgtgagcccgctgctccgcggcatcgaggtcgggctcgcgcacggctacctcctcgtgggccccttcgccctcaccggcccactccgcaacacgcccgtgcacggccaggccggagccctgggcgccgctgggctcgtcaccatcctcagcgtctgcctcaccatgtacggtgtcgcctccttcaacgagggcgacccgtccacggcgcccacgctcacgctcaccggccgcaagaaggaggccgacaagctgcagaccgccgacggctgggccaagttcaccggaggcttcttcttcggcggcatctccggcgtggtctgggcctacttcctcctctacgtgctcgacctcccgtactacttcaagtagacgtcctctctagctacatgcgtgtgtgcataggcgatgaggtcgttgattgagcaatgagcacgtgtataaatgtactttctctgcacatggatggatatggggttgtatacttggagcttggaactgttaattccttactcggatggagttaatttacttggggataaagtgactaggtgttgtattcacttttcattcttgtgggctgttttcttatgctcgatatggggacttgagctgggacttggtctgggcctcgtgttgcattgtacttggacttctaggcacattaagcacatcgtgttgaaattttttatatatttaatttatcatgattttgcaatattg

SEQ ID NO: 4931 - DNA, 1116 bp, Sorghum bicolor
gttcgctcactctcgcaacccagcgaacgccacacagtcctgagccatatcacgcctgcaggccccatccatccacacgcgcgcgccacggattttctcctaaagatcacaaggagacgacccctctccgctaccattttgcagggcagcagcagagccgatcccgtgcgtgtgcgagtgtgagtgagatcgacaccactagctaggtcgagaccatggctacagcttacgctcccatggcgagccaggtgatgaagagcagcctgcagctgcactccaagccgaggggcttgtccggcgctgccctcaccaccaccaggcgtccccggttcaccgtcaaggccatccagcccgagaaggcgacgtaccaggtggtgcagccgatcaacggcgacccgttcatcggcagcctggagacgccggtgacctcgagcccgctggtggcgtggtacctctccaacctgccggcgtaccgcacggccgtgagcccgctgctgcggggcatcgaggtggggctggcgcacggctacctcctcgtggggccgttcgcgctcacgggcccgctccgcaacacgcccgtgcacggacaggcgggcgcgctcggcgccgcggggctcgtcgccatcctcagcgtctgcctcaccatgtacggcgtcgcgtccttcaacgagggggaaccctccacggcgcccacgctcacgcttacggggaggaagaaggaggccgacaagctgcagaccgccgacggatggtctaagttcaccggagggttcttcttcggcggcatctccggcgtgctctgggcttacttcctcctctacgtgctcgacctcccctactacttcaagtagaagttgattaataaagatccatatatatatatatatagctccgatgctgcgatgcatgcgatcctcctctctgcgtcggcggcatgcgtggttatgtaggtgatggggtccttgtttcacttcagcagtgatgagcaccgtgtataaatgtaattcctctgcacatggatggattgggatgtaacttgaaactgttaattttttttttacttggatgcatcatggtgttttcagtccgtctgtgttgtcgacatgctaaccatga

SEQ ID NO: 4932 - DNA, 1607 bp, Sorghum bicolor
cactcagtatgcaggggaacgatccactcccactgccactgcagattctgtttccacatggcgggacgcgagtggagtggagggagggaggtgttgtccacgcacgcattcgttcggatcggataaggggatagggttcgctcactctcgcaacccagcgaacgccacacagtcctgagccatatcacgcctgcaggccccatccatccacacgcgcgcgccacggattttctcctaaagatcacaaggagacgacccctctccgctaccattttgcagggcagcagcagagccgatcccgtgcgtgtgcgagtgtgagtgagatcgacaccactagctaggtcgagaccatggctacagcttacgctcccatggcgagccaggtgatgaagagcagcctgcagctgcactccaagccgaggggcttgtccggcgctgccctcaccaccaccaggcgtccccggttcaccgtcaaggccatccagcccgagaaggcgacgtaccaggtggtgcagccgatcaacggcgacccgttcatcggcagcctggagacgccggtgacctcgagcccgctggtggcgtggtacctctccaacctgccggcgtaccgcacggccgtgagcccgctgctgcggggcatcgaggtggggctggcgcacggctacctcctcgtggggccgttcgcgctcacgggcccgctccgcaacacgcccgtgcacggacaggcgggcgcgctcggcgccgcggggctcgtcgccatcctcagcgtctgcctcaccatgtacggcgtcgcgtccttcaacgagggggaaccctccacggcgcccacgctcacgcttacggggaggaagaaggaggccgacaagctgcagaccgccgacggatggtctaagttcaccggagggttcttcttcggcggcatctccggcgtgctctgggcttacttcctcctctacgtgctcgacctcccctactacttcaagtagaagttgattaataaagatccatatatatatatatatagctccgatgctgcgatgcatgcgatcctcctctctgcgtcggcggcatgcgtggttatgtaggtgatggggtccttgtttcacttcagcagtgatgagcaccgtgtataaatgtaattcctctgcacatggatggattgggatgtaacttgaaactgttaattttttttttacttggatgcatcatggtgttttcagtccgtctgtgttgtcgacatgctaaccatgacgacacctcccccgaacgaacgaggcgccgcttataatggagttcacaagttgcctggccacagagccattcggaactacaaatgaactaggacccgataaagctagggatgggacggtgctacaaatgaatacccgcagttattcactagtataatttaatgaactaaatgaacaaattggagaaaaaattgtttatttagttcattataagttagactagagaagaaccacatatactcatttgaaacaccatccccatccttagataaagccaatttgtttgggtttaccggctctggcttccccatacattagcaaagggctggccaaagccataatgctaaatcgttttcg

SEQ ID NO: 4933 - DNA, 1022 bp, Zea mays
tcatcactcctgaaacccaaggagcgccacacatgcctgagccatatcacgcctgcaggccccatgcatccatgcgtgcacaggatttcctcctaaagatcgatcgcagactttacttaggccgtcacaaggagaccctcctcagctagtacctaccggccagtagtcgtcgcgtttgcaggcagatctgagttagccggcggatccgatccgtgcgcgtgctgctgtgtgtgtgtcggtggagatggccacagcttacgctcccatggcgagccaggtgatgaagagcagcctcgtcgtgcactcgaggccgaggggcctgtcaggcgctgctgcgctcacgaggcggcccggccggttcaccgtcaaggccatccagcccgagaaggcaacgtaccaggtggtgcagcccatcaacggcgacccgttcatcggcagcctggagacgccggtcacctccagcccgctcgtggcgtggtacctctccaacctcccggcctaccgcaccgccgtgagcccgctgctgcggggcgtcgaggtcggcctcgcgcacggctacctcctcgtggggcccttcgcgctcacgggcccgctccgcagcacgcccgtgcacggccaggccggcgcgctcggcgccgccggcctcgtcgccatcctcagcgtctgcctcaccatgtacggcgtcgcctccttcaacgagggggacccgtccacggcgcccacgctcacgctcaccggcaggaagaaggaggccgacaagctgcagaccgccgacggctgggccaagttcaccggggggttcttcttcggcggcatctccggcgtgctctgggcctactttctcctctacgtgctcgacctcccctacttcttcaagtagaaatcatcaaagatgcgtatatatatagctccggccgatcctcctctctagctgcatggtatgtaggtggtgtggtccttgtttcatttcactccagcggtgatcagcgccgtgtataaatgtaattcctctgctttgcaca

SEQ ID NO: 4934 - DNA, 745 bp, Setaria italica
agagccctgttcgtgagagacaggcagaggtcgagatggctaccgcgtacgctcccatggcgagccaggtgatgaagagcggcttggtgcactcgaggcccaggggcctttcaggcgctgcgctgaccaggcggccccgcttcaccgtgaaggccatccagcctgagaaggtcagtggatgtaccaggtggtgcagcccatcaacggcgaccccttcatcggcagcctggagacgcccatcacctccagcccgctcatcgcctggtacctctccaacctcccggcctaccgcaccgccgtgagcccgctgctccgcggcatcgaggtcgggcttgcgcacggctacctcctcgtgggccccttcgccctcaccggcccgctccgcaacacgcccgtgcacggccaggcgggcgccctgggcgccgccgggctcgtcaccatcctcagcgtctgcctcaccatgtacggcgtcgcctccttcaacgagggcgacccgtccacggcgcccacgctcacgctcaccggccgcaagaaggaggccgacaagctgcagaccgccgacggctgggccaagttcaccggaggcttcttcttcggcggcatctccggcgtggtctgggcctacttcctcctctacgtgctcgacctcccatactacttcaagtagacgtcctctctacatgcgtgtgcgtgcatgggtaggcgatgaggtcgttgattgagcagtgagcacgtgtataaatgt

SEQ ID NO: 4935 - DNA, 1168 bp, Zea mays
aggcctgagccgtatcacgcccatgcatccacaggattttctcctaaagatcacagactttacttaggccatcacaaggagacgtacgctctctgctagcacccatcttgcagcaggcggagccgcccgacccaatccgtgcgtgtgttggtcgagatggctacaacagcttacgctcccatggcgagccaggtgatgaagagcagcccggtgcactcgaggccgaggggcctgtcaggcgctgcgctcacgcggccccggccccggttcagcgtcgtcaaggccgccatccagcccgagaaggcaacgtaccaggtggtgcagcccatcaacggcgacccgttcatcggcagcctggagacgcccgtcacctccagcccgctcatcgcgtggtacctctccaacctgccggcctaccgcaccgccgtgagcccgctgctgcggggcgtcgaggtcggcctcgcccacggctacctcctcgtcgggcccttcgcgctcaccggcccgctccgcaacacgcccgtgcacggccaggcgggcgcgctcggcgccgccggcctcgtcgccatcctcagcgtctgcctcaccatgtacggcgtcgcctccttcaacgagggcgacccgtccacggcgcccacgctcacgctcaccggccggaagaaggaggccgacaagctgcagaccgccgacggctgggccaagttcaccggagggttcttcttcggtggtatctccggcgtgctctgggcatacttcctcctctacgtgctcgacctcccctactacttcaagtagaatacaaattcataaagatgcatatatataatatagctccgcctccgatcctcctctctgcgtgcaaaggtatgccatttcagcagtgacgagcatcgtggatacatgcaattcctctgcacatggatggattgggatgtaacttggaactgttaattttttttactttgatttggatgcatcatgacccccccttcaaaccagctagtgaaatgccattttaggtaaaagtcgacctcctagtatcatattgtcgttgtcttgatccgagtatctcaccaaccagtgaaatgatgttgcgtgccttggcccagatgagtgatgtaaggtcacacaagtcatttatcctagtttgggcgagagaaagccctac

SEQ ID NO: 4936 - DNA, 610 bp, Triticum aestivum
aagccaggtgatgaagagcggcttggtgtgctccaagccgaggggactgtccggcgcttcactcaccaggaggccccgcttcgtcgtcaaggccgtcaagtccgacaaggggacgtaccaggtggtccagccccctcgtcgcgtggtacctctccaaccttcccgcgtaccgcaccgccgtcagcccgctcctccgtggcatcgaggtcggcctcgcccacggctacctcctcgtcggccccttcgcgctcaccggcccgctccgcaacacgccaattcacggccaggcgggaaccctcggcgccatcggcctcgtctccatcctcagcgtctgcctcaccatgtacggcgtcgcctccttcaacgagggcgcgccctccaccgcgcccgccctcacgctcaccggccgcaagaaggaggccgacaagctgcagaccgccgaaggctggtcccagttcaccggaggcttcttcttcggcggcgtctccggcgccatctgggcctacttcctcctctacgtgctcgacctcccatacttcttcaagtagattatttattattggcatgcatgtacgatgggtgcacaactgcagatgatgtgatcgatctc

SEQ ID NO: 4937 - DNA, 829 bp, Triticum aestivum
agagttgtgcgtgtgggagttgaaggagatcgagatggccacagcatatgctcctccgatggcgagccaggtgatgaagagcggcttggtgtgctccaagccgcggggcatgtccggcgcttcgctcaccaggaggccccgcctcgtcgtcaaggccgtcaagtctgacaaggtccgttgcaattgcaagagatagacaaaattaagcgattcagcacacttttcctttgttccaagtcttcgtgtatctcatacatattcttgtgtctcctgtctcttctacaaacagccgacgtaccaggtggtccagcccatcaacggcgacccattcatcggcagcctggagacgcccgtcacctccagccccctcgtcgcctggtacctctccaacctccccgcctaccgcaccgccgtcagcccgctcctccgcggcatcgaagtcggcctcgcccacggctacctcctcgtcggccccttcgcgctcaccggcccgctccgcaacacgccaattcacggccaggcaggcactctcggcgccatcggcctcgtctccatccttagcgtctgcctcaccatgtacggtgtcgcgtccttcaacgagggcgcaccgtcaaccgcgcccgcactcacgctcacaggccgcaagaaggaggccgacaagctgcagaccgctgaagggtggtcgcagttcaccggaggcttcttcttcggtggtgtctccggtgccacctgggcctacttcctcctctacgtgctcgacctcccatacttcttcaagtagattaattatcggcatgcatgtacgatgggtgcagatcatgtgatctct

SEQ ID NO: 4938 - DNA, 755 bp, Cynodon dactylon
ggggaggagcggcttggtgtactccaggccgaggggtttgtccggcgctgcgctcacaaggcggccacgcttcaccgtcaaggccatccagcccgagaagccaacataccaggtggtgcagcccatcaacggcgaccccttcatcggcagcctcgagactccggtcacctccagcccgctcatcgcgtggtacctctccaacctcccggcctaccgcacggccgtgaacccgctcctccgcggcatcgaggtcggcctcgcccacggctacctcctcgttggtccgttcgcgctcaccggcccgctccgcaacacgccggtgcacggccaggccggcgccctgggcgccatcgggctggtgaccatcctcagcgtctgcctcaccatgtacggcgtcgcctccttcaacgagggcgacccgtccacggcgcccacgctgacgctcactggacgcaagaaggaggccgacaagctccagaccgccgacggctgggccaagttcaccggaggcttcttcttcggcggcgtctccggcgccatctgggcttacttcctgctctacgtgctcgacctcccctactacttcaagtagacacacgtgcttttgtatcatcatttgtgtgtgcgatgctttgataggtgatgtggtgtggttgtttcagcgactgtataaatggatttgtgatgcggatggatacggctgtaacttgaaagtgctaatttcttatttggacagaattcatttacttggagta

SEQ ID NO: 4939 - DNA, 1407 bp, Secale cereale
cgacggaagcaacacctacacggaactcgcggaagcgagcagaaaattatcggtttatcacctatcgagctccggcgagagaccatgggaagcgcaggagcgctgctctcccacccgccaccgcaactcggcagcatcctcctccgtcgccaccacatctctcttccccatctctcctcatgcatgcccgagcccctccactgccgccgccggcaccttcgctgttccgccattgaggggagcagcagccaggacacgaattcgccagcgtctcaaagagaagagtctccatcgagcagccttggcgccaccctccaagatccacttccaggacgtgtcgaaaatggttcttttgaaggtgccacaaaggaagaagatcagagtagtctatataattttctttatccaagcaaagagctacttccagatgataaagaaatgagtatatttgatcatctagaggaacttcgtgcgaggatatttgtatcagtattggctgttggagcttcaataattggttgttttgctttctccaaagatataattaagattcttgaagcgcctgttagtgttcagggtgtccgatttttgcagctctcccctggagaatttttctttacaacattgaaggtctctggttattgtggcctcctaatcggaagtcctataattttgtacgagatcatagcatttgttctccctggtttaaccaaggatgagcggaaattcctagggcccattgttttgggttcttcagttctgttctaccttggcattttattctcctacactgttcttgctccagcagcattgaacttcttcgtgaattatgccgaaggagcggtggaatcgatatggtcaatagaccagtactttgagttcgtacttgtgcttctgttcagcacagggttatcttttcaggtccctgttatccagctgttgctggggcaagttggactggtttccagcaaacaaatgctctcaatctggaggtatgttgttgttggcgcggttgttgctgcggctgtgcttacgccctcgaccgatcccttgactcagatgcttttggcgggtccactgcttggtctgtacttgggtggtgcgtggatggtcagactaactggacgctaactgcaacaagcgttgtagtgattgggtattgtgtgttagtgtactagaaatcatagccgtggtgattggttcgagtggtcaccgtcccccactgtaacatagtcttgttctgtataaaattaactcggctccttctcatcagcgtatacattatttggcactcttctgcaattgaaacattttataaatagggtaactatactggtgagattctttttttttacggtagtaaatgagagttttattcgaaggtgcagaattacaatccagaggcaa

SEQ ID NO: 4940 - DNA, 2129 bp, Hordeum vulgare
agcatatccgaggagccagggaggagaagaagaaggtctggaagcaacacctacacggaactggctgtagcaagcagaaaattatcggtttatcacctatcgagctcccgcgagagaccatgggaagcgcaggagcgctgctctcccgcccgccaccgcaactcggcagtatcctcctccgtcgccaccacatctcccttccccatctgtcctcatgcacgcccgagcccctccactgccgccgccggcaccttcgctgttccgccgttgaggggagcagcggccaggacacgaatttgccagcgtctcaaagagaagagtctccatcgagcagcctcggcgccaccctccaagatccacttgcaggacgtgtcgaaaatggttcttttgaagatgtcacacaggaagatcagagtagtctatataattttctttatccaagcaaagagctacttccagatgataaggaaatgagtatatttgatcatctagaggaacttcgtgcgaggatatttatatctgtattggctgttggagcttcaataattggttgttttgctttctccaaagatataattaagattcttgaagcgcctgttagtgttcagggtgtccgatttttgcagctctcccctggagaatttttctttacaacattgaaggtttctggttattgtggcctcctaatcggaagtcctgtaattttgtatgagatcatagcatttgttctccctggtttaaccaaggatgagcggaaattcctagggcccattgttttgggttcttcagttctgttctaccttggcattttattctcctacactattcttgctccagcggcattgaactttttcgtgaattatgccgagggagcggtggaatcgatatggtcaatagaccagtactttgagttcgtacttgtgcttctgttcagcacagggttatcttttcaggtgcctgtgatccagctgttgctggggcaagttggaattgtttccagtgaacaaatgctctcaatctggaggtatgttgttgttggcgcggtggttgctgcggctgtgcttacgccctcgactgatcccttgactcagatgctcttggcgggtccactgcttggtctgtacttgggtggtgcgtggatggtcaggctaactgggcgctaactgcaacaagcattgtagggattgggtattctgtgttagtgtactactagaaaccatagccgagccgtggtgattggtccgagtggtcaccgtcccccactgtaacagtcttgtgtaaaattaactcggctccttctcatctacgaatacattatgatcattgctacgaatcagttggatgatttctttcggctagacagccatccgatctgctagtggccgctggattacagcaacacgccacggcagcagcagcggtctactagtggcaattgatgtggcagcagttgacgcgctagtgcttcaacgcagcgcatttgcaccaagacaaaagctccgctacagttttttggtgtaactacagctttttggtgcaacgttgtctggctaagcaccgattcagcaccgatgaccaacttagcatcaatgatgcccggcgaagctccattgtatcaccagtggagctccaaagtggcatcgtcgtgttcggcgaagctccattgcagcatcggtggagctgcaaagcagcattgacgcatctggtgaagcttcattgcagcttttatggtgcatagtcattgtccggtgaagcttcagcacatcattgatgatgtttgttgaagctttattttagcatcggcggagctccaacaaaacaccaacgcgttcggcgaagcttcattgtagatctggtggagctccaacgatgcatctgacgaagcttagttgtagcctcgactagtcttcattgcagagctgcctatgctttcaggggcttggtgttgcttccaacagcttcaaggcagcatcgtcggagttgcaacgcccatgtcggccactctccgctgtcggagttgcaacgcccatgtcggacactctccgctgtcactgtttgtcaaaccttaggtttgtatcattttttacatgatgttttataaaaaatggagccagtatattgtgatgggg

SEQ ID NO: 4941 - DNA, 1591 bp, Brachypodium distachyon
gcagcagcaggagaccatgggaagcgcgggcgcgctgctctcccacccgccaccgcagctcggcggcatactccaccgccgccagagtctctcccttccccgcctcgcctcctgcacgcccgagcccctccactgccgccgccggtaccttcgctgctccgctgttgacggtaacagccgcgggcaagagacggattccccaacgcctcaaagagaggagtctccgtcgagcggtctcggcgctgccctcaaggatccacttccagggcctgttgaaaatggttcctttggaggtatcacgcaggaagaagagcagagtactctgtataattttctgtatccaagcaaagagctacttccagacgacaaggaaatgagtatatttgatcatctagaggaacttcgtgagaggatatttatatcagtattggctgttggagtttccatacttggttgttttgctttctccaaagatataattaagattctagaagctcctgttagtgttcagggtgtccgttttttacagctctctcctggagaatttttctttacgacattgaaggtctctggttattgtggccttctacttggaagtcctatcattttgtacgagatcattgcatttgttctcccaggtttaacaaaagatgaacggaaattcctagggcccattgttttgggttcttcagttttgttctaccttggcattctattctcctacacggttcttgctcctgcagcattgaacttcttcgtgaattatgcagaaggggctgttgaatctatatggtcaatagaccagtactttgagttcgtacttgtgcttctgttcagcacagggttatcttttcaggtgccagtgatccagctgctgctggggcaagtcggattggtttccagcgatcaaatgctctcgatctggaggtatgttgttgttggtgcggtggttgctgctgctgtgcttacgccctcgactgatccattgactcagatgctcttggcgggtccattgcttggtctgtacttgggtggtgcatggatggtcaagctaacagggcggtaactgcaaaacatgtttcagtcgttgggtgttgtacgagtttgttagcatcatagccatagtgattgttgtcgacaggacagtccccattgtaacataccgttgtataaaatgaactcggctctttttttttgaaagtgatgaactcggctcttttgttcattaaaaaaaggaaaaacaatgatattgttgtaagggagaaaaattggctctactcaaggggctctctcctacgaacggattgacaaatgtgacaaaacaaaacaaggaagaattacatggattacattaaagatcaaggcggtcaaagacaacaacttggtgctgatgggttcctgatcagtggtgccgactgaagcttggctgttctacttgtggtaattgcttcagcttgtggtcaacctactagtgactcctacttaatgctgtcacacgatatgaaggtaaagtatcatgccattctgggtactagtaaatggccttgtgtaaaagagaagattatacgaaatccaatacacatgtcacttg

SEQ ID NO: 4942 - DNA, 1808 bp, Brachypodium distachyon
agcccaggcccggccgacgagacgcttcacgcaacgaacacgcacgcagaactcaccgaagcgagccacataattatcgcctatccgagctcccgttgcctcccagtgcggcagcagcagcaggagaccatgggaagcgcgggcgcgctgctctcccacccgccaccgcagctcggcggcatactccaccgccgccagagtctctcccttccccgcctcgcctcctgcacgcccgagcccctccactgccgccgccggtaccttcgctgctccgctgttgacggtaacagccgcgggcaagagacggattccccaacgcctcaaagagaggagtctccgtcgagcggtctcggcgctgccctcaaggatccacttccagggcctgttgaaaatggttcctttggaggtatcacgcaggaagaagagcagagtactctgtataattttctgtatccaagcaaagagctacttccagacgacaaggaaatgagtatatttgatcatctagaggaacttcgtgagaggatatttatatcagtattggctgttggagtttccatacttggttgttttgctttctccaaagatataattaagattctagaagctcctgttagtgttcagggtgtccgttttttacagctctctcctggagaatttttctttacgacattgaaggtctctggttattgtggccttctacttggaagtcctatcattttgtacgagatcattgcatttgttctcccaggtttaacaaaagatgaacggaaattcctagggcccattgttttgggttcttcagttttgttctaccttggcattctattctcctacacggttcttgctcctgcagcattgaacttcttcgtgaattatgcagaaggggctgttgaatctatatggtcaatagaccagtactttgagttcgtacttgtgcttctgttcagcacagggttatcttttcaggtgccagtgatccagctgctgctggggcaagtcggattggtttccagcgatcaaatgctctcgatctggaggtatgttgttgttggtgcggtggttgctgctgctgtgcttacgccctcgactgatccattgactcagatgctcttggcgggtccattgcttggtctgtacttgggtggtgcatggatggtcaagctaacagggcggtaactgcaaaacatgtttcagtcgttgggtgttgtacgagtttgttagcatcatagccatagtgattgttgtcgacaggacagtccccattgtaacataccgttgtataaaatgaactcggctctttttttttgaaagtgatgaactcggctcttttgttcattaaaaaaaggaaaaacaatgatattgttgtaagggagaaaaattggctctactcaaggggctctctcctacgaacggattgacaaatgtgacaaaacaaaacaaggaagaattacatggattacattaaagatcaaggcggtcaaagacaacaacttggtgctgatgggttcctgatcagtggtgccgactgaagcttggctgttctacttgtggtaattgcttcagcttgtggtcaacctactagtgactcctacttaatgctgtcacacgatatgaaggtaaagtatcatgccattctgggtactagtaaatggccttgtgtaaaagagaagattatacgaaatccaatacacatgtcacttgtcattctagttcttggtagatgtggtgatgagctggatggagtgtagctcacggggaaaatccgcatcaactcaaaaggagaccatcatcaactttgcccttca

SEQ ID NO: 4943 - DNA, 1435 bp, Avena sativa
aatcaattatcaccacctatccgagctcccgacgcctcccaagcgcggcacggcagtcggcagcagcagcaggagaacatgggaagcgcgggggcgctgctctcccacccgccaccgcagctcggcggcaccctcctgcgtcgccaccgcatctccctcccccgtctcgtcccctgcacgcccgagcccctccactgccgccgccgccgcaggcgacacctccgctgctccgccgttgaaggggacacggattcgccggttcctcagagggaggagtctccgtcgaccagcctccagctccaggatccacttccaggccctgtcgaaaatggttcctttgctggtctcgcacaggaagaagatcccagttccctgtataattttctttatccgagcaaagagctacttccagatgataaggaaatgagtatatttgatcatctggaggaacttcgtgagaggatatttgtatcagtattggctgttggagcttcaatacttggttgttttttcttctccaaagatattatcaagattctagaagcacctgttagtgttcagggtgtccggtttctgcaactctctcctggagtaatttttctttacaacattgaaggtttctggttattgcggtcttctaatcggaagtcctatcattttatacgagatcatagcgtttgttctcccaggtttaaccaaggacgagcggaaattcttagggcccattgttttgggttcttcagttctgttctaccttggcattttgttctcctacactgtccttgctccagcagcactgaacttctttgtgaactatgccgaaggggcggtggagtcgatatggtcaatagaccagtactttgagttcgtactggtgcttctgttcagcacaggattatcttttcaggtccctgtgatccagctcctgctggggcaagtcggactggtttccagcgaccaaatgctatcgatctggaggtacgtcgttgtgggcgcggtggtcgcagctgccgtgctcacgccctcgaccgatccactgacgcagatgctcttggcgggtccgctgcttggtctctacctgggaggagcatggatggtcaggctaacaggccgctaactgcaactgcatcatgtccttagagtgaaggagtgtagtacaaatcttcgtagccgtggtggttgtcctcgcttggtccctgtttgtaacatagtcttgtataaaattttctcggctccttttgagtggaagattatagggtttatttatgatccttcttatgtgatctgtgtgcacgcacgtgaagttcatgtgaccacaggagttgcagaatttagcaacacggtgaaactttgatactaccaagagtagactctgatgatgccgaatccggttacatataccgtacaatttgttatatgttgatctaaattttcc

SEQ ID NO: 4944 - DNA, 1559 bp, Oryza sativa
gtgtcgtgtggtcgtgactcgtgtgactcggtgcgtgagcataatccacacttccacagagagagcaagacgaggtgaagcggcgcaagcaacagtgcaacacgccaggcaacacggaagcgactagcgagcgagataattatcatcgtccactctatccgcctccagcttgccccgcctcggtcctcggaggtgtaggagcgaccgaccatggggagcgcgggggcgctgctctcgcactcgcctccggggctcggcggattccctcctcgccaccatcaccaccaccgtctctccgtcctccgttgcgtaccgctcctcccctccccggcgcccgagcccctcagctgtcgccacggccggcaccttcgctgcgccgccgtcgacgggggagccggccgggagacggagcgtccctcgccgcccgcacctcagagggaggagtcgccgtcgggcagcctcggcgcagccctcgaggacccatctcctcaacctgtccaaaatggatcttttggaggtatcacagaggatgaagaacagagtagcctgtacaattttctttatccgagcaaagagctacttcctgatgataaggagatgagtatatttgatcatctagaggaacttcgtgacaggatatttgtctcagtattggctgttggtgctgcgatacttggttgtttcgcttactccaaagatcttattagaattctagaagcaccagttagtgttcagggtgttcggtttctgcagctctctcctggagaatttttctttacaacattgaaggtctctggttattgtggccttctacttgggagtcctgttattctgtatgagataatagcatttgttcttccgggtttaacaagggatgaacgtaaattcctagggcccattgttctgggctcttctgtactattctaccttggcattttcttctcctacacggttcttgctcctgcagcattgaatttcttcgtgaactacgcagatggggcagtggaatcgttatggtcgattgatcagtattttgagtttgtgcttgtgcttttattcagcacaggattatcttttcaggtccctgttatccagctactgctggggcaagtcggtttggtttctagtgaccaaatgctttccatctggagatatgttgttgttggcgctgtagttgctgctgctgtgcttacaccgtcgacagatccgttgactcagatgctcttggctggtccgctgcttggcctgtacttgggtggtgcttggatggtcaagctaactggtcgataattcctactagtattttgtattaattagcatcatagtcatggcggtggttctggacaaatcgcattccccattgtaacatagttcgtataaaattaactctttttttctcttcaacaaatctcataaatattgtttttcctcttcttttgttctcctacatgctcctgaatcttatgtgctccctccaatcatctatttgacgttgggagagctgatgactaagatctcctaatgtcaaaaaaagattgggagtacatatgcctctacac

SEQ ID NO: 4945 - DNA, 1435 bp, Oryza sativa
gtgtcgtgtggtcgtgactcgtgtgactcggtgcgtgagcataatccacacttccacagagagagcaagacgaggtgaagcggcgcaagcaacagtgcaacacgccaggcaacacggaagcgactagcgagcgagataattatcatcgtccactctatccgcctccagcttgccccgcctcggtcctcggaggtgtaggagcgaccgaccatggggagcgcgggggcgctgctctcgcactcgcctccggggctcggcggattccctcctcgccaccatcaccaccaccgtctctccgtcctccgttgcgtaccgctcctcccctccccggcgcccgagcccctcagctgtcgccacggccggcaccttcgctgcgccgccgtcgacgggggagccggccgggagacggagcgtccctcgccgcccgcacctcagagggaggagtcgccgtcgggcagcctcggcgcagccctcgaggacccatctcctcaacctgtccaaaatggatcttttggaggtatcacagaggatgaagaacagagtagcctgtacaattttctttatccgagcaaagagctacttcctgatgataaggagatgagtatatttgatcatctagaggaacttcgtgacaggatatttgtctcagtattggctgttggtgctgcgatacttggttgtttcgcttactccaaagatcttattagaattctagaagcaccagttagtgttcagggtgttcggtttctgcagctctctcctggagaatttttctttacaacattgaaggtctctggttattgtggccttctacttgggagtcctgttattctgtatgagataatagcatttgttcttccgggtttaacaagggatgaacgtaaattcctagggcccattgttctgggctcttctgtactattctaccttggcattttcttctcctacacggttcttgctcctgcagcattgaatttcttcgtgaactacgcagatggggcagtggaatcgttatggtcgattgatcagtattttgagtttgtgcttgtgcttttattcagcacaggattatcttttcaggtccctgttatccagctactgctggggcaagtcggtttggtttctagtgaccaaatgctttccatctggagatatgttgttgttggcgctgtagttgctgctgctgtgcttacaccgtcgacagatccgttgactcagatgctcttggctggtccgctgcttggcctgtacttgggtggtgcttggatggtcaagctaactggtcgataattcctactagtattttgtattaattagcatcatagtcatggcggtggttctggacaaatcgcattccccattgtaacatagttcgtataaaattaactctttttttctcttcaacaaatctcataaatattgtttttcctcttct

SEQ ID NO: 4946 - DNA, 2620 bp, Triticum aestivum
ccacgcgtccgcgcaaagcgatcgggaagagcttcccgatcccgctgtcctgtagccgcgcgtgggaaagggggcctgcaacttttcctcggtgcggcggccagtccatccatatatatagcaaatggagaggagctggttcgggtggaggaaggcgaagcagggcggaggtggcggtgccggcggcggcggcggggagagggaggaggaggatcaggccaaggtggtggtggacgggtccgggatacgggagctggtggaggacagggaggcgttcggcatgttcgcggagagcaagttccggcagctcgacgccgacggggacggccggctgtccgtgcgggagctgcagcccgccgtggccgacatcggcgcgtcgctcggcctgcccgcgcagggctcctcgcccaacgccgaccacatctactccgaggcaatgagcgagttcgctcatggtcatgggaaccaagagggggtgagcagggcagagttccaggaggtcctgtccgacattctccttggcatggcggccgggctcaagaaggacccgatcgtgatactgcgcatcgacggcgaggacctcagggacttcgtgtccagcccaaggtatgagccggcagccgctgccatcttctcacaggttgggtctggagatgcccctctccggcaatgcttgctagccgccgtccagcagctcggcgtcgaccacggcatgcccccagccgctgacccttgggtggtagaggacgtggtagagccggcattgcagcagctctccaccgatgagctcgagcaaccggcgtcccgggacgtcttcttagagcagctgaagaagctgctgggcagcgtcgcggagcagcttcaggaggggcacgtcatcgttgcgcacaccgagaacaccttcgacgggaccggtgtcaggaggctgctgggaaacaagttcgagctggacaagctgctggattctgtgtggagggacgtgccggcggagctcaggaagaaggcgcccaaggacaaggagcacctgcgagtcgcactcgataagatggccgatgcagcaagcttaccaccccatggctctgttgctcaggtggacgccgtcgtggacgaggcgctcaaggtggcggacgccggcgacgggaaggtggtcgaagaagcggagttcaagaagctgctgacggaggtgcttggggccgtgatgctgcggctgagcggcgaaccgatcttcttctccaccagcaccgtcgtccacgagccgctgtccagctcgtccgccctgttgccgtcgccggcggtggcatcaccgccgagcgagtagcaatatgcacatgaaaggtaaatagtatgggagtgggcataaggcctctccgtaagcggtgcctgtggttgtgctttttatctgatcacgagcattcctgcgttgctatggttgattggaacctgacggaatgcagcgttgcagttcgtcaagtactctggttaatgtataagtttggaataaggctaccaagccataaagacaaattgtcaatgggaaatgttactgcgtgcgaatgcattggttgggagagatgctacgtgcgaaagcattatctgtgttctgatgtaagaatgggagaagaaacattcagctttcatttccaataataatcaggaaaagaaagtaatctttgtgtagaaaatgatgcttcagtttgtcaacctcagtagaattcaaagcgaaaagaaaaacacgaatcactacgcaagtactgcaagacatgtcaatagtttcgtaaggttcacgatggataacatgaatctacgcaagcactggaagacatggagtcatcgcaccgcttcacacctcaatagttttgttccagaagttcatacgcatcacagcgtcagtgcacggaataaggaaaagtctcaccgtttcctaaggttatactgatctagtacaaagtcaatggtaacacaaaggacacatgccttgtttaaggatcggatacttagctagagatcttttgcttcttgggcttcttaggcatgacaaagtcatcatcgtcgtcgtcatctgtgtcgctagatgccttctttctcttttgtgctgtggtttttccctttgtggctgagttggtttcgacaaagtcgtcgtcctcgtcgtcatcagtgttgctagatgccctcttcttttgcgctgtggtttttccctttgtacctgagttggttttcttatcgcctaacagcagtaccttcttggttggagaacttgcccttctctgtgtagaaggcgttttgaccggtgatctcagtttcagaacctgtttctgaccctgtttcctcgcaaagacctctgtagccacatccagcggtagcaaaccccattccatcaaccaaaatgcagccatttcactatcgggcacctgctcatagagcgattcataaaatatcctcaatggatccctttcaggaggaggatcatgtttctgccctggcaattcatacacctttctctccttcttcaccccagcagccccctccttcttcaccccagcagccttcttttcatcttccttgataccaacttccttctttatttcttttcctcctttgtatcatattcatcttttggttt

SEQ ID NO: 4947 - DNA, 1578 bp, Secale cereale
accaaacgccaagacgcaaagcgatcgggagcttcccgatcatcctcctgtcctgtagctagccgcgtgctgcaacttttcctcggtgcggcggccagtccctgtccgcgtatatatagagacgccgggggcgatggagaggagctggttcgggtggaggaaggcgaagcagggcaccggcgccggcggcggggagaaggagggggaggaggaggatcgggccaaggtggtggtggacgggtcggggatacgggagctggtggaggacagggaggcgttcggcatgttcgcggagaccaagttccggcagctcgacgccgacggggacggccggctgtccgtgcgggagctgcagcccgccgtggccgacatcggagcgtcgctcggcctgcccgcgcagggctcctcgcccaacgccgaccacatctactccgaggctatgagcgagttcagtcatggtcacgggaaccaggagggggtgagcagggcggagttcaaggaggtactgtccgacattctcctcggcatggcggccgggctcaagaaggacccgatcgtgatactgcgcatcgacggcgaggacctcagggacttcgtgtccagcccaaggtatgagacggcagtcgctgccatcttctcacaggttgtgtctcgagacctctctctccggcaatgcctgctagccgctgttcagcacctcggagtcgaccacggcatgcccccagcctctgacccttgggtggtagagaacgtggtcgagccggcactgcagcagctctccgccgatgagctccagcaaccggcgtcccggggcgtcttcttcgaacagctgaagaagctgctgggcggcgtcgcggagcagcttcaggagcggcacgtgatcgttgcgcacaccgagaacaccttcgacgggagcggtgtcaggaggctgctgggaaacaagttcgagctggacaagctgctggattctgtgtggagggacgtgccggcagagcacaggaagaaggcgcccaaggacaaggagcacctccgagtcgcgctcgataagatggccgatgcagcaagcttgccacctcatggcgctgttgctcaggtggacgccgtggtggacgaggtgctcaaggtggcggactccggcgacgggaaggcggtcgaagaagcggagttcaagaagctgctgacagaggtccttggcgccgtgatgctgcggctgagcggcgaaccgatcttcttctccaccagcaccgtcgtccacgagccactctccagctccgccctgttgccgtcgccggcggtggcatccccgccaagcgagtagcaatatgcacatgaaaggtaaatagtaggagagtgggcataaggcctctccgtaagcggtgcctgtggttgtgctttttatctgatcacgagcattcctgctttgctatgtttgattggaagcagcgttgcagttcgtaagtactctggttgatgtataagtttggaataaggctgccaagccagaaagacacattgtcaatggaaaatgttactgcgtgcggattgcattggttgggggagatgctatattactactcc

SEQ ID NO: 4948 - DNA, 1435 bp, Hordeum vulgare
acgcgtccgccagtgcagtccgtccatatatatatatatagcgatggagaggggctggttcgggtggagaaggcgaagcagggcggggggaaggaggaggagggtcgggccaaggtggtggtggacgggtccgggatacggcagctggtggaggaccgggaggcgttcggcatgttcgcggagaccaagttccggcagctcgacgccgacggcgacggccggctgtccgtgcgggagctgcagcccgccgtggccgacatcggcgcctcgctcggcctgcccgcgcagggctcctcgcccaacgccgaccacatctactccgaggctatgagcgagttcactcatggtcacgggaaccaggagggggtgagcagggcagagttccaggaggtcctgtccgacattctcctcggcatggcggccgggctcaagaaggacccgatcgtgatactgcgcatcgacggcgaggacctcagggacttcttgtccagcccaaggtatgagccggtagccgctgccatcttctcacaggttgggtctgaagatgcccctctccggcaatgcctgctagccgccgttcagcagcttggcgtcgaccacggaatgcccccagccgctgacgcttgggtggtagagaacgtggtagagccggcattgcagcagctccccgccgatgagctcgaacgacgggcgtcccgggacgtcttcttggagcagctgaagaagctgctggccggcgtcgcggagcagcttcaggagcggcacgtgatcgtcgcgcacacggagaacaccttcgacgggagcggcgtcaggaggctgctgggtaacaagttcgagctcgacaagctgctggattctgtgtggagggaggtgccggcagagcacaggaagaaggcgcccaaggacaaggagcacctgcgggtcgcgctcgataagatggccgacgcagcaagcttgccaccccatggcgctgttgatcgggtggacgccgtcgtggacgagacgctcaaggtggcggacgccggcgacgggaaggcggtcgaggaagcggagttcaagaagctgctgacggacgtccttggggccgtgatgctgcggctgagcggcgaaccgatcttcttctccaccagcaccgtcgtccacgagtcgatgcccggctcgtccgccctgttgccgtcgcccgcggtggcatctccgccgagcgagtagcaacgcgcgcatataaaaggtaaatagtactgtaggagagtgggcataaggcctctccgtaagcggtgcatgtggttgtgttttttatctgatcacgagcattcatgctttgctatggtttgttggaaactgacggaatgcaacgctgcagttcgtcaagtactccagcagtatgttgacactggttggtgtaatataagtttggaataaggcttccaagccagaa

SEQ ID NO: 4949 - DNA, 1595 bp, Avena sativa
ggcagcagaaccaaacgccgagacgccaagcaatcgacagacagcttcggtcctgtacctacctgcgagtgggaaagggggccgcgcgcggcgcccggccggtgcaacttttcctcgaccgattccttacacgtcagtgcctgctactgctagtgctgctatatatacggagaggccggcgccggggagcgatggagaggagctggttcgggtggaggaaggcgaggaagggcggtactggtggtgccggtggtggtggtggcgcggagaaggaggtggtggtggacgggcaggggatacgggagctggtggaggacagggaggccttcggcatgttcgccgacaccaagttcacgcagctcgacgccgacggggacggcaggctctccgtgcgggagctcgagcctgccgtcgcggacatcggcgccgcgctcggcctgcccgcgcagggctcctcccccaacgcggaccacatctactccgaggctatgagcgagctcacccatggccatgggaaccaagagggggtaagcagggcagagttccaagaagtcctgtcggacattctcctcggcatggcggccgggctcaagaaggacccgatcgtgatactgcgcatcgacggcgaggacctcagggacttcgtgtccagtcccaggtatgaaccggcagctgccgccatcttcgcacaggttgcctctgaagatgcctctctccggcaatgcctgctagctgccgttgaacagctccgtgtcgaccatggcatgcccccggcttctgacccctggatcgtagacaacgtcgtggatccggcactgcagcgactctccgccgatgagctcgagcagaaggcgtccaaggacgacttattcctggagcagctcaagaagctgctgggcgatgtcgcggaccggcttcaggagcagccggtgatcgtcgcgcacacggagaacaccttcgacgggagcggcgtcaggaggctgctggcaaacaagttcgagctggacaagctgttggattctgtgtggagagacgtgccgacagaagacgagaagaaagcgtccaaggaacacctgcgagtcgcactcgataagatggctgatgcagcaagcttaccacctcatggcgctgtcgaccaggtggatgcggtagtgaacgaggcactcaagaaggcgaacgccgacgacgggaaggaggtagacgaagtggagttcaagaaactgctgacggaggtccttggggccgtgatgctgcagctgaaaggcaaaccgatcttcttctccaccagcaccgtcgtccacgagccactgtccagttcgtctgccctgttgtcgtcgccggcggtggcagcaccgccgagtctgtaacgagaaggtaaatatgagagtgggctatatattaaagcctctccataagcagtgcctgttgtgatggtattttttattccaatcacggcattcgtgctttgcttggccgcaacctgacgggatgcagccatgcatttcctcaggtttgttcgcctggttgatgtataactttgtaataaggctttcaaagccagacacactgtcaatgggaaatgcaagtagtttgcg

SEQ ID NO: 4950 - DNA, 1416 bp, Brachypodium distachyon
gcaaggcaatggagaggagctggttcgggcggaggaagacgaagaagcggcagggtggggagaaggaagaccggcagaaggtggtggtggacgggacggagatacgggagctggtgggggacagggaggcgttcggcatgttcgcggagagcaagttcagggagctcgacgccgacggggacggaaggctgtccgtgcgggagctgcagccggccgtggccggcatcggcgccgcgctcgggctgcccgcgcaggggtccgaccccaacgccgaccacatctactccgaggctatgagcgaggtcacgcaagggaagcaagagggggtgagcagggcagagttccaagaggtcttgtccgacattctcctcggcatggcggccgggctcaagagggacccgatcgtcatactacgcatcgacggcgaggacctgagggacttcgtttccagccccagatacgaacctgcagccgctgccatcttctcacaagccgggtctgaagatgcctcttctctccggcaacgcctgctagctgctgttcggcagctcggcgtcgaccatggaatgcccccagctgctgacccttgggtgctagagaacgtcatagagccggcgttgcagcgactctccgccgatcagcttgagcagccagtggcgtccaaggacatcttcttggaacagctcaagaagctcctcggcgacgtcgtggagcggctccaggagcggcctgtgatcgtcgcacacaccgagaacaccttcgacgggagcggtgtcaggagtctgctggccaacaagttcgagctggacaagctgttggattctgtctgcaaagacgtgccggtagagcataagaagaaggcgtccaaggagtgcctgcgagccgcgctagataagatggctgatgcagcaagcttaccacctcatggctctgttactcaggtggatgccatcgtggacgaggcgctcaagatggcgaataacgcccacgacgggaaggcggtagacgaagcggagttcaagaaactcctgacggaggtcctgggagccgtgatgctgcggctgagcggcgacccggtcttcgtctccaccagcaccgtcgtccatgagtcactgtccagttcgtccacgctgctgtcctcgccggcggtgccgtcgccgccgagcgagtaaagcagtacacacaacaaagttaagtatgagaggacgagcataaggcctctctgtattttaaacagtggctgtgatggtgctttttgtctgatcacgcgctgcggggcatgcattgcatatttgcgtgcatccattgcttggtgacaacctgacaggatgcaaaataagatgccgtttcgtcaggtttgttggcctggttgatgtataagtttggaataataaggcttccgagccagacacattg

SEQ ID NO: 4951 - DNA, 2877 bp, Brachypodium distachyon
gcccggtgcagtacaaaataaaaatcaaaagcgtgattgctacgcgcgtgtcccggccgtgcacgcgcgttatccagccgccgaccactcccaaactttttccccggccggttccttgatttcctttccaaaatgcttttcattcccgtctcctgatcctagagctgcctgtagtggaaaaaaaaaggccggcggcgcccggtgcaactttttctcgtttggcacgcagtagtaccatcagtatataaagaacacggaggcaaggcaatggagaggagctggttcgggcggaggaagacgaagaagcggcagggtggggagaaggaagaccggcagaaggtggtggtggacgggacggagatacgggagctggtgggggacagggaggcgttcggcatgttcgcggagagcaagttcagggagctcgacgccgacggggacggaaggctgtccgtgcgggagctgcagccggccgtggccggcatcggcgccgcgctcgggctgcccgcgcaggggtccgaccccaacgccgaccacatctactccgaggctatgagcgaggtcacgcaagggaagcaagagggggtgagcagggcagagttccaagaggtcttgtccgacattctcctcggcatggcggccgggctcaagagggacccgatcgtcatactacgcatcgacggcgaggacctgagggacttcgtttccagccccagatacgaacctgcagccgctgccatcttctcacaagccgggtctgaagatgcctcttctctccggcaacgcctgctagctgctgttcggcagctcggcgtcgaccatggaatgcccccagctgctgacccttgggtgctagagaacgtcatagagccggcgttgcagcgactctccgccgatcagcttgagcagccagtggcgtccaaggacatcttcttggaacagctcaagaagctcctcggcgacgtcgtggagcggctccaggagcggcctgtgatcgtcgcacacaccgagaacaccttcgacgggagcggtgtcaggagtctgctggccaacaagttcgagctggacaagctgttggattctgtctgcaaagacgtgccggtagagcataagaagaaggcgtccaaggagtgcctgcgagccgcgctagataagatggctgatgcagcaagcttaccacctcatggctctgttactcaggtggatgccatcgtggacgaggcgctcaagatggcgaataacgcccacgacgggaaggcggtagacgaagcggagttcaagaaactcctgacggaggtcctgggagccgtgatgctgcggctgagcggcgacccggtcttcgtctccaccagcaccgtcgtccatgagtcactgtccagttcgtccacgctgctgtcctcgccggcggtgccgtcgccgccgagcgagtaaagcagtacacacaacaaagttaagtatgagaggacgagcataaggcctctctgtattttaaacagtggctgtgatggtgctttttgtctgatcacgcgctgcggggcatgcattgcatatttgcgtgcatccattgcttggtgacaacctgacaggatgcaaaataagatgccgtttcgtcaggtttgttggcctggttgatgtataagtttggaataataaggcttccgagccagacacattgtcaattggaatatgcaaatgttttgcaactttcgttggggagctgttaccacggacaaaagccttcagctatctttcaaaaaatagagaatgatcagttaaaaaaggggagaataaaacacctagctctgattcccagcactccagagaattacacaacagaatgcaactgcagtgcagtgttacggcaatccaaggtgtgagtgttcactggattatttctgcatttcaaggttgcaacattggggcatagtaaacaggcttaagattgttgcagaaattattagtttgtgacgctctgaaagtttgtgtgcatgtatatttgcaacttgcaaagttttttttttcttattctgttttaaagtactgtgctaacaaccaaatctacttgttaaatatgtgaagtttggtactgcagtctactctttttttttgtgagctacttaaaacaaacttctttgttattaccagccatggcagtttgctggtccaggaaactcaaattcacgctgcgagaagtttactttgggcaaacgctgatgtgccagtttgacaacctctcacatttctcattagcatttcaggtagaagaaaaaaatgaatcactacgcaagcaccagaagacatggaaccattgtacacatagaaagacaaagttgtcatcgcttctcatcagcatatgaaagagaaaaaatttcatcccttcctaaggttatcctgatctagcttaatgtcatggtgaatgaagaacatgcctcgcttgctaaggatgagacctagcttgagatcttttgccttttggtctttgtcttagacaagacaaagtcatcatcatcgtcatctgtgtcactagctgccctcctcttcttttgtgctgtgctttttccagtgtcctttgcagctgacttggtttccttagccaatcttggttgattcttagttggagtacttgtctttctctgtgcagaaactgttttgaccggtgacttcagtttctgaccctgtttctttcgtaagacctctctagcctcatcttctgggagcaagccccattccatcaacctatgcaaagggttaccaaagatattaacaatgtatcacagcttcaagtaacacaagcttcaagcaattagttaccaaagattttcttacaccagaggaaatagtagactagtaatgtatgcataaaattgtacataccgg

SEQ ID NO: 4952 - DNA, 1432 bp, Pseudoroegneria spicata
  misc_feature (7)..(9): n is a, c, g, or t
cgcacgnnnatttgggaggtggagaaaggggaacggggaaagggatctcgccgcaacgcaccatggagctcaccgccaccggcgctgctgccctccggcgatcgttggcgtcggcgtatccggtggtcccgagggagaggaggagggggatgccggccagggtgtcctgcgtcggccgcggaggcagaggcgtaggcgggggattcgccgacgaggcgcacctcaggtactacgaggcgccgcggaaggcggtggaggcggcggcgagggaccttaccaagctccgggccatgggccttgtcgctggcgacccagccaaggagaagatcctctcggaagccactgagctgctgctgcaggagttgaatcagatgaaggatgcagaggacgagctgaagaagaagcagaaagaggagaaggctgcgatgaaagcactgaagaagcagcagaaggaagcaaagaaggccgcaatgaactgtggagatggctcctctgaatcaagcgagagtgagtgtgaggaagagcaatccatgaaaatgagctgtgttgccaccacatcgattcccgcaattgagcaaggaatggtgacgtcaatgtcagtgcccgaaattgctgcatccaacatcgcaacagctccggcgatggattttgacaaggctgcgatgaaggccatgaagaagagggagaaggaacaaaagaaagctgcaaagaaggccatgaagatgaaaagggaggaagagaagaggatggccacactgaattcctgcaaagatgaagacagctcatgctcatcggagtccagcaacagtgagtgcgaaggggaagtcgtcagaatgagccgctgtgccaccatttctgcgcctcgaacaccacctgcaagcacagttttccccatcatagtgcctcaaatcccagactctgttgcactggatgctcagatcttttccgggtctgcaaatgcaatgcagtgcactgccaccagcattgccgttgtcgaaaaaccagtgctgaacaggatcgaggtctgcatgggcggcaaatgcaagaaggcggggtcgctcgctgtcctgcagaagtttgagacggaggttggcacgggcggcatggtggtcggttgcaaatgcttggggaaatgcgggctaggcccaaatgtgcggcttcggagtgagggctctatacagaagaacagtcccatctgcattggtgtaggcttggatgatgttggcaccatagtggcaggcttcatcggagatgacgatctgggcatgaactgatacgatggttacctggacctggttcaggttggtatttacagacctgcactactacaacttgttttgtctggcaaatgtactactacaactttgctgcgcagtaatacattgtagataatcacgcccctgacgagctgatatatgttctgagcttaatg

SEQ ID NO: 4953 - DNA, 1786 bp, Triticum aestivum
gcagacggatttgggaggtggagaaagggggaacggggaacgcggaaagggatctcgccgcaacgcaccatggagctcgccgcaaccggcgctgctgccctccggcgatcgttggcgtcggggtatccggtggttccgagggagaggagaaggcggatgccggccagggtgtcctgcgtcggccgcggaggcagaggcgtaggcgggggattcgccgacgaggcgcacctcaggtactacgaggcgccgccgcggaaggcggtggaggcggcggcgagggaccttaccaagctccgggccatgggccttgtcgccggcgacccggccaaggagaagatcctctcggaagccactgagctgctgctaaaggagttgaatcagatgaaggatgcagaggacgagctgaagaagaaggacgagctgaagaagaagcagaaagaggagaaggctgccatgaaagcactgaagaagcagcagaaggaagcgaagaaggctgcaatgaactgtggagatggctcctctgaatcaagcgagagtgagtgtgaggaagagcagtccatgaaaatgagttgtgttgccaccacatcgatgcctgcaattgagcaaggaatggcgatgtcaatgtcagtgccccaaattgctgcatccaacattgcaacagctccggcaatggattttgacaaggctgcgatgaaggccatgaagaagagggagaaggaacaaaagaaagctgcaaagaaggccatgaagatgaaaaaggaggaagagaagaggatggccacactgaattcctgcaaggatgaggacagttcatgctcatcggagtccagcaacagtgagtgtgaaggggaagtcgtcagaatgagccgctgtgccaccatttctgtgcctcgaacaccatctgcaagcacagttttccccatcatagtgccacaaatctcagactccgttgcactggatgctcagatcatttctgggtctgcaaatgcaatgcagcgcactaccaccagcattgcggttgtcgaaaaaccagtgctgaacagaatcgaggtctgcatgggtggcaaatgcaagaaggcgggctcgctcgccgtcctgcaggagtttgagacggtggttggcacgggcggcttggtggtcggttgcaaatgcttggggaaatgcgggctaggcccaaatgtgcggcttcggagtgagggctctgtacagaagaacagtcccatctgcattggtgtaggcttggatgatgttggcaccatagtggcaggcttcatcggagatgacgatctgggcatgaactgatacgatggttacctggactcaggttggtatttacagacctgtattactacgacttgttttgtctggcaaatgtactactgcaactttgctgcacaataatacattgtagataatcacgcccctgacgagctgatgtatgttctgagcttaatgagctgctgtttactatatatatactccctgtttcatccaggagccgcgagttcgtcggttgccggttcttaggtttctttcagttgtggttctgccgctcctctgcttatgcttggcggcacgctggcggcgtccaacaacgcatttttgatgttatgttggccttgctcatcgtgtggtgtcttgttttttatttgatcagtttgtatgaggatttccttggcaccttgtagcttgtgccattcgatcttatgtgtttattataaagtgagaccaaagcctgttccaaaagaaaatgaaaatgaaaatgcatgcaacatactttacggcc

SEQ ID NO: 4954 - DNA, 1634 bp, Triticum aestivum
ggagaaagggcagcggggaacggaaaaagggatctcgtcgcaacgcatcatggagctcgccgcaaccggcgctgctgccctccggcgatcgttggcgtcggcgtgtccggttgtcccgagggagaggaggagggggatgccggccagggtgtcctgcgtcggccgcgtaggcggatgcgggggattcgccgacgaagcgcacctcaggttctacgacgcggcgccgcggaaggcggtggaggcggcggcgagggaccttaccaagcttcgggccatgggccttgtcgctggcgacccggccaaggagaagatcctctcggaagcaaccgagctgctgctgcaggagttgaatcagatgaaggatgcagaggacgagctgaagaagaagcagaaagaggagaaggctgcgatgaaagcactgaagaagcagcagaaggaagccaagaaggccgcgatgaactgtggggatgcctcctctgaatcaagcgagagtgagtgtgaggaagagcaatccatgaaaatgagctgtgttgccaccacatcgatgcctgcagttgaccaaggaatggcgatgccaatgtcagtgccccaaattgctgcatctaacatcgcaacagctccggcaatggattttgacaaggctgcgatgaaggccatgaagaagagggagaaggaacaaaagaaagctgcaaagaaggccatgaagatgaaaaaggaggaagagaagcggatggccacactgaattcctgcaaggatgaagacagctcatgctcatcggagtccagcaacagtgagtgtgaaggggaagtcgtcagaatgagccgctgtgccaccatttctgcgcctcgaacaccacctgcaagcacagttttccccatcatagtgcctcaaatcccagactccgttgcactggatgctcagatcttttccgggtctgcaaatgcaatgcagcacactgccaccagcattgcggttgtcgaaaaaccagtgcagaacagaatcgaggtctgcatgggcggcaaatgcaagaaggcgggctcgctcgccgtcctgcaggagtttgagacggaggttggcaccggcggcatggtggtcggttgcaaatgcttggggaaatgtgggctaggcccaaatgtgcggctgcacagcgagggctctgtacagaagaacagtcccatctgcattggtgtaggcttggatgatgtcggcaccatagtggcgggcttcatcggagatggcgacgtgggcatgaactgataagatggttacctggagcaggttcaggttggtatttacagacctgtactactacaacttgttttgtctggcaaatgtactacaaaaactttgctgcacaataatacgttgtatataatcacgcccctgacgagctgatgtatgttctgagcttaatgagctgctgtttactatatatatactccctgcttcatccaggagccgtgagttcgtcggttgtcgtccttaggtttcttttagttgtggttcagccgcttctgtgcttatgcttggcggcacgctggcggcgtccaacaacgcatctctgatgtcttgtttttgctatcgtgcgtgactgcgtgtgatgtcttgtttttatttgatcactttgtatgag

SEQ ID NO: 4955 - DNA, 1742 bp, Hordeum vulgare
cgcagacggatttgggaggtggagaaaaagggcaacggggaacggggaaagggatctcgccgtaacgcaccatggagctcaccgccaccggcgctgctgccctccggcgatcgttggcgtcggcgtatacggtggtaccgagggagaggagaagggggatgccgtccagggtgtcctgcgtcggccgcggaggcataggcgggggattcgccgacgaggcgcacctcaggtactacgaggcggtgccgcggaaggcggtggaggcggcggcgagggaccttaccaagctccgggccatgggccttgtcgccggcgacccggccaaggagaagatcctctcggaagcaactgagctgctgctccaggagttgaatcagatgaaggatgcagaggacgatctgaagaagaagcagaaagaggagaaggctgcgatgaaagcactgaagaagcagcagaaggaagccaagaaggccacgatgaactgtggagacggctcctctgaatcaagcgagagtgagtgtgaggaagagcaatccatgaaaatgagctgtgttgccaccacatcgatgcctgcaattgagcaaggaatggtgatgtcaatgtcggtgccccaaattacggcatccaacatcgcaagagctccggcaatggattttgacaaggctgcgatgaaagccatgaagaagaaggaaaaggaacaaaagaaagctgcaaagaaggccatgaagatgaaaaaggaggaagagaagaggatggccacactgaattcctgcaaggatgaagacagctcatgttcatcggagtccagcaacagtgagtgtgaaggggaagtcatcagaatgagccgctgtgccaccatttctgcgcctcgaacaccacctgcaagcacagttttccccatcatagtgcctcaaatcccagactccgttgcactggaagctcagatcttctccgggtctgcaaatgcgacggagtgcactgccaccagcattgcggttgttgaaaaaccagtgctgaacagaattgaggtctgcatgggtggcaaatgcaagaaggcgggctcgcttgccgtcctgcaggagtttgagacggagcttggcatgggcggcacggtggtcggatgcaaatgcttggggaaatgcggtctgggcccaaatgtgcggcttcggagtgagggctctgtacagaagaacagtcccatctgcattggtgtaggcttgggtgatgttggcaccatagtggcaggcttcctcggagatggcgatctgggcatgaactgatacgaacctggacctgattcaggttggtatttacaagacctgtactactacaacttgttttgtctggcaaatgtactactacatctttgctgcacaataatacattgtagataatcacgtccctgacgagctgatgtatgttctgagcttaatgagctgttgtttactatatatgctccctgtttcatccagtagccgcgagttcgtcggttgttggttcttaggtttcttttagttgtggttctgccgctcctgtgcttatgcttggcggctcgctggcggccaacaacgaatttctgatgttatgttggccttgctcctcgtgtggtgtcttgttttttaatttgataattttgtatcaggatttccttggcaccttgtagcttgtaccattcgacttgaagtgagaccgtactccctctgtcccattcgaccgtactctctttgttttataatataaag

SEQ ID NO: 4956 - DNA, 1411 bp, Hordeum vulgare
gggcaacggggaacggggaaagggatctcgccgtaacgcaccatggagctcaccgccaccggcgctgctgccctccggcgatcgttggcgtcggcgtatacggtggtaccgagggagaggagaagggggatgccgtccagggtgtcctgcgtcggccgcggaggcataggcgggggattcgccgacgaggcgcacctcaggtactacgaggcggtgccgcggaaggcggtggaggcggcggcgagggaccttaccaagctccgggccatgggccttgtcgccggcgacccggccaaggagaagatcctctcggaagcaactgagctgctgctccaggagttgaatcagatgaaggatgcagaggacgatctgaagaagaagcagaaagaggagaaggctgcgatgaaagcactgaagaagcagcagaaggaagccaagaaggccacgatgaactgtggagacggctcctctgaatcaagcgagagtgagtgtgaggaagagcaatccatgaaaatgagctgtgttgccaccacatcgatgcctgcaattgagcaaggaatggtgatgtcaatgtcggtgccccaaattacggcatccaacatcgcaagagctccggcaatggattttgacaaggctgcgatgaaagccatgaagaagaaggaaaaggaacaaaagaaagctgcaaagaaggccatgaagatgaaaaaggaggaagagaagaggatggccacactgaattcctgcaaggatgaagacagctcatgttcatcggagtccagcaacagtgagtgtgaaggggaagtcatcagaatgagccgctgtgccaccatttctgcgcctcgaacaccacctgcaagcacagttttccccatcatagtgcctcaaatcccagactccgttgcactggaagctcagatcttctccgggtctgcaaatgcgacggagtgcactgccaccagcattgcggttgttgaaaaaccagtgctgaacagaattgaggtctgcatgggtggcaaatgcaagaaggcgggctcgcttgccgtcctgcaggagtttgagacggagcttggcatgggcggcacggtggtcggatgcaaatgcttggggaaatgcggtctgggcccaaatgtgcggcttcggagtgagggctctgtacagaagaacagtcccatctgcattggtgtaggcttgggtgatgttggcaccatagtggcaggcttcctcggagatggcgatctgggcatgaactgatacgaacctggacctgattcaggttggtatttacaagacctgtactactacaacttgttttgtctggcaaatgtactactacatctttgctgcacaataatacattgtagataatcacgtccctgacgagctgatgtatgttctgagcttaatgagctgt

SEQ ID NO: 4957 - DNA, 1668 bp, Secale cereale
tcaccgccaccggcgctgctgccctccggggatcgctggcatcggcgtgtccggtggtccagcgggagaggaggagggggatgccggccagggtgtcctgcgtcggccgcggaggcagaggcgtaggcgggggattcgccgacgaggcgcacctcaggtactacgaggcgccgcggaaggcggtggaggcggcggcgagggaccttaccaagctccgggccatgggcctcgtcgccggcgacccggcgaaggagaagatcctctcggaagctactgagctgctgctgcaggagttgaatcagatgaaggatgcagaggacgagctgaagaagaaacagaaagaggagaaggctgcaatgaaagcactgaagaagcagcagaaggaagcgaagaaggccgcgatgaactgtggagatggctcctctgaatcctctgaatcgagcgagagtgactgtgaggatgagcagtccatgaaaatgagctgtgttggcaccacatcgacgcctgcaattgagcaaggaatgtcgatgtcaatgtcagtgccccaaattgctgcatctaacatcgcaacagctccggcaatggattttgacaaggatgcgatgaaggccatgaagaagagggagaaggaacaaaagaaagctgcaaagaaggccatgaagatgaaaagggaggaagagaagaggatggccacactgaattcctgcaaggatgaagacagctcatgctcatcggagtccagcaacagtgagtgtgaaggggaagtcgtcagaatgagccgctgtgccaccatttctgcgcctcgaacaccacctgcaactgcaagcacagttttccccatcatagttcctcaaatcccagactccgttgcactggatgctcagatcttttccgggtctgcaaatgcaatgcagcgcactgccaccagcatcgcagttgtcgaaaaaccagtgctgaacaggatcgaggtctgcatgggcggcaaatgcaagaaggcgggatcgcttgctgtgctgcaggagttcgagacggaggttggaacggacggcatggtggtcggttgcaaatgcttggggaaatgcgggctaggcccaaatgtgcggcttcggagtgagggctctgtacagaagaacagtcccatctgcattggtgtaggcttggatgatgttggcaccatagtggcaggcttcatcggggacggcgacatgggcatgaactgatagaatggttacctggacctggttcaggttggcatttacaagatctgtactactacaacttgtttgtccggcaaatgtactactacaacttgctgcgcaataattcattgtagataatcacgaccctgacgagctgatgtatgttctgagcttaatgagctgctgtttactttctccgttcctaaatataggtcttttgtagagatttcactatgaactacatacggagacaaaatggatgaatctacttactaaaatgcatctatatacatctagtaattggtttgtttttagtagtaaactctactaacaaagtacttaatagttagtttaggaacggaggaagtactatatatactcctacctccttattcagtccgggacgtccgtctacgttcgtcgttcgtcttgtttctttaggttttactttttatttagttgttgttac

SEQ ID NO: 4958 - DNA, 1428 bp, Leymus cinereus x Leymus triticoides
  misc_feature (31)..(31): n is a, c, g, or t
  misc_feature (51)..(51): n is a, c, g, or t
  misc_feature (93)..(93): n is a, c, g, or t
  misc_feature (96)..(96): n is a, c, g, or t
  misc_feature (98)..(98): n is a, c, g, or t
  misc_feature (105)..(105): n is a, c, g, or t
  misc_feature (120)..(120): n is a, c, g, or t
  misc_feature (132)..(132): n is a, c, g, or t
  misc_feature (135)..(135): n is a, c, g, or t
  misc_feature (174)..(174): n is a, c, g, or t
  misc_feature (180)..(180): n is a, c, g, or t
  misc_feature (194)..(194): n is a, c, g, or t
  misc_feature (208)..(208): n is a, c, g, or t
  misc_feature (634)..(634): n is a, c, g, or t
aaacggggaacggggaaagggatctcgccgnaacgcaccatggagctcacngccaccggcgcagctgccctccggcgatcgctggcgtcggcntancnggtggtnccgagggagaggagnagggggatgccngcnagggtgtcctgcgtcggccgaggaggcgggggattcgcngacgangcgcacctcaggtnctacgaggcgccgnggaaggcggtggaggcggcggcgagggaccttaccaagctccgggctatgggccttgtcgccggcgacccggccaaggagaagatcctctcggaagccactgagctgctgctgcaggagttgaatcagatgaaggatgcagaggacgagctgaagaagaagcagaaagaggagaaggctgcgatgaaagcactgaagaagcagcagaaggaagcgaagaaggctgcaatgaagtgtggagatggctcctctgaatcaagtgagagtgagtgcgaggaagagcaatccatgaaaatgagctgcgttgccaccacatcgacgcctccagttgagcaaggaatggtgacgtcaatgtcagtgccccaaattgctgcatctaacatcgcaacagggccggcaatggattttgacaaggctgcgatgaagnccatgaagaagcgggagaaggaacaaaagaaagctgcaaagaaggccatgaagatgaaaagggaggaagagaagaggatggccacactgaattcctgcaaggacgaagacagctcatgctcatcggagtccagcaacagtgagggcgagggggaagtcttcagaatgagcagctgcgcgaccatcgccgcacctcgaacaccacctgcaagcacagttttccccatcatagtgcctcaaatcccggactccgtggcaccggatgctcagatctttttcgggtctgcaaatgcaatgcagtgcactgccaccagcatcgcagttgttgaaaaaccagtgctgaacagaattgaggtctgcatgggcggcaaatgcaagaaggcgggctcgctcgccgtcctgcagaagtttgagacggaggttggcacgggcggcatggtggtcggatgcaaatgcttggggaaatgcgggctaggcccaaatgtgcggcttaggagtgagggctctgtacagaagaacagtcccatctgcattggtgtaggcttggatgatgttggcaccattgtggcaggcttcattggagatggcgatctgagcatgaactgatacgatggttacctggaccttgttcaggttgtatttacagacctgtactattacaacttttatttggtaatcgtactattaccacttgctgcacaataatacattgtagataatcacgcccctgacgagctgatgtatgttctgagcttaatgagccgtttacttatagatgtcatgtatgctactcca

SEQ ID NO: 4959 - DNA, 1204 bp, Secale cereale
gggattcgccgacgaaacgcacctcaggtactacgaggcggccgcggaaggcggtggaggcggcggcgagggaccgttaccaagctccgggccgatgggccttgtcgccggcgacccagccaaggagaagatcctctcggaagccactgagctgctgctacaggagttgaatcagatgaaggatgcagaggacgagctgaagaagaagcgggaagaggagaaggctgcgatgaaagcactgaagaagcagcagaaggaagccaagaagccgcgatgaactgtggagatggctcctctgaatcctctgaatcgagcgagagtgagtgtgaggaagagcagtccatgaaaatgagctgtgttgccaccacatcgacgcctgcaattgagcaaggaatgtcgatgtcaatgtcagtgccccaaattgctgcatctaacatcgcaacagctccggcaatggattttgacaaggatgcgatgaaggccatgaagaagagggagaaggaacaaaagaaagctgcaaagaaggccatgaagatgaaaagggaggaagagaagaggatggccacactgaattcctgcaaggatgaagacagctcatgctcatcggagtccagcgacagtgagtgtgaaggggaagtcgtcagaatgagccgctgtgccaccatttctgcgcctcgaacaccacctgcaagcgcagatttccccatcatagtgcctcaaatcccagactctgttgcactggatgctcagatcttttccgggtctgcaaatgcaatgcagtgcactgccaccagcattgcggttgtcgaaaaaccagtgctgaacagaatcgaggtctgcatgggcggcaaatgcaagaaggcgggctcgctcgctgtcctgcaggagtttgagacggaggttggcacgggcggcatggtggtcggttgcaaatgcttggggaaatgtgggctaggcccaaatgtgcggcttcggagtgagggctctgtacagaagaacagtcccatctgcattggtgtaggcttaaatgatgttggcaccattgtggcaggctttatcagagatgacgatctgggcatgaactgatacgatgattacctggacctggttcaggttggtatttacagacctgtactattataacttgttttgtctggcaaatgtactactacaactttgctgcacaataatacattgtagataa

SEQ ID NO: 4960 - DNA, 1487 bp, Brachypodium distachyon
gggaaaacgcatccatggagttcaccggcgctgctgccctccggcggtcgctccccgcggcatgcccggcggtgttctcgagggagaggaggaatcgggggatgccgggcagggtctcctgcgtcggccgcggcggaggcgtgggattcgccgacgagggacacctcaggtactacgaggcggcgccgcggaaggcggtggaggcggccgcgagggacctcaccaagctccgggccatgggcctcgtcgctggggacccctccaaggagaagatcctctcggaagctaccgagctgctactgctggaattgaaccagatgaaggatgcggaggacgacctgaagaagagggaaaaagaggagaaagctgctatgaaagcactgaagaagcagcagaaggaagcgaagaaggctgcagctgtgatgacctgtggagatggctcctcggaatcaagtgagagcgagtgtgaggaggagcaatccacggaaatgagctgtgtagccaccaagtcgatgcctggaattgcgcaggggatggtgttgccaatgtcagtaccccaaatcactgcatctgaaattggaacaatcccggcaatagagtttgacaaggctgcgatgaaggccatgagaaagatggagaaggaacaaaagaaagctgcaaagaaggccatgaagatgaaaaaggaggaagagaagaggatggccaaactgaattcctgcaagggcgatgacagctcctcgtgctcatcggaatccagcgacagcgaatgcgaaggagaagtcgtcagaatgagccgctgcgccaccatcacggcacctcgaacacctcctgcaaccacagttttccccatcatagtgcctcaaatcccagattccgccgcactgggtgcacagatctcttctgggccaacaactgccattcagtgcactgctaccagcatcgcagttgtcgagaaaccagcgttgaacagaatcgaggtctgcatgggtggcaaatgcaagaagtcaggctcgctcaccgtactgcaggagttcgagaagcaggttggcacgggcggcgcggtggtcggatgcaagtgcttggggaagtgcggggtaggcccgaacgtgcggctgcggagcgaggtcccggaagaaggctccctacagaataagagtaccctctgcattggtgtaggcttggaagatgttggcaccatcgtggcaggcttcttcggagacgacagcgatctgctgggcatgaactgatgatggtcacgtggacagacctggtgcgcatgaactgacgatggtcacgtggacagacctggttgaagatgtattttacaaactttgtcctggtactgcttactgcccaactatagtctatacatctgtagataaccaaaccttgatgagctgttgtattccactgagcctactgtaggatgtaatgtatgttacgtaacgaagagtctggctctccgtgttttcaagttttaagcatct

SEQ ID NO: 4961 - DNA, 2098 bp, Brachypodium distachyon
aaccacggaggcgtgaccaagcatcgcaacgccaccaacgcgccgcaggatttggtagcgggagaggaaggggaaaacgcatccatggagttcaccggcgctgctgccctccggcggtcgctccccgcggcatgcccggcggtgttctcgagggagaggaggaatcgggggatgccgggcagggtctcctgcgtcggccgcggcggaggcgtgggattcgccgacgagggacacctcaggtactacgaggcggcgccgcggaaggcggtggaggcggccgcgagggacctcaccaagctccgggccatgggcctcgtcgctggggacccctccaaggagaagatcctctcggaagctaccgagctgctactgctggaattgaaccagatgaaggatgcggaggacgacctgaagaagagggaaaaagaggagaaagctgctatgaaagcactgaagaagcagcagaaggaagcgaagaaggctgcagctgtgatgacctgtggagatggctcctcggaatcaagtgagagcgagtgtgaggaggagcaatccacggaaatgagctgtgtagccaccaagtcgatgcctggaattgcgcaggggatggtgttgccaatgtcagtaccccaaatcactgcatctgaaattggaacaatcccggcaatagagtttgacaaggctgcgatgaaggccatgagaaagatggagaaggaacaaaagaaagctgcaaagaaggccatgaagatgaaaaaggaggaagagaagaggatggccaaactgaattcctgcaagggcgatgacagctcctcgtgctcatcggaatccagcgacagcgaatgcgaaggagaagtcgtcagaatgagccgctgcgccaccatcacggcacctcgaacacctcctgcaaccacagttttccccatcatagtgcctcaaatcccagattccgccgcactgggtgcacagatctcttctgggccaacaactgccattcagtgcactgctaccagcatcgcagttgtcgagaaaccagcgttgaacagaatcgaggtctgcatgggtggcaaatgcaagaagtcaggctcgctcaccgtactgcaggagttcgagaagcaggttggcacgggcggcgcggtggtcggatgcaagtgcttggggaagtgcggggtaggcccgaacgtgcggctgcggagcgaggtcccggaagaaggctccctacagaataagagtaccctctgcattggtgtaggcttggaagatgttggcaccatcgtggcaggcttcttcggagacgacagcgatctgctgggcatgaactgatgatggtcacgtggacagacctggtgcgcatgaactgacgatggtcacgtggacagacctggttgaagatgtattttacaaactttgtcctggtactgcttactgcccaactatagtctatacatctgtagataaccaaaccttgatgagctgttgtattccactgagcctactgtaggatgtaatgtatgttacgtaacgaagagtctggctctccgtgttttcaagttttaagcatctgctttagactttagcagcaagaatttgaagcattcttgtgggctgaacgagctgctgtttgttgtgtgactgtgtcgcggttgagctacaacacaaaggcatacgtcgtcctgaataaaacagagttcgaagaaaagtaatcctggaggaagctagctggctacaagtaatcttggagtaatctcagagcatacctctgtcagtctctctatacttgattctctacatttctgtatagagattccatataaaagatttccttgtcttatctatagaagaacgctcaaatatcattttttattcatattatatactccttccgatccatattaattgcctcaaatttgtccaaatatggtctaaatacatgtaatattttgacaactaatatgaatcggagggagtaactaaacaataatacattaatggtactaacccatgttcaaaacatcaatcaacattatatttagtaattacaagataggatttgataaaataacgctaaattgcatgtgaatagcattagttatcagtcacacag

SEQ ID NO: 4962 - DNA, 758 bp, Saccharum officinarum
cacgcacgcccaccacagctcctcttccctgccccaaaagcaaggaggtgaaggacaacgcgtcccgccgccgcacaagacgaggaagaggttcccggtcccggcgccgccaccatgtcgtcgttgatgaacgcgctgtccaactggctggtgaacccgcgccgcaacccgctcgcgcgcctccacatgcacgccgtctcctcgcgcctcaggaaatacgggctgaggtacgacgacctgtacgacccctacttcgacctggacatcaaggaggcgctcgggaggcttcctagggaggtggtcgatgcccgcatccagcgcctcaagcgcgccatggacctctccatgaagcaccagtacctccccgagcacctccaggcacagcaggttccattcagaggatatttgagtgacatgttggctctggtgaaaaaggaaaacgccgagcgtgaagcactgggagcccttccactctaccagagaacacttccctaaagcgctggctagacatggtcgcaagtcttctctttacggcaaatcagaatgcatgaaataaaatgcagtggatgaaactgttttttgttttgttttgttccaaccaaagttccattttacttgttcatgcaatggtgcattgaccatgggctgtagctgttgttttcccttctaattaatgggagcaaatttgtcttcaatcattattaacctgtgaaatatattcagctgctggatagctatcgtagtgttctttgatcgtg

SEQ ID NO: 4963 - DNA, 887 bp, Zea mays
cgacaccgcgtccacgtacgcccacgaccgctcctcctcttctctgccccaggccagaatcaagggagggtgaagcaccgccgccgtctccgctgccgcacaaagacgagaggaagaggttcccggcggcgccacgactatgtcgtcgatgatgaacgcgctggcgaactggctggcgaacccgcgccgcaacccgctggcgcgcctccacatgcacgccgtctcctcgcgcctcaggaaatacggactgaggtacgacgacctctacgacccctacttcgatctggacatcaaggaggcgctcggtaggctgcctagggaggtggtcgacgcccgcatccagcgcctcaagcgtgccatggacctctccatgaagcaccagtacctcccggaggacctccaggcacagcaggttccattcagaggatatttgggtgacatgttggcgttggtgaaaaaggaaagcgccgagcgtcagtcactgggagcccttccactataccagaggacacttccctagggtgttggatagacatggtcgcaagtattctacctctttaccgcaaatcagaacgcatcaaataaaatgcagtggatgaaactgttttttttttgttccaaccaaagtctaattttacttgttcatgccatggtgcattaaccatgggctgtagctgttgttttcagcaaatttgtcttcaaccattattaacctgtgaaatcttcgatcgtgagtgccgttatgacaccgggtgaccggaaatgtcttgactaatgtcgctgcccaaatctcccgcatgttatcttagaaaatgcacccattgatttctgaaagatcatgttcacggataggaactttgtactcatgatttaattcaaacttggat

SEQ ID NO: 4964 - DNA, 826 bp, Setaria italica
ggagtcccccgggcccgagatcgagtcccatccatacaccgcctcctctcccataacgcgaggaggcgaaggagtagcggcggaggagtagcgccgccgcgcaagacgaaagagagctcgccgccgcatgtcgtcgatgttgtccgcgctttcgaattggttggtgaacccgcgccgcaacccgctcgcgcgcctccacatgcacgccgtctcctcgcgcctcaggaaatacgggctgaggtacgacgacctgtacgacccgtacttcgacctggacatcaaggaggcgctcgggaggctgcctagggaggtcgtcgacgcccgcatccagcgcctcaaacgctccatggacctctccatgaagcaccagtacctccccgaggacctccaggctgtgcagaccccattcagaggctatttgagtgacatgttggctctggtgaaaaaggagaacgctgagcgtgaagcactgggagcccttccgctttaccagagaaccattccttaaaatggtgcctagacgtgcccacaaggccacattttctctttacgaaacaccaaaatgcatgaaataatatgcagcggatgaaactttttttccttactatcaagttacattttacttgttgatgcaattatgcattgactgtcgcctgtagttctgtttcccctctctaattaatgggaacaaattatgcgttccacccttattaactcgttatgaaatcttcagctgctgagtaactgttatagcgttatgtcgtttgatcttgcatttctgttccatttatgagtacttgtatcatccatttatgcaaaaccctgt

SEQ ID NO: 4965 - DNA, 815 bp, Sorghum bicolor
cgagatcgcgtccacgcaaccacgcactcccaccggtgcgctccgcttcttccctgccccaaaagcgaggaggctgaaggtctgaaggacaaccgcgtcccgccgccgccgcaaaagacgaggaagaggttcccggcgccgaccaccatgtcgtcgatgatgaacgcgctggcgaactggctggtgaacccgcgccgcaacccgctcgcgcgcctccacatgcacgccgtctcctcgcgcctcaggaaatacgggctcaggtacgacgacctgtacgacccctacttcgacgtggaaatcaaggaggcgctcgggaggctgcctagggaggtgatcgacgcccgcatccagcgcctcaagcgcgccatggacctctccatgaagcaccagtacctccccgagcacgtccaggcacagcaggttccattcagaggatatttgagtgacatgttggctctggtgaaaaaggaaaacgccgagcgtgaagcactgggagcccttccactctaccagagaacacttccctaaagtgctgatagacatggtcgcaagtcttctctttacggcaaaatcagaatgcatgaaataaaatgcagtggatgaaactgtttttcttttgttccaaccaaagttccattttacttgttcatgcaatggtgcattgaccatgggctgtagatgttgtttttcccgtctgattaatgggagcaaatttgccttcgactattattaacttgtgaaatcttcagcagctgctgggtagctatcgcagtgttctttgatcgtgaagcttgatttccttccgaccttcccta

SEQ ID NO: 4966 - DNA, 882 bp, Sorghum bicolor
gttgccaaaggccccggcccgagatcgcgtccacgcaaccacgcactcccaccggtgcgctccgcttcttccctgccccaaaagcgaggaggctgaaggtctgaaggacaaccgcgtcccgccgccgccgcaaaagacgaggaagaggttcccggcgccgaccaccatgtcgtcgatgatgaacgcgctggcgaactggctggtgaacccgcgccgcaacccgctcgcgcgcctccacatgcacgccgtctcctcgcgcctcaggaaatacgggctcaggtacgacgacctgtacgacccctacttcgacgtggaaatcaaggaggcgctcgggaggctgcctagggaggtgatcgacgcccgcatccagcgcctcaagcgcgccatggacctctccatgaagcaccagtacctccccgagcacgtccaggcacagcaggttccattcagaggatatttgagtgacatgttggctctggtgaaaaaggaaaacgccgagcgtgaagcactgggagcccttccactctaccagagaacacttccctaaagtgctgatagacatggtcgcaagtcttctctttacggcaaaatcagaatgcatgaaataaaatgcagtggatgaaactgtttttcttttgttccaaccaaagttccattttacttgttcatgcaatggtgcattgaccatgggctgtagatgttgtttttcccgtctgattaatgggagcaaatttgccttcgactattattaacttgtgaaatcttcagcagctgctgggtagctatcgcagtgttctttgatcgtgaagcttgatttccttccgaccttccctatacagcctgtcttgtcccagccatacaggtccacgtacgggcgtgaat

SEQ ID NO: 4967 - DNA, 754 bp, Panicum virgatum
gagaccgcgtacgcacccacgcctaccgccgcctcctctccttctcccacaaaagcgaggaggcgaaggggaagcgcatcccgccgccgcgcaggacgaaggagacctccgccaccatgtcgtcgatgatgtccgcgctgtccaactggctggtgaacccgcgccgcaacccgctcgcgcgcatccacatgcacgccgtttcctcgcgcctcaggaaatacgggctgaggtacgacgacctgtacgacccgtacttcgacctggacatcaaggaggcgctcgggaggctgcctagggaggtggtcgacgcccgcatccagcgcctcaagcgcgccatggacctctccatgaagcaccagtacctccccgaggacctccaggctgcacaaactccattcagaggctatttgagtgacatgttggctctggtaaaaaaggagagtgctgagcgtgaagcgctgggagcccttccgctttaccagagaaccattccttaaaaagtgctgcctagaagctctctcaattttttcgctttacggcacactgaaatgcatgaaataatatgcagtggatgaaactgtttttccttcatatcaagttccattttacttgttgacatgcttgtagttctgcttccaccctctaagtaatgggaacaaattatgtgttcaacccttattaacttctatgaaagtcttcagcagctgggtaactgttgtagcgtaatgttatttgatcttttgcctttttgtcc

SEQ ID NO: 4968 - DNA, 911 bp, Panicum virgatum
cctcggcccgagaccgcgtccccacccacgcccacaaccgctcctcctctcccacaaaagcgaggaggcgaaggggggagcgcatcccgccgccgcgcaggacgaaggagacctcccggtcgccgccgccatgtcgtcgatgatgtccgtgctgtcgaactggctggtgaacccgcgccgcaacccgctcgcccgcctccacatgcacgccgtctcctcgcgcctcaggaaatacgggctgaggtacgacgacctgtacgacccgtacttcgacctggacatcaaagaggcgctcgggaggctgcctagggaggtggtcgacgcccgtatccagcgcctcaagcgcgccatggacctctccatgaagcatcagtacctccccgaggacctccaggctgcgcaaactccattcagaggctatttgagtgacatgttggctctggtgaaaaaggagagtgctgagcgtgaagctctgggagcccttcccctgtatcagagaaccattccttaaaaaagtgctgcctagaagctctctcaatttttctctttacggcacaccgaaatgcatgaaataatatgcagtggatgaaactgtttttccttcctatcaagttccattttacttgttgatgcgcttgtagttctgcttccactctaattgatgggaaaaaattatgtgttcaacccttattaacttgttatggaagtcttcagcagctggttaaactgttatagcgttatgttatttgaacttgcctttttgtcctttttgggtatttgtatcatacatttatgcaccgcgttgtttgctgtaagccccgtgccgcgctgtggccagctgacattattgtgttgtactcgcactccaatggctgatccaaatttcattttgcccgggatttttttccccc

SEQ ID NO: 4969 - DNA, 638 bp, Cenchrus ciliaris
ctcccccggcgccgccgccatgtcgtcgatgatgtccgcgatatcgaactggctggtgaacccgcgccgcaacccgctcgcgcgcctccacatgcacgccgtctcctcgcgcctcaggaaatacgggctgaggtacgatgacttgtacgacccgtacttcgacctggacatcaaggaggcgctcgggaggctgcctagggaggtcgtcgacgcccgcatccagcgcctcaagcgctccatggacctctccatgaagcaccagtacctccccgaggacctccaggctgtgcagaccccattcagaagctatttgagtgacatgttggctctagtgaaaaaggagaacgctgagcgtgaagcactgggagcccttccgctttaccagagaaccattccttaaaatgcttcctggaggtgcccgcaaggccacaagttttctctttacgaaacacctaatgcatgaaataatatgcagtggatgaaactgtttttccttactgtcaagttacattttacttgttgatgcaattatgcattgagcgccccctgtagttctgtttcccctctctaattaatgggaacaaattatgtgtaacttgctatggaatcttcagctcctgagtgctgttatagcttta

SEQ ID NO: 4970 - DNA, 802 bp, Pennisetum glaucum
acacccacacgccccaccgcgtacacaaaagcgaggaggcgaaggagaagcgcatcccgccgccgcgcaggacgaaaggagagtccccccggcgccgccgccgccatgtcgtcgatgatgtccgcgctgtcgaactggttggtgaacccgcgccgcaacccgctcgcgcgcatccacatgcacgccgtctccgcgcgcctcaggaaatacgggctaaggtacgacgacctgtatgacccgtacttcgacctggacatcaaggaggcgctcgggaggctgcctagggaggtcgtcgacgcccgcatccagcgcctcaagcgttccatggacctctccatgaagcatcagtacctccccgaggacctccaggctgtgcagaccccattcagaagctatttgagtgacatgttggctctggtgaaaaaggagaacgctgagcgtgaagctctgggagcccttccactttaccagagaaccattccttaaattgcttcctggaggtgcccacaaggccacaagttttttctttacgaaacaccaaaatgcatgaaataatatgcagtggatgaaactgtttttccttactatcaagttacattttacttgatgctattatgcattgagcgtcgcctgtagttctgtttatcctctctaattaatgggaacaaattatgtgttccacccttattaacttgttatgaaatcttcagctgctgagtactcttatagcgttctgtcgtttgatcttgcccatcagatccatttctgtgtacctgtatcatccatttatgcaaaatcctgt

SEQ ID NO: 4971 - DNA, 1952 bp, Oryza sativa
gcagtgtccaagtgtgagcttcttgtggttggattgccatttggccattgcctctggatctgcctctgcaacattgagaataatgctttccaatttccatgtagtagtagtagcagcatgtagtgtgtatgagccaactgcaaaaacaaaaaagaaaaagaaaaatggcgccaagattaaccgccaaacggcctgcttccctctcctctcgcggcagaaacgcagttcttcagctatggtgtggatcagagaaatggaggattctgcagagccatcgccgcctccccggcggcgtccggtgcagctccggctcgccggacagcggcggcggcggcgccccgccgctcgtcagggcggcggtcagcgccgtcaccgagctactcagggtcctgactcccaagaaccccagagttgttgatgatgatcttcagaagggagatgaaggaggaggaggagcagagttggattcgccgcgcagcgtggatgatgtgattgctgttcttgaagccgattaccagcgagcatatttcctcactgggaactttactccggacatatataccgaagattgcttgtttgaggacccgacaataaagttccgaggaaggtctagatattcccagaacctagatctgcttgtaccgttcttcgacagcccttcacttgagcttgaaaacattgaaaaggggttgagggttgaaacaaagttcatcatggcaacatggacactaaggacatatttaaggcttccatggagacccctcatcgccatcagagggaatacaacatatgatttggatgaagaatacaaggtcactagacatgctgagagctgggatgtctctgcattggaggcgattgggcagatattcgtgccggctccgaaacaaacagatgacatctaattaaccagctaaagcaacacagagcactagtatacatgaatatgatgctggtgctttgccacgtagtgcttctcaaccgcaatgcataactgtacatttcctttttgtgattacacacaagtgggcgaaaaaaaaaagacacctcgcaagaaaaaagaagctactaaaagatacacctaagatgggccggcccatcggcccatcaccgtcgaatgttccacaagcttcgcggcccaaccccaaccacccaaagccaagcaaccgtacggtctcctctctcgtcaaaccaaacccaagcaaagcacccgccacatcggagaagagagagagagagagagagcgtggaagcttctggaaggttctcgaagatgctgtcctccctgtcggcgtggctggtgaacccgcggcggaacccgctggcccgcctccacatgaacgccgtcgcctcccgcctccgcaaatacgggctccggtacgacgacctgtacgacccctaccacgacctcgacatcaaggaggccctggcgcggctgccgcgggaggtggtggacgcccgcaaccagcgcctcaagcgcgccatggacctctccatgaagcaccagtacctccccgccgatgcccaggcgaagcagacaccgttcagaggctatttatctgatatgctagcactggtgaaaaaggagagcgcagagcgcgaagcattgggagcactccccctgtaccagaggaccatcccatgaagcgtctacttcgtaggcctgtttctaattttcttgatgtatgaaagtgaattcaataaaacgcagtggacgattatgtaccatgtattatgctaaaatccttgttgtgtaatgtgttatgtgtatgcttattatgtgaagatacccaccgtcagttctccatagataccttttggtatgacaactgacatatggtgtatgttttgtaatcaatttaaaactctatatagcttcacttggagctgagtaggtaagaaagttttcattgtcgcacagaccctctgagccgtattttcctgttttacta

SEQ ID NO: 4972 - DNA, 1791 bp, Oryza sativa
gtatgagccaactgcaaaaacaaaaaagaaaaagaaaaatggcgccaagattaaccgccaaacggcctgcttccctctcctctcgcggcagaaacgcagttcttcagctatggtgtggatcagagaaatggaggattctgcagagccatcgccgcctccccggcggcgtccggtgcagctccggctcgccggacagcggcggcggcggcgccccgccgctcgtcagggcggcggtcagcgccgtcaccgagctactcagggtcctgactcccaagaaccccagagttgttgatgatgatcttcagaagggagatgaaggaggaggaggagcagagttggattcgccgcgcagcgtggatgatgtgattgctgttcttgaagccgattaccagcgagcatatttcctcactgggaactttactccggacatatataccgaagattgcttgtttgaggacccgacaataaagttccgaggaaggtctagatattcccagaacctagatctgcttgtaccgttcttcgacagcccttcacttgagcttgaaaacattgaaaaggggttgagggttgaaacaaagttcatcatggcaacatggacactaaggacatatttaaggcttccatggagacccctcatcgccatcagagggaatacaacatatgatttggatgaagaatacaaggtcactagacatgctgagagctgggatgtctctgcattggaggcgattgggcagatattcgtgccggctccgaaacaaacagatgacatctaattaaccagctaaagcaacacagagcactagtatacatgaatatgatgctggtgctttgccacgtagtgcttctcaaccgcaatgcataactgtacatttcctttttgtgattacacacaagtgggcgaaaaaaaaaagacacctcgcaagaaaaaagaagctactaaaagatacacctaagatgggccggcccatcggcccatcaccgtcgaatgttccacaagcttcgcggcccaaccccaaccacccaaagccaagcaaccgtacggtctcctctctcgtcaaaccaaacccaagcaaagcacccgccacatcggagaagagagagagagagagagagcgtggaagcttctggaaggttctcgaagatgctgtcctccctgtcggcgtggctggtgaacccgcggcggaacccgctggcccgcctccacatgaacgccgtcgcctcccgcctccgcaaatacgggctccggtacgacgacctgtacgacccctaccacgacctcgacatcaaggaggccctggcgcggctgccgcgggaggtggtggacgcccgcaaccagcgcctcaagcgcgccatggacctctccatgaagcaccagtacctccccgccgatgcccaggcgaagcagacaccgttcagaggctatttatctgatatgctagcactggtgaaaaaggagagcgcagagcgcgaagcattgggagcactccccctgtaccagaggaccatcccatgaagcgtctacttcgtaggcctgtttctaattttcttgatgtatgaaagtgaattcaataaaacgcagtggacgattatgtaccatgtattatgctaaaatccttgttgtgtaatgtgttatgtgtatgcttattatgtgaagatacccaccgtcagttctccatagataccttttggtatgacaactgacatatggtgtatgttttgtaatcaatttaaaactctatatagcttcacttggagctgagtaggtaagaaagttttcattgtcgc

SEQ ID NO: 4973 - DNA, 837 bp, Panicum virgatum
aacttaccgaaatgggccggcccatccatcttgtgccgcccatcctcgtcacccccggaagcttctccggccttctcggaccacacaaaactccaccaacccaagcaccaggacaccgtgtggtgacgaagacggtgggaagccaaagctctctggaactactccggcgatcatcggaagcacacgcacgaggccgcgggaccttccggaaccttcgcgaggatgctcaccaggttctcggcgtggttcgtgaacccgcgccggaacccgctggcgcgcctccaccggaacgccgtcgcctcccgcctccgcaaatacgggctccggtacgacgacctgtacgacccgtaccacgacctggacatcaaggaggcgctggcgcgcctgccgcgggaggtggtggacgcgcgcaaccagcgcctgaagcgggccatggacctctccatgaagcaccagtacctccccgacgacctccaggcaatacagacgccgttcagaagctacctttctgacatgcttgctcttgtgaaaaaggagaatgcagagcgtgaagctctgggagcacttcccctgtaccagagaaccatcccataatgtgctttcttcattatgatctaacaatgatcgcaataaaatacagcgatggtgctatagtgtgtattatgtttaatcaaagacactgccagcccaaatcccactgtgtcagcgcaatgtaatagttgacggagcctttgtatagttgcgaagtcctgaacgattcagtgcgttttgtgaactggaatattgtttctgaagtccgctcggtgctaccgctgcggagtatagttttgtgtcgat

SEQ ID NO: 4974 - DNA, 854 bp, Brachypodium distachyon
tttctatttctgaagcgcccctctccatcgccggcccaagacggaaacaacaacctccgccccctcttcttctcgcacacaaacacgaatcaaaaggcaaagagaagaagacgaccgggatcgcccatcgacgccgccgccgccgcccacgatgtcgtcgatgctgtccgcgttctcgcagtggttcgtgaacccgcgccgcaacccgctcgcgcgcctccacaagtacaccgtcgcctcccgcctcacgaaattcgggctgcggtacgacgatctgtacgacccgtactttgagctggacatcaaggaggcgctcgggaggctgcccagggaggttgtcgacgcccgccaccagcgcctcaagcgcgccatggacctctccatgaagcaccagtacctccccgacgacctccaggcactgcagacaccattcagaagctatttgactgacatgctagctctggtgaaaaaggaggcagcggagcgtgaagcactgggagccctccccctttacgagagaactcttccatgaagccttttttttttgtgctcgacagaggtcgctattttttttacattaatcgtcacatcacaatgcatgaaataaaatgctgtggatgatacagttcctgttccataccgaaagctctgtttttcaatgttcaatattcaggattggccctcacctgtaggcgttctggcttttccatgctattttctttacctttcggtagcaacctttctattccatgatcctgacattgttatgaggcccaaaacacttgtgctttaaccaggcaaccagctgtattccttgtttctgccatgttatccatcattatacatgtttacat

SEQ ID NO: 4975 - DNA, 894 bp, Brachypodium distachyon
tttctatttctgaagcgcccctctccatcgccggcccaagacggaaacaacaacctccgccccctcttcttctcgcacacaaacacgaatcaaaaggcaaagagaagaagacgaccgggatcgcccatcgacgccgccgccgccgcccacgatgtcgtcgatgctgtccgcgttctcgcagtggttcgtgaacccgcgccgcaacccgctcgcgcgcctccacaagtacaccgtcgcctcccgcctcacgaaattcgggctgcggtacgacgatctgtacgacccgtactttgagctggacatcaaggaggcgctcgggaggctgcccagggaggttgtcgacgcccgccaccagcgcctcaagcgcgccatggacctctccatgaagcaccagtacctccccgacgacctccaggcactgcagacaccattcagaagctatttgactgacatgctagctctggtgaaaaaggaggcagcggagcgtgaagcactgggagccctccccctttacgagagaactcttccatgaagccttttttttttgtgctcgacagaggtcgctattttttttacattaatcgtcacatcacaatgcatgaaataaaatgctgtggatgatacagttcctgttccataccgaaagctctgtttttcaatgttcaatattcaggattggccctcacctgtaggcgttctggcttttccatgctattttctttacctttcggtagcaacctttctattccatgatcctgacattgttatgaggcccaaaacacttgtgctttaaccaggcaaccagctgtattccttgtttctgccatgttatccatcattatacatgtttacatgctactgctaggtagttgcgttgtgttcaagcgttggtcc

SEQ ID NO: 4976 - DNA, 867 bp, Eragrostis curvula
  misc_feature (865)..(867): n is a, c, g, or t
agacaattccattctccaaaagcgaggagacgaggaagaagctgcatcccgccgccgtgcaggaagaggaggatccccggcgccgccagccaccatgtcgtcgatgttgtccgcgttctcgcagtggttcgtgaacccgcgccgcaacccgctcgcgcgcatccacatgcaaaccatctcctcgcgcctcaggaaatacgggctgaggtacgacgacctgtacgacccctactttgacctgcacatcaaggaggcgctcgggaggctacccacggaggtggtcgacgcccgcatccagcgcctcaagcgcgccatggacctctccatgaagcaccagtacctccccgagaacgtccaggcaattcagacaccattcaagagctatttgagtgatatgttggctctggtgcaaaaggaggctgcagaacgtgaagcgctgggagcccttccgctttaccagagaaccatcccataaggcgttatcttgagatgctcgtgatttttctcttcatgacacttcagaatgcatgcaataaaaatgcagaggatgatactgtttctttcttgttgaaattccatttcccttctaattaatggaaacaagctgtatgttcaacctttattaacttgttatatgaagttgaagttgttctgcaaaaaaaaaaaaaaaatgaataaaagtactctgagtagatacaactgattaatcgaatcccgagggccgaatggcggacgggaagatgaaaagtaggaccaataagacgataagtgagtgtataaaagtacgtggcggaaataaaaggatgaattgaaataagtgaggtaacagatagacattgaaagatacgaatggaagatgggaatnnn

SEQ ID NO: 4977 - DNA, 567 bp, Saccharum officinarum
gtgacgaggccgcgaacctcccagaagcttcgtcgaagatgctctccaagctgtcggcgtggttcgtgaacccgcggcggaacccgctcgcgcgcctccaccggaacgccgtcgcctcccgcctccgcaaatacgggctccggtacgacgacctctacgacccgtaccatgacctggacatcaaggaggcgctggcgcggctgccgcgggaggtggtggacgcccgcaaccagcgcctcaagcgggccatggacctctccatgaagcacaagtacctacccgacgacctccaggctatacagacgccattcaggagctacctttctgacatgcttgctcttgtgaaaaaggagagtgcagagcgtgaagcattgggagctcttcctctgtaccagagaaccatcccataaagcgcctccttgcgtgatccaacagtgcacgtgatgaaatgtagaggctgatactgtaatgtgtattatttttttcgaggaaatactatgtatattgttcagcagggaaaaaaccatactatgttttacagacattttggtatagaaggttatgcac

SEQ ID NO: 4978 - DNA, 422 bp, Triticum aestivum
cggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattatagcgtgaagaactgggagcccttccccttcaccagaggacccttccctgaagtcttatcttgatag

SEQ ID NO: 4979 - DNA, 653 bp, Zea mays
ctcaaaactacctaaaccaagcacaagcaccaaacactcaaacagacaggaagcccgccgaacatcacaaggctgcgaacctcctagaagctcgaggagatgctctccaagctgtcggcgtggttcgtgaacccgcggaggaatccgctcgcgcgtctccaccggaacgccgtcgcctcccgcctccgcaaatacgggctcaggtatgacgacctctacgacccgtaccacgacctagacatcaaggaggcgctggcgcggctgccgcgggaggtggtggacgcccgtaaccagcgcctcaagcgggccatggacctctccatgaagcaccagtacctacccgacgacgtccaggctatacagacgccattcaggagctacctttttgacatgcttgctcttgtgaaaaaggagagcgcagagcgtgaagcattgggagcgcttccactctaccagagaaccatcccataaagtgcctctttgcatgatccaatcaatagtgcacgcgatgatcagcagaggctgatactgtaatgtgtattgtgttttttcgaggaaatctctactacttattaagacgataagggtagcctgccgttctgacgttatacaaacttagtcatatgttcttgtgcgatctaagctatccgatc

SEQ ID NO: 4980 - DNA, 775 bp, Panicum virgatum
ctctggaactactccggcgagcatcggaagcacacgcacgaggccgcggaaccttccggaaccttcgctaggatgctctccaggttctcggcgtggttcgtgaacccgcgccggaacccgctggcgcgcctccaccggaacgccgtcgccgcccgcctccgcaaatacgggctccggtacgacgacctgtacgacccgtaccacgacctggacatcaaggaggcgctggcgcggctgccgcgggaggtggtggacgcccgcaaccagcgcctgaagcgggccatggacctctccatgaagcaccagtacctccccgacgacgtccaggcaatacaggtgccattcagaagctacctttctgacatgcttgctcttgtgaaaaaggagaaagcagagcgtgaagctctgggagcacttcccctgtaccagagaaccatcccataatgtgctttcttcattatgatctaacaatgagtggcaataagatacagcagatgatactatagtgtgcattatgtgtaatcaaagacattgccagcccaattcccactgtcttagcgcaatgtaatgattgatggagccatgtatatttgtgaacgcttcaacattcagtgcgttttgtgaactggaatatattgttactgaagtccgctcggtgctaccgttgcggagtatagttttgtgtcgattatttgcagattaattcaatgactgaattgtacatgagcagatcataacatcttgtgactcacaacagtgtagtttgtaagggagc

SEQ ID NO: 4981 - DNA, 718 bp, Pennisetum glaucum
ctcccctgccggtggcgacggtgggaagccaaaactcgctggaactccggcgaacacaaacacatcgggagaagcacacacgactacacgaggccgcggaaccttctggaagcttcgcgaggatgctctccaagctctcggcgtggttcgtgaacccgcgccggaacccgctggcccgcgcccaccggaacgccgtcgccgcccgcctccgcaagtacgggctccggtacgacgacctgtacgacccgtaccatgacctggacatcaaggaggcgctggcgcggctgccgcgagaggtggtggacgcccgcaaccagcgcctgaagcgggccatggacctctccatgaagcaccagtacctccccgacgacgtccaggcaattcagacaccattcagaagctacctttctgacatgcttgctcttgtgaaaaaggagaaagcagagcgtgaagcactaggagcacttcccctgtaccagagaaccatcccataaaacagctttccttgttatgatctgacagtaaacgcaataaaatgcagcagctgatacagtaatatgtcgaatgtataatcgcagacaatgccaaccaattccattgttgtattggtgtcttgtatatgtacgatcacttgaatgaactggaatggtgttcctgaagtccactcggtactactactgtcgaataaagttttgtgtccattattttgcaaaaaaaa

SEQ ID NO: 4982 - DNA, 751 bp, Avena sativa
ccaacggggagaccgaaggggatcgccgccgccgtcgccgcgccaccgcccacgatgacgtcgatgctgtccgcgttctcgcagtggttcgtgaacccgcgccgcaacccgctcgcccgcatccacatgctcaccgtgtcctcccgcctcaggaaagtcggtctgaggtacgacgatctgtacgacccgtacttcgatctggacatcaaggaggcgctcgcgaggctgccccaggaggtcgtcgacgcccgcatccagcgcctcaagcgcgccatggacctctccatgaagcaccaatacctcaccgacgagctccaggcactgcagacaccattcaaaagctatctgagtgacatgctggctctggtgaaaaaggaggcagcagagcgtaaagcactgggagcgcttcccatctacgagagaacacttccttgaagtctttcctcttgatatactcgtcgcagttttttgctcctcggcgcatcacgatgcatgaaataaaatgcagttgatgacactgttccccctttcagtttcatgttgatgtggtggtgtattgtcgatcacctgtagctgttcctcgtgcccattcccaaattaattaatggcgacggaaactctgttccatgatctctgtcgttgatatgaagttttcttttgaggaatatatgattcttggcaactctttactcctgggccttttcctggaagcagtcttgttttattattatttatgctacccatttctacc

SEQ ID NO: 4983 - DNA, 683 bp, Avena sativa
gccacgccaccgcccacgatgacgtcgatgctgtccgcgttctcgcagtggttcgtgaacccgcgccgcaacccgctcgcccgcatccacatgctcaccgtctcctcccgcctcaggaaattcggtctgaggtacgacgatctgtacgacccgtacttcgatctggacatcaaggaggcgctcgcgaggctgccccaggaggttgtcgacgcccgcatccagcgcctcaagcgcgccatggacctctccatgaagcaccagtacctcaccgacgaactccaggcactgcagacaccattcaaaagctatctgagtgacatgctggctctggtgaaaaaggaggcagcagagcgtaaagcactgggagcgcttcccatctacgagagaacacttccttgaagtctttcctcttgatatacccgtcccagtttttcctcctcgtcgaatcatgatgcatgaaataaaatgcagttgatgacactgtttctcctttcagtttcatgttgatgtgatggtttattgtccatcacctgtagctgttcctcgtgccccttcccacattaattaatggcgacggaaactctgttaaatgatctttgtcgttgatatgaagttttcttttgagggaattgctgatataaaagtcctggcgactctttactcctttacaaaaaaaaaaaaaa

SEQ ID NO: 4984 - DNA, 1054 bp, Hordeum vulgare
ctggcccaagagggaaaccacaaccacccccacctcccctcctcccctccccaaatcacaaacaccgaagaagagaggagacgaaaggggatcgccgccgccgccgtcgccgaagatgacgtcgatgctgtctgcgttctcgcagtggttcgtgaacccgcgccgcaacccgctggcccgcatccacatgctcaccatctccaaccgcctcaagaactacggcctgaggtacgacgacctgtacgacccctacttcgatctggacatcaaggaggcgctcaccaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcggaaagcactgggagcccttcccctctacgagagaacccttccttgaagacattttacttgatatgcgccactgtttttgctcctcgtagcatcacaatgcatgaaataaaatgcagatcatgacactgttcctccttccggtttcatgtccattgcctgtagcagtttcctaattaatcgcgatggaatttctgttgctgttgctgatataaaagtattttttggttgatggaattgttggtataaaagtcttcaacaattccgtactcttgggcattgagaaactgattgttgttttctcttgggttcacgttatccatttctatgtacagagctgtggtgctatgttctgaaatgcttgcccagcgggtggatgagctctaatgttcatactacacctatcctgttacccgtcttcccaaccccactcgtcatgttctgaatgcggattatgtggaatgcagattatgtgggatttcttctcgtgcatgagatgatgagaatatgctgcagtttcatctccatcgtcgtgcttaacttttcacgcattttcttccttcatgattataacctagtttgtttttggtatagatgggatttttat

SEQ ID NO: 4985 - DNA, 744 bp, Hordeum vulgare
cctcctcccctccccaaatcacaaacaccgaagaagagaggagacgaaaggggatcgccgccgccgccgtcgccgaagatgacgtcgatgctgtctgcgttctcgcagtggttcgtgaacccgcgccgcaacccgctggcccgcatccacatgctcaccatctccaaccgcctcaagaactacggcctgaggtacgacgacctgtacgacccctacttcgatctggacatcaaggaggcgctcaccaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcggaaagcactgggagcccttcccctctacgagagaacccttccttgaagacattttacttgatatgcgccactgtttttgctcctcgtagcatcacaatgcatgaaataaaatgcagatcatgacactgttcctccttccggtttcatgtccattgcctgtagcagtttcctaattaatcgcgatggaatttctgttgctgttgctgatataaaagtattttttggttgatggaattgttggtataaaagtcttcaacaattccgtactcttgggcattgagaaactgattgttgttttctcttgggttcacgttatccatttctatgtaca

SEQ ID NO: 4986 - DNA, 1157 bp, Triticum aestivum
ccaaatcacaaacgccgaagaagagaggagacgaaaggggatcgccgccgccgccgccgccaccgcccaggatgacgtcgatgctgtccgcgttctcgtcgtggttcgtgaacccgcgccgcaacccgctggcccgcatccacatgctcaccatctccaaccgcctcaagaacttcggcctgaggtacgacgatctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcgtaaagcactgggagcccttcccctctacgagagaacccttccttgaagacttcttttcatgatatgcgccacagtttttgctcctcgtagcatcataatgcatgaaataaaatgcagattatgacactattcctacttccggtttcatgtccattgcctgtagcagtttctcgtgcccattcccaaattaattgcgacagaatttctgttgctgttgctgatataaaagtttattttggttgacggaattgttgctgtagaagtctgaacaactctctgctcttgggacttttccgttgagcaactgttttgttgtttgcttctgggtttacgcttcccatttctacagagctatggtgctagtgatctgctatgtgctgtgaattgttcttctgagcttgcatagagatgtttctctctcaaagttctacagacgtgttaaccaacaagttgtcctagtaagaacttgaaagaaaatccaaatatgggaatcaccctgttgcagtacgttatgttggttccctcatttgtttttccacggatgttctttcatctcttgaaggaagccgtgctcttctgcatggccaatgcttgttctttacgtcttctacgactgatgtgctttccctattcaggatcatgcactcatcaacatgtagtgtgtgttgaaatagaactctgagagagagaaccgagagatgtaaatgaatcaactgtgtctctttattgatgatgatgttataatatactt

SEQ ID NO: 4987 - DNA, 892 bp, Brachypodium distachyon
cggggacacgtggatagcccgcgaccgggccgacgcggggcgcgcgaccagcgcagttcatctctgccttctccgattcctcgaaaaaaataaatccaaaacagatatatcccctcactctcgcgacccaaaccaaagatcacgccgaggaacgaagccgcggccggggaggcttctggaaccctctctcgaagatgctgtcgtcgctgtcggcgtggttcgtgaacccgcggcggaacccgctcgcccgcctccacatgaagaccgtcgcctatcgcctcagcaactacggtctgcggtacgacgacctctacgacccgtacaacgacctggacatcaaggaggcgctggcgcggctgccgcgggaggtggtggacgcccgcaaccagcgcctcaagcgcgccatggacctctccatgaagcatcagtacctccccgacgacgtaaaggcattacagacacctttcaggagctatctagctgatatgctggctctggtgaaaaaggagagagcagagcgtgaagcgctgggagcacttcctctctacgagagaacccttccatgatgtccctactttgtagtggcagttttattttccttgtatatcacacagtgcatgcaatgaaatgcagttatgatactgtaccatgtattatgctaaacacagtaatgttgtatcttgttgtgatgcccagcagaaggtgtccaccatatgttatcctgctgatacttgccgttctaatgacttagatataaaactccaaacagctgtgggtataagctgtggttcagttgaacaagtttgtcattgatgcccctccctaaagttatatactgtttccctgcctcttatgaattaatctgatggccaataaagctttctaatggttt

SEQ ID NO: 4988 - DNA, 903 bp, Brachypodium distachyon
gcggggacacgtggatagcccgcgaccgggccgacgcggggcgcgcgaccagcgcagttcatctctgccttctccgattcctcgaaaaaaataaatccaaaacagatatatcccctcactctcgcgacccaaaccaaagatcacgccgaggaacgaagccgcggccggggaggcttctggaaccctctctcgaagatgctgtcgtcgctgtcggcgtggttcgtgaacccgcggcggaacccgctcgcccgcctccacatgaagaccgtcgcctatcgcctcagcaactacggtctgcggtacgacgacctctacgacccgtacaacgacctggacatcaaggaggcgctggcgcggctgccgcgggaggtggtggacgcccgcaaccagcgcctcaagcgcgccatggacctctccatgaagcatcagtacctccccgacgacgtaaaggcattacagacacctttcaggagctatctagctgatatgctggctctggtgaaaaaggagagagcagagcgtgaagcgctgggagcacttcctctctacgagagaacccttccatgatgtccctactttgtagtggcagttttattttccttgtatatcacacagtgcatgcaatgaaatgcagttatgatactgtaccatgtattatgctaaacacagtaatgttgtatcttgttgtgatgcccagcagaaggtgtccaccatatgttatcctgctgatacttgccgttctaatgacttagatataaaactccaaacagctgtgggtataagctgtggttcagttgaacaagtttgtcattgatgcccctccctaaagttatatactgtttccctgcctcttatgaattaatctgatggccaataaagctttctaatggtttattctggata

SEQ ID NO: 4989 - DNA, 766 bp, Setaria italica
gaagcttctccggccttctcggagtagagctccgctacctacccaaacgccagagaggcaggaagagcgccggtggtgacggtgggaagccaaaactctctgcaactccggcgagcatcgaaaccacgcacacgaggccgaggaaccttcgggaaccttcgcgaggatgctctccaagctctcggcgtggttcgtgaacccgcgccggaacccgctggcccgcgcccaccggaacgccgtcgcctcccgcctccgcaaatacgggctccgatacgacgacctgtacgacccgtaccacgacctggacatcaaggaggcgctgtcgcggctgccgcgggaggtggtggacgcccgtaaccagcggctgaagcgggccatggacctctccatgaagcacaagtacctccccgacgaagtccaggcaatacagacgccattcagaagctacctttctgacatgcttgctcttgtgaaaaaggagaaagcagagcgtgaagcacttggagcacttcccctgtaccagagaaccatcccataaaacgctttctttgttacttatgatctaacaatgaacgcaataaaatgcagcagctgatactgtaatatgatactgtagtaaaatgttacggtcgatggagccttgtatatttctgaacgcttgaatgaactgggatatcgttactgaagtccgctcggtgctactgttgagtacagttttgtgtcaattattttcaaattagttgaatgactgaattgtacctgaagc

SEQ ID NO: 4990 - DNA, 679 bp, Lolium multiflorum
ggagaccgaacgggatcgcccgccgccgccgtcgccgtcgccgcacccgcctccgcccacgatgtcgtcgatgctggcctcgttctcgcagtggttcgtgaacccgcgccgcaacccgctcgcgcgcatccacatgctcaccatctcctcccgcctcaagaactacggtctgaggtacgacgatctgtacgacccgtacttcgatctggacatcaaggaggcgctcgccaggctgccccaggaggtcgtcgacgcccgcatccagcgcctcaagcgcgccatggacctctccatgaagcaccagtacctccccgacgacctccaggcactgcaaacaccattcaagagttatttgagtgacatgctggctctggtgaaaaaggaggcagcagagcgtcaagcactgggagcgcttcccatctacgagaggacccttccttgaagtctttcttcttgatatactcgtcgcagttttttctccttggcgcctcacaatgcatgaaataaaatgcagttgttgacactgttcctactttccagtttcatgttgatgtggtggtctattgtgcatcacatgtagctgttcctcatgccccgttccaaattaatgggggcagaatttctgtcacctgatcaatgtcattgaaatcaaagttttattcttttgagggaattgtta

SEQ ID NO: 4991 - DNA, 657 bp, Eragrostis curvula
ggcggggggtctcgagctttcctggaccttctgggagatgctctccaggctgtcggcgtggttcgtgaacccgcgccggaacccgctggcccgtctccaccgggacgccgtcgccgcccgcctccgcaagtacgggctccgctacgatgatctctacgatccgtatcacgacctggacatcagggaggcgctggcgcggctgccgcgggaggttgtggacgcccgcaacgcgcgccttaagcgcgccatggacctctccatgaagcatcagtacctccccgacgacgtccaggcgttgcagacaccgttcagaagctatctttctgacatgttggctcttgtgaaaaaggagagtgcagagcgtgaggccttgggagcacttcccctctaccagagaaccatcccataaacctgcttgtttgatgatctaacaatgcgtccagttcagtggatggtaccacaccatgtattatgataagtccctatttatgttacttatgtggtgaatgttctacaaaaaatgcacgctctactccatagcatgatggaatggtgagtgtaaacttgtattcgaggatagcagaccactttggagtgtttaccaaactgaggtattttattgaagtgatacgtgttctactgagaacatttttatat

SEQ ID NO: 4992 - DNA, 978 bp, Oryza sativa
ctcctccttcgtcggcccatttggcctattacaattcacaaatctggctcatttttccgaatcctccctacgacttgggcccgagactggtctcctctctctttcccccacaaaagcgaggacgcgaaggaggccgccgccgccgcagagaaggaagagagggagagatcgccggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattagagcgtgaagaactgggagcccttccccttcaccagaggacccttccctgaagtcttatcttgataggccctgctgttttttcccaccacaatgcatcaaataaaatgcagtggatgactcatgatactgtctctcattttgaagttccattttcatatatattcgtgtgtgatgcattggtcgtcactgattacttcgcatccttttcaaatatgttaatttaacagcaacaatttttcttttacatcattgtcgtaaattcttcatgtattgtgcttcacatgagaagaatgtctgttgtttgctcagaatggcttttgttttaccacctattgttttgattatgccatggttcttggtcatggttgtttgtgcagagtcgcatttgagcgattattcatgtatattgtgcttcacctgagcaaagaattgctttatgtttacaactac

SEQ ID NO: 4993 - DNA, 910 bp, Oryza sativa
tacgacttgggcccgagactggtctcctctctctttcccccacaaaagcgaggacgcgaaggaggccgccgccgccgcagagaaggaagagagggagagatcgccggatcgccgcccgccgccgccacgatgtcgtcgatgctgtccgcgttctcgcagtggttcgtgaacccgcgccgcaacccgctcgcccgcctccacatgcaggcgatctcctcgcgcctccggaaatacggcctgaggtacgacgatctgtacgacccgaagcatgatctggacatcaaggaggcgctcgagaggcttcccagggaggtggtcgacgcccgccaccagcgcctcaagcgcgccatggacctctccatgaagcaccagtacctctccgaaaacgaccaggcgcaacagacaccattcagaggctatttgagtgacatgatggatctggtgaagaaggagagattagagcgtgaagaactgggagcccttccccttcaccagaggacccttccctgaagtcttatcttgataggccctgctgttttttcccaccacaatgcatcaaataaaatgcagtggatgactcatgatactgtctctcattttgaagttccattttcatatatattcgtgtgtgatgcattggtcgtcactgattacttcgcatccttttcaaatatgttaatttaacagcaacaatttttcttttacatcattgtcgtaaattcttcatgtattgtgcttcacatgagaagaatgtctgttgtttgctcagaatggcttttgttttaccacctattgttttgattatgccatggttcttggtcatggttgtttgtgcagagtcgcatttgagcgattattcatgtatattgtgcttcacctgagcaaagaattgctttatgtttacaactac

SEQ ID NO: 4994 - DNA, 859 bp, Sorghum bicolor
ccccatccccactccccgccgagcaccaaaacagtttggcaggacgcccgccgagcggcgagccgccgaacatcacaagcacacacgagtgacgaggccgccaaccttccagaagcttcgccaaagatgctctccaagctgtcggcgtggttcttgaacccgcgccggaacccgctcgcgcgactccaccggaacgccatcgcttcccgcctccgcaaatacgggctccggtacgacgacctgtacgacccgtaccatgacctggacatcaaggaggcgctggcgcggctgccgcgggaggtggtggacgcacgcaaccagcgactcaagcgcgccatggacctctccatgaagcacaagtacctacccgacgacgtccaggctatacagacgccattcaggagctacctttctgacatgcttgctcttgtgaaaaaggagagcgcagagcgtgaagcattgggagcgcttccactctaccagagaaccatcccataaagcgcctttgcatgatccaacagtgcacgccatggtcagcagcgtcttgtagtataatgtgtattgtttcttttcccaggaaatactatgtactattatgtttggcagcaaaaaataaaaaagacatatgttttactgacattttggtatagaagtctacatggttatgcacaactgttttcgcttcagttgaacaacttgccgttgtcctctcgtagtcctacaacaatatatggtcgatgagatgtatatttgtgtatttacaaaattctggaactgttcggttcacttcgcgaacagatatactgtactgaggtccctcatgtcagatgcactgtgcaatgttttgtgtcagctattg

SEQ ID NO: 4995 - DNA, 1045 bp, Sorghum bicolor
atttgcttaaacttatcagtcaagagtcacacttttctgtgcttaccaaaatgggccggacggcctggcccagtggccctggcccgtcttgtgcccatgcccatcctcctgaagcttctccggccttctccgtccccggaatccccatccccactccccgccgagcaccaaaacagtttggcaggacgcccgccgagcggcgagccgccgaacatcacaagcacacacgagtgacgaggccgccaaccttccagaagcttcgccaaagatgctctccaagctgtcggcgtggttcttgaacccgcgccggaacccgctcgcgcgactccaccggaacgccatcgcttcccgcctccgcaaatacgggctccggtacgacgacctgtacgacccgtaccatgacctggacatcaaggaggcgctggcgcggctgccgcgggaggtggtggacgcacgcaaccagcgactcaagcgcgccatggacctctccatgaagcacaagtacctacccgacgacgtccaggctatacagacgccattcaggagctacctttctgacatgcttgctcttgtgaaaaaggagagcgcagagcgtgaagcattgggagcgcttccactctaccagagaaccatcccataaagcgcctttgcatgatccaacagtgcacgccatggtcagcagcgtcttgtagtataatgtgtattgtttcttttcccaggaaatactatgtactattatgtttggcagcaaaaaataaaaaagacatatgttttactgacattttggtatagaagtctacatggttatgcacaactgttttcgcttcagttgaacaacttgccgttgtcctctcgtagtcctacaacaatatatggtcgatgagatgtatatttgtgtatttacaaaattctggaactgttcggttcacttcgcgaacagatatactgtactgaggtccctcatgtcagatgcactgtgcaatgttttgtgtcagctattgccattgctcatttacatttcaatttgccgggctgcgaattcaga

SEQ ID NO: 4996 - DNA, 825 bp, Triticum aestivum
ccaaatcacaaacgccgaagaagagaggagacgaaaggggatcgccgccgccgccgccgccgaggatgacgtcgatgctgtccgcgttctcgtcgtggttcgtgaacccgcgccgcaacccgctggcccgcatccacatgctcaccatctccaaccgcctcaagaactacggcctgaggtacgacgacctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcgtaaagcactgggagcccttcccctctacgagagaacccttccttgaagacatttttccttgatatgcgccacagcttttgctcctcgtagcatcacaatgcatgaaataaaatgcagattatgacactgttcctccttccggtttcatgtccatggcctgtagctcgtgccccttcccaaattaattgcgacagaatttctgttgctgttgctgatataaaagtttgttttggttgacggaattgttgctatagaagtctgaacaagtctgtgctcttgggccttttccgttgagcaactgtttgttgtttgcttccgggtttacgctgcctatttctacagagctgtggtgctagtgatctgctatgtgctgtgaattgttcttccgagcttgcctagagatgtttctctctcaaagttctaca

SEQ ID NO: 4997 - DNA, 1157 bp, Triticum aestivum
gggatcgccgccgccgccgccgccgccgcccaggatgacgtcgatgctgtccgcgttctcgtcgtggttcgtgaacccgcgccgcaacccgctggcccgcatccacatgctcaccatctccaaccgcctcaagaactacggcctgaggtacgacgacctgtacgacccctacttcgatctggacatcaaggaggcgctcggcaggctgccccgggaggtggtcgacgcccgccaccagcgcctcaagcgcgccatggacctctccatgaagcaccagtacctccccgacgacgtccgggcactgcagacaccattcaaaagctatttgagcgacatgctggctctggtgaaaaaggaggcagcagagcgtaaagcactgggagcccttcccctctacgagagaacccttccttgaagacatcttccttgatatgcgccacagcttttgctcctcgtagcatcacaatgcatgaaataaaatgcagattatgacactgttcctccttccggtttcatgtccatggcctgtagctcgtgccccttcccaaattaattgcgacagaatttctgttgctgttgctgatataaaagtttgttttggttgacggaattgttgctatagaagtctgaacaagtctgtgctcttgggccttttccgttgagcaactgtttgttgtttgcttccgggtttacgctgcctatttctacagagctgtggtgctagtgatctgctatgttccctgaattgttcttctgagcttgcatagagatgtttctctctcaaagttctacagacgtgttaaccaacaagttgtcctagtaagaacttgaaagaaaatccaaatatgggaatcaccctgttgcagtacgttatgttggttccctcatttgtttttccacggatgttctttcatctcttgaaggaagccgtgctcttctgcatggccaatgcttgttctttacgtcttctacgactgatgtgctttccctattcaggatcatgcactcatcaacatgtagtgtgtgttgaaatagaactctgagagagagaaccgagagatgtaaatgaatcaactgtgtctctttattgatgatgatgttataatatacttacaagggacacgaacaaagggtgatcatgcactcatcaacatgta

SEQ ID NO: 4998 - DNA, 828 bp, Lippia dulcis
tcgcagtaacaaacatttttaccgagcaccatatccaaaacaccgcattttttgaagaaagaagaaatctttcgtgaaagaaagttcgagagagagtttcagagttctgtaatggcgtctgctatatccaaatggctcgtagacccaaatcggaaccctttagcaaaactacacatgaaagccgtatcgagtcgcctccggaaatacggtcttcgatatgacgatttgtacgacccaatgaacgatctggatgtgaaggaggcgctgaatcggctgccaagagaggttgtggatgcgaggaatcaacgcctcaagcgcgctctggacctttccatgaagcacgagtatcttccagaggatctccaggctatgcagacaccatttaggagctatcttcaggagatgctggctcttgtcaagagagagaatgctgaacgtgaagcgctcggtgctttgcctctttatcaacgcaccattccttgagtggatctctgttcttctggaactgccttccattgaattacatatgatatgataagggacaatgatgataaagtgtctgaatttagtgccattgttgatatataatgagcagtggactcatactgtttggttatggggtcatatcattaatctgtaatgtttggacggaattttctgagttatgcttggatttggatcacaagctcatgaaacggatataatctattaagtctttagctaaataacgggaaaggaattaagatttaagagagaagtagcgtaataagaaaaaagggtttggaattgtggagagaatattgtcttgattaattgtattgttatcta

SEQ ID NO: 4999 - DNA, 732 bp, Pseudoroegneria spicata
tccccaaatcacaaacaccaaagaagagaggagacgaaagggggtcgccgccgccgccgccgccgtcgcccaggatgacgtcgatgctgtcctcgttctcgcagtggttcgtgaacccgcgccgcaacccgctggcccgcatccacatgctcaccatctccaaccgcctcaagaattacggccttaggtacgacgatctgtacgacccgtacttcgatctggacatcaaggaggcgctcgccaggctgccccgggaggtggtcgacgcccgcaaccagcgcctcaagcgcgccatggacctctccatgaagcaccagtacctccccgacgacatccgggcactgcagacaccattcaaaagctatttgagcgacatgctggctctggtgaaaaaggaggcggcagagcgtaaagcactgggagcccttcccctctacgagagaacccttccttgaagacattttccttgatatgcgccacagtttttgctcctcgtagcatcacaatgcatgaaataaaatgcagattatgacactgttgctccttccggtttcatgtccatggcctgtagctgttcctcgtgcccctttcctaattaatcgcggcggaatttctgttgctgttgctgatataaaagtttattttggttgtcggaattgttgctatagaagtctgaacaactctgcgctcttgggccttttccgttgagcaactgtttgttgtttgctgcta

SEQ ID NO: 5000 - DNA, 1671 bp, Panicum virgatum
agatcccgtcccctttcccattccgcaccgagcaactcaaaaccctcctctcctctcctctcccacccacccacgatggccgccgccgccacatccactgctcactcactcctcctccagcgccccaccgcgccgagggctcccgccgccgccgcttcctccctgcgcctcccggcgcgcgccgccaagatctcctgcgcggcggtggcggcgccgtccgcgtcctcccccctcaccggcgccggggaccggggcgtctacaacttcgcggcgggcccggcgacgctcccgctcagcgtcctcaagcgggcgcaggcggagctcgtcgactaccacggctccgggatgagcatcatggagatgagccaccgcgggaaggagttcgacgccgccatcaagaaggccgaggccgacctgcgcgcgctcctcgcggtgcccgacacccacgccgtgctcttcctccagggcggcgccaccacgcagttcgccgccgtgccgctcaacctctgcgccggcccctccgaccccgccgacttcgtcgtctcggggtcctggagcgacaaggccttcaaggaggccaagaaattctccgccgcctccgtcgcctggtccggcaaggacgccaagtacaccgccctcccgcccttcgacgacatcaagcagaacccggaggccaggttcctccacatctgctccaacgagactatccacggcgtcgagttcaaggactacccggagccccgcaacaagtccggcatcctcgtcgccgacatgtcctccaacttctgctccaagcccgtcgacgtctcccgcttcggcgtcatctacgccggcgcgcagaagaacgtcggcccctcgggggtcaccatcgccatcgtgcgcaaggacctcatcggcaacgcgcagcccatcacccccgtcatgcttgacttcaagacacacgccgacaacgcctcgctctacaacaccccgccctgcttcgccatctacatctgtggcctcgtcttcgaggacctgctcgcgcagggcggccttgcggaggtcgagaagaagaacgcctacaaggctggcatcctgtacgacaccattgatgccagcggcgggtactacatctgtcccgtggagaattcagtgcggtcgctgatgaacgtgcccttcactctggccaaggggccggactttgagaagcaattcatcgccgaggcggccaaggagggcatggtgcagctcaaggggcacaggtcggtcggtggcgtgcgcgcatccatctacaatgctatgccgctcgccggcgtggagaagcttgtcgcgttcatgaaggatttccaagctaggaacctttgattggcttggcttatgatcatttggtattgctaatatttagcaggatgttttgttcttcataacataagtgagctctgtgcaagagttgatttgcgcatttgtgatatgtccgtagtattagtgctgtagtaactattttgcaatgtttcttttcactttttggtgttcatgtgattccattccatggccaccattgttgttggaacttggaatgtgttttgctgggaataagtaataagctagatggtcagttgtctcgagagcaggtgatgctgctgtatgattcagacttctcagagcttataaaacactaataattcatagttt

SEQ ID NO: 5001 - DNA, 1746 bp, Setaria italica
ccccgattctgacgcctccccgcgactccctatagatctccccgtcccctttccccattccgccccaaccagcccgaacccaaaaccctcgtctcctcccctccccacgatggccgccgccgccgccaccacgccgcactccctcctcctccagcgccccacgaccccggccgcgccgagggcctcctccgcctcctccctgcgcctccccgcgcgagccgccaagatctcctgcgcggcggtggcggcgccgtcggcgtcctcccccgtcgccggggccggggaccggggcgtctacaacttcgcggcgggcccggcgacgctcccgctcaacgtcctcgagcgggcgcagcggagctcgtcaactaccacggctccgggatgagcatcatggagatgagccaccgcgggaaggagttcgacgccgccatcaagaaggccgaggccgacctccgcgcgctcctcgccgtgcccgacacccacgccgtgctcttcctccagggcggcgccaccacgcagttcgccgccgtgcccctcaacctctgcgccggccccaccgaccccgccgacttcgtcgtctcgggctcctggagcgacaaggccttcaaggaggccaagaagttctccgccgcctccgtcgcctggtccggcaaggacggcaagtacaccgccctcccgcccttcgacgccatcaagcagaacccggaggcaaggttcctccacatctgctccaacgagaccatccacggcgtcgagttcaaggactacccggtgccgcagaacaagtccggcatcctcgtcgccgacatgtcctccaacttttgctccaagcccgtcgacgtctcccgcttcggcgtcatctacgccggcgcgcagaagaacgtcggcccctcgggcgtcaccatcgccatcgtgcgcaaggacctcatcggcaacgcgcagcccatcacgccggtcatgctcgacttcaagacgcacgccgacaacgcctcgctctacaacaccccgccctgcttcgccatctacatctgcggtctcgtcttcgaggacctgctcgcccagggcggcctcgcggaggtcgagaagaagaacgcccacaaggcgggcatcctgtatgacaccattgacgccagcggcgggtactacatctgcccagtggagaagtcagtgcggtcgctgatgaacgtgcccttcactctggccaaggggccagattttgagaagcaattcatcgctgaggcagccaaggagggcatggttcagctcaagggacacaggtcagttggtggcgtgcgcgcatccatctacaatgccatgccgctcgccggcgtggagaagcttgtcgccttcatgaaggatttccaagctaggaacccttgattggcttgtgcttatgatcatttggtattgctacaatttagcaggatgttttgttcttcataacataagtgagctctttgcaagagctgctttgcgcatttgtgatccgcctgtagtattagtgccgtagtaactattttgcaatatttcttttcactttttggtgctcatgggatttcattaccatggccaccattgttgttggaatgtgttttgctgggaataattaataaggtagatggtcagttgtctcgagagcaggtgatgctgctgtatgattcagacttctcagagcttataaaacactaataattcaaagtctggttggtttttgcctctcaaatgaagcaaattatgctggtttct

SEQ ID NO: 5002 - DNA, 1668 bp, Triticum aestivum
cccacgcgtccgctctccccccttcctccccacgatggccgccgccgccgccgccgccacccccaactccatgctcctccaccgcccgagccccaaggcgggcccctccgcccgcgtcccggcgcgcgccgccaggatccgctgccaggccgtcgcggcgcccgccgccccctcccccctcgccgccgcgggcgagcgcggcgtctacaacttcgcggcgggcccggccacgctccccctctccgtcctccagaaggcgcaggcggagctggtcgactaccgcggctccggcatgagcatcatggagatgagccaccggggcaaggagttcgacgcggccatcaagaaggccgaggcggacctgcgcgcgctcctcgccgtgccggacacccacgaggtgctcttcctgcagggcggcgccaccacccagttcgccgccgcgccgctcaacctctgcgcctcccccgcggaccccgccgacttcgtcgtctccggctcctggagcgacaaggccttcaaggaggcgaaaaagtactcggccgcctccgtcgcctggtccggcaaggccgccaagtacacctccctcccggcggacttcggggccatgtcgcagaaccccgaggcccgcttcctccacatctgctccaacgagaccatccacggcgtcgagttcaaggactacccggagccgaggaacgaggcgggcctcctcgtcgccgacatgtcctccaacttctgctccaagcccgtcgacgtctcccggttcggcctcatctacgccggcgcgcagaagaacgtcggcccgtcgggcgtcaccatcgccatcgtgcgcaaggacctcgtcggcagcgcgcagcccatcacgccggtgatgctcgactacaagacgcacgccgacaacgcctcgctctacaacaccccgccctgcttcgccatctacatctgcgggctggtgttcgaggacctgctcgcgcagggcggcctcgccgaggtggagaagaagaaccagcacaaggccggcatcctgtacgacaccatcgacgccagcggcggctacttcgtctgccccgtggacaagccggtgcggtcgctcatgaacgtgcccttcacgctggccaagggggccgactacgagaagcagttcatcgccgaggcggccaaggagggcatgctgcagctcaaggggcacaggtcggtcggcggcgtgcgcgcctccatctacaacgccatgccgctctccggcgtggagaagctcgtcgccttcatgaaggacttccaagcgaggaacccttgatcggcccgtcgtcgccatggtcctccggtattgctcgctctagtaggatgtcttgttgtttatcatatatcataacataagtaggctgcaagatgttgtgcaccgtcgctcatatgagatttgctatccgtctgtagtattagtatggtaaccattttgcaatgctgctgcatcttccccgcgtttgcgggactcttctccatctgctcgcctttgagattggaacatgttgtattggggaataaaggttggtcgatggtcaattgttttcagattctgattctgctgtatgattgaggggtaaattcaggtttggctgcttttgtgatctgtaagcaagcaagtttgttgatcattgtctcctaaaaaaaaaa

SEQ ID NO: 5003 - DNA, 1890 bp, Sorghum bicolor
ccccgattctgacaagtgacacctccccttccccttccccttccccttcctatagatcccgtcccctttcccatttccgcaccacgcagccggcccaagcccaaaacccttcccttcctctcctcccttcccacgatggccgccgccgccgccaccacgccgcactctctcctcctccagcgcgcggcgagcccggccgcgccgccgagggcgaccgccaccgccacctccctccgtcttccggcccgcgccgccaggatctcatgcgcggcggtggcggcgccgtctccagccgccgcagccgcggcggacgaggcggagcgcggcgtctacaacttcgcggcggggcccgcgacgctgccgctctccgtcctcaagcgggcgcaggcggagctggtggactaccacggctccgggatgagcatcatggagatgagccaccgcgggaaggagttcgacgccgccatcaagaaggccgaggccgacctgcgtgcgctcctcgcggtgcccgacacccacgacgtgctcttcctccagggcggagccaccacgcagttcgccgccgtcccgctcaacctctgcgcggggccctccgaccccgctgacttcgtcgtgtccggctcctggagcgacaaggccttcaaggaggccaagaagttctccgccgcctccgtcgcctggtcgggcaaggacggcaagtacaccgcgctcccgcccttcgacgccatcaagcagaatcccgaggccaggttcctccacatctgctccaacgagactatccacggcgtcgagttcaaggactacccggagccccggaacaagtcgggcatcctcgtcgccgacatgtcctccaacttctgctccaagcccgtcgacgtctcccgcttcggcgtcatctacgccggcgcgcagaagaacgtcgggccctccggcgtcaccatcgccatcgtgcgcaaggacctcatcggcgccgcgcagcccatcacgcccgtcatgcttgacttcaagacgcacgccgacaacgcctctctctacaacaccccgccctgcttcgccatctacatctgcggcctcgtcttcgaggacctgctcgcgcagggcggcctcgccgaggtcgataaaaagaacacgcacaaggccggcatcctctacgacaccatcgacgccagcggcgggtactacatctgccctgtcgacaaatcggtgcggtcgcacatgaacgtgcccttcaccctggcgaaggggccggactttgagaagcagttcatcgcagaggcagccaaggagggcatggtgcagctcaaggggcacaggtcagtcggtggcgtccgtgcttccatctacaatgccatgccactcgccggcgtggagaagcttgtcgccttcatgaaggatttccaagctaggaacccttgagtggcttgtgcttgtgatcatttggtattgatgctctttagcagtatgtttcgttctttcttcacagcataagtgagctctgtgcaggagctgctttgctttgcgcatctgggatctatctgtagtattattagtaatagctactgtattttgcgatgtactttttcacttttattaggtgttcatggaatttcatttctatggatcaccactgtagttggaatgtgttttgctggaaataaggaataaggtggatggtcaattgcctcgcctccatcgagagcaggtggccacgctgctatatcatccagacttgtcatcaatctaaaacactaatctgaaggttgcttggtttttgcctctccaaacaaagcaaacgttgtttgtttcttcttttcgtcttatcttgagagacaaaattgtactggaatttgatgcatctgtgctttagtaagactctgttggaaattcttt

SEQ ID NO: 5004 - DNA, 2135 bp, Sorghum bicolor
ctcaagttggttgcaacttgcaggcagaggcaggcggcagagcatttcatttcactgccgagcgggcccaccaaccaacccatcatcagtaggcagcaccaaccccccgattctgacaagtgacacctccccttccccttccccttccccttcctatagatcccgtcccctttcccatttccgcaccacgcagccggcccaagcccaaaacccttcccttcctctcctcccttcccacgatggccgccgccgccgccaccacgccgcactctctcctcctccagcgcgcggcgagcccggccgcgccgccgagggcgaccgccaccgccacctccctccgtcttccggcccgcgccgccaggatctcatgcgcggcggtggcggcgccgtctccagccgccgcagccgcggcggacgaggcggagcgcggcgtctacaacttcgcggcggggcccgcgacgctgccgctctccgtcctcaagcgggcgcaggcggagctggtggactaccacggctccgggatgagcatcatggagatgagccaccgcgggaaggagttcgacgccgccatcaagaaggccgaggccgacctgcgtgcgctcctcgcggtgcccgacacccacgacgtgctcttcctccagggcggagccaccacgcagttcgccgccgtcccgctcaacctctgcgcggggccctccgaccccgctgacttcgtcgtgtccggctcctggagcgacaaggccttcaaggaggccaagaagttctccgccgcctccgtcgcctggtcgggcaaggacggcaagtacaccgcgctcccgcccttcgacgccatcaagcagaatcccgaggccaggttcctccacatctgctccaacgagactatccacggcgtcgagttcaaggactacccggagccccggaacaagtcgggcatcctcgtcgccgacatgtcctccaacttctgctccaagcccgtcgacgtctcccgcttcggcgtcatctacgccggcgcgcagaagaacgtcgggccctccggcgtcaccatcgccatcgtgcgcaaggacctcatcggcgccgcgcagcccatcacgcccgtcatgcttgacttcaagacgcacgccgacaacgcctctctctacaacaccccgccctgcttcgccatctacatctgcggcctcgtcttcgaggacctgctcgcgcagggcggcctcgccgaggtcgataaaaagaacacgcacaaggccggcatcctctacgacaccatcgacgccagcggcgggtactacatctgccctgtcgacaaatcggtgcggtcgcacatgaacgtgcccttcaccctggcgaaggggccggactttgagaagcagttcatcgcagaggcagccaaggagggcatggtgcagctcaaggggcacaggtcagtcggtggcgtccgtgcttccatctacaatgccatgccactcgccggcgtggagaagcttgtcgccttcatgaaggatttccaagctaggaacccttgagtggcttgtgcttgtgatcatttggtattgatgctctttagcagtatgtttcgttctttcttcacagcataagtgagctctgtgcaggagctgctttgctttgcgcatctgggatctatctgtagtattattagtaatagctactgtattttgcgatgtactttttcacttttattaggtgttcatggaatttcatttctatggatcaccactgtagttggaatgtgttttgctggaaataaggaataaggtggatggtcaattgcctcgcctccatcgagagcaggtggccacgctgctatatcatccagacttgtcatcaatctaaaacactaatctgaaggttgcttggtttttgcctctccaaacaaagcaaacgttgtttgtttcttcttttcgtcttatcttgagagacaaaattgtactggaatttgatgcatctgtgctttagtaagactctgttggaaattctttacatggggtgaatgttactgttgttttcatttcagataggttggtactagtatattcatttgtgaaagaatccatttaatgatttaaggttggtaccggcctaacgggtgagcactctagagtttggtgaggtacttttgc

SEQ ID NO: 5005 - DNA, 1561 bp, Triticum aestivum
tcgccgccgccgccgccgccacccccaactccatgctcctccaccgcccgagccccaaggcgggcccctccgcccgcgtcccggcgcgcgccgccaggatccgctgccaggccgtcgcggcgcccgccgccccctcccccctcgccgccgcgggcgagcgcggcgtctacaacttcgcggcgggcccggccacgctgcccctctccgtcctccagagggcgcaggcggagctggtcgactaccgcggctccggcatgagcatcatggagatgagccaccggggcaaggagttcgacgccgccatcaagaaggccgaggcggacctgcgcgcgctcctcgccgtccccgacacccacgaggtgctcttcctgcagggcggcgccaccacgcagttcgccgccgcgccgctcaacctctgcgcctcccccgcggaccccgccgacttcgtcgtctccggctcctggagcgacaaggccttcaaggaggcgaaaaagtactcggccgcctccgtcgcgtggtccggcaaggccgccaagtacacctccctcccggcggacttcggggccatgtcgcagaaccccgaggcccgcttcctccacatctgctccaacgagaccatccacggcgtcgagttcaaggactacccggagccgaggaacgaggcgggcctcctcgtcgccgacatgtcctccaacttctgctccaagcccgtcgacgtctcccggttcggcctcatctacgccggcgcgcagaagaacgtcggcccgtcgggcgtcaccatcgccatcgtccgcaaggacctcgtcggcagtgcgcagccgatcacgccggtgatgctcgactacaagacccacgccgacaacgcctcgctctacaacaccccgccctgcttcgccatctacatctgcgggctcgtcttcgaggacctgctcgcgcagggcggcctcgccgaggtggagaagaagaaccagcacaaggccggcatcctgtacgacaccatcgacgccagcgccggctacttcgtctgccccgtggacaagccggtgcggtcgctcatgaacgtgccattcacgctggccaagggggccgactctgagaagcagttcatcgccgaggcggccaaggagggcatgctgcagctcaaggggcacaggtcggtcggcggcgtgcgcgcctccatctacaacgccatgccgctctccggcgtggagaagctcgtcgccttcatgaaggacttccaagcgaggaacccttgatcggcccgtcgtcgccatggtcctccggtattgctcgctctagtaggatgggctgttgtttatcatatatcataacataagtaggctgcaagatgtgcaccgtcgctcatatgagatttgctatccacctgtagtattagttatggtaaccatttcgcaatgctgctgcattttcaccgcgtttgcgggactcttctccatttgctcgcttttgagattggaacatgttgtattggggaataaaggtcgattggtgtcttcagattacctgattcttatatatggttgagagtttatatgttaca

SEQ ID NO: 5006 - DNA, 1703 bp, Zea mays
ccccgattctgacacctcctcttcccaacaactcccttcctatagatctcgccgccccctttctccccatttccgcaccacgcccagtcgcccacgcagccggcccaagcccaaaaacctttctccatcctctactctcatccccacgatggccgccgccgccaccacgccgcactccctcctcctccagcgcgccgcgatcccggccgcgccgtcgagggcgtccgccgccgcctctcccgtccgcctcccggtccgcgccgccaggatctcgtgcgcggcggtggcggcgccgtccccggccgcagccgccgcggcggacgaggtggagcgcggcgtctacaacttcgcggcgggtcccgcgacgctccctctctccgtgctcaagcgggcgcaggcggagctggtggactaccacggctccgggatgagcatcatggagatgagccaccgcgggaaggagttcgacgccgccatcaagaaggccgagtccgacctgcgcgcgctcctcgcggtgcccgacacccacgccgtgctcttcctccagggcggcgccaccacgcagttcgccgccgtcccgctcaacctctgcacggggccctccgacccggccgacttcgtcgtgtccggatcctggagcgacaaggccttcaaggaggccaagaagttctccgccgcctccgtcgcctggtcgggtaaagacggcaagtacacggccctcccgccgttcgacgccatcgcccagaaccccgaggccaggttcctccacatctgctccaacgagaccatccacggcgtcgagttcaaggactacccggagccccgcaacaggtcgggcatcctcgtcgccgacatgtcctccaacttctgctccaagcccgtcgacgtctcccgcttcggcgtcatctacgccggcgcacagaagaacgtcgggccctccggcgtcaccatcgccatcgtgcgcaaggacctcatcggcgccgctcagcccatcacgcccgtcatgctcgacttcaagacgcacgccgacaacgcctccctctacaacaccccgccctgcttcgccatctacgtctgcggtctcgtcttcgaggacctgctcgcgcagggcggcctcgccgaggtcgagaagaagaacgcgcgcaaggccggcgccctctacgacaccatcgatgccagcggagggtactacgtctgccccgtcgacaagtccgtgcgctcgcacatgaacgtgcccttcaccctggccaagggcccggacttcgagaagcagttcatcgccgaggcggccaaggagggcatggtgcagctcaaggggcacaggtctgtcggcggtgtccgcgcctccatctacaatgccatgccgctcgccggcgtcgagaagctcgtcgccttcatgaaggacttccaagccaggaacccttgattgccttgtgcttatgatcatttggtattgctactcagtctttcttcctagcataagtgagctcgtgcaagagctgtctcgcgttgcgcactgggatctatctgtagtattagtaccataacgtaacggctactgtattttgcaatgttttttttcctctctcgcttttgttatgtgttcatggaatttcatttctatgtatcaccattgcagttgtaatgtgtttttgctggaaataaggaataaggtagatggccggttgcctcgcctcgatgga

SEQ ID NO: 5007 - DNA, 1546 bp, Hordeum vulgare
cccctccgtccgcgtcccgccccgcgccgcccagatccgctgcgcggcggtcgcggcgccctccgcccccgcccccctcgccgccgccggcgaccgcggcgtctacaacttcgcggcgggcccggccacgctcccgctctcggtcctccagagggcgcaggcggagctcgtcgactaccgcggctccggcatgagcatcatggagatgagccaccggggcaaggagttcgacgcggccatcaagaaggccgaggccgacctgcgcgcgctcctcgccgtccccgacacccacgaggtcctcttcctccagggcggcgccaccacccagttcgccgccgcgccgctcaacctctgcgcctccccctcggaccccgccgacttcgtcgtctcgggctcctggagcgacaaggccttcaaggaggccaagaagtactcggccgcctccgtcgcctggtccggcaaggccggcaagtacacctccctcccggaggacctcggggccctcccgcagaacccggaggcccgcttcctccacatctgctccaacgagaccatccacggcgtcgagttcaaggactaccccgtgccgacgaacaagtccggcgtcctcgtcgccgacatgtcctccaacttctgctccaagcccgtcgacgtctcccggttcggcctcatctacgcgggggcgcagaagaacgtcggcccgtcgggcgtcaccatcgccatcgtgcgcaaggacctcgtcggcgccgcgcagcccatcacccccgtcatgctcgactacaagacccacgccgacaacgcctcgctctacaacaccccgccctgcttcgccatctacatctgcgggctggtgttcgaggacctgctcgcccagggcggcctcgccgaggtggagaagaagaaccagcacaaggccggcatcctctacgacaccatcgacgccagcggtggctacttcatctgccccgtggacaagccggtgcggtcgctcatgaacgtgccattcacgctggccaagggcgccgactttgagaagcagttcatcgccgaggcggccaaggagggcatgctgcagctcaaggggcacaggtcggtcggcggcgtgcgcgcctccatctacaacgccatgccgctctccggcgtggagaagctcgtcgctttcatgaaggacttccaagcaaggaacccttgatcggccatgatcctctggtattgctcgctctagtaggatggcttgttgttggtcagtaacataagtaggctctgtgcaagagctgcatcgtcgtctcccatttgaggtttcctatccatgcgtagtattagtatggtaactatattttgcaatgctgctgcattttcccacgattgtgggactcttttccattgctcacttttgagattggaacatgttgtattggggaataaaggttgattaatagccagttgtcttcacatcttacctgattcttatgtatggttgagagtttatgttagatagaccaaactcaggtttggttgcttttgtgatctctaaaacaagcaagtt

SEQ ID NO: 5008 - DNA, 1640 bp, Secale cereale
acgggccggtccgccgccggtccccctccgtcgtcgttccgttccccgggtcgtcggccgcccgccgaaggacgtccgctcgccgacggccgtcgcggccgcctccctccccttcgtcgccgcggcgggcgcggggcgagcgcggcgtctacaacttcgcggcgggcccgccacgctgccgctctcggtgctgcagcgggcgcaggcggagctggtcgactaccgcggctccggcatgagcatcatggagatgagccaccggggcaaggagttcgacgcggccatcaagaaggccgaggccgacctgcgcgcgctcctcgccgtgcccgacacccacgaggtgctcttcctccagggcggcgccaccacgcagttcgccgccgcgccgctcaacctctgcggctccccctcggaccccgccgacttcgtcgtctcgggctcctggagcgacaaggccttcaaggaggccaagaagtactcggccgccgccgtcgcgtggtccggcaagggcgacaagtacacctccctgccggaggacttcggggcgctcgcgcagaaccccgaggcccgcttcctccacatctgctccaacgagaccatccacggcgtcgagttcaaggactacccggagccgaggaacaagtccggcgtcctcgtcgccgacatgtcctccaacttctgctccaagcccgtcgacgtctcccggttcggcctcatctacgccggcgcgcagaagaacgtcggcccgtccggcgtcaccatcgccatcgtgcgcaaggacctcgtcggcagcgcgcagcccatcacccccgtgatgctcgactacaagacccacgccgacaacgcctcgctctacaacaccccgccctgcttcgccatctacatctgcgggctggtgttcgaggacctgctcgcgcagggcggcctcgccgaggtggagaagaagaaccagcacaaggccggcatcctgtacgacaccatcgacgccagcggcggctacttcatctgccccgtggacaagccggtgcggtcgctcatgaacgtgcccttcacgctggccaagggggccgactttgagaagcagttcatcgccgaggcggccaaggagggcatgctgcagctcaaggggcacaggtcgggtcggcggcgtgcgcgcctccatctacaatgccatgccgctctccggcgtggagaagctcgtcgccttcatgaaggatttccaagcgaggaacccttgatcggcccatcgccggcacgatcctctggtattgctcgctctagtaggatggcttgttgttggtcatagcataagtaggctctgtgcaagagctgcgtcatcgccgatttgcattttccgatcgattcatccgtagtattagtatggtaactattttgcaacgctgctgcatctttccatcgctcacttttgagcttggaacatgttgtattggggaataaaggttgattgatgttctattgtcttcagattacctgatttgctgtccatctgtaggatggcttgttgtttatcatggcataagtaggctgcaagatgtgcaccatggctcatatgagattttgctatccatctgtagtactacctccgtctaggtgaataagtcattcgcgtagttgatcgt

SEQ ID NO: 5009 - DNA, 1514 bp, Saccharum officinarum
cctcctccctccgcctcccggcccgcgccgccaggatctcgtgcgcggcggtggcggcgccgtccccggccgccgccgcggcggcggacgaggcggagcgcggcgtctataacttcgcggcggggcccgcgacgctgccgctctccgtcctcaagcgggcgcaggcggagctcgtggactaccacggctccgggatgagcatcatggagatgagccaccgcgggaaggagttcgacgccgccatcaagaaggccgaggccgacctgcgcgcgctcctcgcggtgcccgacacccacaccgtgctcttcctccagggcggcgccaccacgcagttcgccgccgtcccgctcaacctctgcgcgggccccaccgacgccgctgacttcgtcgtgtccggctcctggagcgacaaggccttcaaggaggccaagaagtactccgccgcctccgtcgcctggtcgggtaaagatggcaagtacacggccctcccgcccttcgacgccatcaagcagaaccccgaggccaggttcctccacatctgctccaacgagaccatccacggcgtcgagtacaaggactacccggagccccgcaacaagtcgggcatcctcgtcgccgacatgtcctccaacttctgctccaagcccgtcgacgtctcccgcttcggcgtcatctacgccggcgcgcagaagaacgtcggcccctcgggcgtcaccatcgctatcgtgcgcaaggacctcatcggtgccgcgcagcccatcacgcccgtcatgctcgacttcaagacgcacgccgacaacgcctccctctacaacaccccgccctgcttcgccatctacatctgcggcctcgtcttcgaggacctgctcgcgcagggcggcctcgccgaggtcgagaagaagaacgcgcacaaggccggcatcctctacgacaccatcgacgccagcggcgggtactacatctgccccgtcgacaagtcggtgcggtcgcacatgaacgtgcccttcaccctggccaaggggccggacttcgagaagcagttcatcgccgaggcgaccaaggagggcatggtgcagctcaaggggcacaggtcggtcggtggcgtccgcgcctccatctacaatgccatgccgctcgccggcgtggagaagcttgtcgccttcatgaaggatttccaagctaggaacccttgattggcttgtgcttatgatcatttggtattgctgctctttagcagtatgtttcgctcttccttcatagcatgagtgagctctgtgcaggagctgctttgctttgcgcatctgggatctatctgtagtattagtaccataacagccactgtattttgcattgttctttttcacttttattaggtgttcatggaatttcatttctatggatcaccattgtagttggaatgtgttttgctggaaataaggaataaggtggtcaattgcctcgcctccatcgagagcaggtgacgctgctatatcaaaaaaaaaaataacaatcta

SEQ ID NO: 5010 - DNA, 1592 bp, Hordeum vulgare
gccccgcgccgcccagatccgctgcgcggcggtcgcggcgccctccgcccccgcccccctcgccgccgccggcgaccgcggcgtctacaacttcgcggcgggcccggccacgctcccgctctcggtcctccagagggcgcaggcggagctcgtcgactaccgcggctccggcatgagcatcatggagatgagccaccggggcaaggagttcgacgcggccatcaagaaggccgagtccgacctgcgcgcgctcctcgccgtccccgacacccacgaggtcctcttcctccagggcggcgccaccacccagttcgccgccgcgccgctcaacctctgcgcctccccctcggaccccgccgacttcgtcgtctcgggctcctggagcgacaaggccttcaaggaggccaagaagtactcggccgcctccgtcgcctggtccggcaaggccggcaagtacacctccctcccggaggacctcggggccctcccgcagaacccggaggcccgcttcctccacatctgctccaacgagaccatccacggcgtcgagttcaaggactaccccgtgccgacgaacaagtccggcgtcctcgtcgccgacatgtcctccaacttctgctccaagcccgtcgacgtctcccggttcggcctcatctacgcgggggcgcagaagaacgtcggcccgtcgggcgtcaccatcgccatcgtgcgcaaggacctcgtcggcgccgcgcagcccatcacccccgtcatgctcgactacaagacccacgccgacaacgcctcgctctacaacaccccgccctgcttcgccatctacatctgcgggctggtgttcgaggacctgctcgcccagggcggcctcgccgaggtggagaagaagaaccagcacaaggccggcatcctctacgacaccatcgacgccagcggtggctacttcatctgccccgtggacaagccggtgcggtcgctcatgaacgtgccattcacgctggccaagggcgccgactttgagaagcagttcatcgccgaggcggccaaggagggcatgctgcagctcaaggggcacaggtcggtcggcggcgtgcgcgcctccatctacaacgccatgccgctctccggcgtggagaagctcgtcgctttcatgaaggacttccaagcaaggaacccttgatcggccatgatcctctggtattgctcgctctagtaggatggcttgttgttggtcagtaacataagtaggctctgtgcaagagctgcatcgtcgtctcccatttgaggtttcctatccatgcgtagtattagtatggtaactatattttgcaatgctgctgcattttcccacgattgtgggactcttttccattgctcacttttgagattggaacatgttgtattggggaataaaggttgattaatagccagttgtcttcacatcttacctgattcttatgtatggttgagagtttatgttggatagaccaaactcaggtttggttgcttttgtgatctctaaaacaagcaagtttgtcgatcatcgtctcctgaggcacttgctgttcttgtgatcttggtagatttttcagggtgca

SEQ ID NO: 5011 - DNA, 1039 bp, Secale cereale
gactccgtctcgagttccgcctcacctccccgatccctctttctccctcggtagagccagggcgcgaccgcgccaaggaagcaacgaaagcccaaagctggcgcatccttagcacccaagggaagaagaaagagtcgagagagcgaggcgtcccggaggcagagccaaggatccatggatcggccccaggtggtcagcgagaactatgccaatcctataacctgcctcttccatgtgctcttcaaggcgtcggcactggcgttctacatcctcttctcgctcttcgtgaagagcttcgtcatcatctttgtcatcaccgtgctcctcgctgcgctcgacttctgggtggtgaagaatgtcagcggaaggatactcgtcgggctgcggtggtggaatgagattgacgatgatggcaacagtgtgtggaagttcgagtgccttgacggggagtctcttgctcggatgaacaaaaaggactcgtggctgttctggtggactctttacttgaacgctgctgcatggatcattcttgggatattttcactcattagacttgaagctgattaccttcttgttgttggagtttgcttgactctaagccttgcaaacatcgtggggttcaccaaatgcaacaaagatgccaagaagaacatcagagcttttgctgaaaatgccgctcaaaacgccatcacatcccgcatcacatcatccctgcagtcagcattcggtatctgaagtgcagattacacagaggcccaaaattacatacaactgtgtaccatctgtcaaagaagatcagcttgtgatatcccgttttcatgtgattttggcttatataccaagtaggtcgattttgattggagtgacactatgatggaatacagcgtactaattagccctaggtaaatttacactttctcctgtactaaagagcatactttcttcttctcttgtaccctggtgtggcctagaggtccgaagcatatctgccaatacagaaggccttccttttttttgggaaaagaactgagatctatta

SEQ ID NO: 5012 - DNA, 1134 bp, Secale cereale
gactacccgcggtaaacttgactgtaccaagcacttttgaccgtctcgagttccgcctcacctccccgatccctctttctccctcggtagagccagggcgcgaccgcgccaaggaagcaacgaaagcccaaagctggcgcatccttagcacccaagggaagaagaaagagtcgagagagcgaggcgtcccggaggcagagccaaggatccatggatcggccccaggtggtcagcgagaactatgccaatcctataacctgcctcttccatgttctcttcaaggcgtcggcgctggcgttctacatcctcttctcgctcttcgtgaagagcttcgtcatcatctttgtcatcaccgtgctcctcgctgcgcttgacttctgggtggtgaagaatgtcagcggaaggatactcgtggggctgcggtggtggaatgagattgacgatgatggcaacagtgtgtggaagttcgagtgcctcgacggcgagtctcttgctcggatgaacaaaaaggactcgtggctcttctggtggactctttacttgaacgctgctgcatggatcatccttgggatattttcactcattagacttgaagctgattaccttcttgttgttggagtttgcttgactctaagtcttgcaaacatcgtggggttcaccaaatgcaacaaagatgccaagaagaacatccgagcttttgctgaaaatgccgctcaaaacgccatcacatcccgcatcacatcgtccctgcagtcagcattcggtatctgaagtgcagattacacagaggcccaaaattacatacaaccgtgtaccatctgtcaaagaagatcagcttgtgatatcccgttttcatgtgattttggcttatataccaagtaggtcgattttgattggagtgacactgtgatggaatacagcgtactaattagccctaggtaaatttacactttctcctgtactaaagagcatactttcttcttctcttgtaccctggtgtggcctagaggtccgaagcatatctgccaatacagaaggccttctttttttgggtaaaagaactgagatctattataaagatgtgctgatgtcgttgttcccatgccggagctgcctgatttcgttgaaccttga

SEQ ID NO: 5013 - DNA, 1069 bp, Secale cereale
caaagctggcgcatccttagcacccaagggaagaagaaagagtcgagagagcgaggcgtcccggaggcagagccaaggatccatggatcggccccaggtggtcagcgagaactatgccaatcctataacctgcctcttccatgttctcttcaaggcgtcggcgctggcgttctacatcctcttctcgctcttcgtgaagagcttcgtcatcatctttgtcatcaccgtgctcctcgctgcgctcgacttctgggtggtgaagaatgtcagcggaaggatactcgtcgggctgcggtggtggaatgagattgacgatgatggcaacagtgtgtggaagttcgagtgcctcgacggcgagtctcttgctcggatgaacaaaaaggactcgtggctgttctggtggactctttacttgaacgctgctgcatggatcattcttgggatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcatcacatcatccctgcagtcagcattcggtatctgaagtgcagattacacagaggcccaaaattacatacaactgtgtaccatctgtcaaagaagatcagcttgtgatatcccgttttcatgtgattttggcttatataccaagtaggtcgattttgattggagtgacactatgatggaatacagcgtactaattagccctaggtaaatttacactttctcctgtactaaagagcatactttcttcttctcttgtaccctggtgtggcctagaggtccgaagcatatctgccaatacagaaggccttcctttttttgggaaaagaactgagatctattataaagatgtgctgatgtcgtcgttccactagaaaacaaaaaaaaaaaaaaaaaacaaaaaagtaactcgtacgtcgttagtactaacctactgtcgttactgagaacttgcccgaaggccaac

SEQ ID NO: 5014 - DNA, 1144 bp, Triticum aestivum
ttgactgtacctcacctcgcctccccgatccctctttctcccctcggtagagccagggcgcgaccgcgcgaaggaagcaacgaaagcccaaagctggcgcatccttagcacccaagggaagaagaaagaggcgagagagcgaggcgtcccggaggcagagccaagaggatccatggatcggccccaggtggtcagcgagaactatgccaatcctataacatgcctcttccatgtgctcttcaaggcgtcggcgctggcgttctacatcctcttctcgctcttcgtgaagagcttcgtcatcatctttgtcatcaccgtgctcctcgctgcgctcgacttctgggtggtgaagaatgtcagcggaaggatactcgtcgggctgcggtggtggaatgagattgacgatgatggcaacagtgtgtggaagttcgagtgcctcgacggcgagtctctcgctcggatgaacaaaaaggactcgtggctgttctggtggactctttacttgaacgctgctgcatggatcattcttgggatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcatcacatcatccctgcagtcagcattcggtatctgaagtccagattacagaggcccaaaattacatacaactgtgtaccatctgtcaaagaagatcagcttgtgatatcccgttttcatgtgattttggcttatataccaagtaggtcgattttgattggagtgacactatgatggaatacagcgtactaattagccctaggtaaatttacactttctcctgtactaaagagcatactttcttcttctcttgtaccctggtgtggcctagaggtccgaagcatgtcttccaatacagaaggccttttttgtttgtgaaaaggacacggttctgttatgattcctcacatgctggacctgcctgagttcttgcatgtgcccttaaggactaagcgccttggaggcgtagttgtcgttgttgaaccttgaatcaaattcacaccaaatt

SEQ ID NO: 5015 - DNA, 1377 bp, Triticum aestivum
ggtcgctccttattttcttcttttaaataaaagattaaaagaaatattactgccatttttctttataccaagtgccaatataaaaagttcggaaaataagtggaaaataacccgcggtttacttgactgtacctcacctcgcctccccgatccctctttctcccctcggtagagccagggcgcgaccgcgcgaaggaagcaacgaaagcccaaagctggcgcatccttagcacccaagggaagaagaaagaggcgagagagcgaggcgtcccggaggcagagccaagaggatccatggatcggccccaggtggtcagcgagaactatgccaatcctataacatgcctcttccatgtgctcttcaaggcgtcggcgctggcgttctacatcctcttctcgctcttcgtgaagagcttcgtcatcatctttgtcatcaccgtgctcctcgctgcgctcgacttctgggtggtgaagaatgtcagcggaaggatactcgtcgggctgcggtggtggaatgagattgacgatgatggcaacagtgtgtggaagttcgagtgcctcgacggcgagtctctcgctcggatgaacaaaaaggactcgtggctgttctggtggactctttacttgaacgctgctgcatggatcattcttgggatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcatcacatcatccctgcagtcagcattcggtatctgaagtccagattacagaggcccaaaattacatacaactgtgtaccatctgtcaaagaagatcagcttgtgatatcccgttttcatgtgattttggcttatataccaagtaggtcgattttgattggagtgacactatgatggaatacagcgtactaattagccctaggtaaatttacactttctcctgtactaaagagcatactttcttcttctcttgtaccctggtgtggcctagaggtccgaagcatgtcttccaatacagaaggccttttttgtttgtgaaaaggacacggttctgtacctcggccgcgacacgctaatccgcggcccatgcggccggaacatcgacgtcggcccaatcggctatagtggtcgtatacaatcactgccgtcttttacacgtcgtgatggaaaacctgcgttaccaattatcgctttgagcatccccttcgccagtgggtataccaaagccgaccaatccctccaaaattccacccaatgggatgacccccttacggccata

SEQ ID NO: 5016 - DNA, 1166 bp, Hordeum vulgare
gctcgactgtgccaagcacttctgaccgtctcgagttccgcctcacctcacctccccgatccctctttctccttgggtagagccagggcgcgaccgcgcgaaggaagcaacgaaagcccaaagctggcgcatccttagcacccaagggaagaagaaagaggcgacagagcgaggcgtcccggaggcagagccaaggatccatggatcggccccaggtggtcagcgagaactatgccaatcctataacatgcctcttccatgtgctcttcaaggcgtcggcgctggcgttctacatcctcttctcgctcttcgtgaagagcttcgtcatcatctttgtcatcaccgtgctccttgccgcgcttgacttctgggtggtgaagaatgtcagcggaaggatactggtcgggcttcgttggtggaatgagattgacgacgatggtaacagtgtgtggaagttcgagtgcctcgacggggagtctctcgctcggatgaacaaaaaagactcatggctgttctggtggactctttacttgaacgctgctgcatggatcattcttgcgatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcatcacatcatccctgcagtcagcattcggcatctgaagtccagattacacagaggcccaaaattacatacaactgtgttaccttctgtcaaagatcagcttgtgatatcctgttttcatgtgattttggcttatatacaagtaggtcgattttgattggagtgacaatgatggaaaacagcgtactaattagccctaggtaagtttacactttctcctgtactaaagagcatactttcttcttctcttgtactctggtgtggcctagaggtctgaagcatgtctttcaatacaaaaggcctttttttttaatctattatgaagatgtgctgatgtcgttgttcccatgccggagctgcctgtcttcgtgcatgtgcctccaaggaccagtgcattggaggtgtagttgtcgccgttgaaccttgcataagtttgataccat

SEQ ID NO: 5017 - DNA, 1012 bp, Hordeum vulgare
ctgaccgtctcgagttccgcctcacctcacctccccgatccctctttctccttgggtagagccagggcgcgaccgcgcgaaggaagcaacgaaagcccaaagctggcgcatccttagcacccaagggaagaagaaagaggcgacagagcgaggcgtcccggaggcagagccaaggatccatggatcggccccaggtggtcagcgagaactatgccaatcctataacatgcctcttccatgtgctcttcaaggcgtcggcgctggcgttctacatcctcttctcgctcttcgtgaagagcttcgtcatcatctttgtcatcaccgtgctccttgccgcgcttgacttctgggtggtgaagaatgtcagcggaaggatactggtcgggcttcgttggtggaatgagattgacgacgatggtaacagtgtgtggaagttcgagtgcctcgacggggagtctctcgctcggatgaacaaaaaagactcatggctgttctggtggactctttacttgaacgctgctgcatggatcattcttgcgatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcatcacatcatccctgcagtcagcattcggcatctgaagtccagattacacagaggcccaaaattacatacaactgtgttaccttctgtcaaagatcagcttgtgatatcctgttttcatgtgattttggcttatatacaagtaggtcgattttgattggagtgacaatgatggaaaacagcgtactaattagccctaggtaagtttacactttctcctgtactaaagagcatactttcttcttctcttgtactctggtgtggcctagaggtctgaagcatgtctttcaatacaaaaggcctttttttt

SEQ ID NO: 5018 - DNA, 1055 bp, Pseudoroegneria spicata
  misc_feature (156)..(156): n is a, c, g, or t
  misc_feature (159)..(159): n is a, c, g, or t
  misc_feature (973)..(973): n is a, c, g, or t
  misc_feature (995)..(995): n is a, c, g, or t
ccgtctcgagttccgtctcacctcacctccccgatccctctttctccctcggtagagccagggcgcgaccgcgcgaaggaagcaacgaaagcccaaagctggcgcatccttagcacccaagggaagaagaaagaggcgagagagcgaggcgtcccngangcagagccaaggatccatggatcggccccaggtggtcagcgagaactatgccaatcctataacatgcctcttccatgtgctcttcaaggcgtcggcactggcgttctacatcctcttctcgctcttcgtgaagagcttcgtcatcatctttgtcatcaccgttctcctcgctgcgcttgacttctgggtggtgaagaatgtcagcggaaggatactcgttgggctgcggtggtggaatgagattgacgatgatggcaacagtgtgtggaagttcgagtgcctcgacggcgagtctctcgctcggatgaacaaaaaggactcgtggctgttctggtggactctttacttgaatgctgctgcatggatcattcttgggatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcttcacatcatccctgcagtcagcattcggtatctgaagtccagattacagaggcccaaaattacatacaactgtgtaccatctgtcaaagaagatcagcttgtgatatcccgttttcatgtgattttggcttatataccaagtaggtcgattttgattggagtgacactgatggaatacagcgtactaattagccctaggtaaatttacactttctcctgtactaaagagcatactttcttcttctcttgtaccctgttgtggcctagaggtncgaagcatgtcttccaatacanaaggcctttttttgtgtgaaaagaactcagatcataaagacgtgcggatgtcgttgttca

SEQ ID NO: 5019 - DNA, 932 bp, Avena sativa
gaccgcgcgaaggaaacgacgaaataccaaagcactccaaagcacccaagggaagagacgagagagcaaggtcctcggcgggcggagggaagcggtgccaaggatccatggatcggccccaggtggtcagcgagaattatgccaacccaataacgtgcctcttccatgtgctcttcaaggcgtcggccttggcgttctacatcctgttctccctcttcgtgaagagcttcgtcatcatcttcgtcatcaccgtgctcctcgccgcgctcgacttctgggtcgtgaagaacgtcagcggcaggatacttgttgggctgcggtggtggaatgagattgacgacgagggcaatagcgtgtggaagttcgagtgcctcgatggggagtctctcgctcggatgaacaagaaggactcgtggttgttctggtggactatttacttgaacgctgctgcatggatcattcttggagtattttccctcattagacttgaggctgattaccttctagttgttggagtctgtatgactctgagcattgcaaacatcgtggggttcaccaaatgcaacaaagatgccaagaagaacatccgtgcttttgttgaaaactctgctcaaaacgccatcacatctcgcatcaccacatctttacaatcagcattcggtatctgaaatccagattacgtagaggcggaaatgttacatacaacagtgtacaatctgtcaaaaagatgagcttgtggtatcctgttttcacatgtttttttttggacttgtacaccatataggtcgattttgattggagtgacacgatgacagaaaacgactagccctagatgaatttcacacttgtctcctgcactaaagagcatactttctgcatttcttgtaccctagtctggaacatgttgaatgcaaatttgttcctttgttgtt

SEQ ID NO: 5020 - DNA, 992 bp, Avena sativa
gcccatcgaccatagtagagtcactgcgcgaccgcgcgaaggaaacaacgaaaaactaaagcactccaaagctggggcatccttagcacccaagggaagagacgagcgagcgaggtcatcggcgggcggagggcagcggtgccaaggatccatggatcggacccaggtggtcagcgagaattatgccaacccaataacgtgcctcttccatgtgctcttcaaggcgtcggcgttggcgttctacatcctgttctccctcttcgtgaagagcttcgttatcatcttcgtcatcaccgtgctcctcgcggcgctcgacttctgggtggtgaagaacgtgagcggcaggatacttgtagggctgcggtggtggaatgagattgacgacgacggcaacagcgtgtggaagttcgagtgcctcgatggggagtctcttgctcggatgaacaagaaggactcgtggttgttctggtggactatttacttgaacgctgctgcatggatcattcttggagtattttccctcattagacttgaggctgattaccttctagtcgttggagtttgtatgactctaagcattgcaaacatcgtggggttcaccaaatgcaacaaagatgccaagaagaacatccgtgcttttgttgaaaactctgctcaaaacgccatcacatctcgcatcacctcatctctacaaacagcattcggtatctgaaatccagattacgtagaggcgcaaatgttacctacaacagtgtacaatctgtcaagatgagcttgtggtatcctgttttcgtatgatattttgacttaatacaccatataggtcgattttgattggagtgacacgatgacagaaaacaattagccctagatgaatttcacacttgtctcctgcactaaaaagcaatactttctgcatttcttgtgccctagcctggaacatgtcaaatgcaaaagtattcctttgttgttggtactttgttaatgccatg

SEQ ID NO: 5021 - DNA, 748 bp, Cynodon dactylon
gcacccaagggcgcgaggcggggtcggcggaaagaagcgcggagcatccatggatcagcgccaggttgttagcgagaactatgccaatcctataacgtgtttcttccatgtgctcttcaaggcggcggcactggccttctacatcctgttctcgctcttcgtgaagagctttgtcatcatcttcgtgatcaccgtgctccttgccgcacttgacttctgggtggtgaagaatgtcagcggcaggattttggttggtttgcgctggtggaatgagatcgatgatgagggaaatagtgtgtggaagtttgagtgcttggatggggagtctctggctcggatgaacaaaaaggactcgtggctgttctggtggactctttacttgactgctgctgcatggatcgttctgggtatattttcactcatcagacttgaggccgattaccttcttgttgttggagtttgcttgagtctaagcattgcaaacattgttggattcacgaaatgcaacaaagatgccaagaagaacatccaggcctttgcccagaatgcccttgcttcccgtgtcacatcatcactccaatcagcatttggagttatctgaagtcccacatggaggacctattattacacacaagtgttcaagaggattagtatgaattctatgttactacctttcttctgattgcgaggatgcccccccaacgtaggtagcatatccctactattccatttttatagagttccttga

SEQ ID NO: 5022 - DNA, 958 bp, Avena sativa
gatagaccagtgcgcgaccgcgcgaaggaaacgacgaaataccaaagcactccaaagcacccaagggaagagacgagcgagcaaggtcctcggcgggcggagggaagcggtgccaaggatccatggatcggtcccaggtggtcagcgagaattatgccaacccaataacgtgcctcttccatgtgctcttcaaggcgtcggcgttggcgttctacatcctgttctccctcttcatgaagagcttcgtcattatcttcgtcatcaccgtgctcctcgcggcgctcgacttctgggtggtgaagaacgtgagcggcaggatacttgtagggctgcggtggtggaatgagattgatgacgacggcaacagcgtgtggaagttcgagtgcctcgatggggagtctctcgctcggatgaacaagaaggactcgtggttgttctggtggactatttacttgaacgctgctgcatggatcattcttggagtattttccctcattagacttgaggctgattaccttctagtcgttggagtttgtatgactctaagcattgcaaacatcgtggggttcaccaaatgcaacaaagatgccaagaagaacatccgtgcttttgttgaaaactctgctcaaaacgccatcacatctcgcatcacttcatctctgcaaacagcattcggcatctgaaatccagatttacgtagaggcgcaaatgttacatacaacattgtacaatctgtcaaaatgatgagcttgtggtatcctgttttcctatgaatttttgacttaataggtcgattttgattggagtgacacgatgacagaaaacaactagccctagatgaatttcacacttgtctcctgcactaaaaagcaatactttctgcatttcttgtgccctagcctggaacatgccaaatgcaaaagtgttcctttgttgttggtactttgttaatgccatg

SEQ ID NO: 5023 - DNA, 1103 bp, Panicum virgatum
ggcttgaaaaacaattcagcttacaccttttttccatttttgagttcacctcttggctgttggatcccggccccggacagggcgcgactgcgcgagcacgagacagcatcctccaaacctcgcgcgttcgtggcttccgacggagtggaggagcgagagcgcgaggcggtggccgcggaaggggaggagggccgagcagcaccatggatcagcgccaggtggtcagcgagaattatgccaatcccattacatgcttcttccatgtgcttttcaaggcggcggcgctagccttctacatcctgttctcgctctttgtgaagagcttcgtcatcatctttgtgatcaccgtgctccttgcggcgcttgacttctgggtggtgaagaacgtgagcggcaggattttggtcgggctgcggtggtggaatgagattgacgatgagggaaacagcgtgtggaagtttgagtgccttgatggggagtctcttgctcggatgaacaagaaggattcgtggctattctggtggactctttacttgactgctgctgcatggattgttctcggtatattttcgctcataagacttgaggctgattaccttctcgtcgtcggagtttgcttgagtctaagcattgcaaacattgttggcttcaccaagtgcaacaaagacgccaagaagaacatccaggcttttgctcaaaatgctcttgcttcccgcgtcacatcatcgctgcaatcagcattcggtgtcatctgaaatcctacgtggaggtgctgatattacacacagcagtgtaagatttgtcaaaaggacaagcttgcattctatgctactgcctttcctctgattgcaagggtgtaactccacctgcgtagatatcatattgtactgtctcgtttccgtacggttttttgactcatcatacaacaaataggtcgattttgatgtgagtaccagaaaacaacttgggttaatgctcttggatctgaagagcattctctgcatcatcttttacttcttttgccatggagatgaaaactactactgtagggagcattttactcgtctaaacctggtatccaatacagaagtgctttgttgctt

SEQ ID NO: 5024 - DNA, 1030 bp, Panicum virgatum
cccagacagggcgcgactgcgtgggcacgagacagcatccatcttccaaagctcgcgcgttcgtggcttccgacggagttggggagcgagagcgcgaggcggtggccgcggaggggaaggagggccgagcaccatggatcagcgccaggtggtcagcgagaattatgccaaccccattacatgcttcttccatgtgcttttcaaggcggcggcgctagccttctacatcctgttctcgctctttgtgaagagcttcgtcatcatctttgtgatcaccgtgctccttgcggcgcttgacttctgggtggtgaagaatgtgagcggcaggattttggtcgggctgcggtggtggaatgagattgacgatgagggaaacagcgtgtggaagtttgagtgcctcgatggggagtctctcgctcggatgaacaagaaggattcatggctgttctggtggactctttacttgactgctgctgcatggattgttctcggtatattttcactcataagacttgaggctgattaccttctcgttgtcggagtttgcttgagtctaagcattgcaaacattgttggcttcaccaagtgcaacaaagatgccaagaagaacatccaggctttcgctcaaaatgctctcgcttcccgcgtcacatcatcgctgcaatcagcatttggtgtcatctgaaatcccacttgaaggtgatgatgttacacacagcagtgtacgatttgtcaaaaaggacgagcttgcattctatgctactgcatttcctctgattgcaagaatgtaactccaccggcgtagatagcatattgtactgccccattttcatacggttttttgactcatcataacaaatagtttggtgtaacagaaaacaactttggttaatgctcttggatgatttgtccatgaagctttcatacacttgtttgattgtttcctgcacagctgcactgaaagcattatttgcatcatgttgtactttttttgccagggagatgaaaattactgcagggagcattatac

SEQ ID NO: 5025 - DNA, 1058 bp, Setaria italica
ctcttgccgcttggatctcgggagagagacatcccaagccccagacagggcgcgactgcgggagcacgagaccagcatcctctcccaagctcgcgcgttcgtggcttccgacggagtggggagcgcgaggcggtggccgcggaaggggagcgtcaagcacccatggatcagcgccaggtggttagcgagaattatgccaatcccattacatgcttcttccatgtgcttttcaaggcggcggcactagccttctacatcctgttctcgctctttgtgaagagcttcgttatcatctttgtgatcaccgtgctccttgcggcgctcgacttctgggtggtgaagaacgtgagcggcaggattttggttgggctgcggtggtggaatgagattgacgatgagggaaacagcatctggaagtttgagtgcctcgatggggagtctctcgctaggatgaacaagaaggattcatggctattctggtggactctttacttgactgctgctgcatggattgttctcggtattttttcgctcatcagacttgaggctgattaccttcttgttgtcggagtttgcttgagtttaagcatcgcaaacattgttggcttcaccaagtgcaacaaagatgccaagaagaacatccaggctttcgctcaaaatgcgctcgcttcccgcgtcacatcatcgctgcaatcagcatttggggtcatctgaaatcccatatggagtctacaatttgtcaaaactcaaaagggcgaccttgcaaggatgcaactccaccggcgtagatagcacattgtactgtcctgttttcagacatttttttttactcatacaacaaataggtcgattttgatgtgagtaccagcaaacaactttggttacagctctttgggtcattcgtccatgaagctttcatatacttgtctcctgtactgaagagcattctctgcatcaatctttacttcttttgcaatggatacgaaaattattactgtagtgagcattctatttgtccgaacctggtgtccaacgcagaagtgctttgttgctcaaac

SEQ ID NO: 5026 - DNA, 953 bp, Zea mays
acgcaaatggtaaaacgcttgggaaacacaattcagccctggcctttttccagttgagttcacctcttggctcttgcctcctgcatctctagagaggcacatcccagctccaagcttcgcgccttgttggatcgtggcgtccaagcaacggtggtagcggagcgcgaggcagtggccgcagaaggaagcgcgaagcatccatggaccaacgccaggtggttagcgagaattatgccaatcccataacatgcttcttccatgtgctattcaaggcgggggcgctagccttctacatcctattctcgctctttgtgaagagcttcgtcatcatcttcgtgatcacggtgctcctcgcagcgcttgacttctgggtggtgaagaacgtcagtggcaggatactagtcgggctgcggtggtggaatgagatcgatgatgacggaaacagtgtgtggaagtttgaatgccttgatggggagtctctcgctcggatgaacaagaaggattcatggctgttctggtggactctttacttgactgctgctgcatggatcgttcttggtatattttcactcatcaggcttgaggctgattaccttcttgttgttggagtttgcttgagtctaagcattgcaaacattgttggattcaccaagtgcaacaaagatgccaagaagaacatccagactttcgctcaaaatgcactcgcttcccgtgtcacatcatcgctgcaatcagcattcggtgtcatctgaagtcccacgcggaggccctggtattagtatattactcacagcggtgtacaatttgtcaaaaggatgagcttgcattctacgtttactgcctttcctctgattgcaaggatgtaattctaccagcgtagacagcaagcatattgtactgtcccgttatcattcttttttacctcatacaacaaataggtcgattttgatgtc

SEQ ID NO: 5027 - DNA, 810 bp, Leymus cinereus x Leymus triticoides
  misc_feature (116)..(116): n is a, c, g, or t
  misc_feature (128)..(128): n is a, c, g, or t
  misc_feature (294)..(294): n is a, c, g, or t
attatgccaatcctataacctgcctcttccatgtgctcttcaaggcgtcggcactggcgttctacatcctcttctcgctcttcgtgaagagcttcgtcatcatctttgtcatcacngtgctcctcgcngcgcttgacttctgggtggtgaagaatgtcagcggaaggatactggtcgggctgcggtggtggaatgagattgacgatgacggcaatagtgtctggaagttcgagtgcctcgacggggagtctctcgctcggatgaacaaaaaggactcgtggttgttctggtggnctctttacttgaacgctgctgcatggatcattcttgggatattttcactcattagacttgaagctgattaccttcttgttgttggagtttgcttgactctaagccttgcaaacatcgtggggttcaccaaatgcaacaaagatgccaagaagaacatccgagcttttgctgaaaatgccgctcaaaacgccatcacatcccgcatcacatcatccctgcagtcagcattcggtatctgaagtccagattacagaggcccaaaattacatacaactgtaccatctgtcaaaaaagatcagcttgtgatatcccgttttcatgtgattttggcttatataccaagtaggtcgattttgattggagtgacactatgatggaaaacagcgtactaattagccctaggtaaatttacactttctcctgtactaaagacatactttcttcttctcttgtaccctggtgtggcctagaggtccgaagcaagtcttccaatacagaaggcctttttttgcgaaa

SEQ ID NO: 5028 - DNA, 963 bp, Pennisetum glaucum
gggagagaggggggatagaggacatcccaagccccacccagccagggcgcgactgcggtggcctgcgggagcacgagatcagcgtcctctcccaagtcccaagctcgcgcgttcgtggcttccgacggagtggggagcgcgaggcggttgccgcggaaggggagcgccaagcacccatggatcagcgccaggtggttagcgagaattatgccaatccgattacatgcttcttccacgtccttttcaaggctgccgcactagccttctacatcctgttctcgctctttgtgaagagctttgtgatcatctttgtgatcaccgtgctccttgcggcgctcgacttctgggtggtgaagaacgtgagcggcaggattttggtcgggctgcggtggtggaatgagattgacgatgagggaaacagcatctggaagtttgagtgcctcgatggggagtctctcgctcgaatgaacaagaaggattcgtggttgttctggtggactctttacttgactgctgctgcgtggattgtccttgctatcttttcactcatcagacttgaggctgattaccttcttgttgttggagtttgcttgagtctaagcattgcaaacattgttggcttcaccaagtgcaacaaagacgccaagaagaacatccaggcttttgctcaaaatgcgcttgcttcacgcgtcacatcgtcactgcaatcagcattcggagtaatctgaaaccacatacggagtctccaatttgtgaaaaggacgtccttgcattctatgctactgtcctccctcagattgcaaggatgtaactccactggcgtagatagcacattgtaccgtcctgttttcatatggtttttttactcatacaacaaataggtccattttgacgtgagtaccagtaaacaacttggttaaagctctttggatgattagtccgtgaatcattgatacacttgtc

SEQ ID NO: 5029 - DNA, 1149 bp, Oryza sativa
agaaagaaatagtgaatataatcaactcctctctgttggatctcaagaaagagttgggcgcgagagcaccgacgacccaacaacacaagacgaagcgagcgacgagacgacctaaccccaaagcgaaaaaagttgctgcatccttagcgcgcaagcgaaagcgagagggagctcgcgcgcgcgcgagggatcgatggatcgaccccaggtagttaccgagaactatgccaatcctgtgacgtgcctctttcatgtgctcttcaaggctggggcgctggtgttctacatcttgttttcgctcttcgtgaagagcttcgtcatcatattcgtcatcaccgtgttcctggcggcgctcgacttctgggtggtgaagaatgtgagtggcaggatattggtcgggatgcggtggtggaatgagatcgacgacgagggcaacagcgtgtggaagtttgagtgcctcgatggggaggctcttgctcggatgaacaaaaaggactcgtggctgttctggtggactctttacttgactgctgctgcatggatcattcttgggatattttcacttatcagacttgaagctgactaccttcttgttgttggagtttgcttgactctaagccttgcaaacattgttgggttcaccagatgcaacaaagatgccaagaagaatatccggggttactttgaaggtcatgctcaaaatgcgatcacatcccgcatcacatccaccctgcaatcagcatttggagtaatctaaaatccgagctccaaacagcaaggcccttttcgaatacaaccatgtaaaatctgtcaaaaggattagcgtgcattatcccatttccatacatttttgttgacccaatacacccagtaggttgattttgattggaaagacagagaacaccttgttagtactactgccttccaaaggagtaaaaaagaagtttttagccgagaatatgtcttgagtctgagtgtaccctttagggattttgaccctggaacctgtcttccaatgcagcttcttgttaattccatatattattaatcatttgctgtgctgtatcttaacgacaattttctgtaattttatgcattctcgcaaaatgcccgtacatggttacgtgattgagaaaatcgcatcggcac

SEQ ID NO: 5030 - DNA, 1025 bp, Oryza sativa
aagaaagagttgggcgcgagagcaccgacgacccaacaacacaagacgaagcgagcgacgagacgacctaaccccaaagcgaaaaaagttgctgcatccttagcgcgcaagcgaaagcgagagggagctcgcgcgcgcgcgagggatcgatggatcgaccccaggtagttaccgagaactatgccaatcctgtgacgtgcctctttcatgtgctcttcaaggctggggcgctggtgttctacatcttgttttcgctcttcgtgaagagcttcgtcatcatattcgtcatcaccgtgttcctggcggcgctcgacttctgggtggtgaagaatgtgagtggcaggatattggtcgggatgcggtggtggaatgagatcgacgacgagggcaacagcgtgtggaagtttgagtgcctcgatggggaggctcttgctcggatgaacaaaaaggactcgtggctgttctggtggactctttacttgactgctgctgcatggatcattcttgggatattttcacttatcagacttgaagctgactaccttcttgttgttggagtttgcttgactctaagccttgcaaacattgttgggttcaccagatgcaacaaagatgccaagaagaatatccggggttactttgaaggtcatgctcaaaatgcgatcacatcccgcatcacatccaccctgcaatcagcatttggagtaatctaaaatccgagctccaaacagcaaggcccttttcgaatacaaccatgtaaaatctgtcaaaaggattagcgtgcattatcccatttccatacatttttgttgacccaatacacccagtaggttgattttgattggaaagacagagaacaccttgttagtactactgccttccaaaggagtaaaaaagaagtttttagccgagaatatgtcttgagtctgagtgtaccctttagggattttgaccctggaacctgtcttccaatgcagcttcttgttaattccatatattattaatcatttgctgtgctgtatctt

SEQ ID NO: 5031 - DNA, 1069 bp, Saccharum officinarum
ctcgaccgcatttcccgagtcgacccacgcgtccgcgccccgttcccgcgggttcaacgcgctctccacggcggacttcacctgcgtgagcctgggctgggactgggagccgccgcacaagaagccgcgacccctctgctactgatccaccggcactgccgccggatctatcacgaacgaaccggaggtggagcgagcggcgaaggcggcggggttcgaggcggtggtggcggagctacgcggcgacgacgcagcggaggcggagcaggcgcaggtggtggaagcaagcatccatggatcagcgccaggtggttagcgagaattatgccaaccccattacatgcttcttccatgtgctattcaaggcgggggcgctggccttctacatccttttctcgctctttgtgaagagcttcgtcatcatcttcgtgatcacggtgctcctcgcagcgctcgacttctgggtggtgaagaacgtcagtggcaggatattagtcgggctgcggtggtggaatgagattgacgacgaaggaaacagcgtgtggaagtttgagtgccttgatggggagtctctcgctcggatgaacaagaaggattcgtggctgttctggtggacgctttacttgactgctgctgcatggatcgttcttggtatattttcactcatcaggcttgaggctgattaccttcttgttgttggagtttgcttgagtctaagcattgcaaacattgttggattcaccaagtgcaacaaagatgccaagaagaacatccagactttcgctcaaaatgcacttgcttcccgtgtcacatcgtcgctgcaatcagcattcggagtcatctgaagtcccacatggaggccctgatattagtatattactcagaacggtgtacaatttgtcaaaaggaagagtttgcattctatgttactgcctttcctctgattgcaaggatgtacctctaccagcgtagatagcaatattgtactgccccattatcataccttttttacctcatacaacaaataggtcgattttgatgtgattaccagaatccttcggtttatttc

SEQ ID NO: 5032 - DNA, 901 bp, Sorghum bicolor
acgacaggtaaaaaacgcttgggaaacaattcagcactggcctttttgcagttgagttcacctccctcctggatctctagtctctagagagaaagaggggcatcccgctccagctccaggcttcgcgccttgttggatcgtggcgtccaagcaacggtggaagcggagcgcgaggcggtggccgcggaagggagcccgaggcatccatggatcagcgccaggtggttagcgagaattatgccaaccccattacatgcttcttccatgtgctattcaaggcgggggcgctggccttctacatccttttctcgctctttgtgaagagcttcgtcatcatcttcgtgatcacggtgctcctcgcagcgctcgacttctgggttgtgaagaacgttagtggcaggatattagtcggcctgcggtggtggaatgagattgacgacgaaggaaacagtgtctggaagtttgagtgccttgatggggagtctctcgctcggatgaacaagaaggattcgtggctcttctggtggactctttacttgactgctgctgcatggatcgttcttggtatattttcactcatcaggcttgaggctgattaccttcttgttgttggagtttgcttgagtctaagcattgcaaacattgttggattcaccaagtgcaacaaagatgccaagaagaacatccagactttcgctcaaaatgcactcgcttcccatgtcacatcatcgctgcaatcagcattcggagtcatctgatgtcccacatggaggccctgatattagcatattactcagcggtgtacaatttgtcaaaatgatgagtttgcattctatgttactgcctttcctctgattgcaaggatgtaactttaccagcgtaatagcatattgcactgtcc

SEQ ID NO: 5033 - DNA, 926 bp, Sorghum bicolor
cagtcttcttcctcttcttgttgcgacgacaggtaaaaaacgcttgggaaacaattcagcactggcctttttgcagttgagttcacctccctcctggatctctagtctctagagagaaagaggggcatcccgctccagctccaggcttcgcgccttgttggatcgtggcgtccaagcaacggtggaagcggagcgcgaggcggtggccgcggaagggagcccgaggcatccatggatcagcgccaggtggttagcgagaattatgccaaccccattacatgcttcttccatgtgctattcaaggcgggggcgctggccttctacatccttttctcgctctttgtgaagagcttcgtcatcatcttcgtgatcacggtgctcctcgcagcgctcgacttctgggttgtgaagaacgttagtggcaggatattagtcggcctgcggtggtggaatgagattgacgacgaaggaaacagtgtctggaagtttgagtgccttgatggggagtctctcgctcggatgaacaagaaggattcgtggctcttctggtggactctttacttgactgctgctgcatggatcgttcttggtatattttcactcatcaggcttgaggctgattaccttcttgttgttggagtttgcttgagtctaagcattgcaaacattgttggattcaccaagtgcaacaaagatgccaagaagaacatccagactttcgctcaaaatgcactcgcttcccatgtcacatcatcgctgcaatcagcattcggagtcatctgatgtcccacatggaggccctgatattagcatattactcagcggtgtacaatttgtcaaaatgatgagtttgcattctatgttactgcctttcctctgattgcaaggatgtaactttaccagcgtaatagcatattgcactgtcc

SEQ ID NO: 5034 - DNA, 706 bp, Eragrostis curvula
  misc_feature (7)..(7): n is a, c, g, or t
  misc_feature (20)..(20): n is a, c, g, or t
  misc_feature (703)..(704): n is a, c, g, or t
attgcgngaggaccgactgngagccgagcatcctccaaagcctcgcggtcgtagcaacaaagggagcgagggcgcgaagcggtggcggcggagggaagcggcgagcgtccatggatcagcgtcaggttgttagtgagaattacgccaatcctataacatgcttcttccatgtgctgttcaaggcggcggcattggccttctacatcctgttctcccttttcgtgaagagcttcgtcatcatctttgtgatcactgtgctccttgccgcacttgacttctgggtggtgaagaatgtcagcggcaggatcctggttgggctgcgctggtggaatgagattgatgacaagggaaacagtgtgtggaagtttgagtgcctggatggggagtctcttgctcggatgaacgaaaaggactcgtggctgtactggtggactctttacttgactgatgctgcatggattgatctaggtatattttcactcatcagacttgaggctgattaccttcttgttgttggagtttgcttgagtctaagcattgcaaacattgttggcttcaccaaatgcaacaaagatgccaagaagaacatccaggcctttgcacaaaatgcgcttgcctcccgtgtcacgtcctcactgcaatcagcatttggagttctttgaagtccacgtgaaggcccaaatatcagccataacagtgtacnntt

SEQ ID NO: 5035 - DNA, 563 bp, Secale cereale
  misc_feature (66)..(66): n is a, c, g, or t
  misc_feature (83)..(83): n is a, c, g, or t
  misc_feature (155)..(155): n is a, c, g, or t
  misc_feature (164)..(164): n is a, c, g, or t
  misc_feature (206)..(206): n is a, c, g, or t
  misc_feature (269)..(269): n is a, c, g, or t
  misc_feature (275)..(275): n is a, c, g, or t
  misc_feature (290)..(290): n is a, c, g, or t
  misc_feature (314)..(314): n is a, c, g, or t
  misc_feature (356)..(356): n is a, c, g, or t
  misc_feature (428)..(428): n is a, c, g, or t
  misc_feature (459)..(459): n is a, c, g, or t
  misc_feature (483)..(483): n is a, c, g, or t
atccatggatcggccccagtggtcagcgagaactatgccaatcctataacctgcctcttccatgtnctcttcaggcgtcggcnctggcgttctacatcctcttctcgctcttcgtgaagagcttcgtcatcatctttgtcatcaccgtgctcctngctgcgctngacttctgggtggtgaagaatgtcagcggaaggatactcgtngggctgcggtggtggaatgagattgacgatgatggcaacagtgtgtggaagttcgagtgcctngacggngagtctcttgctcgnatgaacaaaaaggactcgtggctnttctggtggactctttacttgaacgctgctgcatggatcatncttgggatattttcactcattagacttgaagctgattaccttcttgttgttggagtttgcttgactctaagncttgcaaacatcgtggggttcaccaaatgcnacaaagatgccaagaagaacatcngagcttttgctgaaaatgccgctcaaaacgccatcacattccgcatcacatcatccctgcagtcagcattcggtatctga

SEQ ID NO: 5036 - DNA, 1184 bp, Oryza sativa
gcagacgcggggatccgcccctcttctagacgacatatttgcatttgaccccccgtcctcttcgatctccaagggagtaaccgaggaagggatcccgcgaagcagtagcatagcagcggaagaactcaagcggagtgggcgaagaagcaaagcccgatggatcaacaccaggtggtcggcgagaattatgcaaatccaaagacatgtttcttccatgtcctcttcaaggcaggggcattggcgttctacatactgtctgcgctgttcgtgaccaactttgttattatctttgtcatcaccgtgctcctggcagcacttgacttctgggtggtcaagaacgtcagtgggaggatattggttgggctgcgctggtggaatgagatcgatgatgagggcaatagcgtgtggaagtttgagtgccttgatggagagtctcttgctaggatgaacaagaaggactcatggctgttctggtggactctgtacttgactgctgctgcatggattgttcttgggatattctcactcatcagacttcatgctgattaccttcttgttgttggagtttgcttgagtctcagcatagcaaacattgttggcttcaccaagtgcaacaaagatgccaagaaaaacgttgcagattggactagaactacgctcctatcatctggtgtcaggtcaacaattcagtcagcattcggtgtctaaatagaggcgccctaatgtcacatacagtggtgtgcaatttatgaatcagatgatgcattctgcttttgtttactttgcctagttgcttattgaccctatacatctttgtgtcccctgatatccttggtattgtttgattcactgtgacaaaagattgagggtcaagataggcacactactcaacctacaagttcttgatgttctttgtattttttagccttgtcactggtgacactgtatagcagctgaactggaaaacgttctacttgggatagattgtagtgtacagctaacatcttgaaacattatcatagtactgcatggagtttgtcttgtcgaacttttaaccatgaggcaaaagcaatggatgttgatgttgtgaaggagcatcttgcaggagaaaatgcattgtgattttcattatttgacatctccaccaccggcaagacaaattcgcctacctcttccttcagcct

SEQ ID NO: 5037 - DNA, 1108 bp, Oryza sativa
gcagaatttgcgatccgcccctcttctagacgacatatttgcatttgaccccccgtcctcttcgatctccaagggagtaaccgaggaagggatcccgcgaagcagtagcatagcagcggaagaactcaagcggagtgggcgaagaagcaaagcccgatggatcaacaccaggtggtcggcgagaattatgcaaatccaaagacatgtttcttccatgtcctcttcaaggcaggggcattggcgttctacatactgtctgcgctgttcgtgaccaactttgttattatctttgtcatcaccgtgctcctggcagcacttgacttctgggtggtcaagaacgtcagtgggaggatattggttgggctgcgctggtggaatgagatcgatgatgagggcaatagcgtgtggaagtttgagtgccttgatggagagtctcttgctaggatgaacaagaaggactcatggctgttctggtggactctgtacttgactgctgctgcatggattgttcttgggatattctcactcatcagacttcatgctgattaccttcttgttgttggagtttgcttgagtctcagcatagcaaacattgttggcttcaccaagtgcaacaaagatgccaagaaaaacgttgcagattggactagaactacgctcctatcatctggtgtcaggtcaacaattcagtcagcattcggtgtctaaatagaggcgccctaatgtcacatacagtggtgtgcaatttatgaatcagatgatgcattctgcttttgtttactttgcctagttgcttattgaccctatacatctttgtgtcccctgatatccttggtattgtttgattcactgtgacaaaagattgagggtcaagataggcacactactcaacctacaagttcttgatgttctttgtattttttagccttgtcactggtgacactgtatagcagctgaactggaaaacgttctacttgggatagattgtagtgtacagctaacatcttgaaacattatcatagtactgcatggagtttgtcttgtcgaacttttaaccatgaggcaaaagcaatggatgttgatgttgtgaaggagcatcttgcaggag

SEQ ID NO: 5038 - DNA, 1075 bp, Panicum virgatum
ccactacctttcacttttgaccctcgtcgtctcccacgtcgatcttgagggattcccccaaaacgaagcaaacaccgttagaaaaaccagcaagatccggcgaagaatcagaagcaggagcagaagctaaattcacgcggagagagctaggcgcggagaaagggtacgatggatcaacaaccccaggggattagtgagaactatgcaaatccgaagacatgcttattccatgtgctcttcaaggcagcagcattggcgttctacatactgtcagcgcttttcgtgaacaacttcgtcattatctttgtcatcactgtgctcctcgcagcactcgacttctgggttgtgaagaatgtcagtggaaggatattggttgggctgcggtggtggaacgagattaatgatgaaggagagagtgtctggaagtttgagtgtcttgatggagagtctctggctagaatgaacaagaaggactcatggctgttctggtggactctatatttgactgctgccgcatggattattcttggaatattctcgctcatcagacttcaagcagattaccttcttgttattggagtttgcttgagcctcagcattgcaaacattgttggtttcaccaaatgcaacaaagatgccaagaagaacatccaggattggactacaaatgccctcctatcagggagcgtcaggtcacatctgcagtcagcattcggtgtctgaactctgaacagatggcctacaacatggtgtcacgttgtaaaatttactgttaacatgatgacacattttcattttgttcatcctacctaattacttgccatatgaatacatggatctgcctccttgatgcccttggtaccgtttcatcttctgtcaccggaggatgattttgactagagttaaatgcagaatagcaccactctgtactaagcactgaaagctcctgattaactttgaagttggcttggccttctcgttgatgttgttgtgtccctagttaactgcaaaacattctgttgtgatggaatgccgtgtaattggtacatatacagttcttagttatccaggcgtg

SEQ ID NO: 5039 - DNA, 1090 bp, Panicum virgatum
tcccacgtcgatctcgagggattccccaggaacgaagcaaacgcaactaggaaaaccagtaagatccggcgaagaatcagaagcaggagcagaagccaaattcacgcggcgagagctaggcgcggagaaagggtccgatggatcaacaaccccaggggattagtgagaactatgcaaatccgaagacatgcttattccatgtgctcttcaaggcagcggcattggcgttctacatactgtcagcgctttttgtgaacaacttcgtcattatctttgtcatcactgtgctcctagcagcactcgacttctgggttgtgaagaatgtcagtggaaggatactggttgggctgcgctggtggaacgagattaatgacgagggagagagtgtctggaagtttgagtgccttgatggagagtctctggctaggatgaacaagaaggactcatggctgttctggtggactctatatttgactgctgctgcatggattattcttgggatattctcgctcatcagacttcaagcggattaccttcttgttattggagtttgcttgagcctcagcattgcaaacattgttggtttcaccaaatgcaacaaagatgccaagaagaacatccaggattggactacaaatgcccttctatcagggagcgtcaggtcacatctgcaatcagcattcggtgtctgaactctgaacagatggcctatgacatggtgtcacgtaggagtatagtgcttgctgtacaatttactgataacatgatggcacattttgattttgttcatcttacctaattaattgtcatatgaatagatggatctgcctcctcgatgcccttggtatgtttcatcttctgtcaccgaggatgattttgactagagttaaatgcagaatagcacctctctgtagtaagcacttgctagctcctgattaactttgaagttggcttggccttctcattgatgttgttgtgttgctagttaactgcaaaacattctgcttgtgacggaatgccgtgtgtattggtacatatacagttctgagttatccaggcgtgctgtggtgggaagcctttttgtcggagt

SEQ ID NO: 5040 - DNA, 1170 bp, Musa acuminata
gtttcgatgactaactggccacgaagcctcgtctgttctgctcgcatgcgactcgatcgccgagaccgccggaagggatcgagaatccccctcttgtgatggatccagttcagcctacaggggaaaactacgccaatccaaagacttgccttttccatgttcttttcaaggctgcggcgttggctttctacatactctcggcgatcttcattgacagttttgtgatcatttttgtggtcactgtctttcttgcggctcttgatttctgggtcgtcaagaatgtcagcgggaggattttggttgggctgaggtggtggaacgagattgacgagcagggagagagcatctggaagtttgagtgcttggatcaggagtctcttgcgcgtatgaataagaaggattcatggctcttttggtggacgctttatctcacggctgttgcatggatttttcttggtatattctcacttataaggttccaggcagattatctactggttgtgggagtttgtttaaccctcagcattgcgaatattgttggcttcactaaatgccgtaaagatgccaagaaacagatccaacaatttgccactcagaccatcgcttcgcgcttcacatcatccttgcagtcagcattcagtgttgtctgaaataacatcggataaagaattatgccagaggatgtcgtgtttgttaaacaaacaaatttgttctttttcttaaactctgtaggctatcagaaaacaacttaattgtctgtatcttagttccccacagtgctttccttcaatattaagtagtatacagtgtgttacaacagtctggtgctttgcaaataaaggaaaatgagattggaaatctaactctgcatcaattatcactcttcatggatgcttacatggtttaattttctgaccacagcttaacgtgattgtgaagtgctgttcctgccactctcctatgccaagtgccaaaatatatagtgagaaatattttatctagagatcagaaatttgagtctcttgtaaatgtctggtatgcttatcatgcaatattacctttgatccaatgagtaaaaactttggaaagacaaaacaaaattatcagtcaccagaaccaccatcatcagtatttgctggtgattcatggatactctcaagaggtaaaaag

SEQ ID NO: 5041 - DNA, 930 bp, Phaseolus coccineus
ggtccgaaatttgttggaggggtatgagatctggtatcctatagttccctcgtctctctttacttgcaagcttcgttcattctctttcatctctacacatggatcccaaccagtctgtgggtgaaaactacgccaatcccaagacttgcttctttcatgtcctcttcaaggccgcagccttggcattttacattctctcggccctctttattgataactttgtcatcatttttgtcgtgactgtccttcttgctgcccttgacttttgggtagtcaagaatgtgagtgggcgaattttagttggtttgaggtggtggaatgagattaatgatctgggtgagagtgtttggaaatttgagtgtcttgaccatgagtcattggctcggatgaacaagaaagattcttggcttttctggtggaccctgtaccttacggctattgcatggatttttctggcaatattctcactcataaggcttcaagctgattatctccttgttgttggagtttgtctgaccctgagcattgcaaatattgttggttttaccaaatgcaaaaaagatgccaagaagcagattcaacaatttgcctctcagacaattgcctctcggttctcatctaccctacagtcagcattcagtgtcgtctgattgtgaaagatggaaatacaagttgaattgagatcggtggaagtttgtacatgattatacagcacgtgcaaaattttgtactttttatgtgaaatggattgaatgagacttttatgattgaatagtaaaaacagttcttttaggtgtaaatcatgtttttttttgtattctttttgcattgaaggatattcaacattgactgcaaaaagtagctgtttcatataatcagaatattatctcatggaaatgaatgataattataaatgacgatgttgcatca

SEQ ID NO: 5042 - DNA, 839 bp, Musa acuminata
ggagcttcgtctggtctgctcgcatgcgactcgatcgccgagaccgccggaagggatcgagaatccccctcttgtgatggatccagttcagcctacaggggaaaactacgccaacccaaggacttgctttttccatgttcttttcaaggctgcagcgttggctttctacatactctccgcgatcttcattgacagttttgtgatcatttttgtggtcactgtctttcttgcggctcttgatttctgggtcgtcaagaatgtcagcgggaggattttggttgggctgaggtggtggaatgagattgacgagcagggagaaagcgtctggaagtttgagtgcttggatcaggagtctcttgcgcgtatgaataagaaggattcatggctcttttggtggacgctttatctcacggctgttgcatggatttttcttggtatattctcacttataaggttccaggcagattatctactggttgtgggagtttgtttaaccctcagcattgcgaatatagttggcttcactaaatgccgtaaagatgccaagaaacagatccaacaatttgccactcagaccatcgcctcgcgcttcacatcatccttacagtcagcattcagtgttgtctgaaataacatcggataaagaattatgccagaggatgtcgtgtttgttaaacaaacaaatatgttctttttcttaaactctgtaggctatcagaaaacaacttaattgtctgtatcttagtttcccacagtgctttccttcaatattaagtagtatacagtgtgttacaacagtctggtgctttgcaaataaaggaaaatgagattggaaaccg

SEQ ID NO: 5043 - DNA, 1054 bp, Glycine max
gggttaatgcgattttactcacaagtacttgtgctttgggaacaaattttggtctgaaaatcgttgctttgcagagtataagatcttgctcccacgtctctgattacttgcaagcttcatctgcactcatggatcccaaccagcctgtgggtgaaaactacgccaatcccaggacttgcttctttcatgtcctcttcaaggctgcagccttggcattttacattctctcggccctctttattgataactttgtcatcattttcgtggtgactgtccttcttgccgcccttgatttttgggtagtcaagaatgtcagtgggcgaattttagttggattgaggtggtggaatgaaattaatgatctgggtgagagtgtttggaaatttgaatgtcttgaccacgagtcattggctcggatgaacaagaaggactcatggcttttctggtggaccctgtatcttacagcgattctgtggattgtgctggctatattctcactcataaggcttcaagctgattatctccttgttgtaggagtttgtctgacccttagcattgcaaatattgttggttttaccaaatgcaaaaaagatgccaagaagcagattcaacaatttgcctctcagacaattgcctctcggttctcatctaccttacagtcagcgttcagtgttgtctgatcgtcaaagatggaaatgcaagttgaaccgttcattattgagatgcggtggaagtttgtacatgattatttcggccaggagcatcgaattggattgatcaaacttgcatagttactgatatagcaaatgcaaaattttgtactttttacatgaaatggcttgaatgagactttgatgatcaaattacatagtaaaacagttctttgtaggtgtaaatcatgtttttttcttgtattctttttgcatcgaaggattaagatttatattctgtattgactgcaataaatctttatggcatataatcaggatattgactcttggaaattgaaggataattataaattacgaggttgcatcatcaccgttgattggtc

SEQ ID NO: 5044 - DNA, 3093 bp, Triticum aestivum
gggagggggagagacgagttccgaaggggaacggaaaagaaagccaagccctctctcgcggaggccaacggcaaggcttcctcccttgcgccctcgatcagttcagcggttcggctcctcgggaccattgttggttcgctgaaatggagtcacacggtgatgacctgccaccaccaccaccactcccgccaaatgcagagccgataaaagctgagtcggctgatgacttgccaccaccaccacccctgccgcctatcaaacctgaagaagcaaagaagatctcaaagcctaagagggccctgatcgctcgtcctggttttggcaagaggggaaatcctatacagcttgtgacaaatcatttcaaagtctcgttgaagacgacagatgagttcttccatcattactatgtaaatctgaagtatgaagatgacaggcctgttgatggaaaaggtgttggtagaaaagtcattgataagctttcacagacttatgcatcggagctagcccataaagactttgcctatgatggtgaaaagagtctttttaccattggtgccctcccacaaattaacaatgagtttgttgtggttcttgaagacgtttccagtggaaagactcctgcaaatggcagccctggaaacgacagtccagacaagaagagagtgaaaagaccatatcagactaaaaccttcaaggtggagttgagctttgcagcaagaatccccatgagtgctattgcaatggcactcaaaggccaggaatcagagcacacgcaagaagccattcgggttattgatatcatattaagacaacactctgccaaacagggctgcctgttagtccgccagtcattttttcacaacaatccttcaaactttgtggacttgggtgggggtgtgatgggctgcagaggtttccactcaagctttcgagccacacagagtgggctttctcttaatattgatgtttctacaacaatgattgtgaaacctggccctgttgttgattttctgctggccaaccagaaggttgaccaccctaataaaattgattgggctaaggccaagcgtgcacttaagaatttaaggataaaaacaagcccagcaaatacagaatacaagattgttggtttgagtgagaggaattgttatgaacaaatgttttccctcaagcaaaggaatggtgggaatggtgaccctgaagcaatagaaatatctgtttatgattactttgtgaagaaccgtggcattgagctgaggtactctggtgatttcccttgtataaatgttgggaaacctaggcggccaacatattttcccattgagctctgccagctggtgcctttgcaaaggtataccaaatctttgagtaccctacaaagatcatctcttgttgagaagtccaggcagaagcctcaagagaggatgtcagttttgtctgatgtactgaaacgcagcagctatgatacagaacccatgctgaaggcatgtggaatttcgatagctcaaggctttactcaagtgtctggtagggtactgcaggcccccaagctcaaagctggaaatggtgaagatattttcacaaggaatggacgttggaatttcaacaacaagaggcttgctagagcttgtgtggtggacagatgggcggttgtaaacttttcggctaggtgtaacaccatgaaccttgtcaatgacctcatcaagtgtgggggcatgaagggcattacagtagaaaaacctcatattgtaattgaagagaatggttcaatgagacgtgcacctgctccaaaaagggttgaggatatgtttgagcaagtgaagtctaagcttcctggggctcccaagtttctcttgtgtattcttgctgagaggaagaactcagatgtttatggtccatggaagcgaaaatgccttgctgactttgggattgtcactcaatgtgtggccccaacaagggtcaatgaccaatatctgacaaatgttctgctgaagatcaatgcaaaacttggtggaatgaactcactgctacaaattgaaatgtccccaagtatacctcttgtatcaaaggtcccaactctcatcttgggaatggatgtgtcccatggatcccctggacagtctgatataccgtccattgcagcagttgttggttctcgggaatggcctcttgtctcgaaatatagggcttcagtgcgctcgcagtcaccaaagctagaaatgatagattcattgttcaagccacaaggaactgatgatgatggccttgttcgggagtgtctcattgacttctacaccagttctggaaaaaggaaaccagatcagatcatcatcttcagggatggtgttagtgagagccagtttaatcaggtgctgaacattgaattggatcaaataattgaggcctgcaagttcttggatgaaaattggaaccccaagttcacgctgattgttgctcagaaaaatcaccacaccaagttcttcatacctggatctcctgacaatgtccctccaggcactgttgtagataatgcagtctgccatccaaggaattatgacttctacatgtgcgctcatgctggaatgattgggactacaaggccaacgcactaccatatcctgcatgatgagatacactttgccgcggatgacctgcaggatcttgtgcactcgctctcgtatgtgtaccaaaggagcacgacagccatatcagttgtttctccaatctgctatgcacatcttgcggctgctcaggtggcgcagttcataaagtttgatgagatgtcagagacgtcgtcgagccagggtggtggccacacctctgccggcagtgccccagtgcaggagctgcctcgcctccatgagaaagtccgtagcagcatgttcttctgctgagccagcccgccagcctgctgcacttgcgcgttccaacttttggttatgcgcttggttatctagtactagtagtatgtggtagtggcctgtgatggcctgttgggactcctggtatgttgtgttcctaagctggttgccgcacttggtgcctcagaacctttgaatcctgttaggatgctgctgttgaacctttactatc

SEQ ID NO: 5045 - DNA, 3149 bp, Secale cereale
ggagtgttgctcaaagagggaggggagagacgagaagggaacggaaagaaagccaagccctctctcgcggaggcgccctcgcagatcagttcagtggtttggctcctccgggccatttttggttcgcgcaaatggagtcacacggtgatgacctgccaccaccaccaccactcccgccaaatgcagagccgataaaagctgagttggctgatgacttgccaccaccaccacccctgccgcctaacaaatctgaagaagcaaagaagatctcaaagcctaagagggccctgatcgctcgtcctggttttggcaagaggggaaatcctatacagcttgtgacaaatcatttcaaagtctcattgaagacgacagatgaattcttccatcattactatgtaaatctgaagtatgaagatgacaggcctgttgatggaaaaggtgttggtagaaaagtcattgataagctgcagcagacttatgcatcggatctagccaataaagactttgcctatgatggtgaaaagagtctttttaccattggtgccctcccacaaatcaacaatgagtttgttgttgtccttgaagacgtttccagtggaaagactcctgcaaatggcagccctggaaatgacagtccaggaaatgacaagaaaagagtgaaaaggccatatcagactaaaaccttcaaggtggagttaagctttgcagctagaatccccatgagtgctattgcaatggcactaaaaggccaggaatcagagcacacacaagaagccattcgggttattgatatcatattaagacaacactctgccaaacagggctgcctgttggtccgccagtcattttttcacaacaatccttcaaacttcgtggacttgggtgggggtgtgatgggctgcagaggtttccactcaagctttcgagccacacagagtgggctttctcttaatattgatgtttctacaacaatgattgtgaaacctggccctgttgttgattttctgctggccaaccagaaagttgaccaccctaataaaattgattgggccaaggccaagcgtgcacttaagaatttacggataaaaacaagcccagcaaatacagaatacaagattgttggtttgagtgagaggaattgttatgaacaaatgttttccctcaagcaaaggaatggtgggaatggtgaccctgaagcaatcgaaatatctgtttatgattactttgtgaagaaccgtggcattgagctgaggtactctggtgatttcccttgtataaatgttgggaaaccaaagcggccaacatattttcccattgagctctgccagctggtgcccttgcaaaggtataccaaatctttgagtaccctacaaagatcatctcttgttgagaagtccaggcagaagcctcaagagaggatgtcagttttgtctgatgtactaaaacgcagcagctatgatacagaacccatgctgaaggcatgtggaatttcgatagctcaaggttttacacaagtggctggtagggtactgcaggcccctaagctcaaagctgggaatggcgaagatattttcacaaggaatgggcgttggaatttcaataacaagaggcttgctagagcttgcgtcgtggatagatgggcagttgttaacttttcagctaggtgtaacaccacgaaccttgtcaatgacctcatgaagtgtggggccatgaagggcattacagtagaaaaacctcatattgtaattgaagagaatggttcaatgagacgcgcacctgctccaaaaagggtggaggatatgtttgagcaaatcaagtctaagcttcccggggctcccaaatttctgctgtgtattcttgctgagaggaaaaattctgatgtttatggtccatggaagcgaaaatgccttgctgactttgggattgtcactcagtgtgtggccccaacaagggtcaatgaccaatatctgacaaatgttctgctgaagatcaatgcaaagcttggtggaatgaactcactgctacaaattgaaatgtccccaagtatacctcttgtatcaaaggtcccaactctcatcttgggaatggatgtgtcccatggatcgcctggacagtctgatataccatccattgcagcagttgttggttctcgggaatggcctcttgtctcgaaatatagggcttctgtgcgctcgcagtcaccaaagctagaaatgatagattcattgttcaagccacaaggaactgatgatgatggccttgttcgggagtgtcttattgacttctacaccagttctggaaaaagaaaaccagatcagatcatcatcttcagggatggtgttagcgagagccagtttcatcaggtgctgaacattgaattagatcaaataattgaggcctgcaagttcttggatgaaaattggaaccccaagttcacgctgattgttgctcagaaaaatcaccacaccaagtttttcatgcctggatctcctgacaatgtccctcctggcacagtcgttgataatgcagtctgccatccaaggaattatgacttctacatgtgcgctcatgccggaatgatcgggactacaaggccaacacactaccatatcctgcatgatgagatacactttgctgcggatgacctgcaggatcttgtgcactcgctctcttatgtgtaccaaaggagcacaacagccatatcagttgtttctccaatctgctatgcgcatcttgcggctgctcaggtggcgcagttcatcaagtttgatgagatgtctgagacgtcgtcgagccagggcggtggccacacctctgccggcagcgccccagtgcaggagctgcctcgcctccatgagaaagtacgcagcagcatgttcttctgctgagccagccagcctgcccgccgcagtcgcgttggtgatgcgcttggttatctagtactagtatatgtagtagtggagtagtggcctgtgatggcctgttggactcctgggatgttatgttcctaagctggttgctgcacttggtgcctcagaacctttgaatcctgttaagatgctgctgttgaacctttactatcgaaccatacttaatttgctgtctttccttctctctgtcttgctctagttgtattttcttactgtaac

SEQ ID NO: 5046 - DNA, 3006 bp, Secale cereale
gatcagttcagtggtttggctcctccgggccatttttggttcgcgcaaatggagtcacacggtgatgacctgccaccaccaccaccactcccgccaaatgcagagccgataaaagctgagttggctgatgacttgccaccaccaccacccctgccgcctaacaaacctgaagaagcaaagaagatctcaaagcctaagagggccctgatcgctcgtcctggttttggcaagaggggaaatcctatacagcttgtgacaaatcatttcaaagtctcattgaagacgacagatgaattcttccatcattactatgtaaatctgaagtatgaagatgacaggcctgttgatggaaaaggtgttggtagaaaagtcattgataagctgcagcagacttatgcatcggatctagccaataaagactttgcctatgatggtgaaaagagtctttttaccattggtgccctcccacaaatcaacaatgagtttgttgttgtccttgaagacgtttccagtggaaagactcctgcaaatggcagccctggaaatgacagtccaggaaatgacaagaaaagagtgaaaaggccatatcagactaaaaccttcaaggtggagttaagctttgcagctagaatccccatgagtgctattgcaatggcactaaaaggccaggaatcagagcacacacaagaagccattcgggttattgatatcatattaagacaacactctgccaaacagggctgcctgttggtccgccagtcattttttcacaacaatccttcaaacttcgtggacttgggtgggggtgtgatgggctgcagaggtttccactcaagctttcgagccacacagagtgggctttctcttaatattgatgtttctacaacaatgattgtgaaacctggccctgttgttgattttctgctggccaaccagaaagttgaccaccctaataaaattgattgggccaaggccaagcgtgcacttaagaatttacggataaaaacaagcccagcaaatacagaatacaagattgttggtttgagtgagaggaattgttatgaacaaatgttttccctcaagcaaaggaatggtgggaatggtgaccctgaagcaatcgaaatatctgtttatgattactttgtgaagaaccgtggcattgagctgaggtactctggtgatttcccttgtataaatgttgggaaaccaaagcggccaacatattttcccattgagctctgccagctggtgcccttgcaaaggtataccaaatctttgagtaccctacaaagatcatctcttgttgagaagtccaggcagaagcctcaagagaggatgtcagttttgtctgatgtactaaaacgcagcagctatgatacagaacccatgctgaaggcatgtggaatttcgatagctcaaggttttacacaagtggctggtagggtactgcaggcccctaagctcaaagctgggaatggcgaagatattttcacaaggaatgggcgttggaatttcaataacaagaggcttgctagagcttgcgtcgtggatagatgggcagttgttaacttttcagctaggtgtaacaccacgaaccttgtcaatgacctcatgaagtgtggggccatgaagggcattacagtagaaaaacctcatattgtaattgaagagaatggttcaatgagacgcgcacctgctccaaaaagggtggaggatatgtttgagcaaatcaagtctaagcttcccggggctcccaaatttctgctgtgtattcttgctgagaggaaaaattctgatgtttatggtccatggaagcgaaaatgccttgctgactttgggattgtcactcagtgtgtggccccaacaagggtcaatgaccaatatctgacaaatgttctgctgaagatcaatgcaaagcttggtggaatgaactcactgctacaaattgaaatgtccccaagtatacctcttgtatcaaaggtcccaactctcatcttgggaatggatgtgtcccatggatcgcctggacagtctgatataccatccattgcagcagttgttggttctcgggaatggcctcttgtctcaaaatatagggcttctgtgcgctcgcagtcaccaaagctagaaatgatagattcattgttcaagccacaaggaactgatgatgatggccttgttcgggagtgtcttattgacttctacaccagttctggaaaaagaaaaccagatcagatcatcatcttcagggatggtgttagcgagagccagtttcatcaggtgctgaacattgaattagatcaaataattgaggcctgcaagttcttggatgaaaattggaaccccaagttcacgctgattgttgctcagaaaaatcatcacaccaagtttttcatgcctggatctcctgacaatgtccctcctggcacagtcgttgataatgcagtctgccatccaaggaattatgacttctacatgtgcgctcatgccggaatgatcgggactacaaggccaacacactaccatatcctgcatgatgagatacactttgctgcggatgacctgcaggatcttgtgcactcgctctcttatgtgtaccaaaggagcacaacagccatatcagttgtttctccaatctgctatgcgcatcttgcggctgctcaggtggcgcagttcatcaagtttgatgagatgtctgagacgtcgtcgagccagggcggtggccacacctctgccggcagcgccccagtgcaggagctgcctcgcctccatgagaaagtacgcagcagcatgttcttctgctgagccagccagcctgcccgccgcagtcgcgcgttggtgatgcgcttggttatctagtactagtatatgtagtagtggagtagtggcctgtgatggcctgttggactcctgggatgttatgttcctaagctggttgctgcacttggtgcctcagaaccttcgaatcccgttaagatgctgctgttgaacctttactatcgaacc

SEQ ID NO: 5047 - DNA, 3149 bp, Triticum aestivum
ggctaggggagtgttgttcgaggagaggggagggggagagacgagttccgaaggggaacggaaaagaaagccaagccatctctcgcggaggcgaacgacaaggcttcctcccttgcgccctcgatcagttcagcggttctgctcctccggaccattgtgggtttgctgaaatggagtcgcaaggtgatgacctgccaccaccaccaccactcccgccaaatgcagagccgataaaagctgagtcggctgatgacttgccactaccaccacccctgccgcctatcaaacctgaagaagcaaagaagatttcaaagcctaagagggccctgattgctcgtcctggttttggcaagaggggaaatcctatacagcttgtgacaaatcatttcaaagtctcgttgaagacgacagatgagttcttccaccattactatgtaaatctgaagtatgaagatgacaggcctgttgatggaaaaggtgttggtagaaaagtcattgataagctttcacagacttatgcatcggagctagcccataaagactttgcctatgatggtgaaaagagtctttttaccattggtgccctcccacaaattaacaatgagtttgttgtggttcttgaagacgtttccagtggaaagactcctgcaaatggcagccctggaaacgacagtccaggaaatgacaagaagagagtgaaaagaccatatcagactaaaaccttcaaggtagagttgagctttgcagcaagaatccccatgagtgctattgcaatggcactcaaaggccaggaatcagagcacacgcaagaagccattcgggttattgatatcatattaagacaacactctgccaaacagggctgcctgttagtccgccagtcattttttcacaacaatccttcaaactttgtggacttgggtgggggtgtgatgggctgcagaggtttccactcaagctttcgagccacacagagtgggctttctcttaatattgatgtttctacaacaatgattgtgaaacctggccctgttgttgattttctgctggccaaccagaaggttgaccaccctaataaaattgattgggctaaggccaagcgtgcacttaagaatttaaggataaaaacaagcccagcaaatacagaatacaagattgttggtttgagtgagaggaattgttatgaacaaatgttttctctcaagcaaaggaatggtggaaatggtgaccctgaagcaatagaaatatctgtttatgattactttgtgaagaaccgtggcattgagctgaggtactctggtgatttcccttgtataaatgttgggaaacctaggcggccaacatattttcccattgagctctgccagctggtgcctttgcaaaggtataccaaatctttgagtaccctacaaagatcatctcttgttgagaagtccaggcagaagcctcaagagaggatgtcagttttgtctgatgtactgaaacgcagtagctatgatacagaacccatgctgaaggcatgtggaatttcgatagctcaaggctttactcaagtgtctggtagggtactgcaggcccccaagctcaaagctggaaatggtgaagatattttcacaaggaatggacgttggaatttcaacaacaagaggcttgctagagcttgcgtggttgacagatgggcggttgtaaacttttcggctaggtgtaacaccatgaaccttgtcaatgacctcatcaagtgtgggggcatgaagggcattacagtagaaaaacctcatattgtaattgaagagaatggttcaatgagacgtgcacctgctccaaaaagggttgaggatatgtttgagcaagtgaagtctaagcttcctggggctcccaagtttctcttgtgtattcttgctgagaggaagaactcagatgtttatggtccatggaagcgaaaatgccttgctgactttgggattgtcactcaatgtgtggccccaacaagggtcaatgaccaatatctgacaaatgttctgctgaagatcaatgcaaaacttggtggaatgaactcactgctacaaattgaaatgtccccaagtatacctcttgtatcaaaggtcccaactctcatcttgggaatggatgtgtcccatggatcccctggacagtctgatataccatccattgcagcagttgttggttctcgggaatggcctcttgtctcgaaatatagggcttcagtgcgctcgcagtcaccaaagctagaaatgatagattcattgttcaagccacaaggaactgatgatgatggccttgttcgggagtgtctcattgacttctacaccagttctggaaaaaggaaaccagatcagatcatcatcttcagggatggtgttagtgagagccagtttaatcaggtgctgaacattgaattggatcaaataattgaggcctgcaagttcttggatgaaaattggaaccccaagttcacgttgattgttgctcagaaaaatcaccacaccaagttcttcattcctggatctcctgagaatgtccctccaggcactgttgtagataatgccgtctgccatccaaggaattatgacttctacatgtgcgctcatgctggaatgattgggactacaaggccaacgcactaccatatcctacatgatgagatacacttcgccgcggatgacctgcaggatcttgtgcactcgctctcgtatgtgtaccaaaggagcacaacagccatatcagttgtttctccaatctgctatgcacatcttgcggcagctcaggtggcgcagttcataaagtttgatgagatgtcagagacgtcgtcgagccagggtggtggccacacctctgccggcagtgccccagtgcaggagctgcctcgcctccatgagaaggtccgtagcagcatgttcttctgctgagccagcccgccagcctgctgcacttgcgcgttccaacttttggttatgcgcttggttatctagtactagtagtatgtggtagtggcctgtgatggcctgttgggactcctggtatgttgcgttcctaagctggttgccgcacttggtgcctcagaacctttgaatcctgttaggatgctgctgttgaacctttactatcaaaccatctaatttgctgctttc

SEQ ID NO: 5048 - DNA, 3014 bp, Secale cereale
tctctcgcggaggcgccctcgcagatcagttcagtggtttggctcctccgggccatttttggttcgcgcaaatggagtcacacggtgatgacctgccaccaccaccaccactcccgccaaatgcagagccgataaaagctgagttggctgatgacttgccaccaccaccacccctgccgcctaacaaatctgaagaagcaaagaagatctcaaagcctaagagggccctgatcgctcgtcctggttttggcaagaggggaaatcctatacagcttgtgacaaatcatttcaaagtctcattgaagacgacagatgaattcttccatcattactatgtaaatctgaagtatgaagatgacaggcctgttgatggaaaaggtgttggtagaaaagtcattgataagctgcagcagacttatgcatcggatctagccaataaagactttgcctatgatggtgaaaagagtctttttaccattggtgccctcccacaaatcaacaatgagtttgttgttgtccttgaagacgtttccagtggaaagactcctgcaaatggcagccctggaatgacagtccaggaaatgacaagaaaagagtgaaaggccatatcagactaaaaccttcaaggtggagttaagctttgcagctagaatccccatgagtgctattgcaatggcactaaaaggaccaggaatcagagcacacacaagaagccattcgggttattgatatcatattaagacaacactctgccaaacagggctgcctgttggtccgccagtcattttttcacaacaatccttcaaacttcgtggacttgggtgggggtgtgatgggctgcagaggtttccactcaagctttcgagccacacagagtgggctttctcttaatattgatgtttctacaacaatgattgtgaaacctggccctgttgttgattttctgctggccaaccagaaagttgaccaccctaataaaattgattgggccaaggccaagcgtgcacttaagaatttacggataaaaacaagcccagcaaatacagaatacaagattgttggtttgagtgagaggaattgttatgaacaaatgttttccctcaagcaaaggaatggtgggaatggtgaccctgaagcaatagaaatatctgtttatgattactttgtgaagaaccgtggtattgagcttaggtactctggtgattttccttgtataaatgttgggaaaccaaagcggccaacatactttcccattgagctctgccagctggtgcccttgcaaaggtataccaatctttgagtaccctacaaagatcatctcttgttgagaagtccaggcagaagcctcaagagaggatgtcagttttgtctgatgtactaaaacacagcagctatgatacagaacccatgctgaaggcatgtggaatttcgatagctcaaggttttacacaagtggctggtagggtactgcaggcccctaagctcaaagctggaaatggcgaagatattttcacaaggaatgggcgttggaatttcaacaacaagaggcttgctagagcttgcgtcgtggacagatgggcagttgttaacttttcagctaggtgtaacaccatgaaccttgtcaatgatctcatgaagtgtgggggcatgaagggcattacagtagaaaaacctcatattgtaattgaagagaatggttcaatgagacgcgcacctgctccaaaaagggtggaggatatgtttgagcaagtgaagtctaagcttcctggggctcctaagtttctgttgtgtattcttgctgagaggaagaactctgatgtttatggtccatggaagcgaaaatgccttgctgactttgggattgtcactcagtgtgtggccccaacaagggtcaatgaccaatatctgacaaatgttctgctgaagatcaatgcaaagcttggtggaatgaactcactgctacaaattgaaatgtccccaagtatacctcttgtatcaaaggtcccaactctcatcttgggaatggatgtgtcccatggatcgcctggacagtctgatataccatccattgcagcagttgttggttctcgggaatggcctcttgtctcgaaatatagggcttctgtgcgctcgcagtcaccaaagctagaaatgatagattcattgttcaagccacaaggaactgatgatgatggccttgttcgggagtgtcttattgacttctacaccagttctggaaaaagaaaaccagatcagatcatcatcttcagggatggtgttagcgagagccagtttcatcaggtgctgaacattgaattagatcaaataattgaggcctgcaagttcttggatgaaaattggaaccccaagttcacgctgattgttgctcagaaaaatcaccacaccaagtttttcatgcctggatctcctgacaatgtccctcctggcacagtcgttgataatgcagtctgccatccaaggaattatgacttctacatgtgcgctcatgccggaatgatcgggactacaaggccaacacactaccatatcctgcatgatgagatacactttgctgcggatgacctgcaggatcttgtgcactcgctctcttatgtgtaccaaaggagcacaacagccatatcagttgtttctccaatctgctatgcgcatcttgcggctgctcaggtggcgcagttcatcaagtttgatgagatgtctgagacgtcgtcgagccagggcggtggccacacctctgccggcagcgccccagtgcaggagctgcctcgcctccatgagaaagtacgcagcagcatgttcttctgctgagccagccagcctgcccgccgcagtcgcgttggtgatgcgcttggttatctagtactagtatatgtagtagtggagtagtggcctgtgatggcctgttggactccgtgggatgttatgttcctagctggttgctgcacttggtgcctcagaaccttcgaatcccgttaagatgctgctgttgaaccttt

SEQ ID NO: 5049 - DNA, 3097 bp, Triticum aestivum
aacggaaaagaaagccaagccctctctcgcggaggccaacggcgaggcttcctcccttgcgccctcgcagatcagttcagcggttcggctcctcgggaccattgttggttcgctgaaatggagtcacacggagaggacctgccaccaccaccaccactcccgccaaatgcagagccgataaaagctgagtcggctgatgacttgccaccaccaccacccctgctgcctatcaaacctgaagaagcaaagaagatctcaaagcctaagagggccctgatcgctcgtcctggttttggcaagaggggaaatcctatacagcttgtgacaaatcatttcaaagtctcgttgaagacgacagacgagttcttccatcattactatgtaaatctgaagtatgaagatgacaggcctgttgatggaaaaggtgttggtagaaaagtcattgataagcttgctcagacttatccatcggaactagcccataaagactttgcctatgatggtgaaaagagtctttttaccattggtgccctcccacaaattaacaatgagtttgttgtggttcttgaagatgtttccagtggaaagactcctgcaaatggcagccctggaaacgacagtccagacaagaagagagtgaaaaggccatatcaaactaaaaccttcaaggtggagttgagctttgctgctagaatccccatgagtgctattgcaatggcactcaaaggccaggaatcagagcacacgcaagaagccattcgggttattgatatcatattaagacagcactctgccaaacagggctgcctgttagtccgccagtcattttttcacaacaatccttcaaactttgtggacttgggtgggggtgtgatgggctgccgaggtttccactcaagctttcgagccacacagagcgggctttctcttaatattgatgtttctacaacaatgattgtgaaacctggccctgttgtcgattttctgctggccaaccagaaggttgaccaccctaataaaattgattgggctaaggccaagcgtgcacttaagaatttaaggataaaaacaagcccagcaaatacagaatacaagattgttggtttgagtgagaggaattgttatgaacaaatgttttccctcaagcaaaggaatggtgggaatggtgaccctgaagcaatagaaatatctgtttatgattactttgtgaagaaccgtggcattgagctgaggtactctggtgatttcccttgtataaatgttgggaaacctaggcggccaacatattttcccattgagctctgccagctggtccctttacaaaggtataccaaatctttgagtaccctacaaagatcatctcttgttgagaagtccaggcagaagcctcaagagaggatgtcagttttgtctgatgtactgaaacgcagcagctatgatacagaacccatgttgaaggcatgtggaatttcgatagctcagggctttacacaggtggctggtagggtactgcaggcccccaagctcaaagctggaaatggtgaagatattttcacaaggaatggacgttggaatttcaacaacaagaggcttgctagagcttgtgtggtggacagatgggcagttgtaaacttttcggctaggtgtaacaccatgaaccttgtcaatgacctcatcaagtgtgggggcatgaagggcattacagtagaaaaacctcatattgtaattgaagagaatggttcaatgagacgtgcacctgctccaaaaagggttgaggatatgtttgagcaagtgaagtctaagcttcctggggctccgaagtttctcttgtgtattcttgctgagaggaagaactcagatgtttatggtccatggaagcgaaaatgccttgctgactttgggattgtcactcaatgtgtggccccaacaagggtcaatgaccaatatctgacaaatgttctgctgaagatcaatgcaaaacttggtggaatgaactcactactacaaattgaaatgtccccaagtatacctcttgtatcaaaggtcccaactctcatcttgggaatggatgtgtcccatggatcccctggacagtctgatataccgtccattgcagcagttgttggttctcgggaatggcctcttgtctcgaaatatagggcttcagtgcgctcgcagtcaccaaagctcgaaatgatagattcattgttcaagccacaaggaactgatgatgatggccttgttcgggagtgtctcattgacttctacaccagttctggaaaaaggaaaccagatcagatcatcatcttcagggatggtgttagtgagagccagtttaatcaggtgctgaacattgaattggatcaaataattgaggcctgcaagttcttggatgaaaattggaaccccaagttcacgctgattgttgcccagaaaaatcaccacaccaaattcttcatacctggatctcctgacaatgtccctccaggcactgttgtagataatgcagtctgccatccaaggaattatgacttctacatgtgcgctcatgctggaatgattgggactacaaggccaacacactaccatatcctgcatgatgagatacactttgctgcggatgacctgcaggatcttgtgcactcgctctcatatgtgtaccaaaggagcacgacagccatatcagttgtttctccaatctgctatgcacatcttgcggctgctcaggtggcgcagttcataaagtttgatgagatgtctgagacgtcgtcgagccagggcggtggccacacctctgccggcagcgctccagtgcaggagctgcctcgcctccatgagaaagtccgcagcagcatgttcttctgctgagccagccagccagccgcacttgcgcgttccaacttttggtgatgcgcttggttatctagtactagtagtatgtagtagtggcctgtgatggcctgttggactcctgggatgttgtgttcctaagctggttgctgcacttggtgcctcagaacctttgaatcctgtcagggtgctgcagttgaacctttactatcgaaccatctaatttgttgctttccaaaaaaaaaaa

SEQ ID NO: 5050 - DNA, 3257 bp, Secale cereale
tgcctagggagtgttgctcgaagaggggagggggagagacgagaaggggaacggaaaagaaagccaagccctctctcgcggaggccaacggcaaggcctcctcccttgcgccctcgatcagttcagtggtttggctcctccgggccattgttggttcgcgcaaatggagtcacacggtgatgacctgccaccaccaccaccactcccgccaaatgcagagccgataaaagctgagtcggctgatgacttgccaccaccaccacctccgccgcctaacaaacctgaagaagcaaagaagatctcaaagcctaagagggccctgatcgctcgtcctggttttggcaagaggggaaatcctatacagcttgtgacaaatcatttcaaagtctccttgaagacgacagatgagttcttccatcattactatgtaaatctgaagcatgaagatgacaggcctgttgatggaaaaggtgttggtagaaaagtcattgataagctgcagcagacttatccatcggagttggcccataaagactttgcctatgatggtgaaaagagtctttttaccattggtgccctcccacaaatcaacaatgagtttgttgtggtccttgaagacgtttccagtggaaagacacctgcaaatggcagccctggaaatgacagtccaggaaatgacaagaagagagtgaaaaggccatatcagactaaaaccttcaaggtggagttaagctatgcagctagaatccccatgagtgctattgcaatggcactaaaaggccaggaatcagagcacacacaagaagccattcgggttattgatatcatattaagacaacactctgccaaacagggctgcctgttagtccgccagtcattttttcacaacaatccttcaaactttgtggacttgggtggggctgtgatgggctgcagaggtttccactcaagctttcgagccacgcagagcgggctttctcttaatattgatgtttctacaacaatgattgtgaaacctggccctgttgttgattttctgctggccaaccaaaaagttgaccaccctaataaaattgattgggccaaggccaagcgtgcacttaagaatttacggataaaaacaagcccagcaaatacagagtacaagattgttggtttgagtgagaggaattgttatgaacaaatgttttccctcaagcaaaggaatggtgggaatggtgaccctgaagcaatagaaatatctgtttatgattactttgtgaagaaccgtggtattgagcttaggtactctggtgattttccttgtataaatgttgggaaaccaaagcggccaacatattttcccattgagctctgccagctggtgcccttgcaaaggtataccaaatctttgagtaccctacaaagatcatctcttgttgagaagtccaggcagaagcctcaagagaggatgtcagttttgtctgatgtactaaaacgcagcagctatgatacagaacccatgctgaaggcatgtggaatttcgatagctcaaggttttacacaagtggctggtagggtactgcaggcccctaagctcaaagctggaaatggcgaagatattttcacaaggaatgggcgttggaatttcaacaacaagaggcttgctagagcttgcgtcgtggacagatgggcagttgttaacttttcagctaggtgtaacaccatgaaccttgtcaatgatctcatgaagtgtgggggcatgaagggcattacagtagaaaaacctcatattgtaattgaagagaatggttcaatgagacgcgcacctgctccaaaaagggtggaggatatgtttgagcaagtgaagtctaagcttcctggggctcctaagtttctgttgtgtattcttgctgagaggaagaactctgatgtttatggtccatggaagcgaaaatgccttgctgactttgggattgtcactcagtgtgtggccccaacaagggtcaatgaccaatatctgacaaatgttctgctgaagatcaatgcaaagcttggtggaatgaactcactgctacaaattgaaatgtccccaagtatacctcttgtatcaaaggtcccaactctcatcttgggaatggatgtgtcccatggatcgcctggacagtctgatataccatccattgcagcagttgttggttctcgggaatggcctcttgtctcgaaatatagggcttctgtgcgctcgcagtcaccaaagctagagatgatagattcattgttcaagccacaaggaactgatgatgatggccttgttcgggagtgtcttattgacttctacaccagttctggaaaaagaaaaccagatcagatcatcatcttcagggatggtgttagcgagagccagtttcatcaggtgctgaacattgaattagatcaaataattgaggcctgcaagttcttggatgaaaattggaaccccacgttcacgctgattgttgctcagaaaaatcaccacaccaagtttttcatgcccggatctcctgacaatgtccctcctggcacagtcgttgataatgcagtctgccatccaaggaattatgacttctacatgtgcgctcatgccggaatgatcgggaccacaaggccaacacactaccatatcctgcatgatgagatacactttgccgcggatgacctgcaggatcttgtgcactcgctttcttatgtgtaccaaaggagcacaacagccatatcagttgtttctccaatctgctatgcgcatcttgcggctgctcaggtggcgcagttcatcaagtttgatgagatgtctgagacgtcgtcgagccagggcggtggccacacctctgccggcagcgccccagtgcaggagctgcctcgcctccatgagaaagtacgcagcagcatgttcttctgctgagccagccagcctgcccgccgcagtcgcgcgttggtgatgcgcttggttatctagtactagtatatgtagtagtggagtagtggcctgtgatggcctgttggactcctgggatgttatgttcctaagctggttgctgcacttggtgcctcagaaccttcgaatcccgttaagatgctgctgttgaacctttactatcgaaccatctaatttgctgctttccttctctctgcttgctcagtttgttttttcttacttgtttgttttgtggtcttgcatggataatcacttgttctgaatctagagttggtaggatgagctagatatatacggtgggtga

SEQ ID NO: 5051 - DNA, 3015 bp, Secale cereale
cgatcagttcagtggtttggctcctccgggccatttttggttcgcgcaaatggagtcacacggtgatgacctgccaccaccaccaccactcccgccaaatgcagagccgataaaagctgagttggctgatgacttgccaccaccaccacccctgccgcctaacaaacctgaagaagcaaagaagatctacaaagcctaagacgggccctgatcgctcgtccttggttttggcaaggaggggaaatcctatacagtcttgtgacaaatctatttacaaagtctcattagaagacgacagatgaattcttccatcattactatgtaaatctgaagtatgaagatgacaggcctgttgatggaaaaggtgttggtagaaaagtcattgataagctgcagcagacttatgcatcggatctagccaataaagactttgcctatgatggtgaaaagagtctttttaccattggtgccctcccacaaatcaacaatgagtttgttgtcgtccttgaagacgtttccagtggaaagactcctgcaaatggcagccctggaaacgacagtccaggaaatgacaagaaaagagtgaaaaggccatatcagactaaaaccttcaaggtggagttaagctttgcagctagaatccccatgagtgctattgcaatggcactaaaaggccaggaatcagagcacacacaagaagccattcgggttattgatatcatattaagacaacactctgccaaacagggctgcctgttggtccgccagtcattttttcacaacaatccttcaaacttcgtggacttgggtgggggtgtgatgggctgcagaggtttccactcaagctttcgagccacacagagtgggctttctcttaatattgatgtttctacaacaatgattgtgaaacctggccctgttgttgattttctgctggccaaccagaaagttgaccaccctaataaaattgattgggccaaggccaagcgtgcacttaagaatttacggataaaaacaagcccagcaaatacagaatacaagattgttggtttgagtgagaggaattgttatgaacaaatgttttccctcaagcaaaggaatggtgggaatggtgaccctgaagcaatcgaaatatctgtttatgattactttgtgaagaaccgtggcattgagctgaggtactctggtgatttcccttgtataaatgttgggaaaccaaagcggccaacatattttcccattgagctctgccagctggtgcccttgcaaaggtataccaaatctttgagtaccctacaaagatcatctcttgttgagaagtccaggcagaagcctcaagagaggatgtcagttttgtctgatgtactaaaacgcagcagctatgatacagaacccatgctgaaggcatgtggaatttcgatagctcaaggttttacccaagtggctggtagggtactgcaggcccctaagctcaaagctgggaatggcgaagatattttcacaaggaatgggcgttggaatttcaataacaagaggcttgctagagcttgcgtcgtggatagatgggcagttgttaacttttcagctaggtgtaacaccacgaaccttgtcaatgacctcatgaagtgtggggccatgaagggcattacagtagaaaaacctcatattgtaattgaagagaatggttcaatgagacgcgcacctgctccaaaaagggtggaggatatgtttgagcaaatcaagtctaagcttcccggggctcccaaatttctgctgtgtattcttgctgagaggaaaaattctgatgtttatggtccatggaagcgaaaatgccttgctgactttggcattgtcactcagtgtgtggccccaacaagggtcaatgaccaatatctgacaaatgttctgctgaagatcaatgcaaagcttggtggaatgaactcactgctacaaattgaaatgtccccaagtatacctcttgtatcaaaggtcccaactctcatcttgggaatggatgtgtcccatggatcgcctggacagtctgatataccatccattgcagcagttgttggttctcgggaatggcctcttgtctcgaaatatagggcttctgtgcgctcgcagtcaccaaagctagaaatgatagattcattgttcaagccacaaggaactgatgatgatggccttgttcgggagtgtcttattgacttctacaccagttctggaaaaagaaaaccagatcagatcatcatcttcagggatggtgttagcgagagccagtttcatcaggtgctgaacattgaattagatcaaataattgaggcctgcaagttcttggatgaaaattggaaccccaagttcacgctgattgttgctcagaaaatcaccacaccaagtttttcatgcctggatctcctgacaatgtccctcctggcacagtcgttgataatgcagtctgccatccaaggaattatgacttctacatgtgcgctcatgccggaatgatcgggactacaaggccaacacactaccatatcctgcatgatgagatacactttgctgcggatgacctgcaggatcttgtgcactcgctctcttatgtgtaccaaaggagcacaacagccatatcagttgtttctccaatctgctatgcgcatcttgcggctgctcaggtggcgcagttcatcaagtttgatgagatgtctgagacgtcgtcgagccagggcggtggccacacctctgccggcagcgccccagtgcaggagctgcctcgcctccatgagaaagtacgcagcagcatgttcttctgctgagccagccagcctgcccgccgcagtcgcgcgttggtgatgcgcttggttatctagtgtagtagtggagtagtggcctgtgatggcctgttggactcctgggatgttatgttcctaagctggttgctgcacttggtgcctcagaacctttgaatcctgttaagatgctgctgtcgaacctttactatcgaaccatctaatttgc

SEQ ID NO: 5052 - DNA, 3298 bp, Hordeum vulgare
tcaaatggagtcgcatgttgttgagggtgatgacctgccaccgccaccacctctcccaccaaatgcagagccggtaaaagctcagtcggctgatgacttgccgcggccgccacccctgccgcctgtcaagcctgaagaagcaaagaagatatcaaagcctaggagagccctgattgctcgtcctggttttggcaagaggggaaatcctatacagcttgttaccaatcatttcaaagtttcgttgaagacaacagatgagttcttccaccattactatgtaaatctgaagtatgaagatgacaggcctgttgatggaaaaggtgttggtagaaaagtcattgataaactgcagcagacttatgcatctgatctagctcataaagactttgcctatgatggtgaaaagagtctttttaccattggcgcccttccacaaatcaacaatgagtttgttgtggttcttgaagacttttccactggaaagactcctgcaaatggcagccctggaaatgacagtccaggaaatgacaagaagagagtgaaaaggccatatcagactaaaactttcaaggtggagttaagctttgcagctagaatccccatgagtgctattgcaatggcactaaaaggacaggaatcagagcacacgcaagaagccattcgggttattgatatcatattgaggcaacactctgccaaacagggctgcctgttagtccgtcagtcattttttcacaacaatccttcaaactttgtggacttgggtggaggggtaatgggctgcagaggtttccactcaagctttcgagccacacagagtgggctttctctcaatattgatgtttctaccacaatgattgtgaaacctggacctgttgttgattttctgctggccaaccagaaggttgaccaccctaacaaaattgattggcctaaggccaagcgtgcactcaagaatttaaggataaaaacaagcccagcaaatacagaatacaagattgttggtttgagtgataggaactgttatgaacaaatgttttccctcaagcaaaggaatggtgggaatggtgaacctgaagcaatagaaatatctgtgtatgattactttgtgaagaaccgtgggattgagcttaggtactctggtgatttcccttgtataaatgttgggaaacctaagcggccaacgtattttcccatcgagctctgccagctggtgcctttgcaaaggtacaccaaatctttgagtaccctacaaagatcatctcttgttgagaagtccaggcagaagcctcaagagaggatgtcagttttgtctgatgtgctgaagcgcagcagctatgatacagaacccatgctgagggcatgtggaatttcaatagctcaaggttttacacaggtggctggtagggtactgcaggctcccaagctcaaagctggaaatggtgaagatattttcacaaggaatgggcgttggaatttcaacaacaagaggcttgctagagcttgtgtcgtggacagatgggcggtggttaacttttcagctaggtgtaacaccgtcaaccttgtcagtgacctcatcaagtgtggggccatgaagggcattacagtagaaaaacctcatacgataattgaagagaatggtgcaatgagacgtgcacctgctccaaaaagggttgaggatatgtttgagcaagtgaagtctaaacttcctggggctcccaagtttctgttgtgtgtccttgccgagaggaagaactctgatgtttatggtccatggaagcgaaaatgccttgctgactttgggattgtcactcaatgtgtggccccaacaagggtcaatgaccaatatctgacaaatgttttgctgaagatcaatgcaaaacttggtggaatgaactcactgctacaaattgaaatgtccccaagtatacctcttgtatcaaaggtcccaactctcatcttgggaatggatgtgtcccatggatcccctggacagtctgatataccatccattgcagcagttgttggttctcgagaatggccccttgtctcgaaatatagggcttcagtgcgctcgcagtcaccaaagctagaaatgatagattcattgttcaagccacaaggaactgaagatgatggccttgttcgggagtgtctcattgacttctacaccagttctggaaagagaaaaccagatcagatcatcatcttcagggatggtgttagcgagagccagtttaatcaggtgctgaacatcgaattagatcaaattattgaggcctgcaagttcttggatgaaaattggaaccccaagttcacactgattgttgctcagaagaatcaccacacaaagtttttcatgcctggatctcctgacaatgtccctcctggcactgttgttgataatgctgtctgccatccaaggaattatgacttttacatgtgcgctcatgctggaatgattgggacaacaaggccaacacattaccatatcctgcatgatgagatacactttgccgcggatgacctgcaggatcttgtgcattcgctctcttatgtgtaccaaaggagcacaacagcaatatcagttgtttctccaatctgctatgcacatcttgcagctgctcaggtggcgcagttcataaagtttgatgagatgtccgagacgtcgtcgagccagggtggtggccacacctctactgccagcggcccggtgcaggagctgcctcgtctccatgagaaagtccgcagcagcatgttcttctgctgagcgctagtcgcacttgcgcgttccaacttttggtgatgcgcttatctaataccagtatgtagtgatggtagtagtggcccctttgatgacctgttggacacctgggatgttgtgttcctaagcttgctgccacactttggtgcctcagaacctttggattatgatagtatggtgctgttgaaccgtcaaatttgcacctttgaattatgttagtatggtgctgttgaaccttcaaatttgcacctttgaattatgttagtatggtgctgttgaaccttcaaatttgctgctttacgtctctatgcttgcttggttcgtttttctttctgtgtgcttgcttggtgctgttgaaccttcaaatttgctgctttacgtctctatgcttgcttggttcgtttttctttctgtgtgcttgcttggtgctgttgaaccttcaaatttgctgctttacgtctctatgcttgcttggttcgtttttctttctgtgtgcttgcttggtgctgttgaaccttcaaatttgctgctttc

SEQ ID NO: 5053 - DNA, 3150 bp, Hordeum vulgare
aaaagaaaagccaggggggcgaacggccaagccttcttcctcccttgcgccctcgactagttcagcggttcggctcctccggactgttccctgtttccccaaatggagtcgcatgttgttgagggtgatgacctgccaccgccaccacctctcccaccaaatgcagagccggtaaaagctcagtcggctgatgacttgccgcggccgccacccctgccgcctgtcaagcctgaagaagcaaagaagatatcaaagcctaggagagccctgattgctcgtcctggttttggcaagaggggaaatcctatacagcttgttaccaatcatttcaaagtttcgttgaagacaacagatgagttcttccaccattactatgtaaatctgaagtatgaagatgacaggcctgttgatggaaaaggtgttggtagaaaagtcattgataaactgcagcagacttatgcatctgatctagctcataaagactttgcctatgatggtgaaaagagtctttttaccattggcgcccttccacaaatcaacaatgagtttgttgtggttcttgaagacttttccactggaaagactcctgcaaatggcagccctggaaatgacagtccaggaaatgacaagaagagagtgaaaaggccatatcagactaaaactttcaaggtggagttaagctttgcagctagaatccccatgagtgctattgcaatggcactaaaaggacaggaatcagagcacacgcaagaagccattcgggttattgatatcatattgaggcaacactctgccaaacagggctgcctgttagtccgtcagtcattttttcacaacaatccttcaaactttgtggacttgggtggaggggtaatgggctgcagaggtttccactcaagctttcgagccacacagagtgggctttctctcaatattgatgtttctaccacaatgattgtgaaacctggacctgttgttgattttctgctggccaaccagaaggttgaccaccctaacaaaattgattggcctaaggccaagcgtgcactcaagaatttaaggataaaaacaagcccagcaaatacagaatacaagattgttggtttgagtgataggaactgttatgaacaaatgttttccctcaagcaaaggaatggtgggaatggtgaacctgaagcaatagaaatatctgtgtatgattactttgtgaagaaccgtgggattgagcttaggtactctggtgatttcccttgtataaatgttgggaaacctaagcggccaacgtattttcccatcgagctctgccagctggtgcctttgcaaaggtacaccaaatctttgagtaccctacaaagatcatctcttgttgagaagtccaggcagaagcctcaagagaggatgtcagttttgtctgatgtgctgaagcgcagcagctatgatacagaacccatgctgagggcatgtggaatttcaatagctcaaggttttacacaggtggctggtagggtactgcaggctcccaagctcaaagctggaaatggtgaagatattttcacaaggaatgggcgttggaatttcaacaacaagaggcttgctagagcttgtgtcgtggacagatgggcggtggttaacttttcagctaggtgtaacaccgtcaaccttgtcagtgacctcatcaagtgtggggccatgaagggcattacagtagaaaaacctcatacgataattgaagagaatggtgcaatgagacgtgcacctgctccaaaaagggttgaggatatgtttgagcaagtgaagtctaaacttcctggggctcccaagtttctgttgtgtgtccttgccgagaggaagaactctgatgtttatggtccatggaagcgaaaatgccttgctgactttgggattgtcactcaatgtgtggccccaacaagggtcaatgaccaatatctgacaaatgttttgctgaagatcaatgcaaaacttggtggaatgaactcactgctacaaattgaaatgtccccaagtatacctcttgtatcaaaggtcccaactctcatcttgggaatggatgtgtcccatggatcccctggacagtctgatataccatccattgcagcagttgttggttctcgagaatggccccttgtctcgaaatatagggcttcagtgcgctcgcagtcaccaaagctagaaatgatagattcattgttcaagccacaaggaactgaagatgatggccttgttcgggagtgtctcattgacttctacaccagttctggaaagagaaaaccagatcagatcatcatcttcagggatggtgttagcgagagccagtttaatcaggtgctgaacatcgaattagatcaaattattgaggcctgcaagttcttggatgaaaattggaaccccaagttcacactgattgttgctcagaagaatcaccacacaaagtttttcatgcctggatctcctgacaatgtccctcctggcactgttgttgataatgctgtctgccatccaaggaattatgacttttacatgtgcgctcatgctggaatgattgggacaacaaggccaacacattaccatatcctgcatgatgagatacactttgccgcggatgacctgcaggatcttgtgcattcgctctcttatgtgtaccaaaggagcacaacagcaatatcagttgtttctccaatctgctatgcacatcttgcagctgctcaggtggcgcagttcataaagtttgatgagatgtccgagacgtcgtcgagccagggtggtggccacacctctactgccagcggcccggtgcaggagctgcctcgtctccatgagaaagtccgcagcagcatgttcttctgctgagcgctagtcgcacttgcgcgttccaacttttggtgatgcgcttatctaataccagtatgtagtgatggtagtagtggcccctttgatgacctgttggacacctgggatgttgtgttcctaagcttgctgccacactttggtgcctcagaacctttggattatgatagtatggtgctgttgaaccgtcaaatttgcacctttgaattatgttagtatggtgctgttgaaccttcaaatttgcacctttgaattatgttagtatggtgctgttgaaccttcaaa

SEQ ID NO: 5054 - DNA, 3206 bp, Oryza sativa
aagagagagagagagagtgtgtgtggagaggcgaggcgttcgagtttcgagaggagggaggggggacaaggaggaggagcgcaccaccctctcggagaggtcgcctccgttcttgcatcgttttctttggatagggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctctgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctgaattttgcttgcatccgttggaatcagctcatgttttcttggaacccatgtagccgtgtactccctccctccgtccca

SEQ ID NO: 5055 - DNA, 3128 bp, Oryza sativa
aagagagagagagagagtgtgtgtggagaggcgaggcgttcgagtttcgagaggagggaggggggacaaggaggaggagcgcaccaccctctcggagaggtcgcctccgttcttgcatcgttttctttggatagggcagcgctttgacagctttggggagttagtcgagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagggttgccttttggttcgccaatcctttttccataacaatccttcaaattttgttgacttgggtggtggtgtgatgggctgtaggggattccattcaagcttccgagctacacagagtggactttcactcaatatcgatgtgtccacaacgatgattgtgaaacctggtcctgtggtagattttctacttgccaaccagaaggttgatcacccaaacaaaattgactgggcaaaggccaagcgtgctctgaagaatttaaggataaaaacaagtccagcaaatactgaatacaagattgttggtttgagtgagagaaactgctatgaacaaatgttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgagctctgctctcttgtgcctttgcaaaggtataccaaggctttgagtacactacagaggtcttcgcttgttgagaagtccaggcagaaacctgaagaaaggatgtcagttttgtctgatgtgctgaaacgcagcaactatgattcagagcctatgttgaattcttgtggtatttcaattgctcgaggttttacacaagttgctggcagggtgctgcaggcccccaagctaaaagctggaaatggtgaagatctttttgcacgtaatgggcggtggaactttaataataagaggctcattaaggctagcagtatcgagaaatgggcagttgttaacttctctgcacggtgtaatattagggatcttgtccgagacatcatcaagtgtggtggcatgaaaggaattaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatgggccctggaagcggaaatgtcttgctgaatttgggattattacacaatgtgtggcccctactagggtcaatgatcagtatattacaaatgtactgttaaagataaatgcaaagcttggtggcttgaactccctgcttcaaattgaaacatccccttccattcctcttgtatccaaggtcccgacaataatattgggaatggatgtttcccatggatcacctggacagtctgatataccttcaattgctgcggtcgttagttctcgtgaatggcctcttgtatcaaaatacagggcttcagtccgttctcagtcacctaagttagaaatgattgatggactatttaagccacaaggagctcaggaagatgatggcctcattcgggagttattagttgacttctataccagtactggtaaacgtaagcctgatcaagtcattatcttcagggatggggtcagtgagagccagtttacccaggtgctgaacattgagctggatcaaataattgaggcatgcaagtttcttgacgaaaactggtctccaaagtttacactgattgttgcacagaagaatcatcataccaaattttttgtgcctggatctcaaaataacgttcctcctggtactgttgtggacaacgcagtctgtcatccaaggaacaatgacttctacatgtgtgcgcacgctggaatgattggaactacaaggcctacacattatcatatccttcatgatgagataggcttctctgctgacgatcttcaggagttggtccactccctttcctatgtctaccagaggagcactacagccatatcagtcgttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctg

SEQ ID NO: 5056 - DNA, 3239 bp, Setaria italica
cgaggataactaaatggagtctcacaatggcgaggctgatgacttgcctcctccacctcccctaaatgcgggcgatgaacctcttaaagctgaggaaacaaagaagctgtcaaaacctaagagggttctcgtccctaggaaaggttttggcaaaaaggggcagccaatacgtcttgtaacaaaccacttcaaagtttccttaaagaacactgaagagtttttcttccattactatgtgaatttgaaatatgaagatgacacaccggttgatcgcaagggagcaggaagaagtgtgatcgagaaacttcagcagacttatgccactgaacttgcaaataaagattttgcatatgatggtgagaagagcctgttcacaattggtgctcttcctcaagttaataacgagttcaccgttgtggtggaagatgtttcaaccggaaagactcctgcaaatggcagccctggcaatgatagtccacctggaagtgaccggaaaagggtcagaaggccttacaacacaaagacgtataaagttgagctgtcttttgctgcaaggattcctatgaatgcaattgctcatgccttgagaggtcaggaatctgagcatactcaggaagcaattcgggtgattgatattatcttgaggcagcactcagcgaagcagggttgcttgctagtgaggcagtcgttctttcacaacaatccttcaaactttgttgacctcggtggcagtgtaatgggctgtcgaggattccattctagttttcgtgcaacacagagtggactttcacttaatattgacgtatccacaacaatgatagtgaaaccaggtcctgttgttgattttctacttgccaaccagaaggttgaccatcctaacatgattgactgggcaaaggcaaagcgctcgttgaggaacttaaggataaaaataactccaacaaatgcagaaaataagattgctggtttgagtgacaagccttgccgagaaacaatgtttacactaaagcgtagaaatggagacaatggtgactctgaagagatcagtgtttatgatcactttgtaaagaaccgtggcatagaacttaggtactctggtgactttccttgtatcaatgtgggaaaaccaaagcgcccatcatattttcccatagagttgtgtaaccttgtgtctttacaaagatacactaaggcattgagtacacttcagaggtcttcacttgttgagaagtctaggcagaaaccccaagaaagaatgtcagttctgtctgatgtcctgcaacgcagcaactacgactcagagcctatgctaatggcatgtggtatttcaatagcaaaaagtttcactgaagttgatggtagggtgctgcagccccccaagcttaaagctggaaatggagaagacatttttacacgcaatgggagatggaacttcaacaataagaggctcattagagcaagcagtgttgacaaatgggcagtggtcaacttttctgcgcgctgtaatgtcagggaccttgtccgagatcttatcaagtgtggaggcatgaagggaatcaaagtagaaccaccttttaatgcatttgaagagaatccttctatgaggcgggcacctgctgtaagaagggttgaggacatgtttgaacaagtgaaaacaaagcttcctggagcacctaagtttcttttgtgtgttcttgctgagaggaagaattctgatgtttatgggccgtggaagaagaaatgccttgcagaatttgggatcgttacacagtgtgtggcaccaacaagagttaatgatcagtaccttaccaatgtcctgctaaaaataaatgcaaagctggggggcttaaattcaatgctccaagttgaatcatcccctgcaatgcctcttatatccaaggtcccaactatgattttgggaatggatgtgtcccatggttctcctggacaatctggtgtaccttcaattgcagctgttgtcagctctcgtgaatggcctcttatatcaaaatatagagcttcggtgcgctcacaatcacctaaaatggaaatgattgactccttgtttaagccaaggggaactgatgatgatggcctgattcgggagtgtctgattgacttctacaccagttctgggaagagaaagccagatcaaatcatcatcttcagggatggtgttagtgagagtcagtttaatcaggtgctgaacattgagttggatcagataatagaggcatgcaagtttttggatgaaaaatggaatcccaagttcacattgattattgcccagaagaatcatcatacgaaatttttcattcctggcgctccagaaaatgtgcctcctggtaccgttgtggacaacaaggtctgccatccaaggaactatgacttctacatgtgttcccatgctggaatgatagggactacgagacctacacattatcacatccttcatgatgagataggcttcaaccctgatgaccttcaggagctcgtgcactcactctcttatgtataccaaaggagcacaacagccatatcagttgttgctcccatctgctacgcacatcttgctgctgcccaggtcggacagttcattaagtttgaagagatgtcggagacgtcctccagtcagggcgagcacacctcggcgggcagtgtccctgtgcaggagctgccccgcctgcacgagaaggtccggagctccatgttcttctgctgagctgcagagcacttcgcgtgtgctgtggtctgctactggtgtatgcttggcggtttggaacctcagtctgttgtggcggtcagcactcgccattcatcatgggtttgcttttggtggatgtttctgaaccttggtagttaatcatgccggcattggtagacatctggtggcatgatgcccctaaactgattgcctgcctcaggaagactctggaacctgttaggatgtcgctgatcgctatttgccactgctccagttgttttaatcgtcagctcatgtttcgtcaatcttgtttctgctatctctttgttggttgctatcggcttctggtgcttcagtgattgcaccgattatcgatgatgattgatctgatgatcgttgcagctcattgatgcaaatctcttggcgagttgaaacaaggaaaccccctgctatgctagcagtgctgtttgcctggggtccagttgaagttggcaacaaggtcaagttgatctatcagccaatcagtttgaaacct

SEQ ID NO: 5057 - DNA, 3436 bp, Pennisetum glaucum
gaaggtgggtgctctgttggaaagggcgcagggggaggagttctcggagaggtcgccttcgtctcccaccactgagactgactcgggtgcagctttacactagagacacttgcctgcgaggataaccaaatggagtctcacaatggcgaggctgaagacttgcctcctccacctcctctaaattcgggcgatgaacctcttaaagccgaggaaataaagaagctgtcaaaacctaagagggctcttgtccctaggaaaggttttggcaaaaagggccagccaatacgtcttgtaacaaaccatttcaaagtttccttaaagaacactgaagaatttttctatcactactatgtgaatttgaaatatgaagatgatacaccggttgatcgcaagggagcaggaagaagtgtgattgagaaacttaagcaaacttatgccactgaacttgcaaataaagattttgcatatgatggtgagaagagcctgttcacaattggtgctcttcctcaaattaataacgagttcactgttgtggtggaagacatttcaaccggaaagactcctgcaaacggcagccctggcaatgatagtccacctggaagtgacaggaaaagagtcagaagaccttacaacacgaagacatataaagttgagctgtcttttgctgcaaagattcctatgaatgctattgctcatgccttgagaggtcaggaatctgagcatacccaggaagcaattcgggtgattgatattattttgagacagcactcagcgaagcagggttgccttctggtgaggcagtcgttcttccacaacaatccttctaactttgttgaccttggtggtggtgtaatgggctgtagaggattccattccagtttccgtgcaacacagagtggactttcactaaatattgatgtgtccacaactatgatagtgaaaccaggtccagttgttgattttttgattgccaaccagaaggttgatcacccgagcaagattgactgggcaaaggcaaagcgctcattgaagagtttaaggataaaaataaatccaacaaattcagaaaataagattgttggtttgagtgagaagccttgccgagaaacaatgtttacgctaaagcgtagaaatggagacagtgttgagtctgaagagatcagtgtttatgatcacttcgtaaagaaccgtggcatagagcttaggtactctgctgaccttccttgtataaatgtgggaaaaccaaaacgcccttcatattttcccatagagttgtgtaatcttgtgtcgttacaaagatacacaaagtctttgagtacccttcagaggtcttcacttgttgagaagtctaggcagaaaccccaagaaagaatgtcagttctgtctgatgtcctgcagcgcagcaactatgattccgagcctatgctgatggcatgtggcatttcaatagcaaaaagtttcactgaagttgatggtagagtgctgcagccccccaagcttaaagctggaaatggagaagacatttttacacgcaatgggagatggaacttcaacaataagaggcttattagagcaagcagtattgacaaatgggctgtggtcaacttttctgcgcgttgcaatgtcagggaccttgtccgagatcttatcaaatgtgggggcatgaagggaatcaatgtagaaccacctttcaatgtatttgaagagaatccttctatgaggcgggcacctcctgtaagaagggttgaggacatgtttgaacaagtgaaaacaaagcttcctggagcacctaaatttcttttgtgtattcttgctgagaggaagaattctgatgtttatgggccttggaagaagaaatgccttgcggaatttggtattgtcacacagtgtgtggcaccaacaagagtgaatgatcagtaccttaccaatgtcctgctaaaaataaatgcaaagctgggtggcttaaattcattgctccaagttgaatcatccccagcaatgcctcttatatccaaggtcccaactatgattttgggaatcgacgtgtcgcatgggtctcctggacaatctggtgtaccatcaatcgcagcagttgtcagttctcgtgaatggcctcttatatcaaaatatagggcttcggtgcgttcacaatcacctaaaatggaaatgatagactctttgtttaagccaaggggaactgatgatgatggcctaattcgggagtgtctgattgacttctacaccagttctgggaagagaaagccagatcaaatcatcatcttcagggatggtgttagtgagagtcaatttaatcaggtgctgaacattgagttggataaaatcatagaggcatgcaagtttttggatgaaaaatgggaccccaagttcacattgattgttgcccagaagaatcaccacacaaaatttttcattcctggagtcccagataatgtgcctcctggtactgttgtggacaacaaagtctgccatccaaagaactatgacttctacatgtgttcacatgctggaatgatagggactacaagacctacacattatcacatccttcatgatgagataggcttcaaccctgatgacctgcaggaacttgtgcactcactctcttatgtgtaccaaaggagcacaacagccatatcagttgttgctcccatctgctacgcacatcttgctgccgcccaggtcgggcagttcatcaagtttgaagagatgtcagagacctcctccagccacggtgagcacacctcggcaggcagtgtccctgtgcaggagctgccccgccttcatgagaaggttcggagctccatgttcttctgctgagctgcagagcactttggggtctgcttctggtgtatgctcggcagtttggaaccttgttgtggcggtcagcactggccattatcatgggtttacttttggtggatgtttctgaaccttggtagttaatcttgctggcattggtagacatctggtggcatgatgcccctaaactgattgcctgcctcaggaaagactctggaacctgtcagaacgttgctgatcgctatctgccactgcaccagttgcattaatcgttagctcatgtttcgtgactctgtttctggaatctcttctgtggctgccatctgctcgtggtgtttcagtggtagctcatctagagactgccctgatgatcaatgatgatcaataatcgttgcagctcattggtgcaaatctctggcgagttgaaaaccacgaaaccccttgctatgttatcagcctagcagtgctatttgcctggggttcggttgaagttggcaacacggtcaggttgatctatccgccttctaagcctaacagcttgcatgtatgctgcgattgagttttgtgttctgatcatctctggtggtagttatagtgtgacttggttaagtacgat

SEQ ID NO: 5058 - DNA, 3173 bp, Panicum virgatum
ggcggaggggggaagcgaagttctcggaggggtcgccattgtcttcctccactgtctcggattgggcagcggctttgggccggatacagttgcctgtgaggctaacgaaatggattctcacaacggggaggctgatgacttgcctcctccacctcctctaaatgcgtgcattgaacctcttaaatctgaggaaacaaagaagctgttgaaacctaagagggctctgatccctaggaaaggttttggcaaaaaggggcagcaaataaggcttgtaacaaaccacttcaaagtttcgctgaagaacactgacgaatttttctatcactactacgtgaatttgaaatacgaagatgatacacctgttggcaagggagccggcaggagtgtgattgagaaacttcagcaaacctatgccactgaacttgcaaacaaagattttgcgtatgatggtgagaagagcctgttcacaattggtgctcttcctcaaaatattaacgagttcactgttgtggtggaagatgtttcaactggaaagactcctgcaaatggcagccctggcaatgacagtccacctggaagtgacaggaaaagggtcagaaggccttacaatacaaagacgtacaaagttgagctgtctttcgcagcaaaaattcctatgaatgcaatcgcacatgctttgaaaggtcaggaatcagagcatactcaggaagcgattcgagtgattgatattattctgaggcagcactcagcaaaccagggttgcctcttggttcgtcaatcattcttccataacaatccttccaactttgttgagcttggaggtggtgtaatgggctgtagaggattccattccagtttccgtgccacacagagtggactttcactaaacattgatgtgtcaacaacaatgatagtacaacctggtcctgtcattaattttctacttgccaaccagaaggttgacaatccaaacaagattgactggcaaaaggcaaagcgctcattgaagaacttgaggataaaaataaccccaacgaatgctgtgaacaagattgttggtctgagtgacaggccttgccgagaaacaatgtttacactaaagcgtagaaatggtgacaatggtgactctgaagagatcagtgtttatgatcacttcgtaaagaaccgtggcatagagctcaaatactctgctgactttccttgtatcaacgtgggaaaacaaaagcggccatcttattttccaatagagctctgtacgcttgtgtctttacaaagatacaccaagtcattgactacacttcagaggtcttcacttgttgagaagtctaggcagaaaccccaagaaaggatgtctgtgctatctgatgtactgaaacgcagcaactacgattcagagcctatgctaaaggcatgtggcatttcaattgctaaaagtttcactgaggttgatggtagggtgctgcaagcccccaagctcaaagctggtaatggagaagacatttttacacgcaatgggagatggaacttcaacaataagaggctcattaaagctagcagtgttgacaaatgggcagtagtcaacttttctgcacgctgcaatgtcagggaccttgtccgagatctcatcaagtgtggtggcatgaagggaattaacgtagaaccaccttttgatgcatttgaagagaatccttcaatgaggcgggcacctgctgtaagaagggtggaggaaatgtttgaacaagtgaaaacaaagctgccaggagcacccaagtttcttttgtgtattcttgctgagaggaagaattctgatatttatggaccttggaagaagaaatgccttgctgaatttgggattgttacacagtgtgtggcaccaccaccaagagttaatgatcagtaccttaccaacgtcctgctcaagataaatgcaaagctgggtggcttaaattcaatactccaagttgaatcatcccctgcaatgcctcttatatccaaggtcccaactatgattttgggaatggatgtgtcccacggttctcctggacagtctggtgtaccttccattgctgctgttgtcagttctcgtgaatggcctcttatctcaaaatatagagcatcagtgcgctctcaatcagctaagatggaaatgattgactcgttgtttaagccacagggaacagatgataacggcctcattcgggagtgtctgattgacttctacacaagttctgggaagagaaagccagatcaaatcattatcttcagggatggcgttagcgagagtcagtttagtcaggtgctgaacattgagttggaccaaataattgaggcatgcaagtttttggatgaaaaatgggaccccaagttcacattgattgttgcccagaagaatcatcatacgaaatttttcatccctggggcaccagataatgttcctcctggtactgtggtggacaacaaagtctgccatccaaggaactatgacttctacatgtgttcgcatgctggaatgataggaactacgagacctacacattatcacatccttcatgatgagataggcttcaaccctgatgaccttcaggagctggtgcactcactttcttatgtgtaccaaaggagtacaacagccatctcagttgttgctcccatctgctatgcacatcttgctgctgcccaggtcggacaattcataaagttcgatgagatgtcggagacatcctcaagccatggagagcacacatcggcaggcagtgtccctgtgcaggagctgccgcgcctccacgacaaggtcaggagctccatgttcttctgctgagctgcacatgctccggtgctttctgggtggttggcgtatgccatttgccatgttgcttttggtggatgtttatgaaccttggtagtttggtgacatcggtggtgacatgacatcgggtggcttgatgcccctaaaatgttttcgagactcaggaagaaccatgttgctttttggtggatgtttcagaaccatggtagttaattaagtaggtgacatggggtggcatgatcaatcccctaaactggttacgtgacttcggcagacttaaacttgttagaatgtggttgatcgctatttgccattgcttctaccgctttatttgttgctatatatgttggcatttgtgttcttggcc

SEQ ID NO: 5059 - DNA, 3101 bp, Cenchrus ciliaris
gaaagggggaaggggaggagttctcggagaggtcgccttcgtctcccaccactgactcgggtgcagctttaggctagaaacagttgcctgtgaggataactatatggagtctcacaatagcgaggctgatgacttgcctcctccacctcctctaaattcgggtgatgaaccccttaaagctgaggaaacaaagatgctgtcaaaacctaagagggctcttgtccctaggaaaggttttggcaaaaaggggcagccaatacgtcttgtaacaaaccacttcaaagttgccttgaagaacactgaagaatttttctatcactactatgtgaatttgaaatatgaagatgacacaccggttgatcgcaagggagcaggaagaagtgtgattgagaaacttcagcaaacttatgccactgaacttgcaaataaagattttgcatatgatggtgagaagagcctgttcacaattggtgctctacctcaaaatattaatgagttcactgttgtggtggaagacatttcaaccggaaaggctcctgcaaatggcagccctggcaatgatagtccacctggaagtgacaggaaaagggtcagaagaccttacaacacaaagacatataaagttgagctgtcttatgctgcaaagattcctatgaatgccattgctcatgccttgagaggtcaggaatctgagcatactcaggaggcaattcgggtgattgatattattttgaggcagcactcagctaagcagggttgccttcttgtaaggcaatcattcttccacaacaatccttctaactttgttgaccttggtggtggtgtaatgggttgtagaggattccattctagtttccgtgcaacacataaagggctgtcactaaatattgacgtgtccacaactatgatagtgaaaccaggtcctgttgttgattttctcattgaaaaccagaaggttgatcacccgaacaagattgactgggcaaaggcaaagcgctcattgaagaatttaaggattaaaataagtccagggaatgcggaaaataagattgttggtttgagtgacaggccttgccgagaaacaatgtttacactaaagcgtagaaatggagacaatgttgactctgaagagatcagtgtttatgatcactttgtaaagaaccgtggcatagagcttaggtactctggtgacttaccttgtatcaatgtgggaaaaccaaaacgcccatcatattttcccatagagttgtgtaatcttgtcccgttacaaagatacacaaagtctttgagtacccttcagaggtcttcacttgttgagaagtctaggcagaaaccccaagaaagaatgtcagttctgtctgatgtcctgcagcgcagcaactacgactctgagcctatgctgatggcatgtggcatttcaatagcaaaaagtttcactgaagttgatggtagagtactgcaggcccccaagcttaaagctggaaatggagaagacatttttacgcgcaatgggagatggaacttcaacaataagaggcttattagagcaagcagtattgacaaatgggctgtggtcaacttttctgcgcgttgcaatgtcagggaccttgtccgagatcttatcaaatgtgggggcatgaagggaatcaatgtagaagcaccttttaatgtatttgaagagaatcctaatatgaggcgggcgcctgctgtaagaagggttgaggacatgtttgaacaagtgaaaacaaagcttcctggagcacctaagtttcttttgtgtattcttgctgagaggaagaattctgatgtttatgggccttggaagaagaaatgccttgcggaatttggtatcgtcacacagtgtgtggcaccaacaagagtgaatgatcagtacttaaccaatgtactgctaaaaataaatgcaaagctgggtggcttaaattcaatgctccaagttgaatcatccccagcaatgcctcttatatccaaggtcccaactatgattttgggaatggatgtatcgcatggttctcctggacaatctggtgtaccatcaattgcagcagttgtcagttctcgtgaatggcctcttatatcaaaatatagggcatcggttcgttcacaatcacctaaaacggaaatgattgactccttgtttaagcaaaggggaactgatgatgatggcctaattcgggagtgtctgattgacttctacaccagttcagggaagagaaagccagatcaaatcatcatcttcagggacggtgttagtgagagtcaatttaatcaggtgctgaacattgagttggatcaaatcatagaggcatgcaagtttttggatgaaaaatgggaacccaagttcacattgattgttgcccagaagaatcaccacacgaaatttttcattcctggaaatccagataatgtgcctccaggtactgttgtggacaacaaagtctgccatccaaagaactatgacttctacatgtgttcacatgctggaatgatagggactacgagacctacacattatcacatccttcatgatgagataggcttcaatcctgatgacctgcaggaacttgtgcactcactctcttacgtgtaccaaaggagcacaacagccatatcagttgttgctcccatctgctatgcacatcttgctgctgcccaggtcgggcagttcattaagtttgaagagatgtcggagacgtcctccagccatggcgagcacacctcggcaggcagtgtacctgtgcaggagcttccccgcctgcatgagaaggtccggagctccatgttcttctgctgagctgcagagcactttcggcacgcgctgtggtctgctactggtgtgtgcctgggtggtttggaaccttgttatggcgagcactcagccattcatcatgggtctgcttttggtggatgtttctgaaccttggtagttaatcatgctggcatcagtagacagacatctggtggcatgacgccccctgaactgattgcctgcctcaggaagactatgcaacctgttagaatgtcgctgattgctatctgccactgctacagttgctttaatcgttagctcgtgtttcttgatt

SEQ ID NO: 5060 - DNA, 3165 bp, Panicum virgatum
ggcggagggaggggggaagcgaagttctcggagaggtcgccatcgtcggagttcctccactgtctcggactggcagcggcttggcagctttcctgcaaggctatctaaatggagcctcacaatggcgaggctgatgacttgcctcctccacctcctctagatgcgggtattgaacctcttaaagctgatgaaacaaagaagatgttgaaacctaagagggctctggtccctaggcagggttttggcaaaaaggggcagccaataaagcttctaacgaaccacttcaaagtttcgctgaagaacactgaagagtttttctatcactactatgtgaatttgaaatatgaagatgatacacctgttgatagcaagggagcagggcggattgtgattgagaaacttcagcaaacctatgctactgaacttgcaaataaagattttgcatatgatggtgagaagagcctgttcacaattggtgctcttcctcaaattaataacgagttcactattgtggtggaagacgcttcaactggaaagactcctgcaaatggcagccctggtaatgacagttcacctggaagtgacaggaaaagggtccgaagaccttacaatacaaagacgtacaaagttgggctgtctttcgcagcaaaaattcctatgagtgcaatcgcacttgctctgaaaggtcaggaatcagagcatactcaggaagcaattcgagtgatcgatattattctgaggcagcattcagcaaagcagggttgcctcttggttcgtcaatcattcttccataacaatccatctaactttgttgaccttggaggtggtgtaatgggctgtagaggattccattctagtttccgtgccacacagagtggactttcacttaatattgatgtgtcaacaacaatgattgtaaaacctggacctgttgctgattttctgatggccaaccagaaggttgacaacccaaacatgattgactggacaaaggcaaagcgctcattgaagaacttgaggataaaaataaccccaacaaatgcagaaaacaagattgttggtctgagtgacagatcttgccgagaaacaatgtttacactaaagcgtagagatggtgactctgaagagatcagtgtttttgactacttcgtaaagaaccgtcgcatagagctcaggtactctggtgactttccttgtatcaacgtgggaaaaccaaagcgtccaacttattttcctatagagctctgtacgcttgtgtctttacaaagatacaccaagtcattgagtacacttcagaggtcttcacttgttgagaagtctaggcagaaaccccaagaaaggatgtctgttctgtctgatgtactgaaacgcagcaactatgattcagagcctatgctaatggcatgtggcatttcaattgctaaaagtttcactgaggttgatggtagggtgctgcaagcccccaagctcaaagctggtaatggagaagacatttttacacgcaatgggagatggaacttcaacaataagaggctcattagagctagcagtgttgaaagatgggcagtagtcaacttttctgcacgctgcaatgtcagagaccttgtccgagatctcatcaagtgtggtggcatgaagggaattaaagtagaagacccttttgatgcatttgaagagcatccttcaatgaggcgggcacctgctgtaaaaagggtggaggaaatgtttgaacaagtgaaatcaaagctgccaggagcacccaagtttcttttgtgtgttcttgctgagaggaagaattctgatgtttatgggccttggaagaagaaatgccttgctgaatttgggattgttacacagtgtgtggcaccaacaagagttaatgatcagtaccttaccaatgtcctgcttaagataaatgcaaagctgggtggcttaaattcaatgctccaagttgaatcatcccctgcaatgcctcttatatccaaggtcccaactatgattttgggaatggatgtatcccatggttctcctggacaatctggtgtaccttccattgctgctgttgtcagttctcgtgaatggcctcttatctcaaaatatagagcatcagtgcgctctcaatcacctaagatggaaatcattgactcgttgtttaagccacagggaaaggatgataaaggcctgattcgggagtgtctgattgacttctacaccagttctgggaagagaaagccggatcaaatcataatcttcagggatggtgttagcgagagtcagtttagtcaggtgctgaacattgagttggataaaataattgaggcatgcaagtttttggatgaaacttgggatcccaagttcacattgattgttgcccagaaaaaccaccacacaaagtttttcattcctggggcaccagaaaatgttcctcctggtacagtggtggacaacaaagtctgccatccaaggaactatgacttctacatgtgttcgcatgctggaatgataggaactacgagacctacacattatcacatccttcatgatgagataggcttcaaccccgatgaccttcaggagctggtgcactcactttcttatgtgtaccaaaggagtacaacagccatatcagttgttgctcccatctgctatgcacatcttgctgctgcccaggtcggacaattcataaagtttgatgagatgtcggagacatcctccagccatggagagcacacatcagcaggcagtgcccctgtgcaggagctgcccagcctccacgagaaggtcaggagctccatgttcttctgctgagctgcacttgcttggacgtgtgctgcgatatgctcctggtgctttctgggtggtctggaacctgtccattcgattgccatttaccatgatgcttttggtggatgtttcagaaccttggtagtttattacgtcggtgacatctgtgttggctcgatgcaccaaaaatggctacgtgcctcaggaagaaccatgttgcgtttggtggatgtttcatcagaaccatagtagttaattaagtcggtgccatggggtgtcatgatcccctaaaccggttaccacgtgaatatggaaggcttaaacctatttgaatgtggttgatcgctatttgccatcgcttcagttgatttatatgttgct

SEQ ID NO: 5061 - DNA, 3167 bp, Saccharum officinarum
aggggccggaagggtgagaagttctctcgccttctcggagacgtcgccatccgcttccaccactcggcggtttgggcagaggctttgcagctttgggccagatacattgctctccaaggttcactaaatggagtctcacactggcgaggctgatgacttgcctccaccacctcctttggctgctggtgttgagccacttaaagctgatgaaacaaaggcgccattgaaacttaggagtccggtccagaggaatggctttggcagaaaggggcagcagataaaactgataacaaatcacttcaaagtttctctcatgaatgctgcagattacttctatcattattatgtcaatttgaagtatgaagatgatacaccggttgatcgcaaaggatcaggaagaaaagtgatcgaaaaactgcagcaaacttatgctgctgaacttgcaaataaagattttgcatatgatggtgagaagagcctgttcacaattggtgctcttcctcaagttaaaaacgagttcactgttgttgttgatgacgtttcaaccggaaagacacctgcaaatggcagtccaggcaatgacagtcctcctggaagtgacaggaaaaggatcagaaggccttacaatacaaagacgtacaaggtcgaactctcttttgcggcaaaaattcctatgagtgcaatctcacaggccttgagaggtcaggaatcagagcacactcaggaagcaattcgagtgattgacattattctgaggcagcactcagctaagcagggttgcctattagtaaggcaatcattcttccacaacaatccttccaactttgttgacctgggtggtggtgtagtgggctgtagagggtttcattctagttttcgtgcaacccagagtggactttcactcaatattgatgtgtccaccacaatgatagtgaaacctggtcctgtcattgattttctgcttgccaatcagaaagttagtgatccaagcatgattgattgggctaaggccaagcgtgcactgaagaacttacggattaaaacaagtccagcgaaccaagaacagaagattgttggtctcagcgacagaccttgccgtgagcaattattcacactaaaacgtaaaaatggtaacgatggtgactctgaagagatcactgtttttgattacttcgtaaagaaccgtggcatagagctgcaatactctggtgatcttccttgtatcaatgtgggaaaaccaaagcggccaacatattttccagttgagttatgtagtcttctgcctttacaaagatacactaaagctttgagcacactacaaaggtcggcactcgttgagaaatctaggcagaaaccacaagaaaggatgtctgttttgtctgatgtactgcaaagaagcaactatgatgcagagcccatgctgaaggcatgcgggattacaattgctagaagtttcacagaagttgatggtagggtactgcagccccccaagcttaaagctgggaatggagaagacatttttacacgcaatggtagatggaacttcaacaataagaggctcattagagctagcagtgtcgagaaatgggcagtggtcaacttttctgcacgatgcaatgtcagggatcttgtccgtgatctcatcaagtgtggaggcatgaaggggatcatggttgaagcacctttcgatgtatttgatgagaacccttcaatgagacggtcacctgctgtaagaagggttgaagacatgtttgaacaagtgaaaaccaagcttcctggagcacccaagtttcttttgtgtgttctagctgaaaggaagaattctgatatttatgggccttggaagaagaaatgccttgctgaatttgggattgttacacagtgcgtggcaccaactagagtcaatgatcagtatcttacaaatgtcctactaaagataaatgcaaagctgggtggcatgaattcattgctccaaattgaaacatccccggcaattcctcttgtatctaaggtcccaactataatcttgggaatggacgtgtcgcatggttctcctggacattctgatgtaccgtccattgctgctgttgttagttctcgtgaatggcctcttatctcgaaatacagagcttctgtccgcacccaatcaccaaaaatggaaatgatggactcattgtttaagccacgggaaactgaagatgatggtctgatccgggagtgtctgattgacttctacaccagttctgggaagagaaagcctgaccaagtcatcatcttcagggatggcgttagcgaaagtcagtttaatcaggtgctgaacattgagttgcaacaaatcatcgaggcttgcaaatttcttgatgagaaatggaaccctaagttcactttgattattgcccagaagaaccatcacactaaatttttcattcctggaaagccagataatgttccacctgggactgttgtggacaacaaagtctgccatccaaggaactttgacttctacatgtgttcacatgctggaatgattgggactacgaggccaactcactatcacatcctgcatgatgagataggcttcaaccccgatgacctgcaggagctggtgcattcgctctcttacgtgtaccaaaggagcacgacagccatatcagttgttgctcccatctgctatgcacatctcgcagctgctcaggtcggccagttcatcaagtttgatgagatgtcggagacatcctccagccatggcggccatacttcagcaggcagcgtccctgtccaggagctgccccgtctgcatgagaaagtcaggagctccatgttcttctgctgagcctctatagcttgctgcttcggcatttggcttttgcatgtgctgtggccttacttttggtcgatggtagggtctgaaccctggtagcaatgtctggtggcagtaaacgctcttggatgatgcccatgaacttatgaacttgttgtggcacttggtgcctgcctctggaagacttggaacctggtagtaggatgttaagtgttagtttttttaagcatcgctgcagttatgttggctggcttgttgcagcgcttggtgccctgcctgccctcaggaagacttggaaccttgtaggatgtcgttaaaccatccttttaagctgctggttagatct

SEQ ID NO: 5062 - DNA, 3256 bp, Sorghum bicolor
gtttggaaagccggagggggtgagaagttttctcgccttctcggagacgtcgccatccaccccccgcttccaccactctcggcgggtcgggcagaggctttgcagctttgggtcagatacagtgctctccaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttgttgttgatgatgtttcaactggaaagactcctgcaaatggcagtccaggaaatgacagtcctcctggaagtgacaggaaaaggatcagaaggccttacaatacaaagacgtacaaggtcgaactctcttttgcggcaagaattcctatgagtgcaatctcacaggccctcagaggtcaggaatcagagcacacgcaggaagcaattcgagtgattgacattattctgaggcagcactcagctaagcagggttgcctattagtaaggcaatcattcttccacaataatccttctaactttgttgacctgggtggtggtgtagtgggctgtagagggtttcattctagttttcgtgcaacccagagtggactttcactcaacatcgatgtgtccaccacaatgatagtgaaacctggtcctgtcattgattttctgcttgccaatcagaaagttaatcatccaggcatgattgattgggctaaggccaagcgttcactgaagaacttgaggatcaaaacaagtccagcaaaccaagaacagaagattgttggtctcagcgacagaccttgctgtgagcaattattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgagttatgcagtcttttgcctttacaaaggtacactaaagctttgagcacacttcagaggtcatcacttgttgagaaatctaggcagaaaccacaagaaaggataggtgttttgtctgatgtactgcaaagaagcaactatgatgcagagcccatgctgaaggcctgcgggattacaattgctagaagttttaccgaagttgatggtaggatactgcagccccccaagcttaaagctggcaatggagaagacatttttacacgcaatggtagatggaacttcaacaataagaggctcattaagggtagcagtgttgagaaatgggcagtggtcaacttttctgcacgatgcaatgtcagggatcttgtccgtgatctcatcaagtgtggaggcatgaaggggattatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatgggccttggaagaagaaatgccttgctgaatttgggatcgttacacagtgcgtggcaccaactagagtcaatgatcagtatcttacaaatgtcctactaaagataaatgcaaagctgggtggcatgaattcgttgctccaaattgaaacatccccagcaattcctcaagtatccaaggtcccaactataatcttgggaatggatgtctcccatggttctcctggacattctgatgtaccgtccattgctgctgttgttagttctcgtgaatggcctcttatctcgaaatatagagcttctgtccgcacccaatcacctaagatggaaatgattgactctttgtttaagccacgggaaactgaagatgatggtctgatccgggagtgtctgattgacttctacaccagttctgggaagaagaagcctgaccaagtcatcatcttcagggatggtgttagtgaaagtcagtttaatcaggtgctgaacattgagttgcaacaaatcatcgaggcttgcaagtttttggatgaaaaatggaatccaaagttcacgttgattattgcccagaagaatcaccacactaaattttttattcctggaaagacagaaaatgttccagctggaactgttgtggacaacaaagtttgtcatccaaggaactttgacttctacatgtgttcacatgctggaatgatcgggactacgaggccaactcattatcatatactgcatgatgagataggcttcaatcctgatgatctgcaggagctggtgcattcgctctcttacgtgtaccaaaggagcacaacagccatatcagttgttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttggtgccctcaggaagacttggaaccttgtaggatgtcgttaaaccatccttttaagcgttgctggttctctatgagttgtgctgtcgtgcttattgtttgccctggtggctgttttctgcttgattgtatgcaagtgtgatatgtttcagtactggttaaagcttgggattg

SEQ ID NO: 5063 - DNA, 3644 bp, Sorghum bicolor
ggggggtgggtgcgggcagaggagccggtgttctgtttggaaagccggagggggtgagaagttttctcgccttctcggagacgtcgccatccaccccccgcttccaccactctcggcgggtcgggcagaggctttgcagctttgggtcagatacagtgctctccaaggcccactaaatggagtctcacaatggcgaggctgatgacttgcctccaccacctcctttgaatgctggtgttgaaccacttaaagctgatgaaacaaaggtgccattgaaacataggactctggtccagaggaatggctttggcagaaaggggcagcagataaaactgctaacaaatcacttcaaagtttctctcatgaatgctgcagattatttctatcattactacgtcaacttgaagtatgaagatgatacaccggttgatcgcaaagggtcgggaagaaaagttatagaaaaactgcagcagacttatgctgctgaacttgcaaataaagattttgcatatgatggtgagaagagcctgttcacaatcggtgctcttcctcaagttaaaaatgagttcactgttgttgttgatgatgtttcaactggaaagactcctgcaaatggcagtccaggaaatgacagtcctcctggaagtgacaggaaaaggatcagaaggccttacaatacaaagacgtacaaggtcgaactctcttttgcggcaagaattcctatgagtgcaatctcacaggccctcagaggtcaggaatcagagcacacgcaggaagcaattcgagtgattgacattattctgaggcagcactcagctaagcagggttgcctattagtaaggcaatcattcttccacaataatccttctaactttgttgacctgggtggtggtgtagtgggctgtagagggtttcattctagttttcgtgcaacccagagtggactttcactcaacatcgatgtgtccaccacaatgatagtgaaacctggtcctgtcattgattttctgcttgccaatcagaaagttaatcatccaggcatgattgattgggctaaggccaagcgttcactgaagaacttgaggatcaaaacaagtccagcaaaccaagaacagaagattgttggtctcagcgacagaccttgctgtgagcaattattcacactgaaacataagaatggtaatggagactctgaagagatcactgtttatgattacttcgtaaagaaccgtggcatagagctgcaatactctggtgatcttccatgtatcaatgtgggaaaaccaaagcggccaacatattttccagttgagttatgcagtcttttgcctttacaaaggtacactaaagctttgagcacacttcagaggtcatcacttgttgagaaatctaggcagaaaccacaagaaaggataggtgttttgtctgatgtactgcaaagaagcaactatgatgcagagcccatgctgaaggcctgcgggattacaattgctagaagttttaccgaagttgatggtaggatactgcagccccccaagcttaaagctggcaatggagaagacatttttacacgcaatggtagatggaacttcaacaataagaggctcattaagggtagcagtgttgagaaatgggcagtggtcaacttttctgcacgatgcaatgtcagggatcttgtccgtgatctcatcaagtgtggaggcatgaaggggattatggttgaagctccttttgatgtatttgaggagaatccttcgatgagacggtcgcctgctgtaagaagggttgaagacatgtttgaacaagtcaaaaccaagcttcctggagctccgaagtttcttttgtgtgttctagctgaaagaaagaattctgatatttatgggccttggaagaagaaatgccttgctgaatttgggatcgttacacagtgcgtggcaccaactagagtcaatgatcagtatcttacaaatgtcctactaaagataaatgcaaagctgggtggcatgaattcgttgctccaaattgaaacatccccagcaattcctcaagtatccaaggtcccaactataatcttgggaatggatgtctcccatggttctcctggacattctgatgtaccgtccattgctgctgttgttagttctcgtgaatggcctcttatctcgaaatatagagcttctgtccgcacccaatcacctaagatggaaatgattgactctttgtttaagccacgggaaactgaagatgatggtctgatccgggagtgtctgattgacttctacaccagttctgggaagaagaagcctgaccaagtcatcatcttcagggatggtgttagtgaaagtcagtttaatcaggtgctgaacattgagttgcaacaaatcatcgaggcttgcaagtttttggatgaaaaatggaatccaaagttcacgttgattattgcccagaagaatcaccacactaaattttttattcctggaaagacagaaaatgttccagctggaactgttgtggacaacaaagtttgtcatccaaggaactttgacttctacatgtgttcacatgctggaatgatcgggactacgaggccaactcattatcatatactgcatgatgagataggcttcaatcctgatgatctgcaggagctggtgcattcgctctcttacgtgtaccaaaggagcacaacagccatatcagttgttgctcccatctgctatgcacatctggcagcagctcaggtcggccagttcattaagttcgatgagatgtcggagacatcctccagccatggcggccatacttcggcgggcagcgtccctgtccaggagctacctcgtctacatgagaaagtcaggagctcgatgttcttttgctgagcctctatagcttgctgcttcggcattggcctctaagccttacttttggtggatggttgggtctgaaccctggtagtagttatgtctggtggcagtaaacgctcttggatgctgcccataaacttgtgaacttgttgcggcatttggtgcctgcctctggaagacttaatcaagtaggatgttaaatgttagtttttaagcatcgctgcagttatgttggctgtcttgttgcagtgcttggtgccctcaggaagacttggaaccttgtaggatgtcgttaaaccatccttttaagcgttgctggttctctatgagttgtgctgtcgtgcttattgtttgccctggtggctgttttctgcttgattgtatgcaagtgtgatatgtttcagtactggttaaagcttgggattgaaaaattggagtgaatggcttcaattcggcactccggactacttgggagttgaggacctgctggtttggcctgcgctagcctcagtctggaatctgtatgcaggaggaagccgcaagccagtaggttagtttgaacgagtggaggatttctgctttattgcaatgcatgcctagtgtggtatatgtttcagtttttgatcttgcttgaggttgcacacgttggctacttggtcaaggctgtatttatttggcactctgggctatttgggacttgctgatcaaatgatatgcagtaggttgagcgttggcaagggatgaagccgcgagctgtaccaggccgcacctctaatggtt

SEQ ID NO: 5064 - DNA, 3206 bp, Zea mays
acttcacttgtgctctctgttcggaaagaagcccggccgggtcggaaggggagcagttctcgccttctcggggaggtcgccagcgggttgggcagaggctttgcagcttttgggtcagacgcagtgttctccaaggctcactaaatggagtctcacaatggcgaggctgatgatttgcctccaccaccccctttggctgctggtgttgaaccacttaaagccgatgaaacaaagatgccattgaaacctaggagtctggtccagaggaatggctttggcagaaaggggcagcagataaagctgataacaaaccacttcaaagtttctctcatgaaggctgaagattttttctatcattactatgtcaatttgaagtatgaagatgatacaccggttgatcggaaagggtcgggaagaaaagtgatcgaaaaactgcagcaaacttatgctgctgaacttgcaaataaagattttgcatatgatggtgagaagagcctgtttacaattggtgcccttcctcaagttaaaatggaattcactgttgtggatgaagacgtttcaactggaaagactcctgcaaatggcagtccaggcaatgatagtcctcctggaagtgacaggaaaagggtccgaaggccttacaatacaaagacatataaggttgaactatcttttgcggcaaaaatccctatgagtgcaatctcacaggctttgaggggtcaggagtcagagcacactcaggaagcaattcgagtgattgacattattctgaggcagcactcagctaagcagggttgcctattagtaaggcaatcgttcttccacaataatccttccaattttgttgacctgggtggtggtgtagtgggatgtagagggttccattctagttttcgtgcaacccagagtggactttcactcaatatcgatgtgtccaccacaatgatagtgaaacctggtcctgtcattgactttctgattgccaatcagaaagttaatgatccaagcatgattgattgggcaaaggccaagcgctcactgaagaacttaaggataaaaacaagtccggcgaaccaagaacagaagattgttggtctcagcgacaggccttgccgtgagcaattattcacactgaaacataaaaatggtgaatctgaagagatcactgtttttgattactttgtaaagaaccgtggcataaagctggaatattctggtgatcttccttgtatcaatgtgggaaaaccaaagcgtccaacttattttccagttgagttatgcagtcttcttcctttgcaacggtacactaaagcattgagcacacttcaaagatcatcactcgttgagaaatctaggcagaaaccacaagaaaggatgtctgttttgtctgatgtgctgcaaagaagcaactatgatgcagaacccatgctgaaggcttgtgggattacaattgctagaaatttcatagaagttgatggtagggtactgcagccccctaagcttaaagctgggaacggagaagacatttttacgcgcaatggcagatggaatttcaataataagaagctcattagagctagcagtgtcgagaaatgggcagtagtaaacttttctgcacgatgcaatgtccgggatcttgtccgtgatctcatcaagtgtggaggcatgaagggcattatggttgatgcaccatttgctgtatttgatgagaatccttcaatgagacggtcacctgctgtaagaagggttgaagacatgtttgaacaagtgaaaactaagcttcctggagcacccaagtttcttttgtgtgttctagcggaaagaaagaattccgatatttatgggccttggaagaagaaatgccttgctgaatttgggatcgttacacagtgtgtggcaccaactagagtcaatgatcagtatcttacaaatgtcttgttaaagattaacgcaaagttgggtggcttgaattcgttgctccaaattgaaacatccccagcaattcctctcgtatccaaggtcccaactataatcttgggtatggacgtatcacacggatctcctggacattctgatataccgtctgttgctgctgttgttagttctcgtgaatggcctcttatctcaaaatacagagcatctgtccgcacccaatcaccaaaaatggaaatgattgactcgttgtttaagccacgggaaactgatgacgatggtctgattcgggagtgtctgattgacttctacaccagttcagggaagagaaagcccgaccaagtcatcatcttcagggacggtgttagtgaaagtcagtttaatcaggtgctgaacattgagttgcaacaaatcattgaggcttgcaaatttcttgatgagaaatggaatcccaagttcacattgatcattgcccagaagaatcaccacactaaatttttcattcctggaaagccagataatgttccagctggcactgttgttgacaacaaagtctgtcatccaaggaacttcgatttctacatgtgttcacatgctggaatgattggaactaccaggccaactcactatcacatcctgcatgacgagataggcttcaatcctgatgacctgcaggagctggtgcactcgctctcttatgtgtaccaaaggagcacaacagccatatcagttgttgctcccatctgctacgcccaccttgcagccgcccaggttgggcagttcataaagttcgacgagatgtcggagacttcatctagccatggggggcatacctcggcgggcagcgtccctgtacaggagctgccccgtctgcatgagaaagtgaggagctccatgttcttctgctgagcagcagggaatgtgtcccttggttttacctttttgggtgtatggtcgggggttctgaacccatgaacttgttgcctcacttggttccagcctcaggaagaactttgtaggatgctgaatggtaggatttttaagcatcgttgcagttgtgctgggtggcacgctgcaaccattttggctagcttgttgcagcacttggtgccttcctgagaggaagtagacttggaacctggtagcacgtccttaaaccatccttttaagcgttgctggttcggcctctgagctgtgtttgtcgtgctttgttggctgtgcttgtgggtgatttttgttttattgcaagggtagcgtgcaatgccttttccgtt

SEQ ID NO: 5065 - DNA, 958 bp, Zea mays
gtgcacactcgcttgagcatcgtgtgctcttctcttcctcttccagttggtattctttatctgaaacatagtacagaggaggagaggagaacgagagctaagaagatgaccggcaaggttctccttgtggccgtccttatcttggtgggcgtggcctctcgatgctcgggcagtaggggcctgcagggcgatcacgttgctgaacagaagttcggtggcggtggctatggaggtggcggtgggtacggaggctacggtggcggtggaggaggaggtggtggtgggtatggcggtggcggcggcggcggcggcggtgggtacggaggcggtggcggctacacacccggctactctggcaccggcacctgcgactactggaagagccacccggacgccatcatctcgtgcatcgggtcgctgggcagcatcctcggctccttcggcgacgtgtgcagcgccttcttcgggagcaagctgcagacgctgcaggacgcgctgtgcaacacccgcaccgactgctacggcgacctcctccgcgagggcgccgcggcctacctcaactccatcgccgccgagaagtacgcctacagcacgcagcaggttcaggactgcatcgccgtcgcgctcacttccaaggccgccgccgtcgcgcaggccgccatgttcaagaaggccaactacgcctgcagctactagctaggcctcgcgcatcatcagcgtataacgtacgcacgcaatgttcgttatataattccatacgtatatgggtgtgcaaggtccagaccgaccagctgtatgtcttcatcgttgccttcgtttctgcgtcgtcctcccatgcatgtttatgcatgatgccgtgccgtctcgttgtcagctggttcagtagtgatgcttactttcttgtcgttgttgctaatgtaagaaataagacgatgcgttgactgcttaatttgcttgt

SEQ ID NO: 5066 - DNA, 1017 bp, Panicum virgatum
gcgtccacccacgcgtccgtcctcgagcacagagcactgcaccctctcatccgccggtgcttgctcctcctccccacttcagctagtagcctcttcttgagagaatcatcaggaagaggccgggatatcgagggatcgagcaagatgatgagcggcaaggctctccttgtcgccgtgctcttggtgggcgtcgcctcccggtgctccggcagcaggggcctgcagtggggtcacatcgctgagcagaagtacggtggcggtgggtacggtggcggcggcggcggatacggtggtggcggtgggtacggcggcggaggtggtggtggtgggtacggaggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgcgctgtgcaacacccgcaccgactgctacggcgacctcctccgcgagggcgccgccgcctacctcaactccgtcgcctcccagaagtacgcctacaccacgcagcaggtcaaggactgcatcgccgtcgcgctcacctccgaggccgccgccgccgcgcaggccgccatgttcaagaaggccaactacgcctgccactactaatcgatcgatgacgaaggagcgagctgcttcctccatctatcatttcgtcagtgtagcgtgcttgttaaataagatgtgtgtacgtgactgtgtttgtgtgtgtgtccgatccccagctagcgtcgccttcgtttctgcgtcgtcgtcttcccgtgactagctcccatgaatccatgaggacgcatgacgccatgccgtctcgttgtctgcttcttcagtagtgatgatgcctgcttccttgtcgttgttgctgatgtaatgagaaataagatgagttggttggtggtgaaaacggtgattgttcttacg

SEQ ID NO: 5067 - DNA, 1047 bp, Saccharum officinarum
tgccggtgctcttctctttctcttccagttattgctagtctttttcgatctgaaacatacaggaggagaggagagcgagagaggtagaaagatgagcggcaaggttctccttgtcgccgtcctcttggtgggcgtagcctctcggtgctcaggcagcaggggcctccagggcgatcacgttgctgaacagaaatacggtggcggtgggtacggaggaggtggcagcggcggcggatacggcggtggaggtagtggtggtgggtatggaggcggcggcggtggcggctacacgcctggctactctggcaccgggacctgcgactactggaagagccacccggacgcgatcatctcgtgcatcgggtcgctgggcagcatcctcggctccctgggcgacgtgtgcagcgccttcttcgggagcaagctgcagactctgcaggacgcgctgtgcaacacccgcaccgactgctacggcgacctcctccgcgagggcgccgccgcctacctcaactccgtcgcgtctaagaagtacgcctacagcacgcagcaggtcaaggactgcatcgccgtcgcgctcacatcagaggccgccgccgtcgcgcaggccgccatgttcaagaaggccaactacgcctgccactactagctagaccggccggcctcttatcatcagcgtatgacgtaacgtagtgtttcttagataattaagtctctatgcatgggtgtgcaccaggtccagacgtgtatgccatatgtatgtcctcagcgttgccttcgtttctgcgtcgtcttcccatgatgatgcatgatgccatgccgcgtctcgttgtcgatctggttcagtagtgatgcttgctttcttgtctttgttgctgatgtaagaaataagatgacgggttgattgcttactttgctagtgaaatggtcgttggtcttgcttaatgcacgggcgctcgcgtgcttgttaaaaaaaaaaaccctaacataaataaaaacctcttcttctatatcgacaatatccacctgctttccataatataataatgc

SEQ ID NO: 5068 - DNA, 1232 bp, Sorghum bicolor
gtgcacactcgcttcgttcagcatctgccggtgctcttctctttcgttctcttccagttattggtagtctttttcgatctgaaaaacatacaggaggagatcaggagagcgagaggtacctagcaagatgagcggcaaggttctccttgtcgccgtcctcttggtgggcgtagccgcctctcggtgctcaggcagtaggggcctgcagggcggcgatcacgttgctgaacagaagtacggtggcggtgggtacggaggaggtggcagcggcggcgggtatggtggcggcggtggcggtggtgggtatggcgggtacggaggtggcggcggtggcagcgggtacggaggcggcggcggtggctacacgcccgcctactctggcaccgggacctgcgactactggaagagccacccggacgcgatcatctcgtgcatcgggtcgctgggcagcatcctggggtccctgggcgacgtgtgcagcgccttcttcgggagcaaggtgcagacgctgcaggacgcgctgtgcaacacccgcagcgactgctacggcgacctcctccgcgagggcgccgccgcctacctcaactccgtcgccgccaagaagcagcagttcgcctacagcacgcagcaggtcaaggactgcatcgccgtcggcctcacatccaaggccgccgccgtcgcgcaggccgccatgttcaagaaggccaactacgcctgccactactagcagaccggccgggccggcctcttatcatgcatgcatcaccgtttaacgtacgtagtgtttcttataaataattaagtctgctgtatatgcatggtgtggaggtccagacgagtatgtcctcagcggtgccttcgtttctgcgtcgtcgtcttcccaagatgatgcactccgtgatgccatgccgtcgtctcgttgtctggctcagtagtgatatgcttgctttcttgtcgttgttgctgatgtaataagagatgatgcgttcattgctaattactatactttgctagtgaaatactgaaatggtcgttggacggtcttactaaatgcacgggcaatctcgcgcttgtttctgtcagcgctactggttgggtgttgagatttaatcatgtactacatggctacaaactagtacgtatatatctacgtatgcattttcctttttccctgttgtccatacttgtttttgcctgtccaaattcaaacaaggcattaagttactcttcgc

SEQ ID NO: 5069 - DNA, 2478 bp, Sorghum bicolor
ttaatcagctcaattggatcggagcgacacccattttagtgctgatggcggcccgtcgtctcttgccatgaaagcctgcagtctgcgttggaatgcaacacctgcattgtactccattacaaaagttattaccagcattttttacacatgaacttaaatttcccaggcatatatgtagttacagtattgactgcacatgcatgcctcttctatttatctcaatgttactgattgtctgaatcggtacactgacagactcagacgccaagtcacagaattggctctcagcaggttcattcagccaacaagtcatttgcccttaagatccaggagaatccgtcacccgtggccgtagcattgatcgagctggatggatggaagtaggcattcagtggcagccaactactctacaaagccgtggcagtgtgccaggaccgcacggcgcatgcaacggcggcacggctcaagtgcaggtggtgccggtggtgcccggcgccatccagcgcgcctctatataaacccggcctgcgggttcagtgtcccagtgcacactcgcttcgttcagcatctgccggtgctcttctctttcgttctcttccagttattggtagtctttttcgatctgaaaaacatacaggaggagatcaggagagcgagaggtacctagcaagatgagcggcaaggttctccttgtcgccgtcctcttggtgggcgtagccgcctctcggtgctcaggcagtaggggcctgcagggcggcgatcacgttgctgaacagaagtacggtggcggtgggtacggaggaggtggcagcggcggcgggtatggtggcggcggtggcggtggtgggtatggcgggtacggaggtggcggcggtggcagcgggtacggaggcggcggcggtggctacacgcccgcctactctggcaccgggacctgcgactactggaagagccacccggacgcgatcatctcgtgcatcgggtcgctgggcagcatcctggggtccctgggcgacgtgtgcagcgccttcttcgggagcaaggtgcagacgctgcaggacgcgctgtgcaacacccgcagcgactgctacggcgacctcctccgcgagggcgccgccgcctacctcaactccgtcgccgccaagaagcagcagttcgcctacagcacgcagcaggtcaaggactgcatcgccgtcggcctcacatccaaggccgccgccgtcgcgcaggccgccatgttcaagaaggccaactacgcctgccactactagcagaccggccgggccggcctcttatcatgcatgcatcaccgtttaacgtacgtagtgtttcttataaataattaagtctgctgtatatgcatggtgtggaggtccagacgagtatgtcctcagcggtgccttcgtttctgcgtcgtcgtcttcccaagatgatgcactccgtgatgccatgccgtcgtctcgttgtctggctcagtagtgatatgcttgctttcttgtcgttgttgctgatgtaataagagatgatgcgttcattgctaattactatactttgctagtgaaatactgaaatggtcgttggacggtcttactaaatgcacgggcaatctcgcgcttgtttctgtcagcgctactggttgggtgttgagatttaatcatgtactacatggctacaaactagtacgtatatatctacgtatgcattttcctttttccctgttgtccatacttgtttttgcctgtccaaattcaaacaaggcattaagttactcttcgcatgtacgcatggcgttcagtatatattctagttatcagataattagagaggaggtgctaaaattcaggtgtatagagttaccaacattatttggagcgacgttcatcaaccgctagatcacgtacatatcaacaatatatgattaaagcgctttccagtttgttcttttgtctaaaaaaatataactgaaaagtactattcactgatttgttacgagagaaaaacacaagcgaacatgaccttcttcaacctcccgcgcaccatgatattcgcaacaacgccggccggttgagctcccccgccgagttcaactccagtcatcccggtggcggcgcaggtggcctcgccggtcggcggtcgccagctcaaccattgcaactctaacgcaacacgacgccctgctcttttgctgccttagctgttagcctgtcaaccccatcctgctactgacccagacgtccggaccgcccccggccgccttccttctgccctgcattgatcatccagcctcctcgaaagctcaggggtggatctaattaaccttgtctgctgaggtctgccaaacctagctatgggaatcagggaatggccagtctagatttgaccttacacttggcctcctcacctcaaggtcaatttaaaaggaggctatatatgggtttatctatttcagttaaaagctatgggctatatagcctcgat

SEQ ID NO: 5070 - DNA, 862 bp, Cynodon dactylon
aagaccagacaacgagagtctggcatcgtcaaatgacaaggatacctcttcctgaggacaagcacacaaataaacacgtctgatcatgaaaccgcacgcatggactagctaagtttattcgacaagggaagcactattaataattaataactgtttaagcatgcaggaggagcgtagagtcatcagtagtagcaggcgtagttggccttcttgaacatggcagcctgcgcggcggcggcgacctcagaggtgagcccgacagcgatgcagcccttgacctgctgcgtggtgtaggcgaacttggccttcttggcggcgacggagttgaggtacgcggcggcgccctcccggagaaggtcgccgtagcagtcgctgcgggtgttgcacagcgcgtcctgcagcgtctgcaccttgctcccgaagaaggcgctgcacacgtcgcccagggaacccaggatgctgcccagcgagccgatgcaggagatgatcttgtccgggtggctcttccagtagtcgcaggatccggactggccgcctccagagccaccgcctccgtagccgccgccgcctccagagccaccgcctccgtagccacctcctcctccgtagccaccacctccgccgccgtagccgccgctgctacctccgcctccgtaaccaccgccgccgtacttctgctcagccaggtgatctccctgcaggctcctgctcccggagcactgcgagaccacccccaccagcaggacggccaccagcagagccttgccgctcttcatctctccctcccctctctctgctcttctgaagactagtagctggctgatgaaaggtggatagaggagatgcttctgctacttgagcg

SEQ ID NO: 5071 - DNA, 808 bp, Panicum virgatum
gagggatcgagcaagatgatgagcggcaaggctctccttgtcgccgtgctcttggtgggcgtcgcctcccggtgctccggcagcaggggcctgcagggggatcacatcgctgagcagaagtacggtggcggtgggtacggaggcggcggcggcggcggctacacgcccggctactccggcaccggaacctgcgactactggaagagccacccggacgcgatcatctcgtgcatcgggtcgctgggcagcatcctggggtcctttggcgacgtgtgcagcgccttcttcgggagcaagctgcagacgctgcaggacgctctgtgcaacacccgcaccgactgctacggcgacctcctccgcgagggcgccgccgcctacctcaactccgtcgccgcccagaagtacgcctacaccacgcagcaggtcaaggactgcatcgccgtcgcgctcacctccgaggccgccgccgccgcgcaggccgccatgttcaagaaggccaactacgcctgccactactgatccatcgatgacgacgaagctgcttcttccatcatttcgtcggcgtagacgcgtagtatctagtgcttgtgttaaataaataagacgtgtgtacgtgactgtgtgtgtgtgtgtccgatccccagcgtcgccttcgtccgtttcagcgcgtcgtcgtcttcccatgaatacatgatgatgcatgacgccatgccgtctcgttgtcagcttcttcagtagtgatgatacctgcttttccttgtcgttgttgctgatgtgatgagaaattagaagagtttggttggtggtg

SEQ ID NO: 5072 - DNA, 2478 bp, Pennisetum glaucum
tgtagtagctgaagggcatctcggtgtcattccgtccccaccccggcccgccccagtcagatctgctccgccgccaccgacacccccctcctccccttcctccggcgaggtcctcgccggagcagggtcaccaccaccaccaccactccaaagccccgccactgcccagatccgcctagaacccaaactcggaaggccttcccctctgatccagatccaaggccaggcgatggcccgcctcggcgcgctcctcctccccgtcgccgccgccgcggcggcgctgctgctgctgctctccgcgcttcctggcgcgcgggggttctacctcccggggagctacccgcacaagtacaaccccggcgagccgctcagcgtcaaggtgaactccctcacctccatcgacaccgagatgcccttcagctactacagcctccccttctgcgtcccgcccgagggcgtcaaggacagcgccgagaacctcggcgagctcctcatgggcgaccgcatcgagaactccccctaccgcttcaagatgtacaccaacgagtcggacgtcttcctctgccgctccgccccgctcgcccccgacgccttcgccctgctcaagaagcgcatcgacgagatgtaccaggtcaacctcatcctcgacaacctccccgccatccgctacaccaggaaggacgactacttcctccgctggacagggtaccccgtcgggatccgcgtcggcgtcgactactacgtcttcaaccacctccagttcaccgtcctcgtccacaagtacgaggacgccaatgtcgcgcgcgtcatgggcaccgccgacgccaccgacgtcatccccgccgggggcaaggacaaggacgcaggcgccgccggctcctccaccggctggatggtggtcgggttcgaggtcgtgccgtgcagcatcaagcacaacccggaggatgtcaagtccacaaagatgtacgaccgctaccccagcaagatcaagtgcgacccgaccaccgtgtccatgagcatcaaggagaacgagcccatcgtctacacttacgaggtgtccttcgtcgagagcgacatcaagtggccgtccaggtgggatgcctacctcaagatggagggggccaaggtgcactggttctccattctcaactccctcatggtcattgccttccttgctggtattgtgtttgtcatactgttgaggactgtgaggcgtgatctgaccaagtatgaggagcttgatagcgaggcgcaggcgcagatgaatgaggagctgtccgggtggaagcttgtggtcagtgatgtcttccgtgcgccaagcaacccaatgctgctctgtgtcatggtcggggacggcgttcagatccttgggatggcggtcgtgaccattctgtttgctgcacttggtttcatgtcccctgcctcccgtggtactctgatcacaggcatgctgttcttctatctggtccttggaatcctggctgggtatgctggtgttcgtgtatggaagacgatcaagtgcggcgatcactctgggtgggtgggtgtttcatggcgggtggcctgcttcttccctggcattgccttcctgatccttaccacactcaacttccttctctggggaagccaaagcaccggtgccatccccttctcattgttcgttgtgctgctgctgctctggttctgcatctctgtgccgctcacgcttgttggtggattccttggtgccaaggcaccacacattgagtaccctgtccgcactaaccagatccctcgtgaaatccctcctcagaggtacccatcctggctgttggttcttggagctggcacactgcccttcggtaccctgttcattgagctcttcttcatcatgtcgagcatatggatggggcgagtgtactatgttttcggattcctcttcatcgtcatgctgctcctggttattgtctgcgccgaggtttcactggttctgacttacatgcacctttgcgtcgaggattggaagtggtggtggaaatctttcttcgcatctggttcggtggcaatctacattttcttgtactccatcaactatcttgtttttgacctcaaaagcctgagtggaccagtgtctgcaaccctctacattgggtactcactcttcatggtgattgctattatgctggcaactggcacagttgggtttatttcttcattctgctttgtccattatctcttctcatcggtgaaagcagactgagtttcttcctgctgaggagccaatcactcaattgagaggtgagcataatggacactgaaaagtttgtagtcacaaaaatcttagtttatgtcacttttggtatacagggcctgaataactattgtaatgattaatagggttcatcaatggattttatgaagaggtgttagcagcatgcgcgatgtaataggatgaattgctttattcacatgttgtgttgttttagttgcttagtctgc

SEQ ID NO: 5073 - DNA, 2316 bp, Panicum virgatum
tcggcggccacgctgctgctctccgcgctgccgggcgcccgcggcttctacctcccggggagctacccgcacaagtacaaccccggcgagctcctcaacgtcaaggtgaactccctcacctccatcgacaccgagatgcccttcagctactacagcctccccttctgcgtcccgcccgagggcgtcaaggacagcgccgagaacctcggcgagctcctcatgggcgaccgcatcgagaactcgccctaccgcttcaagatgtacaccaacgagtccgacgtcttcctctgccgctccgcgccgctcgcccccgacgccttcgcgctgctcaagaagcgcatcgacgagatgtaccaggtcaacctcatcctcgacaacctccccgccatccgctacaccaagaaggacgactacttcctgcgctggaccggctaccccgtcgggatccgcgtcggcgtcgactactacgtcttcaaccacctccagttcaccgtcctcgtccacaagtacgaggacgccaatgtcgcgcgcgtcatgggcgccgccgacgccactgacgtcatcccggccggggccaaggacggaggcgctgccaactctggctggatggtggttggcttcgaggtcgtgccatgcagcatcaagcacaacccggaggatgtcaagtcgcacaagatgtacgaccgctaccccagcaagatcaagtgcgacccgaccaccgtgtcgatgagcatcaaggagaacgagcccattgtctacacttatgaggtctctttcgtggagagcgatatcaagtggccctcgaggtgggatgcctacctgaagatggagggggccaaggtgcactggttctccattctcaactccctgatggtcattgccttccttgctggtattgtgtttgtcatactgttgaggactgtgaggcgtgatctgaccaagtatgaggagcttgatagcgaggcgcaggcgcagatgaatgaggagctgtctgggtggaagcttgtggtcagtgatgtcttccgtgccccaagcaaaccgatgctgctctgtgtcatggttggtgacggcgttcagatccttgggatggcagtcgtgaccattctatttgctgcacttggtttcatgtccccagcctcccgcggtactctgatcacaggcatgctgttcttctatctggttcttggaatcctggctggatatgttggtgttcgtgtatggaagaccatcaagtgcggggatcactctgggtgggtgggtgtttcatggcgggtggcctgcttcttccccggcatttcattcctgatcctgaccacactcaacttcctgctgtggggaagccaaagcaccggtgccatccccttctcattgtttgttgtgctgcttctgctttggttctgcatctcagtgcctctcacactggtcggtggattccttggtgccaaggcaccacacattgagtaccctgtccgcacgaaccagatccctcgtgaaatcccacctcagaagtacccatcctggttgctggttcttggtgctggcacactgccctttggcaccctattcattgagctcttcttcatcatgtcgagcatatggatggggcgtgtgtactatgtttttggattcctcttcatcgtcttgctgctcctggttattgtctgcgctgaagtttcacttgttctgacatacatgcacctgtgcgttgaggattggaagtggtggtggaaatctttcttctcatctggatcggtggcaatctacattttcttatactcgatcaactatctcgtttttgacctcaagagcctgagtggaccagtgtctgcaaccctctacattggttactcgctcttcatggtgattgctattatgctggcaactggcacggttgggtttatttcttcattctgctttgtccactatcttttctcatcggtgaaagcagattaagtttcttcctgctgaggagtggatcactcaattgagaggtgagcataatggacattgaaatgtttgtagtcacaaaaatcttagttcatgtcatcttttggtatacagagcccaaataactattgtaagggctactagggttcatcaatgggttttatgaagaggtgttagcagcatgcacgatgtaatagaatgaattgctttattcacatgttgtcttattttagttgcttagtctgccattattatatcaaattgtacgcttagtatcatatctgcttcaagttatgcttatgatgttttttttcctgaaatattatatccagttatttcctcctcatgctaatagatccttgcagttcc

SEQ ID NO: 5074 - DNA, 2745 bp, Zea mays
tcatccggcaaccaaccacgccccaaaagtctctccccgttgcttccctcccctagtaccagcaatgaacgacgtataaaccacaccaccgccccccgagtcctccctcttgtcatttcgccttcgcccccacccgcccctaccagatctgctccgccgccaccgacaccccctcctcgccttcctccggcgagctcctcgccggagcagggccggccgccgctaccgacccatcacccacaacaggccttactgccgcgtggcccagatccgcgcgctccccgccgatccagatccatggctcgccccggcgcgctcctcctcgccgtcgcggtggccgcgctgctcgcggccgcagtgccgggcgcccgcggattctacctcccggggagctacccgcacaagtacaacgtcggggacgacctcaacgtgaaggtgaactccctcacctccatcgacaccgagatgcccttcagctactacagcctccccttttgcgagccacaagacggtgtcaaggacagcgccgagaacctcggcgagctcctcatgggcgaccgcatcgagaactcgccctaccgcttccgcatgtacaccaacgagtcagacgtcttcctctgccgctccccaccgctgggcgccgacgccttctctctcctcaagaagcgcatcgacgagatgtaccaggtcaacctcatcctagacaacctccccgccatccgctacaccaggaaggacgactacatcatgcgctggacggggtaccccgtcgggatccgcgtcggcgtcgactactacgtcttcaaccacctccagttcaccgtcctcgtccacaagtacgaggatgccaatgtcgcgcgcgtcataggcgccgccgacgccaccgacgccatcccctccggggctaaggatgccgcctcctcctcccctggatggatggtggtcgggttcgaggttgtgccctgcagtatcaagcacaacccagaggacgtcaagtcgcgcaagatgtacgacagctaccccagcaagatcaagtgcgacccgaccaccgtgtccatgagcatcaaggagaacgagcctattgtctacacctatgaggtgaacttcgtggaaagcgacatcaagtggccctccaggtgggatgcctacctcaagatggagggggccaaggtgcactggttctccattctcaactccctcatggtgattgccttccttgctggtattgtctttgtcattttgctgaggaccgtgaggcgtgatctcaccaagtacgaggagcttgacagtgaagcgcaggcccagatgaatgaggagctgtccggatggaagcttgtggtcagtgatgtgttccgtgcgccaagcaacccgatgctgctttgtatcatggttggggacggtgttcagatccttgggatggcggttgtgaccattctctttgctgcgctcgggttcatgtccccagcctcccgtggtactctgatcacgggcatgctgttcttctatctggtccttggaatcctggctggatatgttggtgttcgcgtatggaagacgatcaagtgtggggatcactctgggtgggtcgctgtgtcgtggcgggtggcttgcttcttccccggcattgcattcctgatcctgaccacactcaacttcctattgtggggaagccacagcactggtgccatccctttctcattgttcgttgtgctgcttctgctctggttctgcatctccgtgccgctcacgcttgttggcgggttccttggtgccaaggctccacatattgagtaccctgtccgcacgaaccagatccctcgtgaaatccctcctcagaagtacccatcctggttgttggttcttggtgctggcacactgcccttcggcaccctattcatcgagctcttcttcatcatgtcaagcatatggatgggtcgtgtgtactatgtctttgggttcctcttcgtcgtcttgctgctcctggttattgtctgtgctgaagtttccctggttctaacttacatgcacctgtgtgttgaggattggaagtggtggtggaagtcattcttctcatctggatcggtggcaatctacattttcttgtactccatcaactatcttatttttgacctcaaaagcctgagtgggccagtgtctgctaccctctacatcggttactcactcttcatggtgattgctatcatgctggcaactggcacagttgggtttatttcttcattctgcttcgtccactatcttttctcatcggtgaaagcagattaagtttcttcctgctgaggattcaagtcactcaattgagaggtgagcagaatggacagtgaaaagtttgtagtcacaaatcttagttcatgtcatcttttggtatacaaaagcctggacaactattgcaagggctactaggattcatcaatggatctgtggagaggtgtttgcagcttgcacgatgtaataggttgaattgctttattctcatgtggcgttgctatagttgtttttagattaccattactatatctcaatatgtatgctaagtaccatatctgcttgaatttatgtttattgacattttccccgaatgttagatctagttatctacttatctgctgcaatgtatgtctgttgacatttgccccaaatgttggatccagttatcgccacctactaatagatctttgtagttccacataaaacataattgctgctagaaatcatcatgttggtatt

SEQ ID NO: 5075 - DNA, 2280 bp, Brachypodium distachyon
atccgctggtcgaagccgccgatccagatccagcggcggcgccatggcccgcctcttcttccttgtcgcggcggcggtggccgtcctcatgtccgcgccagtcgcacacgccttctacctcccggggagctacccgcacaagtacaacccgggggatagcctgaacgtcaaggtgaactcgctcacctccatcgacaccgagatcccgttcagctactacagcctccccttctgcaccccgtccgagggcgtcaaggacagcgccgagaacctcggcgagctcctcatgggcgaccgcatcgagaactcgccctaccgcttcaagatgtacaccaacgagaccgacgtcctgctctgccgctccgccccgctcgcccccgacgccttctccctcctcaagaagcgcatcgacgagatgtaccaggtcaacctcatcctcgacaacctccccgccatccgctacaccaagaaggacgactacttcctccgctggaccggctaccccgtcggcatccgcgtcggcgtcgactactacgtcttcaaccacctccagttcaccgtcctcgtgcacaagtacgaggaccccaatgtcgcgcgcgtcatgggcaccggcgacgccaccgacggcatacctaccgggggcggcaaggacgccgccggctcctctgggtggatggttgttgggtttgaggtcgtgccttgcagcatcaagcacagccccgaggacgtcaagtcgctcaagatgtacagcaagtaccccagcaagatcaagtgtgatccggccaccgtctccatgagcatcaaggagaacgagccgatcgtctacacttacgaagtaacattcgtggagagcgacatcaagtggccctcgcggtgggatgcgtacctcaagatggagggtgccaaggtgcactggttctccatcctcaactcgctcatggtgattgctttcctagctggtattgtgtttgtcatattgttgaggactgtgaggcgtgatctgacgaggtatgaggagcttgacagtgaggcgcaggcccagatgaatgaggaactgtctgggtggaagcttgtggtcagtgatgtcttccgtgcgccaagcaacccaattctgctctgcatgatggttggggatggtgttcagatccttggaatggcggtagtgaccatcctgtttgctgcacttgggttcatgtcaccggcctcccgtggtactctgatcacaggcatgctcttcttctatctggttcttggaattctggcaggatatgcgagtgttcgggtgtggaagacaatcaagtgtggcgatcactcagggtgggtgggtgtttcgtggaggacagcctgcttcttccctggtatcgcattcctgatccttacgacactgaacttcctgttgtggggaagccaaagcactggagccatcccattctcactgttcgttgtgttgattctgctctggttctgcatctctgtgccgcttacacttgttggcggattcctcggtgctaaggcaccacacattgagtaccctgtccgcacaaaccagatccctcgtgaaatccctgctcagaagtacccatcctggttgctggttcttggtgctggcacgctgcccttcggcacccttttcatcgagctcttcttcatcatgtcaagcatatggatggggcgagtgtactatgtcttcggattcctcttcattgtgatgttgctcctggttattgtctgtgctgaggtttccctggttctgacctacatgcacctctgtgtcgaggattggaagtggtggtggaaatcattcttctcatctggatctgtggcgatctacattttcctatactcgatcaactaccttgtttttgacctcaaaagcctgagcggaccagtgtcggcaaccctctacctcggctactcgctcttcatggttattgctattatgctggctaccggtacggttgggttcatttcctcattctgcttcgtccactaccttttttcatctgtgaaggctgattaagtttctccctgcgaagagtatcactcaatggagaggtgagcatagtggagtcgaccattgaaaagtttgtagtcacagggtcttagttcatcccaacttttggtatacctggccttaataactgagattgtatggtttagtaggattcatcaatggactttatcaagtggtgccagcgtgcacaatgtaataggatgaattggtttattcacattttgcgtttagttgctcatcgtgccattaatatgcatggttattat

SEQ ID NO: 5076 - DNA, 2664 bp, Brachypodium distachyon
aagaagaggaaaaaaccgcgagatcgacgaagggaagggagagagagcaagcgctgcaggcaccgacaccgacacgcccacagatccgccaagcaacaccgcgtcacgcccacgccgtataaaccaaaccatcccctcgcctcgtctcgccgctcccctcttcattcctcgccgccgcccccagatctgctcctcctccaccgacactccccttcaccccgtctccggcgaggcgggtctcgccggagcaccgcccgtttcccgctcccccgctccagatccgctggtcgaagccgccgatccagatccagcggcggcgccatggcccgcctcttcttccttgtcgcggcggcggtggccgtcctcatgtccgcgccagtcgcacacgccttctacctcccggggagctacccgcacaagtacaacccgggggatagcctgaacgtcaaggtgaactcgctcacctccatcgacaccgagatcccgttcagctactacagcctccccttctgcaccccgtccgagggcgtcaaggacagcgccgagaacctcggcgagctcctcatgggcgaccgcatcgagaactcgccctaccgcttcaagatgtacaccaacgagaccgacgtcctgctctgccgctccgccccgctcgcccccgacgccttctccctcctcaagaagcgcatcgacgagatgtaccaggtcaacctcatcctcgacaacctccccgccatccgctacaccaagaaggacgactacttcctccgctggaccggctaccccgtcggcatccgcgtcggcgtcgactactacgtcttcaaccacctccagttcaccgtcctcgtgcacaagtacgaggaccccaatgtcgcgcgcgtcatgggcaccggcgacgccaccgacggcatacctaccgggggcggcaaggacgccgccggctcctctgggtggatggttgttgggtttgaggtcgtgccttgcagcatcaagcacagccccgaggacgtcaagtcgctcaagatgtacagcaagtaccccagcaagatcaagtgtgatccggccaccgtctccatgagcatcaaggagaacgagccgatcgtctacacttacgaagtaacattcgtggagagcgacatcaagtggccctcgcggtgggatgcgtacctcaagatggagggtgccaaggtgcactggttctccatcctcaactcgctcatggtgattgctttcctagctggtattgtgtttgtcatattgttgaggactgtgaggcgtgatctgacgaggtatgaggagcttgacagtgaggcgcaggcccagatgaatgaggaactgtctgggtggaagcttgtggtcagtgatgtcttccgtgcgccaagcaacccaattctgctctgcatgatggttggggatggtgttcagatccttggaatggcggtagtgaccatcctgtttgctgcacttgggttcatgtcaccggcctcccgtggtactctgatcacaggcatgctcttcttctatctggttcttggaattctggcaggatatgcgagtgttcgggtgtggaagacaatcaagtgtggcgatcactcagggtgggtgggtgtttcgtggaggacagcctgcttcttccctggtatcgcattcctgatccttacgacactgaacttcctgttgtggggaagccaaagcactggagccatcccattctcactgttcgttgtgttgattctgctctggttctgcatctctgtgccgcttacacttgttggcggattcctcggtgctaaggcaccacacattgagtaccctgtccgcacaaaccagatccctcgtgaaatccctgctcagaagtacccatcctggttgctggttcttggtgctggcacgctgcccttcggcacccttttcatcgagctcttcttcatcatgtcaagcatatggatggggcgagtgtactatgtcttcggattcctcttcattgtgatgttgctcctggttattgtctgtgctgaggtttccctggttctgacctacatgcacctctgtgtcgaggattggaagtggtggtggaaatcattcttctcatctggatctgtggcgatctacattttcctatactcgatcaactaccttgtttttgacctcaaaagcctgagcggaccagtgtcggcaaccctctacctcggctactcgctcttcatggttattgctattatgctggctaccggtacggttgggttcatttcctcattctgcttcgtccactaccttttttcatctgtgaaggctgattaagtttctccctgcgaagagtatcactcaatggagaggtgagcatagtggagtcgaccattgaaaagtttgtagtcacagggtcttagttcatcccaacttttggtatacctggccttaataactgagattgtatggtttagtaggattcatcaatggactttatcaagtggtgccagcgtgcacaatgtaataggatgaattggtttattcacattttgcgtttagttgctcatcgtgccattaatatgcatggttattatatttctctgttgcggatttttcttctgtgacgttctaatacattattgtacagctgccaaaatctttgctactgccaaatatgatgatgatgatgatggtgcaaac

SEQ ID NO: 5077 - DNA, 2777 bp, Oryza sativa
cgcatccattcgttcgttcatcgcaaaaccaaggggggatgatcatctccagccacgtataaacccaaccaaacaccctcccccctctcgcccacccccccattccgccgcccccacccccagatctactccaccgccaccgccaccgacacccccgtctccggcgagtccccccgccgcctcctcgccggagaacccgcctcccctcccccaaccctaaagcctccccgtctcattcgcccccccaccggatccagatcaaaaccacacgccgatccagatcccgccgggcgcccagccatggcgcgcctcctccccttcctcgtcgcggcggcggcggcgttggtggcggtgtccctctccgcgccaggcgccgacgggttctacctcccggggagctacccgcacaagtacaaccccggcgagccgctgagcgtgaaggtgaactccctcacctccatcgacaccgagatcccctacagctactacagcctcccgttctgcacccctcccgacggcgtcaaggacagcgccgagaacctcggcgagctcctcatgggcgaccgcatcgagaactccccctaccgcttccggatgcacgccaacgactccgacctcttcctctgccgctccccgccgctcgccgccgacgccttcaacctccttaagaagcggatcgacgagatgtaccaggttaacctcatcctcgacaacctccccgccatccgctacaccaagaaggacgactacttcctccgatggaccggctaccccgtcggcatccgcgtcggcgtcgactactacgtcttcaaccacctccagttcaccgtcctcgtgcacaagtacgaggaggccaatgtcgcccgtgtcatgggcaccggcgacgccaccgacggcttcccttccaccggcaaggacggcagcggcggcgccgccgggtcatccggctggatggttgtcggcttcgaggtcgtgccttgtagcatcaagcacaaccccgacgacgtcaagtcgctcaagatgtatggcaagtacccgaggagcatcaagtgcgacccgaccaccgtgtccatgagcatcaaggagaacgagcccatcgtgtacacctacgaggtgtcgttcgtcgagagcgatatcaagtggccctcgaggtgggacgcatacctcaagatggagggtgccaaggtgcactggttctcgatcctcaactcgctcatggtgattgctttccttgctggtatcgtgtttgtcatattactgaggaccgtgaggcgtgatctgacgaggtatgaggagcttgacagtgaagcgcaggcgcagatgaacgaggagctgtctgggtggaagcttgttgtcagtgatgttttccgcgcgccaagcaacccaatgttgctctgcgttatggtcggggatggtgttcagatccttgggatggcagtggtgaccattctgtttgcggcgcttgggttcatgtcaccagcttcccgcggtactctgatcacgggcatgctgttcttctatctggttcttggaattttggcaggatatgtgggtgttcgtgtgtggaagacaatcaagtgcggtgatcatacagggtggatggctgtttcatggagggtagcttgcttcttccccggcattgcattcctgatccttaccactctgaacttcctgttgtggggaagccaaagcacaggagccatccccttctcgttgtttgtcatattgattctgctctggttctgtatctctgtgccgcttacacttgtaggtggactcctcggtgccaaggcaccgcacattgagtaccccgtgcgcactaaccagatccctcgtgaaatcccacctcagaagtacccatcctggttgctggttctcggcgctggcacactgccctttggtaccctgttcatcgagctcttcttcatcatgtctagcatatggatggggcgtgtgtactatgtctttggattcctcttcatcgtcctgttgctccttgttattgtctgcgctgaggtttcccttgttctgacctacatgcatctctgtgtcgaggattggaaatggtggtggaaatcattcttctcatctggatctgtggcgatctacattttcttgtactcgatcaactatcttgtttttgacctaaagagcttgagtggacctgtgtcggcgaccctctatctcggctactcactcttcatggttattgctattatgctggctactggaacagtgggattcatttcatcattctgcttcgtccactatcttttctcatccgtgaaagcagattaagctcatcccgatgcagagtgtattactcaaatgagaggtgagaatagtggacatcaaaaagtttgtagtcacaaaatcttagctcatgtcatcttttggtatacaaagactgaataactattgtaagctttactaggatttatcaatgggttttatggagagatgtgctagcagcttgcacgatgtaatagaatgaattggtttattcacattttgagtcattttagttgctctttctgctgccatttagctgttaagatgtaagcttagtactgctgtctgttgcaatcgtgtttggtatcattttcctaaaatgttagatcaattttttgacttatcagaattgtgatggtttgatgcagttgctacacaatatagtgattatacttatttttctttgcaccagaactccaactcctaccttggttcatataagaaactctccttattttgtatggagtaataattaatagtcttca

SEQ ID NO: 5078 - DNA, 2615 bp, Oryza sativa
ccacccccccattccgccgcccccacccccagatctactccaccgccaccgccaccgacacccccgtctccggcgagtccccccgccgcctcctcgccggagaacccgcctcccctcccccaaccctaaagcctccccgtctcattcgcccccccaccggatccagatcaaaaccacacgccgatccagatcccgccgggcgcccagccatggcgcgcctcctccccttcctcgtcgcggcggcggcggcgttggtggcggtgtccctctccgcgccaggcgccgacgggttctacctcccggggagctacccgcacaagtacaaccccggcgagccgctgagcgtgaaggtgaactccctcacctccatcgacaccgagatcccctacagctactacagcctcccgttctgcacccctcccgacggcgtcaaggacagcgccgagaacctcggcgagctcctcatgggcgaccgcatcgagaactccccctaccgcttccggatgcacgccaacgactccgacctcttcctctgccgctccccgccgctcgccgccgacgccttcaacctccttaagaagcggatcgacgagatgtaccaggttaacctcatcctcgacaacctccccgccatccgctacaccaagaaggacgactacttcctccgatggaccggctaccccgtcggcatccgcgtcggcgtcgactactacgtcttcaaccacctccagttcaccgtcctcgtgcacaagtacgaggaggccaatgtcgcccgtgtcatgggcaccggcgacgccaccgacggcttcccttccaccggcaaggacggcagcggcggcgccgccgggtcatccggctggatggttgtcggcttcgaggtcgtgccttgtagcatcaagcacaaccccgacgacgtcaagtcgctcaagatgtatggcaagtacccgaggagcatcaagtgcgacccgaccaccgtgtccatgagcatcaaggagaacgagcccatcgtgtacacctacgaggtgtcgttcgtcgagagcgatatcaagtggccctcgaggtgggacgcatacctcaagatggagggtgccaaggtgcactggttctcgatcctcaactcgctcatggtgattgctttccttgctggtatcgtgtttgtcatattactgaggaccgtgaggcgtgatctgacgaggtatgaggagcttgacagtgaagcgcaggcgcagatgaacgaggagctgtctgggtggaagcttgttgtcagtgatgttttccgcgcgccaagcaacccaatgttgctctgcgttatggtcggggatggtgttcagatccttgggatggcagtggtgaccattctgtttgcggcgcttgggttcatgtcaccagcttcccgcggtactctgatcacgggcatgctgttcttctatctggttcttggaattttggcaggatatgtgggtgttcgtgtgtggaagacaatcaagtgcggtgatcatacagggtggatggctgtttcatggagggtagcttgcttcttccccggcattgcattcctgatccttaccactctgaacttcctgttgtggggaagccaaagcacaggagccatccccttctcgttgtttgtcatattgattctgctctggttctgtatctctgtgccgcttacacttgtaggtggactcctcggtgccaaggcaccgcacattgagtaccccgtgcgcactaaccagatccctcgtgaaatcccacctcagaagtacccatcctggttgctggttctcggcgctggcacactgccctttggtaccctgttcatcgagctcttcttcatcatgtctagcatatggatggggcgtgtgtactatgtctttggattcctcttcatcgtcctgttgctccttgttattgtctgcgctgaggtttcccttgttctgacctacatgcatctctgtgtcgaggattggaaatggtggtggaaatcattcttctcatctggatctgtggcgatctacattttcttgtactcgatcaactatcttgtttttgacctaaagagcttgagtggacctgtgtcggcgaccctctatctcggctactcactcttcatggttattgctattatgctggctactggaacagtgggattcatttcatcattctgcttcgtccactatcttttctcatccgtgaaagcagattaagctcatcccgatgcagagtgtattactcaaatgagaggtgagaatagtggacatcaaaaagtttgtagtcacaaaatcttagctcatgtcatcttttggtatacaaagactgaataactattgtaagctttactaggatttatcaatgggttttatggagagatgtgctagcagcttgcacgatgtaatagaatgaattggtttattcacattttgagtcattttagttgctctttctgctgccatttagctgttaagatgtaagcttagtactgctgtctgttgcaatcgtgtttggtatcattttcctaaaatgttagatcaattttttgacttatcagaattgtgatggtttgatgcagttgctacacaatatagtgattatacttatttttctttgcaccagaa

SEQ ID NO: 5079 - DNA, 2452 bp, Avena sativa
tgagtcgagcccagtcctcgcctccttcatttctcgcccgccgccctccagatctgccccgcgcctccaccgacaccccactccggcgccggagccccaccgccacatcctccactcccattgccagatccgccgcgccccagggtcgaagccgccgaccgcgatccagatccggcggccatggccccccgcctccgcgcactgcgcctcctcctcgcgctcgccgcggctgcggcggtcctcctctcctccccgccctccaccgacgccttctacctcccggggagctacccgcacaagtacaacccgggggagatcctcaacgtcaaggtgaactcgctcacctccatcgacaccgagatccccttcagctactacagcctccccttctgcaccccgcccgagggggtcaaggacagcgccgagaacctgggcgagctcctcatgggcgaccgcatcgagacctccccctaccgcttccggatgcacgccaacgagaccgacgtcctgctctgccgctccgacccgctctccccgggcgccttcgccctcatgaagaagcgcatcgacgagatgtaccaggtcaacctcatcctagacaacctccccgccatccgctacaccaggaaggacgactacttcctccgctggaccggctaccccgtcggcatccgcgtcgccgccgactactacgtcttcaaccacctccagttcaccgtcctcgtgcacaagtacgaggaccccaacgtcgcgcgcgtcatgggcaccggcgacgcctccgacggcatccccaccggcaaggacggcgcctcctcctcctcctctggctggatggtcgtcgggttcgaggtcgtgccctgcagcatcaagcacaacccggacgacgtcaagtcgctcaagatgtacggcaagtaccccagcaggatcaagtgcgaccccaccaccgtctccatgagcatcaaggagaacgagcccatcgtctacacctacgaggtctccttcgtcgagagcgacatcaagtggccctccaggtgggacgcctacctcaagatggagggagccaaggtgcactggttctccatcctcaactcgctcatggtcatcgctttcctggctggtatcgtctttgtcatattgttgaggaccgtgaggcgtgatctgacgaggtacgaggagcttgacagcgaggcgcaggcacagatgaacgaggaactgtccgggtggaagcttgtggtcagtgatgtcttccgtgccccgagcaacccaatgctgctctgcatgatggttggggacggtgttcagatccttggaatggcggtcgtcaccatcctgtttgctgcactggggttcatgtcaccggcctcccggggtactctgatcacaggcatgctcttcttttacctggttctcgggatcctggcaggatacgccagtgttcgtgtgtggaagacgatcaggtgtggagatcactctggctgggtgggtgtttcgtggaggacagcctgcttcttccctggtatcgcgttcctgatcctcaccacgctgaacttcctgttgtggggaagccagagcaccggcgccatcccattctcactgtttgttgtgttgattctgctctggttctgcatctctgtgccgcttacacttgttggtgggttcctcggggccaaggcatcacacattgagtaccctgtccgcacaaaccagatccctcgtgaaatccctgctcagaagtacccatcctggctgctggttcttggtgccggcaccctgccctttggcacccttttcatcgagctcttcttcatcatgtcaagcatatggatggggcgtgtctactatgtcttcgggttcctcttcatcgtgatgttgctcctggttattgtctgcgctgaggtttcccttgttctgacttacatgcacctctgcgtcgaggactggaagtggtggtggaaatcattcttctcatctggatctgtggccatctacattttcctctactcgatcaactaccttgtttttgacctcaagagcctgagcggaccagtgtcggcgaccctctacctcggctactcgctcttcatggttattgctattatgctggctactggcacggttgggttcatttcctcgttctgcttcatccactatctcttttcatctgtgaaggctgattaagtctctccctgcgaggagtcttgtcattcaattgagaggtgagcatagtggagtggacattgaaatttgtagtcactaagtcttagttcatcccaacttttggtatacatgcacttaataactattgtatggactagtaggatttgccaatgggctttatgaagaggtgctggcagcttgcacgatgtaatagaatgaattggtttattcacacttcgtgttctcttagttattcagtctgccattgagtatatcaatatatgcaagcttttgc

SEQ ID NO: 5080 - DNA, 2925 bp, Hordeum vulgare
tctctccatctccatctccatctccatccccaagcaccaacgcgccgtcacgctcacgccgtataaaccaccaccaaacccccgtcgcctcgcgtgactcgcgtccccctccatctccatctccacccccgccgccccagatctgccccctccacctccaccgacgccgcgactgccgtcccactcccagatccagatccggcggccatggcccgcccccgctccacgcgcgcgctcctggcgctcgccctggcggcggcggcggcggcgctcctcctcgccaccccgcccgcggcccacgcgttctacctcccggggagctacccgcacaagtactcccccggggagccgctgagcgtcaaggtgaactcgctcacctccatcgacaccgagatcccctacagctactacagcctgcccttctgcgccccgccggagggggtcaaggacagcgccgagaacctcggcgagctgctcatgggcgaccgcatcgagagctcgccctaccgcttccggatgcacgccaacgagtcggacgtgctgctctgccgctccccgccgctcgaccccaagaccttcgccctcctcaagcgccgcatcgacgagatgtaccaggtcaacctcatcctcgacaacctccccgccatccgctacacccgcaaggacgactacttcctccgctggaccggctaccccgtcggcatccgcgtcggcgtcgactactacgtcttcaaccacctccagttcaccgtgctcgtgcaccgctacgaggaccccaacgtcgcccgcgtcatgggcgccgccggcgacgcttccgacggcgccatcccggccgccaccgccggcagggacgcctctgcctcctccgggtggatggtcgtcggcttcgaggtcgtgccctgcagcatcaagcacaatcccgaggacgccaaggccgtcaagatgtacggcaggttccccagcaagatcaagtgcgaccccaccaccgtctccatgagcatcaaggagaacgagcccatcgtctacacctacgaggtctccttcgtcgagagcgacatcaagtggccctccaggtgggacgcatacctcaagatggagggcgccaaggtgcactggttctccatcctcaactcgctcatggtcattgccttcctcgccggcatcgtcttcgtcatactgctcaggaccgtcaggcgtgacctcacgaggtacgaggagctcgacagcgaggctcaggcccagatgaacgaggagctgtccgggtggaagctcgtcgtcagcgatgtcttccgtgcgcccagcaacccaatgctgctctgcatgatggttggggatggggttcagatccttggaatggccgtggtcaccatcctctttgcagcgctcgggttcatgtcgccggcctcccgtggtaccctcatcacaggcatgctcttcttttacctggtcctcgggatcctggctggatacgccagtgtccgcgtgtggaagacaatcaggtgtggagatcactcaggttgggtgggtgtttcgtggaggacagcctgtttcttccccggcattgcgttcctgatcctcaccacactcaacttcctgctgtggggaagccagagcaccggggccatccccttctcgctgttcgttgtgctgatcctgctctggttctgcatctcggtgccgcttacactcgtcggtgggttcctcggagccaaggcgccgcacattgagtaccctgtgcgcacaaaccagatcccgcgtgagatccctgctcagaagtacccgtcctggctgctggttctcggtgccggcacactgcccttcggcaccctgttcatcgagctcttcttcatcatgtcaagcatctggatgggccgcgtgtactacgtcttcgggttcctcttcatcgtgatgctgctcctggtcatcgtctgcgccgaggtctccctggtcctgacctacatgcacctctgcgtcgaggactggaagtggtggtggaagtcattcttctcgtccggatccgtggccatctacatcttcctctactcgatcaactacctggtgttcgacctcaagagcctgagcgggccggtgtcggcgaccctctacctcggctactcgctcttcatggtcatcgccatcatgctggccaccggcacggttgggttcatctcctcgttctgcttcgtgcactatctcttctcgtctgtgaaggccgattaagtttctccctggaagggggtgatcattgaattgagaggtgagtaagcatagaggagtgggcattgaaaagtttgtagtcatcacattcggtagttcatcccaacttttggtatacatgtcctgaataactatttgtatggtctagtaggattcgcccggtgggctttatgatgaggtgcatgcagcttgcacggtgtaatagaatggattggtttattcacattttactgtcattttagctaatcgttctgccatttagtgcctccatatatcagtatggaagctttggtagttttctctgctgcggcttatgacgttcagtcagttgtctgaaatattagatgacatccagtagtttgcatgatgccaggattgtccgttagttatggtgccaattatgatgattatgatgaactgttattgcaaatgtttctttgctcagaaccattggttagggcagtagttgttacagtatgtcaagagtgtctgacagattagggtttgatgttttccccacttctgctttagatgtccattcaaatacaagaggagaactccagtgtccccagtacaaaatagttcacttctgctatatatgttccagtcattaatctgaaatgttggatccagttgtttcacatgctgccagagtcttctgctagttagtgcaatgtatgatgctgataaattgattatgcaaatgtt

SEQ ID NO: 5081 - DNA, 2526 bp, Triticum aestivum
tcccacgcgtccgcccacgcgtccgccgcccgggatccaccgacaccccacccccctcccccgccgacgccactcccactgccgccccagatccagatccggcggccatggccatggcggcggcccgcccgcgcctcctcctcctgctcgccgcggcggcggcggcgctcctcctcaccccggcccacgccttctacctcccggggagctacccgcacaagtacgccccgggggagcccctcagcgtgaaggtgaactcgctcacctccatcgacaccgagatcccctacagctactacagcctgcccttctgcgcgccgccggagggggtcaaggacagcgcggagaacctcggggagctgctcatgggcgaccgcatcgagagctcgccctaccgcttcaagatgcacgccaacgagtcggacgtgctgctctgccgctccgcccccctctccccgccggacttcgcgctcctcaagcgccgcatcgacgagatgtaccaggtcaacctcatcctcgacaacctccccgccatccgctacacccgtaaggacgactacttcctccgctggacggggtaccccgtcggcatccgcgttggcgtcgactactacgtcttcaaccacctccagttcaccgtgctcgtgcaccgctacgaggaccccaacgtcgcccgcgtcatgggcgccgccggcgacgcctccgacggcgccgccgtccccgccaacgccggcaaggacgcctccgccgcccccggctggatggtcgtcggcttcgaggtcgtgccctgcagcatcaagcacaaccccgaggacgccagggccgtcaagatgtacggcaaattccccagcaagatcaagtgcgacccctccaccgtctccatgagcatcaaggagaacgagcccatcgtctacacctacgaggtctccttcgtcgagagcgacatcaagtggccctcccggtgggacgcctacctcaagatggagggcgccaaggtgcactggttctccatcctcaactcgctcatggtcatcgcgttcctcgccggcatcgtcttcgtcatactgctcaggaccgtcaggcgcgatctcacgaggtacgaggagctcgacagtgaggcgcaggcccagatgaacgaggagctgtccgggtggaagctcgtggtcagcgatgtcttccgtgcgcccagcaacccaatgctgctctgcatgatggttggtgatggggttcagatcctcggaatggccgtggtcaccatcctgtttgccgcgcttgggttcatgtcgccggcctcccgtggtaccctgatcacaggcatgctcttcttctacctggtcctcgggatcctggcaggatacgccagtgtccgcgtctggaagacaatcaggtgtggagatcactcgggctgggtgggtgtttcgtggaggacagcctgcttcttccctggcatcgcgttcctgatcctcaccacactcaacttcctgctgtggggaagccagagcaccggcgccatccccttctcgctgttcgttgtgctgatcctgctctggttctgcatctctgtgccgcttacactcgtcggcgggttcctcggtgccaaggcgccgcacatcgagtacccggtccgcacaaaccagatcccgcgtgagatccctgcccagaagtacccgtcctggctgctggttctcggcgccggcacgctgcccttcggcaccctgttcatcgagctcttcttcatcatgtcaagcatctggatggggcgcgtgtactacgtcttcgggttcctcttcatcgtgatgctgctcctggtcatcgtctgcgccgaggtctccctggtcctgacctacatgcacctctgcgtggaggactggaagtggtggtggaagtcattcttctcatccggatccgtggccatctacatcttcctctactcgatcaactacctggtgttcgacctcaagagcctgagcgggccggtgtcggcgaccctctacctcggctactcgctcttcatggtcatcgccatcatgctggccaccggcacggtcgggttcatctcctcgttctgcttcgtgcactatctcttctcgtctgtgaaggccgattaagttcctcctccctgcgaggagtgaccattgaattgagaggtgagtaagcatagtggagtgggcattggaaagagtttgtagccatcacagtcggtagtccatcccaacttttggtatacatgtcctgaataactatttgtatggtctaggtaggattcgcccggtgggctttatgatgaggtgcaggcagcttgcacgatgtaatagaatgaattggtttattcacatttaccgccattttagctgatcattctgccatttagtactttatatatgaatgtgcaagcttagtagtggttcatttccagtcattcattggaaatgtcataggtcaagtggtctacatgctgccagagtcctctgctagttagtgccgactgtcatgatgttaaattgatattgcatactccctccgtcc

SEQ ID NO: 5082 - DNA, 2659 bp, Hordeum vulgare
gccctggcggcggcggcggcggcgctcctcctcgccaccccgcccgcggcccacgcgttctacctcccggggagctacccgcacaagtactcccccggggagccgctgagcgtcaaggtgaactcgctcacctccatcgacaccgagatcccctacagctactacagcctgcccttctgcgccccgccggagggggtcaaggacagcgccgagaacctcggcgagctgctcatgggcgaccgcatcgagagctcgccctaccgcttccggatgcacgccaacgagtcggacgtgctgctctgccgctccccgccgctcgaccccaagaccttcgccctcctcaagcgccgcatcgacgagatgtaccaggtcaacctcatcctcgacaacctccccgccatccgctacacccgcaaggacgactacttcctccgctggaccggctaccccgtcggcatccgcgtcggcgtcgactactacgtcttcaaccacctccagttcaccgtgctcgtgcaccgctacgaggaccccaacgtcgcccgcgtcatgggcgccgccggcgacgcttccgacggcgccatcccggccgccaccgccggcagggacgcctctgcctcctccgggtggatggtcgtcggcttcgaggtcgtgccctgcagcatcaagcacaaccccgaggacgccaaggccgtcaagatgtacggcaggttccccagcaagatcaagtgcgaccccaccaccgtctccatgagcatcaaggagaacgagcccatcgtctacacctacgaggtctccttcgtcgagagcgacatcaagtggccctccaggtgggacgcatacctcaagatggagggcgccaaggtgcactggttctccatcctcaactcgctcatggtcattgccttcctcgccggcatcgtcttcgtcatactgctcaggaccgtcaggcgtgacctcacgaggtacgaggagctcgacagcgaggctcaggcccagatgaacgaggagctctccgggtggaagctcgtcgtcagcgatgtcttccgcgcgcccagcaacccaatgctgctctgcatgatggttggggatggggttcagatccttggaatggccgtggtcaccatcctctttgcagcgctcgggttcatgtcgccggcctcccgtggtaccctcatcacaggcatgctcttcttttacctggtcctcgggatcctggctggatacgccagtgtccgcgtgtggaagacaatcaggtgtggagatcactcaggttgggtgggtgtttcgtggaggacagcctgtttcttccccggcattgcgttcctgatcctcaccacactcaacttcctgctgtggggaagccagagcaccggggccatccccttctcgctgttcgttgtgctgatcctgctctggttctgcatctcggtgccgcttacactcgtcggtgggttcctcggagccaaggcgccgcacattgagtaccctgtgcgcacaaaccagatcccgcgtgagatccctgctcagaagtacccgtcctggctgctggttctcggtgccggcacactgcccttcggcaccctgttcatcgagctcttcttcatcatgtcaagcatctggatgggccgcgtgtactacgtcttcgggttcctcttcatcgtgatgctgctcctggtcatcgtctgcgccgaggtctccctggtcctgacctacatgcacctctgcgtcgaggactggaagtggtggtggaagtcattcttctcgtccggatccgtggccatctacatcttcctctactcgatcaactacctggtgttcgacctcaagagcctaagcgggccggtgtcggcgaccctctacctcggctactcgctcttcatggtcatcgccatcatgctggccaccggcacggttgggttcatctcctcgttctgcttcgtgcactatctcttctcgtctgtgaaggccgattaagtttcttcctggaagggggtgatcattgaattgagaggtgagtaagcatagaggagtgggcattgaaaagtttgtagtcatcacattcggtagttcatcccaacttttggtatacatgtcctgaataactatttgtatggtctagtaggattcgcccggtgggctttatgatgaggtgcatgcagcttgcacggtgtaatagaatggattggtttattcacattttactgtcattttagctaatcgttctgccatttagtgcctccatatatcagtatggaagctttggtagttttctctgctgcggcttatgacgttcagtcagttgtctgaaatattagatgacatccagtagtttgcatgatgccaggattgtctgttagttatggtgccaattatgatgattatgatgaactgttattgcaaatgtttctttgctcagaaccattagttagggcagtagttgttacagtatgtcaagagtgtctgacagattagggtttgatgtttcccccacttctgctttagatgtccattcaaatacaagaggagaactccagtgtccccagtacaaaatagttcagtcattaatctgaaatgttggatccagttgtttcacatgctgccagagtcttctgctagttagtgcaatgtatgatgctgataaattgattatgcaaatgtt

SEQ ID NO: 5083 - DNA, 2281 bp, Secale cereale
gatccagatccggcggccatggccaaggccgcggcccgcccgcgcctcctcctcctgctcgccgcggcggcggcggcgctcctcctcctcgcccccgcgcccgcccgcgccttctacctgccggggagctacccgcacaagtacgccccgggggagccgctgagcgtcaaggtgaactcgctcacctccatcgacaccgagatcccctacagctactacagcctgcccttctgcgcgccgccggagggggtcaaggacagcgccgagaacctgggggagctgctcatgggcgaccgcatcgagagctcgccctaccgcttcaggatgcacgccaacgagtcggacgtgctgctctgccgctcgccgccgctctccccgccggacttcgcgctcctcaagcgccgcatcgacgagatgtaccaggtcaacctcatcctcgacaacctccccgccatccgctacacccgcaaggacgactacttcctgcgctggacgggctaccccgtcggcatccgcgtcggcgtcgactactacgtcttcaaccacctccagttcaccgtcctcgtccacaagtacgaggaccccaacgtcgcccgcgtcatgggcgccgccggcgacgcctccgacggccccgccaacaccggcaaggacgcctccgccgcccccggctggatggtcgtcggcttcgaggtcgtgccctgcagcatcaagcacaaccccgaggacgccagggccgtcaagatgtacggccggttccccagcaagatcaagtgcgacccctccaccgtctccatgagcatcaaggagaacgagcccatcgtctacacctacgaggtctccttcgtcgagagcgacatcaagtggccctccaggtgggacgcctacctcaagatggagggcgccaaggtgcactggttctccatcctcaactcgctcatggtcattgctttcctcgccggcatcgtcttcgtcatactgctcaggaccgtcaggcgggatctcacgaggtacgaggagctcgacagtgaggcgcaggcacagatgaacgaggagctgtccgggtggaagctcgtggtcagcgacgtcttccgtgcgcccagcaacccaatgctgctctgcatgatggttggggatggggttcagatccttggaatggcagtggtcaccatcctgtttgctgcgctcgggttcatgtcgccggcctcccgtggtaccctcatcacaggcatgctcttcttttacctggtcctcgggatcctggcaggatacgccagtgtccgcgtctggaagacaatcaggtgcggagatcactcgggctgggtgggtgtttcgtggaggacagcctgcttcttccctggcatcgccttcctgatcctcaccacactcaacttcctgctgtggggaagccagagcaccggcgccatccccttctcgctgttcgttgtgctgatcctgctctggttctgcatctctgtgccgcttacactcgtcggtgggttcctcggtgccaaggcgccgcacatcgagtaccctgtccgcacaaaccagatcccacgtgagatccctgctcagaagtacccgtcctggctgctggttctcggcgccggcacgctgcccttcggcaccctgttcatcgagctcttcttcatcatgtcaagcatctggatggggcgcgtgtactacgtcttcgggttcctcttcatcgtgatgctgctcctggtcatcgtctgcgccgaggtctccctggtcctgacctacatgcacctctgcgtcgaggactggaagtggtggtggaagtcgttcttctcatccgggtccgtggccatctacatcttcctctactcgatcaactacctggtgttcgacctcaagagcctgagcgggccggtgtcggcgaccctctacctcggctactcgctcttcatggtcatcgccatcatgctggccaccggcacggtcgggttcatctcctccttctgcttcgtgcactatctcttctcgtctgtgaaggccgactaagttcctcccctccccgcgaggagcgatcattgaattgagagaggtgagtgagcatagcggattgggcattgaaaagagtttgtagtcatcatcacagtccctagttcatcccaacttttggtatacatgtcctgaataactatttgtatggtctagtaggattcgcccggtgggctttatgatgaggtgcaggcagcttgcacgatgtaatagaatggattggtttattcacatttcactgtcattttagctaatcgttcgg

SEQ ID NO: 5084 - DNA, 2484 bp, Secale cereale
cgtcgtcctgccgccacgacctgacgccactgcccgccccacccccagatccagatccggcggccatggccaaggccgcggcccgcccgcggctcctcctcctgctcgccgcggcggcggcggcgctcctcctcctcgccccggcccccgcccgcgccttctacctcccggggagctacccgcacaagtacgccccgggggagccactgagcgtcaaggtgaactcgctcacctccatcgacaccgagatcccctacagctactacagcctgcccttctgcgcgccgccggagggggtcaaggacagcgccgagaacctgggggagctgctcatgggcgaccgcatcgagagctcgccctaccgcttcaggatgcacgccaacgagtcggacgtgctgctctgccgctcgccgccgctctccccgccggacttcgcgctcctcaagcgccgcatcgacgagatgtaccaggtcaacctcatcctcgacaacctccccgccatccgctacacccgcaaggacgactacttcctccgctggacgggctaccccgtcggcatccgcgtcggcgtcgactactacgtcttcaaccacctccagttcaccgtcctcgtccacaagtacgaggaccccaacgtcgcccgcgtcatgggcgccgccggcgacgcctccgacggccccgccaacaccggcaaggacgcctccgccgcccccggctggatggtcgtcggcttcgaggtcgtgccctgcagcatcaagcacaacccagaggacgccagggccgtcaagatgtacggcaggttccccagcaagatcaagtgcgacccctccaccgtctccatgagcatcaaggagaacgagcccatcgtctacacctacgaggtctccttcgtcgagagcgacatcaagtggccctccaggtgggacgcctacctcaagatggagggcgccaaggtgcactggttctccatcctcaactcgctcatggtcattgctttcctcgccggcatcgtcttcgtcattctgctcaggaccgtcaggcgggatctcacgaggtatgaggagctcgacagtgaggcgcaggcacagatgaacgaggagctgtccgggtggaagctcgtggtcagcgatgtcttccgcgcgcccagcaacccaatgctgctctgcatgatggttggggatggggttcagatccttggaatggccgtggtcaccatcctctttgccgcgcttgggttcatgtcgccagcctcccgtggtaccctcatcacaggcatgctcttcttttacctggtcctcgggatcctggcaggatacgccagcgtccgcgtctggaagacaatcaggtgtggagatcactcaggctgggtgggtgtgtcgtggaggacagcctgcttcttccccggcattgcgttcctgatcctcaccacactcaacttcctgctgtggggaagccagagcaccggcgccatccccttctcactgtttgttgtgctgatcctgctctggttctgcatctctgtgccgcttacactcgtcggtgggttcctcggtgccaaggcgccgcacattgagtaccctgtccgcacaaaccagatcccgcgtgagatccctgctcagaagtacccgtcctggctgctggttctcggtgccggcacactgcccttcggcaccctgttcatcgagctcttcttcatcatgtcaagcatctggatgggccgcgtgtactacgtcttcgggttcctcttcatcgtgatgctgctcctggtcatcgtctgcgccgaggtctccctggtcctgacctacatgcacctctgcgtcgaggactggaagtggtggtggaagtcgttcttctcatccgggtccgtggccatctacatcttcctctactcgatcaactacctggtgttcgacctcaagagcctgagcgggccggtgtcggcgaccctctacctcggctactcgctcttcatggtcatcgccatcatgctggccaccggcacggtcgggttcatctcctccttctgcttcgtgcactatctcttctcgtctgtgaaggccgactaagttcctcccctccccgcgaggagcgatcattgaattgagagaggtgagtgagcatagccgattgggcattgaaaagagtttgtagtcatcatcacagtccctagttcatcccaacttttggtatacatgtcctgaataactatttgtatggtctagtaggattcgcccggtgggctttatgatgaggtgcaggcagcttgcacgatgtaatagaatggattggtttattcacatttcactgtcattttagctaatcgttcggccatttagtactcttctatatcagtatatgcaagcttagtaatcttctctgctgcagtttatgttctgtcatttctctgaaatgttgggtacgtttttttacagaacaagttgtcagagtattttgcttagataataagtagctaaaataatagaa

SEQ ID NO: 5085 - DNA, 2381 bp, Triticum aestivum
cgcggcggcggcggcgctcctcctcgccccggcccacgccttctacctcccggggagctacccgcacaagtacgccccgggggagccgctgagcgtcaaggtgaactcgctcacctccatcgacaccgagatcccctacagctactacagcctgcccttctgcgcgccgccggagggggtcaaggacagcgcggagaacctcggggagctgctcatgggcgaccgcatcgagagctcgccctaccgcttcaagatgcacgccaacgagtcggacgtgctgctctgccgctccgcccccctctccccgccggacttcgcgctcctcaagcgccgcatcgacgagatgtaccaggtcaacctcatcctcgacaacctccccgccatccgctacacccgcaaggacgactacttcctgcgctggacggggtaccccgtcggcatccgcgtcggcgtcgactactacgtcttcaaccacctccagttcaccgtgctcgtgcaccgctacgaggaccccaacgtcgcccgcgtcatgggcgccgccggcgacgcctccgacggcgccgccgtccccgccaacgccggcaaggacgcctccgccgcccccggctggatggtcgtcggcttcgaggtcgtgccctgcagcatcaagcacaaccccgaggacgccagggccgtcaagatgtacggcaaattccccagcaagatcaagtgcgacccctccaccgtctccatgagcatcaaggagaacgagcccatcgtctacacctacgaggtctccttcgtcgagagcgacatcaagtggccctcccggtgggacgcctacctcaagatggagggcgccaaggtgcactggttctccatcctcaactcgctcatggtcatcgcgttcctcgccggcatcgtcttcgtcatactgctcaggaccgtcaggcgcgatctcacgaggtacgaggagctcgacagtgaggcgcaggcccagatgaacgaggagctgtccgggtggaagctcgtcgtcagcgatgtcttccgtgcgcccagcaacccaatgctgctctgcatgatggttggggatggggttcagatcctgggaatggccgtggtcaccatcctgtttgccgcgcttgggttcatgtcgccggcctcccgtggtaccctcatcacaggcatgctcttcttctacctggtcctcgggatcctggcaggatacgccagtgtccgcgtctggaagacaatcaggtgtggagatcactcgggctgggtgggtgtttcgtggaggacagcctgcttcttccctggcatcgcgttcctgatcctcaccacactcaacttcctgctgtggggaagccagagcaccggcgccatccccttctcgctgttcgttgtgctgatcctgctctggttctgcatctctgtgccgcttacactcgtcggcgggttcctcggtgccaaggcgccgcacatcgagtaccctgtccgcacaaaccagatcccgcgtgagatccctgcccagaagtacccgtcctggctgctggttctcggcgccggcacgctgcccttcggcaccctgttcatcgagctcttcttcatcatgtcaagcatctggatggggcgcgtgtactacgtcttcgggttcctcttcatcgtgatgctgctcctggtcatcgtctgcgccgaggtctccctggtcctgacctacatgcacctctgcgtggaggactggaagtggtggtggaagtcattcttctcgtccgggtccgtggccatctacatcttcctctactcgatcaactacctggtgttcgacctcaagagcctgagcgggccggtgtcggcgaccctctacctcggctactcgctcttcatggtcatcgccatcatgctggccaccggcacggtcgggttcatctcctcgttctgcttcgtgcactatctcttctcgtctgtgaaggccgattaagttcctcctgcctgcgaggagcgaccattgaattgagaggtgagtaagcatagtggagtgggcattggaaagagtttgtagtcatcatcacagtcctagttcatccatcccaacttttggtatacatgtcctgaataactatttgtatggtctaagtaggattcgcccggtgggctttatgatgaggtgcaggcagcttgcacgatgtaatagaatgaattggtttattcacatttactgccattttagctgatcattctgccatttagtactctatatatgaatgtgcaagcttagtagtggtttatttccagtcatttatttgaaatgtcataggtcaagttgtttacatgctgccagagtcctctgctagttagtgccgactgtcatgatgttaaattgatattgcatactccctccgtcc

SEQ ID NO: 5086 - DNA, 2483 bp, Elaeis guineensis
ccccgatcttggactcgcccccaaatctttctctccgcaattgccgagagctccgaaagaaggggcttcgtctctctggcagtcaaagatctggtgggagaatgggttttgcgtcgagatccggggccaagatggtctttttctggagattcaggctctggatcttgttgtccttactggttctcccgtccggagaagggttttacctccctgggagctacccgcacaagtacttggtgggagacaccctgtcggtgaaggtgaactctctcacctccatcgacaccgagatcccctacggctactacagcctccccttctgcaagccccaagaaggcatcaaggacagcgccgagaacctcggcgagctcctcatgggggaccgcatcgagaactccccctaccgcttcaagatgttcaccaacgagtccgacgtcctcctctgccgagccaatcctttgtccacccaagatttcaatctcctcaagaagaggattgatgagatgtatcaggtcaatctgattcttgataacctcccggcgatccggtacaccaagaaaggtgaatacttcctccggtggactgggtacccggtggggatccgggccggcgacacctactatgtgttcaaccacctaaggctcaaagtcttggtgcacaagtacgaggaaaccaatgtggcgaaggtgatgggcaccggggacgcctctgatgcgatcccaagcttggacaagtctggttccggccctggatggatggtggtagggtttgaagtcgtcccttgtagtttccagcatgactctgagtctatcaagaatctaaagatgtacgataagtatccggcaaagattcagtgcgatccgacaacggtgggcatggcgattaaagaaaaccagcctgttgttttcacctatgaggtctcgtttgtggagagtgatatcaagtggccgtctcgatgggatgcttacttgaagatggagggagccaaggttcactggttctcgatcctcaattcgctcatggtcattgccttccttgctggaattgttctcgttatcttcttgaggaccgtccggagggatttgacccgatatgaggagcttgacaaggaggctcaggcgcagatgaacgaggaactctcaggatggaagcttgtggtaggggatgttttcagggcaccgagccatccgcaattgctctgtgtgatggtgggagatggagttcagattcttggcatggcggtggtgaccatcttgttcgccgcgctagggttcatgtcccctgcttctcgaggtactctcatcactggtatgctgttcttctacatggttcttggaattgttgctgggtatgttgctgttaggatttggaagactatcagatgtggggatcattctggatgggtttcagtttcgtggcgtgttgcttgcttctttcctggtattgccttcttgatcctgaccatgctaaacttcctcttgtggggtagtcatagcacgggggccatccctctctctctgttcatcgtgctgctcttgctttggttctgcatctcggtccctcttaccctcgtgggtggattcctcggtgccaaagctccccacattgagtaccctgtgagaactaatcagatcccacgcgagattcctccacagaaatacccgtcatggttgttggttctgggagctgggaccctgccgtttggcacccttttcattgaactcttcttcataatgtctagcatttggatgggtcgtgtctactatgtcttcggctttctctttattgtgttgattcttcttgtggttgtgtgtgccgaggtttcactggttctcacttacatgcatctctgtgtggaggattggaagtggtggtggaaagccttcttctcatcgggatcagtggctatatatattttcttatactcggtaaactatcttgtgtttgatcttaagagtttgagtgggcccgtatctgccactctctaccttggttactcgctcttcatggttattgctatcatgcttgcaaccggcaccattggattcatttcttcattctggttcgtgcattatctattctcctcggtgaaactagattgagctacttccactgttccacgacaaggtgctttcttttccccaagactacgactggagacgtgatgacaaagtgaaaaatatgctctccttaagaataggtttatcagtttctctcatctttattgggctgttgtagttttggcactcagaaaaaagaatattagatttttgctcttaggattctttatttgtcattatatcagagcatagctttcactttattccggacactgtcagatgcaataggatgtacttgtcaagcttctttccctgtcgtttgtttttagcttgttaagctctgagtgtggtcctgtttagtgcactttgtattgagtgataatttgggaatacctgtttcacatttcttatttacctgttttt

SEQ ID NO: 5087 - DNA, 2512 bp, Elaeis guineensis
ctcggactcgcccccgaatctcgccctccgccattgccgagggctccgggcgaaggtgctctgtctttcttgcaagcaaagatctgggggataatgggtttcgcggcgagatccggggccaagatgggaattatctcgagatttaggctctggatcttgttgttcttgttgtttttcttatctggagaagggttttatctccccgggagctacccccataagtacatggtgggagacaccctgtcggtgaaggtgaactctctcacctccatcgacaccgagattcctttcagctactacagccttcccttctgcaagccccaagaaggcatcaaggacagcgccgagaacctcggcgagctcctcatgggcgatcgcatcgagaactccccctatcgcttcaagatgttcaccaacgagtccgacatcctcctctgccgaaccggtcctctgtccacccaagattttaatctcctcaagaagaggatcgatgagatgtatcagattaatctgattcttgataatctcccggcgatccggtacaccaataaaggtgattacgtcctccggtggactgggtatccggtagggatccgggcgggcgacgcctattatgtgttcaaccacctgaagttcacagttttggtgcacaaatacgaggagaccaatgtagcgaaggtgatgggcactggggatgcctctgctgcgatcccctccttggacaagtctggttctggctcgcctgggtggatggtcgtcgggttcgaggtcgttccttgcagtttccagcatgattcagagtccatcaagaatctgaagatgtacgacaagtacccggcgaagattcagtgtgattccactacggtggccatgagcatgaaagaaaagcagcccattgttttcacctatgaggtctctttcgtggagagcgatatcaagtggccatcccgatgggatgcttacctgaagatggagggagccaaggttcactggttctcaatcctcaattcactcatggtgattgccttccttgctggcattgttcttgttatcttcttgagaaccgtcaggagggatttgacccgatatgaggagcttgataaggaggcacaggcgcagatgaatgaggagctctcgggatggaagctcgtagttgcggatgttttcagggcaccgagccatccacagctgctctgtgtgatggtgggagatggggttcagattcttggtatggcagtggtgaccatcttgtttgctgcgctagggtttatgtccccagcttctaggggaactcttatcactggtatgctgttcttctacttagtacttggaatcgctgctgggtatgctgctgttaggatttggaagactatcagatgtggggatccttctggatgggcttcagtctcatggcgcgttgcttgcttctttcctggtatcgccttcttgatcctgaccatgctgaatttcctcttgtggggtagccatagcacaggggccatccctatttctttgttcatcgtactgctcttgctttggttctgcatctcggtcccgcttacacttgtgggtggattactcggtgccaaaactccccattttgagtatcctgtgaggaccaatcagatcccacgagagattcctccacaaaaatacccgtcatggttgctggttctgggggctgggaccctgccatttggcacccttttcattgagctcttcttcataatgtctagcatttggatgggtcgtgtctattatgtctttggctttctctttattgtgttgattctcctcgtggttgtgtgcgccgaagtttctttggtcctcacttacatgcatctgtgtgtggaggattggaagtggtggtggaaatccttcttctcatcaggatcagtggctatatatatcttcttatactcagtgaactatcttgtgttcgatcttaagagtctaagcgggcccgtatctgccactctctaccttgggtactctctcctgatggttattgctatcatgcttgcaaccggcaccattggattcatttcttcgttctggttcgtgcattatctcttctcttcggtgaaactagactgagctagttccacggttccacaacaaggtgctttctccactcaagagcataactggaaatatgatgaaaaaaatgacaaatattcttgacctttggataaagatctgggtttgtatcatcttgattttgctgttgtagttttgggactccacagaaaaaataatagttcattttcgctcttaagattctttactgctcatatatctgagcatagcttttatttacctctttttatttttcaagcttcttcctctccctttccactctgtctctgtttgtttagtttattaagctgtaattgtagtcctgtctctgatgcactttgtattgggtgacaatttggaaatgttttgttcaccgcttttccagtttatatgtcaatttgcaaatgtggttcagtaccaaaaaaaaaaaaaa

SEQ ID NO: 5088 - DNA, 4183 bp, Musa acuminata
atgcatgcacatgtttatggccgtcacatacaatcacattatatacacacatatggggagttgcgcaaagtcacatgggcattctgggaattcggacgcccacaagtcttcatctccacctcgaccgggaacccaacaaaggaactataaagacgcgtcgccctctccctccttctcagatctccctgccctcatcgtctagttgaaggcgcttgcacacagatttgatgcgcatttgtacatcgaactcctaatgccacgcaacgctgagatctactctttctgatccggtttctgtctgaattctctccagatctgtgaacaaaagcccatctccgatgggtttcgcttccggatccgccgccaagatgggatttttccgcagatttggcctctggttgctcttctcgtccctcgcggacctccgttccggcgacgggttctacctccctggtagctacccgcacgagtaccaggtcggcgatgccctctcggtgaaggtcaactcgcttacctccatcgagaccgagatgcccttcggctactacagcctccccttctgccgtccccaggagggcattaaggacagtgccgagaacctcggtgagctcctcatgggcgaccgcatcgagaactccccttaccgcttcaagatgtttaccaacgagtccgacgtcttcctctgcggatccaatcccctctcgtcccaggacttcgatctcctcaagaagcggatcgacgagatgtaccaggtcaatgtgatcctggacaaccttccggcgatccggtacacgaagaaggacgactacgtcctcagatggacggggtacccggtcggagtccgggctggtgacgcctactacgtgttcaatcacctcaagttcaccgttttcgtgcacaagtacgaggacgccaatgcggcgagggtggtcggcagcactggagacgccgccgacgtgatccagacgacgggcaagtcgggatccggcaagcctggttggatggtggtcggattcgaggtcgtgccatgcagcttcctgcacaacgcggaatcgatcaagaatgtgaagatgtacgataagtatccggccaagatccagtgcgatcctatcaccgtggccatgaagctgacccaaaaccagccaattgtcttcacctacgaggtcgcctttgtcgagagcgacatcaaatggccgtctcgatgggatgcttatctgaagatggaaggagccaaggttcattggttctcaatcctcaattcgctaatggtgattgcatttctagctggcattgttctcgtgatcttactcagaactgtccggagggatctcacccggtacgaagagctcgataaggagtcacaagcacagatgaatgaggagctctctgggtggaagcttgttgtcggggatgtcttcagggctccagaccatccattactgctctgtgtgatggtaggtgatggggtgcagatacttggcatggcaatcgtgaccatcttgttcgctgcgcttggattcatgtcccctgcatctcgtggaactctcatcacgggaatgctgttcttctacttgattcttggaattgtggcagggtactttgccgttaggatttggaagacaatcaaatgtggggatcactctggttgggttggggtctcatggcgtgtcgcttgcttcttcccgggtattgccttcttgatcttgacaacattaaatttcctgttgtggggcagccagagcaccggggcaatcccaatttccttgttcattgtgctcctcttgctctggttctgcatctcggttccacttactcttactggtggtttccttggtgccaaggcaccccacattgagtaccctgtccgtactaatcaaatccctcgcgagatccctccacaaaagtatccatcatggttgctggtcattggagctgggactctaccctttggtaccctgttcattgagcttttcttcataatgtcaagcctttggatgggccgagtctactatgttttcggctttctcttagttgtgttgattctcctcgttatcgtgtgcgctgaggtttctctagtacttacctacatgcacatatgtgtggaagactggaaatggtggtggaaatcattctttgcttccggctcagtggctctatatatcttcttatactcggtgaactacctggtatttgatcttaagagtttaagtggcccggtctctgccaccctttaccttggctactcactcttcatggtcattgccatcatgcttgctactggtacagttggattcatttcatccttctggtttgttcactacctcttctcatctgttaaactagattgagctacattggcagcaagggatttttagcgaggatgaacttgagtaattagcagatctgatacaaatttgaagagcatagaatcttcttcgatttgtcttcaatgggaagcttggaaaatctatagggaaaatattaccttatatgcttgttcttcttagttggtgataaatgtagctgttgcattttgttacctgcattttgggaactcttcaatttgtcgtagagtatatctgttgaattatcagttcatttactttgtctcgtctttttctctttcatatgttaagctgtaaacttattcaactaatgcaccttgtttgaagaatgaataccattttgctgcatttaaatttcttaactcctgtagttctttacgttttgtatgtaccctacagatctttgagctcagtaactgcaaatctttaaagctcttttttgtttcatttgttctactgcactgtcattatggttggttcttttgtgaactctgtagcatgaagacctcatcatgtttgtcttctgcattagtatcattcatttgatagcttttttgctgacttattcatattcagtacatcttagaaacctggctgctattcctaaacaagtaaatgaaatgaaatggcattttgtttattgttcccaagaagttgcttgtattataactagccttcactattctcggaggtgacactaattggaaaatgacaacagtaaaggattcaaagttccatcactaaataataattttcagatggctaaaagaattggcagtttacactgcatgatcttgcagttttagaaaattttaggtctaagcctgctatcctttcagtgttttgatgtggacttgggatataaaactctggaagcatgaccatgtacagatatccagattcacaaagcttcgcgcttctattcttgatggcctgtatggagcattctacagcaaggacattttctgctcctgtggctgagacctttgagttcagaaggaaaacaacctaatcgaaccttcgagttcagatgcctgcttctgtcagcagctacagaacttgtggcatcagcatttttctgttcctcataggaatctgcaacatcaattctttggacattttgtatgctgctgcatggtcctaaatgcaattgtttgatgccaatataaacatacaacccacacctaattcaaatgacctacatggtagaatgtaatgagtctggaaatgttttatctcttggcaaaactagcttttatataactatttatgagaattttgttgctattatcaccttattcaatcctcatatatgtttctaagtaaggactctgcaagttctgaagtttatgacagcttctgcctactagtaagggtcaagtatgtacgagaaattctctggacaacctaagaggtaaaaaactccattaagctgtttatgatcagcctcattgacatgactacaaagcattaatatgttacagatgaatcttgtagttcaagacaagagcaaattcattataaaataactatttttctgtttttataatcacaaaagaaagtgcatctggtatggtatgaatatatagttccatgcatcaaataaatctcattgaaatggagttatgctcattaaaacatgtaacagtgaatagtatgcaacaatatattaatgtcaatgcagtagtttgttctgtgattgttgttcaagaatatgtttattcaaacttgtcaccacaacacattcatttgttacaaattttctggttacagattctgtgtatgaatgtttggtgttgggttttgtattctttgtggttgtcattgtaaaaaaaaaa

SEQ ID NO: 5089 - DNA, 2812 bp, Vitis vinifera
ctccaagaaaagccaaaggctcgtcaacacgctggcaccctttcgaagtaaccgacgttataaagctgggctcgggacatttctcgtcctctctcgttcgacactttgagagctcgtcgatctccgtttcgactcctctcaaccctctatgctccgccctctgctgaggtcagttgaatcgatttctaattactatgtttttttttttttttaatgcaaaaccattttatcgtttgttgtttggttaatttttactctcatgatgctgtaactatggaaaattttatgtattttgatgcatgatttgttgatgaactcaaaaacccatataggaaacggcattttcttgtgttttactcattttcccatccgggtttctttcagatctgacgaaaatccgtaaaaataattagtgcaaaaatggacttatttcgtcaattcaagatctgggtcttgtttacatgcttggtgtttcaatgtggatgtgggttttatcttccgggtagttatccccataaatacgatattggtaataccttgtccgtgaaagtgaattctctgacttcgatcgatactgaaatgccctttagctactatagtttgcccttctgtaagcctccagagggtgtcaaggacagcgctgagaatctcggcgagctcctaatgggggatcggattgagaattcaccatatcggtttaagatgtacacgaatgagactcagatctttttgtgtaagtctgatccgttgtcagctgatgattttaagatcttgaagaagaggattgatgagatgtatcaggtcaatttgattcttgacaatttacccgcaattcggtacacgaaaaaggagggttttttcttgaggtggacggggtaccctgttggaattaaggttcaggatatgtattatgtgtttaatcatttgaagttcacggttctcgttcataagtatgaagagaccaatatggccagagttatgggaactggggatgctgcagaggggatcccaacagttgacaggacatctaatgtgcctgggtatatggtggttggatttgaggtagtcccttgtagtgtctcacacaactttgattcagtaaagaatttgaaaatttatgataaatacccatctgcaattaattgtgatccaactactgtggagatggctgttaaggaaggccagccaatggtttttacttatgatgtttcatttgtggagagtgacattaagtggccgtcaaggtgggatgcttatttgaagatggaaggggctaaggttcactggttttcaattcttaattccctaatggtgatcacttttctagctggcattgtccttgtgatctttttgaggacagttcgcagggatctgacccgatatgaggagattgacaaggaggctcaagcacaaatgaatgaggagttatcagggtggaagcttgttgtggctgatgtttttcgtgctccagacaatcctgcactattgtgcataatggttggagatggggttcagattcttggaatggcagttgtgacaatattgtttgcagctcttgggttcatgtcaccagcttctcgtggtacacttatcacaggtatgctatttttctacatggttcttggcattgcagctggttatgttgctgttcgtctttggaggacaattggatgcggcgattccaagggatgggtctcagtctcatggcgggttgcttgtttcttccctggtattgcctttttgatcctaaccaccttgaatttcctattgtggggaagtcacagcacaggagccattcccttttctctttttgtcattttgctcttgctttggttctgcatctcggttccccttacacttgttggtgggtaccttggggcaaaagccccccacattgaatacccagtccgaaccaatcaaattcctcgggaaatcccagcccagaagtacccatcttggttgttagttcttggtgctggcactcttccttttggtactctgttcattgagctcttctttatcatgtctagtatttggatgggccgtgtttactacgtgtttgggttcctcttcattgttttgatccttcttgtggtggtctgtgctgaagtgtctcttgttctaacgtacatgcatctctgtgtggaggactggaaatggtggtggaaatccttctttgcctcaggctctgttgcgatttacatcttcttgtactcaatcaactatcttgtatttgatctcaagagtttgagtggacctgtctctgctactctttacattgggtattccctcttcatggtctttgcaattatgctggctacaggcactgttgggttcctttcgtctttctggttcgtgcattacctattctcttcagtgaagctggattgaggaacttcttcaagctcggagatttgtgctatgaagagcagtggtgggcatccatgggagaaacgaaaacaacccttaaaattgtccttacatatatatcttacttgtttttcagttttatcgttttgctagggaacttggtgaagataataacaataacttcgtccagttttgcttaattctttattagttgaagatcattgcatgataccaaagctcagttgcattctggcggataggagtagatgtggggttttcattatgtactttgattgtctgaatctgtatggatttattggaatgcaaaatgaaaaaggaaagaaaaaaatcaaatttgcggctctttaggctctggtgtttctttaatttttaattttttttcttccttgaccggatgccttctctgagatttttgctatta

SEQ ID NO: 5090 - DNA, 2613 bp, Musa acuminata
aaaaaattatcgcagcctcctctgaccgaaagcgaagcagcttttaaccccccttctcctccgcctctaatttcatcttgcctcgatcgccggcagatctcggcgactagatctgggtgaagaacccatctcctatgggttttgccgccgaatccggcgccaagatgggattttttcgtaggctcgccctctggatcttgatctcctgcctcgccgtccgatccggcgatgggttctacctccccggcagctacccgcaccggtaccccgccggcggcgctctcccggtcaaggtgaactccctcacctccatcgagaccgagatgcccttcagctactacagcctccccttctgccgcccggcggaggggatcaaggacagcgctgaaaacctcggcgagctcctcatgggagaccgcattgagaactccccataccgcttcaagatgtttaccaacgagtccgacgtcttcctctgccggaccgacccgctctcggcccaggacttccgcctcctcaagaagaggatcgacgagatgtatcaggtcaacctgatcctcgaaaacctacccgcgatccgctacaccaagaaggacgattacgtccttcggtggacggggtacccggttgggatcatgatcgccgacgcctactatgtgttcaaccacctaaaattcacagttttggtacacaagtatgaggagacgaatgtggcgagggtgatgggcacaggggacgcagccgaggcgatcccgacggtggacaaggcaggttcagggtctcccagttggatggtggttggtttcgaggtcgtgccatgtagctttcaacatgatgcggatttggtcaaggctctgaagatgtatgataagtacccagtgaacatccagtgcgatcccaaggcagtggccatgagagtgaaggaaaaccaacctattgtcttcacttatgaggttgcattcgtcgagagtgacatcaagtggccgtctcgctgggatgcctatttgaagatggagggggcgaaggttcactggttctcgatcctgaattcgctaatggtgatcgctttccttgctggtattgttctcgtgatcctgttgaggactgttcgaagggatctgactcggtatgaggagcttgacaaggaggcacaggctcagatgaatgaggagctatcaggatggaagcttgtagttggggatgtgttcagagctccaagtcatccgttgctcctttgtgtattggttggtgatggagttcagatacttggtatggcaatcgtaaccatcttgttcgctgcacttggattcatgtcccctgcatcaaggggaactctcatcacaggaatgctgttcttcttcctggttcttgggatcgctgctggatatgttgctgtcaggatgtggaagacaatcaaaactggggatcacactggttggatttcggtttcttggcgggttgcttgtttcttccctggtattgcgttcttgatcttgacaacattaaacttcctgttgtggggtagccatagcacaggggcaatacccatttctttgttcatcatattgcttttgctctggttctgcatctcagttccactgacacttgttggtggcttccttggtgccaaggcaccgcacattgagtacccagttaggactaatcagatacctcgcgagattcctccgcagaaatacccgccgtggttgttggttcttggagctgggaccctaccatttggcactcttttcatcgagctcttcttcataatgtcaagcatctggatgggccgtgtgtactatgtcttcggctttctcttcatcgtaatgattcttcttgtcgtcgtttgtgctgaagtttctttagtcctgacctacatgcacctgtgtgtcgaggattggaagtggtggtggaaatccttcttctcatcaggatcagtggctatctacatattcttatactctgtgaactatctggtgtttgatcttaagaacttaagtgggcccatctctgcctccctctaccttggctactctttgttgatggtcatcgcaatcatgcttgcaactggtacaatcggattcatctcagcattcgggttcgtccattacctcttttcatcagtcaaactagattgatggacttcaatgagaaagcttcctcgacgaaggaaaagcttggtcaaggctaaatgagattaaagtttgtcactcactggttgatcatttgaaatttgaggctctacagggaaataatatttcacatggctattgtttcatgcatcggcacttggtaagatgcaatagaatgtactctgcagagccgttagttcttttttctatttttttatcttctttttgttctattagttcatctagctgtatactggattgccggtaacaatgcattttactttctgaatgctgaacaactgtagatgcaattgtaattcattgtgctttttgttatcttcacatgatctcatatagataattatggcctatgtctagtgttgcaactggatgaatctgatccatttgtctttcatttgattatacattatctctgttcatttaagaaccgtatcgtggtaaaacatggtgaaattacaag

SEQ ID NO: 5091 - DNA, 3171 bp, Aristolochia fimbriata
ggcgaattttagcaccactatgaagtttagttacgcttattagcattgctattggttgcgttccccaacatcatctaaagtggcgaatttacacaatcaaatacattaagaatttgggtctaattctttcctacgattacgagacgtagacatacacccttgcccatcatcctctttgtgtcgtgttctttgttacatctattaaattaagacaatcttgcctcttacgttaattaaacttgaaaaattagttcaagatttcgggtccttgaccgtggggaccgtgggggccgcggggactagcctacgggtgcggtcgaggggccttgaaaaggaaggggggtattacgtacaccggctcttctggaaactctactgcgagaaggagagggggggcgtattacggtcacttttgctttaactgggaaaacaattaaaggtaagaaagccaaaagagacgagggagacggatataaatacggattcttgctctgcttctccttccgcgtgtttggattcgggagattgttctgcgtctctgcagttcatgaactcataatgcggtagtcggatctctttctctccttctcgtttccgtccggagatctgaagacgctgtttgggaaattttgtttatcttctggaaagccagccgttgttacttggattgtcgcaagatcttggtttttcctgcccattttcacctgggttgcgcgtagatctggcaggaggggataaagatgggtgctttcgatcggtttggtgtctgggtcttggttgcttttctggttgttgggtctggaaacggattttatctacctggaagttatcctcacaaataccaagtgggtgacatcttgtcggtgaaggttaattctttgacatccatagatacagagatgccctttacctactatagtcttcccttctgtaagcccaaaggaggtgtcaaggatagtgctgagaaccttggtgaactccttatgggggatcgaatcgagaattccccctatagatttaaaatgaacatcaacgagaccgagatcttcttatgccgcacgaatccactgacgtctgatgagtttaagctcatgacaaaacgaattgacgagatgtatcaggtgaacttgatcttagacaacttacctgcaattcgttacacgaagaaagatgagtactttctgagatggacgggttatcctgttggaatcaaagtccaagatctttattatatcttcaaccatttgaagttcactgttttggttcacaagtatgaagaagccaatgtggcacgagttatagggactggtgatgcggccgaattgatgccaacaactaagggatctgaggttcctggttacatggttgttggttttgaagtggtaccatgcagctcccagcatgacgcagagtcagtcaagaacttgaatatgtatgataaatacccatctgctataaactgtgacccctcaaccgtggccatgactgtgaaggaaggtcagcctcttgttttcagttatgaagtttcattcgtggagagtgatattaaatggccttctagatgggatgcatatttgaagatggaaggggcaaaggtccactggttctctatcttaaattcactcatggttattgcgtttttggctggaatcgttcttgtgatctttctacgaacagtaaggagagatttgactcgctatgaggaactcgataaagaagctcaggcacaaatgaatgaggagctatcagggtggaagcttgtggttggtgatgtgttcagggctccatcgaatgcctctcttctttgtgtgatggtgggcgatggggttcaaatccttggaatggctgttgtgactattttatttgctgctctcggttttatgtcccctgcctctcgtggaacccttattactggtatgctatttgtctaccttgtgcttggcatactggcaggttatgtggctgtgaggctttggaggacaattggctgtggggactttactggttgggtatctgtttcttggagggtagcttgcttcttccctggtattgctttcctgatcctaaccgtcctgaactttctattatgggggagtcaaagcacaggggcaataccgttctctttgtttgttattcttctcttactttggttttgtatctctgtcccacttacccttactggtggctattttggagccaaagcacctcacattgaatatccggtccgaacgaatcaaatcccccgtgaaatccctgcacaaaagtatccttcatggttgttggttcttggagctggcactttaccgtttggaaccctcttcattgagctatttttcatcatgtctagcttgtggatgggccgagtatactatgtatttgggttcctcttcattgtgatgattctccttgtcattgtatgtgctgaagtgtccttggtccttacttacatgcacctttgtgtcgaggactggaaatggtggtggaaatccttctttgcatctggatctgttgccatttacatcttcttgtactccgtcaactatcttgtgttcgacctgaagagcctgagtggccccgtgtcagccactctctatcttggatactctctcttcatggttctcgccataatgcttgcgacaggcacagtcggattcctttcgtcgttctggttcgtccattacctgttttcttcagtgaaactggattagtagacagatcagaagagatcacactgctgcattggaggtgcatttcatattgagcaaggtgggcagagattcatcctgaacttcttgctgttgagacccttatctgggtttatgctgtcgggacttctatgaggaaaataatatcccttgttttcttctattcattataattagctaagggtagactgatggtataatagatgtttatttgctgtgggtggtaatcactgtatttgagttaatattttttgtacttagcaatgaggatgaatgaagttaattaatcgaagatttcctttgtttccaatctgttgattattatagatgaactatctcactcatagtttgctgcagcagatgctatttgcatggctgccatacagagctgcttgtagagaattgtggtgagataatgaaggccataaggaaattctacttttggttttttttgagtccaaaaaaa

SEQ ID NO: 5092 - DNA, 2454 bp, Musa acuminata
tgcgtcttcttcgtcgccttctcactcctctgttctccgttctcctcagattcctcctcccgccctccctccctctctgccgtcgtcgattggttagatctcgcatcgaagcgactcgaatagagatctgtaagggaacccatccctgatgggtcttgcttccggtttcggcgctaagatgggatctcttcgcggatttggcctctggttgctggtctcctgcctcgccatcatccgatctggcgacgggttctacctccccggcagctacccccacgagtatcaggtcggcaatcttctctccgtgaaggtgaactccctcacctccatcgagaccgagttgcccttcacctactacagccttcccttctgccgccccccggagggcatcaaggacagcgccgagaacctcggcgagctcctcatgggcgaccgcatcgagaactctccctatcgtttcaagatgttcaccaacgagtccgacatcctcctctgccgaaccgatccgctgtcagccaaggacttcaatctcctcaagaagcggatcgacgagatgtaccaggtcaatgtgatcctcgacaacctcccggcgattaggtacacgaggaagggcgatttcctcctccggtggacagggtacccgatcggtgtccgggcgggcgacgcctactacctcttcaatcacctcaagttcaccgttttggtgcacaagtacgaggaaaccaacgtggcgagggtggtgggcagcaccggggacgcggccgacgtgatccagacgacagacaagtcgggatccggcaagcccgggtggatggtggtcggattcgaggttgtgccgtgcagcttcctgcacaatgccgagtcggccaagaacctgaagacgtacgacaagtacccggcgaagatccagtgtgatcctaccaccgtggccatgaagctgaacgagaaccaacctgtggtcttcacctacgaggttgccttcgtcgagagcgacatcaagtggccgtcccgatgggatgcttacttgaagatggaaggagcgaaggttcactggttctcaatactcaattcgctgatggtgattgctttcctggccggcattgttcttgtgatcttactgagaaccgtccgaagagatctcacccggtacgaagagctggacaaggagtcgcaagcgcagatgaacgaggagctctccgggtggaagcttgtcgtcggggacgtcttcagggctccgagccacccgttgctgctttgcgcgatggtaggtgatggagtgcagatactcggtatggcggtcgtgaccatcttgttcgccgcacttggattcatgtcgcctgcgtcccgcggaacccttatcacggggatgctgtttttctacttgatcctcggaattgcagcaggatacgttgctgtcaggatgtggaagacgatcaatgtcggagatcactctggatgggtctccgtctcctggcgtgtcgcttgcttcttccctggtatcgccttcttgatcttaacaacactaaatttcctgttgtggggtagccacagcaccggagcgattccgttctccttgttcgtcgtgctgctgttgctctggttctgcatctcggttccgcttactctcgccggtggtttcatcggtgccaaggcaccacatatcgagtatcctgtccgcacaaatcaaatccctcgcgagatccctccacaaaagtacccatcttggctgctggtcatcggagcagggactttacccttcggcaccctgttcattgagctcttcttcataatgtctagcctttggatgggccgagtctactacgtcttcggcttcctgttgatcgtcttgattcttctggtcgtcgtctgtgccgaggtatctctggtcctcacctacatgcacctatgtgtggaagactggaaatggtggtggaaatccttcttctcctcaggatcagtggctctatacatcttcctatactcggtgaattatctggtattcgatcttaaaagtttaagcggccctgtctctgccaccctctaccttggctactcattgttcatggtcattgccatcatgcttgctactggcacggttggattcatttcatccttctgttttgttcactacctcttctcatccgtcaagctagattgagctaccacttcttgttccttaaactcgaagaacgtacttgctagtgggtgctatcttgaatggggagcttggacagtctatagaacacatactacctcatttgtatcttgttatttttcattggcaataactgtggctataccattttgtcacctgcattttaagaacctttctctgtcatagaatgtgtatcagtcgaactatcattttttttcttcgttgttgtctcttttttctattgtttgttaagctgtaaacatagtcagccaatgcatttgttttcatgaataactgct

SEQ ID NO: 5093 - DNA, 2432 bp, Elaeis guineensis
acaatagatctacgatcccaaacacccagatcctccagatctcccctcttacattccattcctcacccgatctggtggccctccagatcttcaatggcttccaagatttgcgccacgatcttcttctctctcctccttctcccctccggccatggcttctacctccccggtagctacccccacaagtacggcgtcggcgaccctctttccgttaaggcgaactccctcacctccatcgagaccgagctcccctatgggtactactcgctccccttctgccggccccaggagggcatcaaggacatggccgagaacctgggcgagctcctcatgggcgaccgcatcgagaactccccctaccgcttcaagatgcgcaccaacgagtccgacgtcttcctctgccgctccggccccctctccgccgacgatttcaacctcctcaagaagcggatcgacgagatgtaccaggtcaacctcatcctcgacaacctccccgccatccgctacaccaatcgcgacggattcctcctccgctggaccggctaccccgtcggcatcaaggtcgccgacggctactacctcttcaaccacctcaagttcaccgttctagtccacaagtacgaggagaccaatgtggcctccgtcatgggcaccggcgacgctgccgagatgatcccctctaaatccggcaagtccggcccgccggggtacatggtcgtcggcttcgaggtcgtcccctgcagcttccagcacgatcccgagtcggtcaagaacgccaagatgtatgacaagtacccggcgaagatcaattgcgacccggcgacggtggcgatggcgatcaaggagaaccagcccgtggtcttcagctacgaggtcgaattcgtggagagcgacatcaagtggccgtcgcggtgggacgcctacctcaagatggagggcgccaaggtgcactggttctcgatcctcaactcgttgatggtcatcgccttcctcgccgggatcgttctcgtgatcttgctccggacggtgcgccgggacctgacgcgctacgaggagctggataaggaggcgcaggcgcagatgaatgaggagctctccgggtggaagctcgtggtcagcgacgttttccgggcgccggacaatcccacgctgctttgcgtcatggtcggcgacggcctacggattctcggcatggcggtggtgaccatcctgtttgccgcgctcgggttcatgtctccggcttctcgaggagctctgatcaccggaatgctcttcttctacatggttcttggcattctggccggttatggtgctgtgaggctctggaagaccttgcgatccggcgatcattccggctgggtttcggtctcgtggcgcgttgcttgcttcttccccggcatcgcctttctcatcctcaccattctcaatttcctcctttgggggagtcacagcaccggagccatccccttcagtctgttcgttatattgcttctgctctggttctgcatctcggtgcctctcaccatggtgggcggattcctcggggcgaaagcacctcacttggagtaccctgtgaggaccaatcagatccctcgcgaaatccctccccagaggtacccatcctggctgctggtgctgggtgccggcacgctgccattcggtactctgttcatcgagctcttctttataatgtcgagcttgtggatgggccgggtctactatgtcttcggctttctcttcattgttttgatccttctcgtcgtcgtgtgcgccgaagtttcactcgtcctcacttacatgcacctgtgtgtggaggactggaggtggtggtggaaggcattctttgcgtccgggtcggtggccatatacattttcttgtactcggtgaactacctggtgtttgatctcaagagtttgagcggcccggtctcggccacactctaccttggctactcgctcctaatggttcttgcaatcatgcttgccaccggcaccgtcgggttcatttcttccttctggtttgttcacttccttttctcctcagtgaagctagattgagatgccgtggcatcgagaagcttgtcctgagtccgaggaagtatttgaggccccattataagtgagcagaatgttctccaagccgacagtattatagctcttaattcttaagtttctgttattttgtagttggagactggataaaaaagatacctcctttgagctcttatgatttctttttataggagttctttcaatatgtagttgcttgtattagtccaacctttctattcttttcatatagtctgttagtatggaaatgaagaaatgtttctgattcttatcggatgaattgaatttgtatttgtgaaaaaaaaaaaaaaaactagtagacgtacgtccgaacggtacgaccaaccaagggtaagggtagg

SEQ ID NO: 5094 - DNA, 2407 bp, Tripterygium wilfordii
ggtgcacaagctctttcacacggagaggagatctcggttcctctctatgcaactaaagatctgacacatattcgccgagacagacttcagaaaatggatcctttaggtcgtttcaagatctgggtcttgactgtattactcattgtccaatctggatttgggttttacctgcccggtagttaccctcacaagtacgctgtcggtgacactttgtcagtgaaagtgaattccatcacttctattgatacagaaatgccttttagttactacagtttgcccttctgcaagcccgaagggggtatcaaggacagtgctgagaatcttggtgagctccttatgggagacaggattgagaactccccctatcggttcaagatgttcactaatgagtctgaggtccttctgtgtcggaccgatccgttatcagctgataactttaagatcttgaagaagaggattgatgacatgtatcaggttaatttgatccttgataacttgccagcaataaggtacaccaagaaggatggttacgttttgaggtggactggctatccagttgggatcaaggttcaggatttgtattatgtgtttaaccatttgaagtttacggttcttgtccataaatacgaggagaccaatgtggcacgcgtaatggggactggagatggagctgagatgatccccgctaatagagatggagactctggtaagcctgggtatatggttgttggatttgaggtggttccttgtagtttcaagcataattcagattcagtgaagaaatcgaaaatgtatgagaagtatccttcgaagatacaatgtgatcctactactgtggcaatgcctatcaaggaaaatgagcccattgtctttacctatgaagttacgtttgaagagagtgacatcaagtggccatcacgctgggatgcatatttgaaaatggagggttcaaaagttcattggttctcaattctgaactctctaatggtcataactttccttgctggtatagtccttgtgatcttcttgaggacggttagacgggatctgacccgatatgaggagctggacaaggaagctcaagcacagatgaatgaggaattatccggatggaagcttgttgttggggatgttttccgtgctccatctagtcctgctcttttgtgtgttatggttggagatggtgttcagattcttgggatgggagtcgtgactatattgtttgcggctcttggattcatgtcacctgcttcccgtggaacacttattacaggtatgctgtttttctacttggttcttggcattgcagctggctatgttgctgttcgcctttggaggaccattggatgtggggatcacaaagggtgggtttcagttgcatggaaggcagcttgcttctttcctggtattgcctttttgatcttaacagttttgaacttcctactgtggggtagtcatagcaccggtgccattccattttccttgtttgttatactacttttgctctggttctgtatctcggttccccttactcttgttggtggttattttggggcaaaggctcctcatattgaatatcctgttcggacaaatcagatccctcgtgaaattccagctcaaaagtatccatcttggttgctagttctcggtgctggcactcttccatttggaaccctttttattgagctcttctttatcatgtctagtctctggatgggccgtgtttactacgtttttgggttcctctttattgttatgattcttcttgtggttgtttgtgctgaagtatcattggttttaacctacatgcacctctgtgtggaggactggaaatggtggtggaagtccttctttgcttctggttctgttgccatctacattttcctgtactccgtgaattacctgatatttgaccttaagagtttgagcggtcccgtttctgccacactctacttggggtattctctcttaatggtcctagcagtcatggtctcaactggcacagttggcttcctttcatcattctggttcgtgcattacttgttctcttcagtgaagctggattgaagaactctcggattatcaatggattgccattttgaagataagtggtcagcacttcttgaggagaaacaaacacagtggttacacagtctatttgttactttattttcctttatctaatttgctagggaactttttaaatgtaatatcaataatttcgtccagttttgctttattctttattagatgaaataatcatggcgtgatggtggcagatatgagagacttagttggtggtagtccgtattgtggtctctactttctacttggttttcatgtccttgtggattaaactgaatggagcataattctgtaatagttcttaaattgaattgtgtttgtc

SEQ ID NO: 5095 - DNA, 2852 bp, Theobroma cacao
tctttctctcaaaatttcggttaaatattttgaagatctctatgtttggagttgaaatttcttcatagagagtcttcgcgtctttctctcaggcaattctaaatttctttccagagaaaactcatttctggatctgggttttcccagatctgacaaaatttggacttaatgggtaattttgggatctgggtgttgacaatttgcttgctatttcaatctggatatgggttttatcttcctggtagttaccctcacaaatatgtggttggggactatttatctgtcaaagtgaattccctcacttccattgacaccgaaatgccctttagctattacagtttacccttttgtaagcctacagagggtgttaaggatagtgctgagaatcttggtgagcttctcatgggagatcggattgagaactcaccgtataggtttaagatgtacactaatgagaccgagatcttcttgtgtcaatctaacaagttatcagctgatgattttaagttgttgaagaagaggatagatgagatgtatcaggttaacttgattctcgataatttgcctgctataaggtatactaggaaagaaggttttatgttgaggtggaccgggtatcctgttggggttaaggttcaggatgtgtattatgtgtttaatcatttgaaatttaaggtgcttgttcataagtatgaggaaacaaatgtggcacgtgtgatgggtactggggatgccgctgaggttattcccactgttggcaatgggggatcggatgcgcctggatatatggttgttgggtttgaggtggttccttgcagtgtcctgcataatggtaactctgttaagaacttgaacatgtatgaaaaatacccatctccaatcaaatgtgagtcgactactgtgtcgatgcctatcaaggaaggtgagccaattgtcttcacctatgaggttgtctttgaggagagtgatatcaagtggccatcgcgttgggatgcttatctgaagatggagggatccaaagttcattggttctcaatcttgaattctcttatggtgatcactttccttgctggtatagtccttgtaatcttcttaaggactgttaggcgggatctgacccgatatgaggagcttgacaaggaggcccaagcacagatgaatgaggagttatctgggtggaagcttgttgttggggatgttttccgtgccccatccaatcctgctcttctgtgtattatggttggggatggagttcagatccttgggatggcagttgtgacaatattgtttgctgctcttggatttatgtcaccagcatcccgtggaactcttattacaggtatgctatttttctacatgattcttggtattgtagctggctatgttgcagttcgtctttggagaacaattggctgcggtgaccacaagggatgggtttctgttgcttggaaggctgcttgtttcttccctggtattgcctttttgattctaaccactttgaatttcctgttatggggaagtcacagcacaggagctattccattttctctctttgttattctacttctactttggttctgtatctctgttccactcaccctagttggtggatactttggggctaaggcacctcatattgaataccctgttcgaaccaaccagatccctcgggaaattccagcccagaagtacccatcctggctgttagttctgggtgctggaactctacctttcggtactcttttcattgagcttttcttcattatgtctagcatctggatggggcgagtttactatgtctttgggtttctgttcattgttctggtcctacttgttgtggtttgtgctgaagtatctttagtgttgacctacatgcatctctgtgtggaggactggaaatggtggtggaaatccttctttgcttctggttcagttgccatctacatcttcttgtactccataaactatctcatatttgatcttaagagtttgagtggacctgtctccgctactctgtacttggggtattctctcttcatggttctcgcaatcatgattgcaacaggcacaattggattcctttcttctttctggttcgtgcattatttattctcttcagtaaagctagattgaagaaacttctccaaacacaagaattggcacatttgaagaggtaaatggtacattgaagaggctcaggagaaaagaattcatcctttacattagtcaatcctcttttacttgttactttgagcgtttattttgttaggggactttggtaaatgtaataacaataatttcgcccagttttgcttaattctttattagatctctatgatgcatgataatgcaatacgagtctgtatttgcattttgatgtattggaggcctatctaggttgtgttggtaactttatctgtggtacttatactatttacttctatgtccaaacttttatcagtcggaatgcaatgagcacagttcatcacttttttcttttgttcttatagtactctccattcccccactgggcttaactctaaaatgctttcaacttcccaagataggaatactgcccttggatcttggtaaagggacactcatggggtttcccgtgaactgctagtattcagatctgtatttgtaaattaccactaattagtttgcaagtgtctgaaatgaaaagaaactgcagtcacaacacacatgcctaagtctaagcttcataacacgtaggttggtatgctgtgagctaaaagaagcagctgccagggttgagggggcagaagtagaagtaatgtcacaaagttatgacattcacattatatgataaataaataagaactcaagat

SEQ ID NO: 5096 - DNA, 2919 bp, Ricinus communis
tgctatttaggcaactggtgaaagaggtgagtaaaaatggataatatcgtcaattcgtgaaaagcaaggaaatcagtcggcagtctacttctaagggagcaatacagaacccatttacatataaaacttgttgccgtgccatccaatcctgtaaactctctctttgctctctttctttcttattccatcaagatctctacctttccttagcttgcatatacattttcactattttcacaaggtcagttagatccaatctgcccttcttattctttaaagctccccttttctattttctgtttttccatttcttttacttctgtatttgtctagcctttgattttgttttaacttcttattggcacccagaatcacatatcattggatcttttgtgttccacttgtttcttgatctgggtttcccagatctgacgttaatcgctacagaactccttaaagatggagtcttttgcttgttttaagatctgggtcttgaccattttcttgattttccaatctggatatgggttttaccttcctggtagttacccccacaaatataatgtaggtgaaactttatcggtgaaagtgaattctatcacttctattgatactgagatgccgtttagttattacagtttgcccttttgcaagcccgctgagggtgtcaaggatagtgctgaaaatcttggtgaattacttatgggagataggattgagaattcaccgtataggtttaggatgcatgtgaatgaaagtgaggtctttttgtgtaaaactgatcctttatctgctgatagttttaagcttttgaagaagaggatcgatgagatgtatcaggttaatttgattcttgataatttgcccgcaataaggtatacaaagaaggagtcatacttgttgaggtggactggttttcctgttggcattaaggttcaggatgcatattatgtgtttaaccatttaaggtttacagttcttgttcataaatatgaggaggctaatgtggcgcgtgtgatgggaactggagatggtgctgaggtgattcctacaattgggaatgggggatcagatattcctggttacatggttgtggggtttgaagtggttccttgtaacgtcatgcataatgttcagtcagttaagaacacgaaaatgtatgagaaatatcctgctcaaattaagtgcgatcccaccactgtgtctatgccaattaaggagaacgagccaattgtttttacctatgaggttaattttgaagagagtgatatcaagtggccatcgagatgggatgcctatttgaagatggagggatcaaaggtccattggttctcaatcatgaattctctgatggttatcacttttcttgctggtattgttcttgtcatcttcttgaggactgttaggcgggatctgactcgttatgaggagcttgacaaagaggctcaggcacagatgaatgaggagttatctgggtggaaacttgtcgttggagatgttttccgcgccccagcaaatccctctcttttgtgtgtcatggttggagatggagttcagattcttgggatggcaattgtgacaataatgtttgctgcacttggattcatgtcaccagcttcccgtggcactcttattacaggtatgcttattttctacatgattctgggtattgcagccggctatgttgcagttcgcctttggaggactatcggatgtggtgatcacaaaggatgggtttcagtatcctggaaagctgcttgcttctttcctggtattgcctttttgattctaaccattttgaatttcctgctctggggtagtcaaagcacaggtgccattccattctctttgtttgtcatcctgattttactctggttctgcatatctgttccccttaccctaatcgggggatattttggtgcaaaggcacctcatattgaataccctgttcgaaccaaccagattccaagggaaattccagcccaaaagtacccatcttggcttcttgttcttggtgctggtactcttcccttcggtacacttttcattgagctcttctttatcatgtctagtatctggatgggccgtgtttactatgtttttgggtttctcttgattgtttttatccttctcgtggtggtttgtgccgaagtctctctggttttaacttacatgcatctatgtgtggaggactggaaatggtggtggaagtccttctttgcttctggttcagtggccatttacattttcttgtactccatcaactatctcgtatttgacctcaagagtctaagtggacctgtctctgcaacactctacctgggctattcccttctgatggttctagcaattatgtttgcaacgggaacagttgggttcctttcatcattctggtttgtgcactacttgttctcatcagtgaagctggactgaagcaatttcttctaaatagaatctggcaatttggaaaagcagccagcattgtcaccaaggagccaaaatgaattcaaacactttacaatagtctaccatgttttacttttttatttttttttgagtttacttttctagggagcttactgcaatgtaataagaataatctcaaccagattttgcattattcttttattagatgaagagaagttggtttgctagtatgatagtgagaatttataatttttcattatagcataattgatggcatttctagtattttacttgtttaattgagttttgtatggcttgaagctcaagagaagtttatgccctgcatttttatccattgattatgttattgataatatggaaatgagcattgttccaatgtgctttagcagtagactgcttgcaggggtggctttaacatatatcatccatgatctggtgtagcacaattttggttaaattatgcaaatgcag

SEQ ID NO: 5097 - DNA, 2818 bp, Eucalyptus grandis
cgtctcgcatcttctggacttcctccttccccagcaataaataaaggccatagatttcacctttcgggcgttgtggttgccgcctagtctcccctgctctctctatgcgcgttcctctccaaaagatctgacgcggatcgagagatatcgtcgtggaaatggacttctttgatcggttcaagatctgggttttggccgtctcccttgtcttgaactgtggatgtggatattacctccctgggagttacccgcataagtattctgtcggtgatactctgtcggtgaaggtgaattcgctcacttccatcgacactgagatcccctacagctactacagcttgcccttttgccagcctctggagggtgtgaaggatagcgccgagaacctcggcgagctcctcatgggggatcgcatcgagaactcgccgtatcagtttaagatgtacaccaacgagtctgagatcttctcgtgccgcaccgatccactcacagcggatagtttcaagctcttgaaggagaggatcgatgaaatttatcaggtcaacctgatccttgataatttgcctgctataaggtacacgaagaaggaagagtttttcctccggtggactgggtaccccgtgggaatcaaggttcaggacacctattatgtgtttaaccatttgaagttcactgttctggttcataagtatgaggagaccaatgttgctcgtgttatggggacaggggatgctgccgagatgattccaactattggaaatgatggttcagatgtgcagggctatatggttgtgggttttgaggttgtgccttgtagtgtcatgcataatgctgattcagtgaagaacttgaagatgtacgagaagtatccttcttcgattaaatgtgatccgaccactgtgtcaatggccattaaggaagggcagcccatcgtgttcacttatgaggtcgccttcgaggagagtgatatcaagtggccatctcgttgggatgcttatttgaagatggaaggatccaaagtccactggttctctatcctcaattctcttatggtgatcaccttccttgctggtatcgtcctcgtgatctttttgaggactgtccgtcgtgacttgacgcgatacgaggagcttgacaaggaggcacaggctcagatgaatgaggaattatctgggtggaagcttgtggttggggatgtgttccgcactccgtcaaaccccgcacttttatgcataatggtcggagacggtgtccagattcttggaatggcagtggtgaccatattatttgctgcactcgggttcatgtcccctgcttcacgtgggacacttatcacaggtatgctgttcttctacatgattcttggtgtagttgctggttatgttgctgtccgactttggaggaccatcggctctggtgatcacaagggatgggtgtcggttgcatggaaagccgcgtgcttcttccccggtatagcctttttgatcctgaccgttctgaattttctcttgtggggtagtcacagcactggagctatcccgttttctcttttcgttatcctgctgttgctctggttctgcatatcagttccacttactctttttggtggatatctcggagcgaaagctccccagatcgaatatcctgtgaggactaaccaaattcctagggaaatcccacctcagaaatacccatcttggttgttagtccttggtgctggcactctcccgtttggcacccttttcatcgagctattcttcatcatgtctagtttgtggatgggccgtgtctactatgttttcggtttcctcttcgtcgttttgatccttctagtcgtggtttgtgctgaagtatctctagttttgacgtatatgcacctttgtgtggaggactggaaatggtggtggaaatccttctttgcctctggttctgttgcgatatacatcttcttgtactccgtaaactaccttgtgtttgaccttaagagcttgagcggaccagtctccgccactctttacctgggctattccctattcatggtcaccgcaatcatgctcacgaccggcacagttgggttcctctcctcattctggtttgtgcattacctgttctcttctgtgaagctcgactaaactgatagaacagttttgagaggcagtggcggcggacgggtatgtggctagagagaaggaagaccccacaaactgttctatcttgtattacttgctttccttgagtttttacttttgctagggatacagtcaatgtaatctgaataattcatttggtctttctaatacaattttttttcttgctgagatcagttcatgacactgttagtgcatttggttcatttgtcgaaatgtttcggtaatgacggttggttctaggtagatgatgcatcttaatacagattcttctttgatacagtgagtgggtggaatgctgtgtattcttttggtaatgacttgtgatctaagactccttgcttatggtattgtgatcctaagatttctggcaccctgcttttcttatgtttatgggtcttgcccttctgggtttggactaatcttggtgggcttatagctgattagtcaatgttcattgccgtcgaaatgaaatatggtgtgccaagactcgtgaccagagactgcttcttgtagtttggtcaggaccaaagaggcctgagaatttaggttccaaacaacaggctttggaagcacagcatttgaccaagaaccacttactagcatcatagttctcttcgactgtatatcacagcaataaacaaaaaaaaaaaaaaaggaaaagaaaagaa

SEQ ID NO: 5098 - DNA, 2444 bp, Euonymus alatus
aatcgttctctgtaacaatctgaaagtctctctctcaccgactcaccgtttctggtggtgcacaggctctttcacccggagaggagatctcggtttctctctatgcaactaaagatctgacacatattcgtcgagaaagtcttcagaaatggatcctttaggtcgtttcaagatctgggtcttgactgtattccttattgtccaatctggatttgggttttacctgcccggtagttaccctcacaagcacgttgtcggtgacactctgtcagtgaaagtgaattccatcacttctattgatacagaaatgccttttagttactatagtttgcccttctgcgaacccgaagggggggtcaaggacagtgccgagaatcttggcgagctccttatgggagacaggattgaaaactccccctatcggttcaagatgtacactaatgagtctgaggtcctcctgtgtcggaccgatccgttatcaactgataactttaagatcttgaagaagaggattgatgagatgtatcaggttaatttgatccttgataacttgccagcaataaggtacaccgggaaagatggttactctttgaggtggactggttatccggttgggatcaaggttcagggtttgtattatgtgtttaaccatttgaagtttacagttcttgtccataaatatgaggagaccaatgtggcacgcgtaatgggaactggagatggagctgagatgatccccactgtcggagatggtgactctggtaagccagggtatatggtggttggttttaaggttattccttgtagtttcaagcataatacggattcagtgaagaaatcgaaaatgtatgagaagtatccttcgaagatacaatgtgatcctactactgtggcaatgcctatcaaggaaaatgagcccattgtctttacctatgaagttacatttaaagagagtgacatcaagtggccatcacggtgggatgcctatttgaagatggagggttcaaaagtccattggttctcaattctgaactctctgatggtcataactttccttgctggtatagtccttgtgatcttcttgaggacggttaggcgggatctgactcgatatgaggagctggacaaggaagctcaagcacagatgaatgaggaattatccggatggaagcttgttgtcggggatgttttccgtgctccatccagtcctgctcttttgtgtgttatggttggagatggtgttcagattcttgggatggcaattgtgactatattgttcgcagctcttggattcatgtcacctgcttcccgtggaacacttattacaggtatgctgtttttctacatggttcttggtcttgcagctggctatgttgctgttcgtctttggaggactattggatttggggatcacaaaggatgggtttcagttgcatggaaggcagcttgcttctttcctggtattgcctttttgatcttaacagttctgaacttcctactgtggggtagtcagagcacaggtgccattccattttccttgtttgttatattacttttgctctggttctgtatctcggttccccttactcttgttggtggttattttggggcaaaggctcctcatattgaatttcctgttcggacaaaccagatccctcgtgaaattccagctcagaagtatccatcttggttgctagttctcggtgctggcactcttccttttggtaccctttttattgagctcttctttatcatgtctagtctctggatgggccgtgtttactatgttttcgggttcctctttatcgttatgattcttctcgtggttgtttgtgctgaagtatcattggttttaacctacatgcacctctgtgttgaggactggaaatggtggtggaagtccttctttgcttctggttctgttgccatctacattttcttgtactccgtaaattacctgatatttgaccttaagagtttgagcggtcccgtttctgccacgctctacttgggatattctctcttaatggttctagcaatcatggtctcaactggcacggttggcttcctttcatcattctggtttgtgcattacttgttctcttcagtgaagctggattgaagagctttcggatcatcgatgatggattggcattttgaagagaaatggttatcactttttgaggagaaacaaacacagtgccttacacaagtctatttgtcattttgtttgccttgaataatttgctagggaacttggtaaatgtaatatcaataacttcgtccagttttgctttattctttattagacgaaaatcatgtttgtacttggttatcatatccttatggattaaactaaatggagcacaatttctttaatagttctcaagttgaattgtgtttctcatgcctatccttatttttatgtgagaaggatgttcatc

SEQ ID NO: 5099 - DNA, 2432 bp, Catharanthus roseus
atctcatcgcctcaaggttcttcttctcggattttatgtttaaagatcttgaatttttctccaagctcgaattgaaactaaattgatcttggcatattaatcacctttactgatctggttcaaccagatctgttcaaggaaatgataaagatggattcttttgcaaattcaagatctgggtttgtcatatgcatgttatctggagtgggttttggtttacctctggtagttaccctcacaaatacggcattggtgacttcttgaatgtgaaggttaattcactgacttcaattgatactgagttaccctttagctattatagtttgcctttctgtccgccaaaagagggaattaaggatagtgctgaaaatcttggtgagcttcttatgggtgataggatagagaattctccctataggtttaagatgtacaccaatgaatcagatgttttcctgtgtcaaacaaagcccttatctggagaggagtttaagctcttcaaaaagaggattgatgagatatatcaggttaacttgatcctggataatttgccggctatccgttataccaggaaggagggctatttcttgaggtggacagggtatcccattgggattaaggttaaggatgtgtactatgtgtttaatcatttgaaatttacagttcttatccataagtatgaagagactaatgtggctcgtgtgatgggaactggagatgctgctgaggtaattccaacagttggaaatgatggatcagaggcacctggttacatggttgttgggtttgaggtggttccttgtagcgttcagcataatgctgattcagttaagaacttgaaaatttagagaagtacccaacttctatcaagtgtgatccatccatggtggctatgtctattaaagaaaacgagcctatttctttctcatatgaggtgtcctttgtggagagtgatattaagtggccatctaggtgggatgcttatctgaagatggagggagcaaaagtgcattggttctcgatcctcaattctcttatggtgattactttcctggctggaatagtgtttgtgatcttcttgagaactgttaaacgggatctgactcgttatgaggagctcgacaaagaagctcaagcccagatgaatgaggagttatctggatggaagcttgtagttggtgacgttttccgggcccctagccatccagcacttttgtgtgtgatggttggagatggaatccagattctggggatggcaattgtgacaattttgtttgcagcccttggatttatgtctcctgcttctcgtggaactttggtcactggtatgctgttcttctacatgattctaggaattgcagctggttatgtggctgttcgaatgtggaggacgatattctgtggtgatcacaaaggatgggtttcagtctcatggaaagtttcttgtttctttcctggtattgctttccttattttaaccactttgaatttccttgtatggggtagccacagtacaggagccattccattttctctatttgtcattctcatcttgctgtggttctgtatctctgttccccttacccttgttggtggttactttggagcaaaagcacctcatattgaataccctgtccgaactaaccagatcccacgtgaaataccacctcaaaagtatccatcttggctgttagttcttggtgctggcactctcccattcggtacacttttcattgagcttttcttcatcatgtccagcctctggatgggtcgggtatactatgtgtttggattccttctcattgttttgatcctcttagtagttgtctgtgccgaagtctcccttgttcttacttacatgcatctttgtgttgaggactggaaatggtggtggaaatcattctttgcttctggttctgttgccatatacatctttttatactcgatcaactacttaatattcgatctcaagagtttgagtggacctgtctcagctaccctttacctcggttattcactcttcatggttatagcaatcatgcttgctactggcgcggttggattcctttcttcattctggtttgtgcattacttgttctcttcagtgaagttggattaaacaaactctttgtcatgcaaagaatgactttggaagagcagcaatgattgatcggcccttaggagttaaagatgtttcttgttacttgtactgttttaaaattttactactttgttttctagagaattccaaatacaagaacaatcacctcttcaagttttattacatttttttcgcatgctagcaaatcgaactcttcttactcagtactaggtggatgtcatgatgtaagcttgcagattatgtttatttggtattcatattcattattaattagtttaactaaagaaaaaaaaaaaaactagaaggcgtggtc

SEQ ID NO: 5100 - DNA, 2613 bp, Fagus grandifolia
catccatataaatctcattgcgtgccttccaattccttcaccctttctctctctctccaatcccaaattcccagtgctccaagatctcgtctctcgcacagaaagagatccctctctcaattttcgtgtgcgttggaaggtcagttagatccgtacttcttctcaaacccttttcatttttgtattaaatttcgtagctttcgtattggaatctgaaattaaacccaaaacccacatcaaatttgctttctttcactcatttcccgatctgggtcgtccagatccgacgcaaaatcgtttcaaaaatggggttttttaatcaatttaggatctgggttttgaccatttgcttggtatttcaatccgggtatgggttttaccttccgggtagttacccccacaagtacgttgtcggtgaccttttatcagtgaaagtgaattctctcacttccattgataccgaaatgccctttagctattacagtttgcccttctgtaagcccgatgagggtgtcaaggatagtgccgagaatctcggtgagctcctcatgggggatcggattgagaactcgccgtatcagtttaagatgtatacaaatgaatccgatatcttcttgtgtaagtcggatccgttatcggcagacagtttcaagatcttgaccaagagaattgatgagatgtatcaggttaatttgattctcgataatttgccggctattcgttatacgaagaaggagggctatgttttgcggtggacgggttatccggttggagttaagcttcaggatgtgtactatatattcaatcatttgaagtttaatgtgcttattcataagtatgaggatgcgaatgtagctcgcgtaatggggaccggcgatgcagctgaggtgatcccatcggttgggaagggggattcagatgagcccggatacatggttgttgggtttgaggttgtgccttgtagtgtcgtgcatactgttgattcggtgaagaatgtgaagaagtatggcaagtacccaaatccattgaaatgtgatcccaatactgtgtcgatgccaatcaagcaagggcagccgattgtcttcacctatgaggttacattcgaggtgagtgacatcaagtggccatcacgatgggatgcttatttgaagatggagggatcgaaagtccattggttctcgattttgaattctctaatggtgatcactttccttgctggtatcgtgctggttatcttcttgaggactgttaggcgggatctgacccgttatgaggagcttgacaaggaggctcaagcacagatgaatgaggaattatccgggtggaagcttgttgtgggggatgttttccgtgcaccaaacaatcctgcccttttgtgcatcatggtaggcgatggggttcagattcttggaatggctgttgtgacgatattgtttgcagctcttggattcatgtctccggcttcacgtggaacacttattacaggtatgctgtttttctatatgatacttggtattgcagctggttatgttgctgttcgtctctggaggacaattggctgcggtgaccccaaaggatgggtttcagtctcatggaaggctgcttgtttcttccctggtattgcgtttttgattctcaccactttgaatttcctattgtgggggagtcacagcacaggagccattccattttctctgtttgttattctgcttctgctctggttctgcatatcagttccccttactttagttggtggataccttggggcgaaagcaccacatattgaataccctgttagaaccaaccagattcctcgtgaaatcccagctcagaaatacccatcttggctgcttgttcttggtgctggcaccctccctttcggtaccctcttcattgagctgttctttatcatgtctagcatttggatgggtcgtgtatactatgtctttggattcctctttatcgttttgatccttctcgtggtggtttgtgctgaagtgtctttggttttaacctacatgcatctctgtgtggaggactggaaatggtggtggaagtcattcttcgcatctggttctgtcgccatatacatcttcttgtactccgtaaactatcttgtatttgatctaaagagtttgagtggacctgtctccgccactctttacttgggatattcgctcttcatggttgtagcaatcatgctggcaaccggcacagttgggttcctttcatcattctggttcgtgcattacttgttctcttcggtgaagctggattgaagaactcattccactcaaaagattggcactttgaagagctttggtggtgcggtggtcatttaagggacaaagaatgtaactctcaaaagatgttctatcatgtttacttttctacagtttattttgttagggaacctagaaaatgtaataacaataattcgtccagttttgcttaattcttttctagatggagatcatggcatgatagttcactaccaaattttatttgcattctggcggatacaaggcatatctagttgatggtagttggcatgggatcttagtgtgtaactttttgactgttcagatctgtttggtttgaaatactaaaggc

SEQ ID NO: 5101 - DNA, 2446 bp, Amorphophallus konjac
agatcccagatccaccgggcgatcacctccccaccccctctctctcttctcagatctggggctgggctcccgccagatctgagcgtccggcggcggaggagagacgacgatggggtcctcccatggcactgggatctggttcttgctccccctgctgctgctgctgctgctgggcgacgccggcgtccatgtccatggcttctacctccccggcagctacccccacaagtacgaggtcggcgacgccctctccgtcaaggtgaactccctcacctccatcgacaccgagatgcccttcagctactacagcctccccttctgccaccctccggagggcgtccgcgacagcgccgagaacctcggcgagctgctcatgggcgatcgcatcgagacctctccctaccgcttccgcatgtacaccaacgaatccgacatcctcctctgccgcaccggccccctctccgccgccgacctcgccctcctccgggagcgcatcgaccagatgtaccaggtcaacctgatcctcgacaacctccccgccatccgctacacccgcaaggacgacttcgttctccggtggacgggctaccccgtcggcatccgcatccaggacgtctactacctcttcaaccacctcaagttccgggtgctggtccacaagtacgaggagaccaacgtcgcccgcgtcatgggcaccggcgacgccgccgaggtcatccccgccgtcgccggctccgccgacggccccccgggctacatggtcgtcggcttcgaggtcgtcccctgcagcttccagcacgactccgaggcggccaagaacctgaagatgtatgataagtacccgtcgaagatccagtgcgagcccaccaccgtggccatggccgtcaaggagaaccagcccctggtgttctcctacgaggtggagttcgtggagagcgacatcaagtggccatcccggtgggacgcctacctgaagatggagggcgcccgggtgcactggttctccatcctcaactccctcatggtgatcgccttcctcgccgggatcgtacttgtcatcctcctccgcacggtgcggcgggacctgacccggtacgaggagctggacaaggaggcacaggcccagatgaacgaggagctctccgggtggaagctggtggtgggggacgtcttcagggcccccggcaacccggtgctgctctgcgtcatggtcggcgacggcgtccagatcctggggatggccgtcgtcaccatcctgttcgctgcgctggggttcatgtccccggcctccaggggggcgctcgtcaccggtatgctcttcttctacctggtcctcggcatcgccgctggctattccagcgtcaggctgtggaagacgattagggtcggggaccattccggatggatgtccgtctcctggcgcgtggcctgcttcttccccggcatcgcgttcctcatcctcaccaccctaaattttctcctgtggggcagccacagcacgggcgccatccccttgtctctgttcgtcatcctcctcttgctctggttctgcatctccgtccccctcaccctcgtgggcgggtacctcggcgccaaggcgccccacatcgaataccctgtgcgcactaaccagatcccccgcgagatccccgcacagaggtacccctcgtggttgctggtcgtcggcgccggcaccctgcccttcggcaccctcttcatcgagctcttcttcatcatgtccagcctgtggatgggccgcgtctactacgtctttgggtttctgttcatcgtcatggtcctcctcgtcgtcgtttgcgccgaggtctccctcgtcctgacctacatgcacctgtgcgtggaggactggaagtggtggtggaaatccttcttctcatccgggtccgtcgccctgtacatcttcctctactccgtcaactacctcgtcttcgatctcaagagcctcagcgggcccgtctccgccacattgtacctgggctactccctgttcatggtcctggccatcatgctcgccaccggcacagttgggtttctctcctctttctggttcgtgcactacctcttctcttcggtgaagctggactgaggtggtcgaggcccccacccccccaatcccacaaccttaatcggtctttgcgctttggaggaaatccggtttgaaggtgcagacataagccgcttttgctctgctcgccatagaattcctatacgacgaagtagcgaagaagtaatgtctcatttgtttttgcccttttcccccccttccacattctttgtaagacatagctgcatgaccttttgctaccttgcattatagaaacccgataagatgtaacagctagtgtcgagtgttcgtttttttttttctttcatttttctctacaatttcggcgacaattaagacatgtatcagtgataagttcaaaag

SEQ ID NO: 5102 - DNA, 2220 bp, Manihot esculenta
attggatctttcttatacactcgtttcgtgatctgggtctcccagatctggcactattcaccagagaattccaaaaatggactatttttctcatcttaagatctggatcttggcccttagcatgatattccaatccgtatatggattttaccttcctggtagctacccccacaaatacaatgtcggtgaatctttatccgtgaaagtgaattccatcacttctattgataccgagatgccatttagctattacagtctgcccttttgccagcctgcagagggtatcaaggatagtgctgaaaatctcggtgagctccttatgggagataggattgagaattccccatataggtttaagatgcatgtgaatgagagtgagatctttttgtgtcgaaccgaccccttgtctgctgataactttaagcttttgaaggagaggattgatgagatgtatcaggttaatttgattcttgataatttgccggcaataaggtatactaagaaggatgcatacttgttgaggtggacaggataccctattggaattaaggttcaggatgcatattatgtgtttaaccatttgaagtttacagttcttgttcataagtatgaagaggccaatatggcacgtgtgatggggactggagatggtgctgaggttattccgacaattgggaacggaggatctgatattccagggtacatggttgtgggatttgaagtggtaccttgcaacttcatgcataatgttcagtccgtgaagaactcgaaaatgtatgacaaatacccatctccaatcaagtgcgatcccaccactgtgtcaatgccaattaaggaaaatgagccaattgtttttacctatgaggtcacatttgaagagagtgatatcaagtggccatcaagatgggatgcttatttgaagatggaagggtcaaaggtccattggttctcaatcatgaattctctgatggttatcaccttccttgctggtattgtccttgtcattttcttgaggactgtgagacgggatctgactcgttatgaggagcttgacaaggaggctcaagcacagatgaatgaggagttatctgggtggaaacttgttgtgggggatgttttccgtgccccaaccaatgcatcacttctttgtgttatggttggagatggagttcaaatccttgggatggcagttgtgacaatcttgtttgctgctcttggattcatgtcaccagcttcccgtggaactcttattacaggtatgcttttattctacatgattctgggtattgcagccggctatgtagcagttcgtctttggaggaccataggatgtggcgatcacaaaggatggatgtcagtttcctggaggtctgcttgctttttccctggtattgccttttttatcctaacgatgctgaatttcctactgtggggtagtcatagcacaggtgccattccaatctctttgtttatcattctgattctgctctggttctgcatttctgttccccttacccttattggaggatactttggggcaaaggcaccccatattgaatacccagttcgaaccaaccagattcctagggaaataccagctcaaaagtacccatcttggcttctagttcttggtgctggaactcttccctttggtacacttttcattgagctattctttatcatgtctagcatatggatgggccgagtttattatgtttttgggtttctcttgattgttttcatccttctggttgtggtttgcgccgaagtatccctcgttttaacatacatgcatctctgtgttgaggactggaaatggtggtggaagtccttctttgcttccggttcagtagccatctacattttcttgtactccattaactatctggtatttgatctcaagagtttaagcggaccagtctctgcaacgctttacctggggtattctcttttaatggttctagcgatcatgtttgcgacaggaacagttgggttcctttcatcattctggtttgtgcactacttgttctcttcagtgaagctggattgaactatgaagaagttttatcttaccaaaaactttggcacttctagagagcaacattgttcactgggggcagaaatgcttgcaaccccttacaatagtctttttatcttgttcgtcttttgagtttactttcctagggagattatcaaaatgtaataacaataatttcaacc

SEQ ID NO: 5103 - DNA, 2387 bp, Plantago ovata
cggccggggggaattttccacatctacgcgttctcttcactttcagctgtactgagttcccaaccagcaacagatttcgatttgctgttttttgacggagaaactctttcggttggttctcggcgttgatttcacgatctggtgtgtccagatctggaatgagtagggtgaaaatggatcacaggtgcatgatctggatcgtggtggtttcgttggcggcggtgtttggtgtagggaatggattttacctgccaggtagttatcctcacaagtacggagttggtgagtttttgaatgtgaaggttaattctctcacttcgattgatactgaaatgccgtttagctattatagtttgccgttttgtcagccgaaagagggtgttaaggatagtgcggagaatctaggtgagcttttgatgggtgataggattgagaattctccctataggtttaagatgtataccaatgagtctgaggtttttctgtgtcaaactaagcctttgaatgctggggagtttaagcttttgaaggagaggattgatgagatgtatcaggtgaatgtgattctcgataacttgcctgcgattcggtatacgaataaggaagggtttgtgatgaggtggacgggttaccctgtcggtgctaaggttgctgatggttattacatatttaatcacctgaagtttactgttcttgttcataagtatgaggagaccaatgtggcccgtgttatgggtactggtgatgcggcagaggtgatcccgacaattgggaactctggatctgatgcgcctggatatatggttgttgggtttgaggttgtggcttgtagttaccagcacaatactgatgccataaagaacttgaaaatgtacgagaagtacccgtcacccattaagtgtgatccagggactgttgccatggctgtcaaagagaacgaaccgatagccttctcgtacgaggttgtgtttgaggagagggatattaagtggccatcaaggtgggatgcatacttgaaaatggagggagcaaaggtgcattggttctcgatcctgaactcgcttatggtgataactttcttggctggaattgtgcttgtaatcttcttgaggaccgttaggagggatcttacaagatatgaggagattgataaggaagctcaagcccagatgaatgaggagctatcaggatggaaacttgtggttggtgatgttttccgtgcaccttctaatccagcactcttgtgcgtgatggttggagatggtgttcagattcttggtatggcagttgtgactattttgtttgctgctcttggattcatgtcccctgcatcccgaggcacattgattactggtatgctctttttctacatgatcctcggaattgctgctggttatgtggctgtacgtatgtggaggactatatttgtaggagacaacaagggatggatatcagtttcatggaaagttgcttgtttcttccctggtattagtttcttgatcctcacaactttgaatttcttgttatggggtagtcatagcacaggagctattccattctcactgtttgttgtactcatcttgctatggttctgcatctctgtaccacttacccttgttggtggctactttggtgcaaaagcaccccacattgaatatcctgtccgcacaaaccaaattccaagagaaatcccacctcaaaaatacccatcatggcttttggttcttggagctggtacccttccttttggtacacttttcattgagcttttcttcatcatgtctagtatctggatgggccgtgtgtactatgttttcggtttccttttcgttgtattgatcctgttggtggttgtgtgtgctgaggtatcacttgttcttacatacatgcatctatgtgtggaggactggaaatggtggtggaaatctttctttgcttctggctcagttgccatatacatcttcctctactccatcaattacctgatatttgacttgaagagtctgagtgggcctgtctctgccacactatacctcggttactcactcttcatggtcttggcaatcatgttggcaactggcactgtgggattcctttcttcattctggtttgtgcactacctgttctcttcagtgaagctggactgagtcgaggtgagttggtcactgtgctgtggtcagttctactgcaatggagatatggctagtaagaaagaaatgaaagcgacgttttgaaatatgttgtgattttcttatttttgatattgtctattatctttactctagggaatttggacttttatatcctttaagaagctgtactgagttcttttttatagatagaaatattccatgttagccaaagtgaaaaatttgcagggattctat

SEQ ID NO: 5104 - DNA, 2320 bp, Vinca minor
tctcgagaattgaaactccattgatcttcgcatattaatcaacttttctgatctgggttcaaccagatctgttcaagaaaatggtaaagatggaatcttttcgcaaatttaagatctgtgttctgtttatttgcatgttatttgaagtgggttttgggttttatcttccgggtagttaccctaaaaaatatgggattggtgatcccttgaatgtgaaggtgaattctttgacttcaattgatactgaactaccctttagctattatagtttgcctttttgtcagccagatgagggtattaaggacagtgctgaaaatcttggtgagttacttatgggtgataggattgagaattccccttataggtttaagatgtacacaaatgaatctgatattttcttgtgtcaaactaagcccttatctggtgaggagtttaagttgttcaagaagaggattgatgagatatatcaggttaatttgatccttgataatttgccggcgattcgttatacgaggaaggaaggttatttcttgaggtggacagggtatcctattgggattaaggttcaggatttgtactacgtgtttaatcacttgaaatttactgttcttatccataagtatgaagagacaaatgtggctcgcgtgatgggaactggggatgctgctgaggtaataccaactgttccaaatggtggatcagaggcacctggttacatggttgttggatttgaggtggttccttgtagcgtccagcataatgctgattcagttaagaagataaaaatgtatgagaagtacccatctccgatcaagtgtgatccatccatggtggccatggcaattaaagaaaacgagcctgtttctttctcatatgaggtctcctttgtggagagcgatattaagtggccatctagatgggacgcttatctgaagatggagggagcgaaagtgcattggttctcgatcctcaattctctgatggtgattactttcctggctggaatagtgtttgtgatcttcttgaggactgttaaacgagatctgactcggtatgaggagctcgataaagaagctcaggctcagatgaatgaggagttatctgggtggaagcttgtagttgctgatgtttttcgggctcccagcaatccagcacttttgtgtgtgatggtcggggatggaatccagattcttgggatggcagttgtgacaattttgttcgcagctcttggatttatgtctcctgcttctcgtggaacgttgatcactggtatgctgttcttctacatgattctaggaattgcagctggttatgtggctgttcgaatgtggaggacaatattcgttggtgatcacaagggatgggtttcggtctcatggaaggttgcttgtttcttccctggtattgctttccttattttaaccacattgaatttccttttatggggtagccacagtacaggagccattccattttctctatttgtcattcttatcttgctatggttctgtatttccgttcccctgacccttgttggtggttactttggagcaaaagcacctcatattgagtatcccgttcgaactaaccagatcccccgtgaaatcccacctcaaaagtatccatcctggctgttagttcttggagccggcactctcccattcggtacacttttcattgagctcttcttcatcatgtccagtctctggatgggacgtgtgtactatgtgttcggattccttctcatcgtcttgatccttttagtagttgtctgtgctgaagtatcccttgtcctgacctacatgcatctttgtgtggaggattggaaatggtggtggaagtcattctttgcttctggttcagttgccatttacatcttcttgtactcggtcaactatttaatatttgacctcaagagtttgagtggaccggtctctgctactctttacctgggttattcactcttcatggttatagcaatcatgctcgctactggcgctgttgggttcctttcttcattctggtttgtgcattacttgttctcttcagtgaagttggattaaacagatctttttggctcaaaggttcactttggagaagcatcaatgatcgatcggccataggagtaaagatggttcttcttacttttactgtcttcaattttatttcatagtaaaatttcaaatacaagaacagtcctaggtgttgtgattgtcttgtaaactttcagattgtgttatttgttattagtttcatattaatagttgagcctgttgatgccaagtattagtatgttaatgtgctctttgaaatatttttc

SEQ ID NO: 5105 - DNA, 2247 bp, Euphorbia peplus
tttggcacttccgagagaaggtagcgattatgctatggtagatatcatcctcaatccctgaaaatcaacacaagttactcagatctgaattcaaatttcgaaaatggagtctatggctcaatctaagatatgggtattgtttgtttgcctgatatttcaactgggtcatggattttatcttcccggaagctaccctcataaatataatgtgggtgaaagtttatcagtgaaggtgaattcaatcacctccattgatactgagatgccatttagttattacagtttgcctttttgtaaaccgaaggagggtgttaaggatagtgctgaaaatctaggggagcttcttatgggtgataggattgagaattcgccgtataagttcaagatgcatgtcaatgaaagtgagatatttttgtgcaaaagtgatcctttatctgctgatagttataagcttttgaagaagcggattgatgagatgtatcaagttaatttgattcttgataatttgcctgccatacggtatactaagaaggatagttatttgttgagatggactggctatccggttggtattaaggttcaagatgcgtattacgtgttcaatcatttgaagttaactgttcttgttcataagtatgaggaggccaatgtagcccgtgtgatgggaactggagacggtgcagaggtgattccttcgatggggaatggtggatcggatattcctgggtatatggttgtcgggtttgaagttgttccttgtaactttatgcataatgttcagtcggtgaaggacactaaaatgtatgagaaatacccgtctcagattaagtgtgatccaacaactgtggctatgccgattaaggagaatgagccgattgtttttacgtatgaggttacattcgaggaaagtgagattaagtggccgtcgcgatgggatgcttatttgaagatggagggatcaaaggtccattggttctcaattatgaattctctcatggttatcactttcctcgctggtattgtacttgtaatcttcttgaggactgtacggcgagatttgactcgttacgaggagctagacaaggaggctcaagcgcagatgaatgaggagttatctgggtggaaacttgtcgtgggagatgttttccgcgctcctacaaatgcatcacttttgtgtgttatggttggggatggagttcagattctcgggatggcaattgtgacaatattttttgctgcactcgggtttatgtctccggcttctcgtggtactcttattacaggtatgctcattttctacatgatccttggtgttgcagccggctatgttgcagttcgcctttggaggactatcggatgtggagatcacaaaggatgggtctctgtttcgtggagagcagcttgcttctttcctggtattgcgtttttcatcttaacccttttgaatttcctactatggagtagtcacagcaccggtgccattccgatatctttgtttatcgttctaattttattgtggttctgcatctctgtcccacttaccctaattggaggatactttggggccaaggcacctcatatcgagtatcccgttagaaccaatcaaattcctagggaaattccagcccaaaagtacccgtcttggcttctagttttaggagccggaactcttcccttcggtacacttttcattgagctcttctttatcatgtctagcatctggatgggtcgtgtgtactacgttttcgggtttctcttgattgtgtttattctccttgtggtggtttgcgccgaagtttctctcgttcttacctacatgcatctctgcgtggaggattggaaatggtggtggaagtcattctttgcttccggttcagtagccatttacattttcttgtattccattaactatctcatatttgatctcaaaagtttaagtggtccggtatctgcaactctttatcttggatattcgctcttaatggttcttgcaattatgttcgcaaccggaactgttggcttcatatcttccttctggtttgttcactacttgttctcttccgtgaagctggattgaaaagggattctagttttttcttccatactcaggttatagtttatcttgttttctttttctttttgcttcttttgagtttaattagggagattaattaatgtaataactataacttccaattaacgttttgcttaattctttattagatgagagattttggctttgatagc

SEQ ID NO: 5106 - DNA, 2307 bp, Tropaeolum majus
cggccggggggctctcaccatttcagagatccccaaagctcctggtgttggattctctcgcctaccctacgactctctacacctttttcatttgttgatttcttctcttaaagatctgttacaatttggataaaaaaaggacttagggagtggtttcaggatcgggagtctgatcatatgcttgctattccaatttgggtatgggttttaccttccgggtagttatccacacaaatacggtgtaggtgactatttgtcagtgaaagtgaactcgctcacttctattgatactgagatgccctttagctattacagtttgcctttttgtactccccctgaaggtataaaggatagtgctgagaatctgggtgaacttcttatgggggataggatcgagaattctccttataggtttaagatgtacaagaatgagagtgagatctttctttgtcgaactcctgctttatcagcagataactttaagctcctgaagaagaggatagatgagatgtatcaggttaatttgatcctcgataatttgcctgcaattcgttataccgtgaaagaaagttataatttgagatggacaggttatcctgttggaattaaggtgcaagatgtgtattatctgtttaaccacctgaaattcaaggtccttgttcacaagtatgaggagaccaatgtggcaagtgtgatgggaacaggggacgctgctgaggtgattcccgctgttccaaagggggaacctgaggtgcctggatacatggttgtagggtttgaagtgattccttgcagtttcatgcataattctgaaacagttaaaaagttgaaaatgtacggaaagtacacatctccaataagatgtgatcccacaaccgtgtccatgcctatcaaggaagggcagccaatggtttttacctatgaggttttatttgaggagagtgatatcaaatggccatcccggtgggatgcatatctaaagatggagggatcaaaggttcattggttctcgatattgaactctctaatggtgatcacattccttgctggtattgtccttgttattttcttgaggacaatcaggagggatctgacccgttatgaggagcttgacaaggaggctcaagcacaaatgaacgaggagttatctggctggaagcttgttgttggggatgctttccgtgctccatctaatccttcacttttgtgtgttatggttggaaatggtatacaaattcttgggatggcagttgtgacaatcttatttgctgctctaggattcatgtctcccgcctcccgaggaacacttatcacaggtatgctgtttttcttcatgatacttggtattgctgccggttatgttgcagttcgtatttggaagacaattcacttaggtgaccacaagggttgggtttcagtatcatggaaggttgcctgcttcttccctggtattgccttttccattctaacaactttaaactttctactatggggtagtcatagcactggagccataccaatttctctgtttgttattcttcttctgctctggttttgtatatcagtaccccttacactcattgggggataccttggggcaaaggcacctcatattgagtaccctgttcgaacaaatcagattccaagagaaataccagcccagaaatacccatcatggcttttagttctgggtgctggaactcttccttttggtacactgttcattgagcttttctttatcatgtctagtatttggatggggagggtgtactacgtctttggatttctgttggtggtgatgattctgcttgtggtggtatgtgctgaagtatcacttgtgttaacatacatgcatctatgtgtggaagactggaaatggtggtggaagtccttctttgcttctggttcagtagccatctacattttcctctactccataaattatctagtgtttgatcttaaaagtttaagtggaccggtttcggctacactctacttgggttattcactgttgatggtttttgcaatcatgctagcaacaggaacagttgggttcctttcttcattctggtttgtgcattacttgttttcttcagtgaaattggattgaaggaaggtcaaatttagtttgtatttggatttgggtttacatttacatattgtagggaacttggtagtgcatgtaacagcaataattttcttcatcggcctttgcttaattcattagtagattgagagtattgcatgatatttgccttttatagtgaaacacttgtgcctctgtgatctttttaatctatacttcaa

SEQ ID NO: 5107 - DNA, 2442 bp, Vinca minor
cttatgcttcaaggtctgtaaaatttgcatttaagtcgtataaatctcggatcttgagggattgaaactgcattgatcttggcatattaatcacttttcttgatctgggttgaacaagatctgttcaagaaaatggtaaagatggaatcttttcgcaaatttaagctcgtgggttctgtttatatgcatgttacttgaagtgggtttcgggttttatcttccgggtagctaccctaaaaaatatgggattggtgatcccttgaatgtgaaggtgaattcactgacttcaattgatactgaactgccctttagctattatagtttgcctttctgtcagccaagtgagggcattaaggacagtgctgaaaatctaggtgagctacttatgggtgataggattgagaattccccctataggtttaagatgtacacaaatgaatctgagattttcctgtgtcaaacaaagcccttatctggcgacgagtttaatctcttcaagaaaaggattgatgagatatatcaggttaatttgatccttgataatttgccagctatccgttatatgagaaaggagggttatttcctgcggtggacagggtatcctattgggattaaggttcaggatgtgtactatgtgtttaatcatttgaagtttacagttcttatccataagtatgaagagaccaatgtggctcgcgtgatgggaaccggggacgctgctgaggtaattccaacagttggaaatgctgaatcagaggaacctggttacatggttgttggatttgaggtggttccttgtagtgtccagcttactgctgattcagttaagaacaaaaaatgtatgagaagtacccatctccgatcaagtgtgatccgtccatggtggccatgtcaattaaagaaaatgagcctgtttctttctcatatgaggtctcctttgtggagagtgatattaagtggccatctagatgggatgcttatcttaagatggagggagcgaaagtgcattggttttcgatcctgaattctcttatggtgattactttcctggctggaatagtgttcgtgatcttcttgaggactgtcaaacgggatctgactcggtatgaggagctcgacaaagaagctcaagcccagatgaatgaagagttatctgggtggaagctcgtagttgctgatgttttccgggctcccagcaatcccgcacttttgtgtgtgatggttggggatggaatgcagattcttgggatggcaattgtgacaattctgtttgcagctcttggatttatgtctcctgcttctcgtggaacattgatcaccggtatgctgttcttctatatgattctaggaattgcagctggttatgtggctgttcgaatgtggaggacaatatttgtcggtgatcacaagggatgggtttcggtgtcgtggaaggttgcttgtttcttccctggtattggtttccttattttaaccacattgaatttccttttatggggtagccacagtacaggagccattccattttcactatttgtgattctaatcttgctatggttctgtatttctgttcccctgacccttgtcggtggttactttggagcaaaagcacctcatattgagtaccctgttcgaaccaaccagatcccccgtgaaatcccaccccaaaagtatccatcttggctgttagttcttggagctggcactctcccattcggtacacttttcattgagctcttcttcatcatgtccagcctctggatgggtcgtgtctactatgtcttcggattccttctcatcgtcttgatcctcttagtagttgtgtgtgccgaagtctctcttgtcctgacctacatgcatctttgtgtggaggattggaagtggtggtggaagtcattctttgcttctggttccgttgccatttacatctttttgtactctgtcaactatttaatatttgatctcaagagtttgagtggaccggtctctgctactctttacctgggctattcactcttcatggttatagcaatcatgcttgctactggcgccgttgggttcctttcttcattctggttcgtgcattacttgttctcttcggtgaagttggattaaacaactcttttttgccgcaaaggttcaatttggatgattgaccataggagtaaaggatggttattgttattttactttactgtctttcaattttattttctagaatatttcaaatacaagaacggttacctcttcaaatcgtgcttagccagtcctaggtgcttgtcatgtaagctttcatattccctattagtttcatagtaatagccgctgatgtcaattatcatgttattgccctcgtagaaataatttcgcgtcttcaatcttctattcttcacttcctctgttttcccatttttactctttgttatttttgctgttaaatcc
